United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 13

SEQ ID NO: 192481 - DNA, 20 bp, Artificial Sequence
  Description of Artificial Sequence: Synthetic oligonucleotide
  Target: ATXN1; (-) strand; PAM type: YTN; PAM sequence: CTG
taggagttatttacggatac

SEQ ID NO: 192482 - DNA, 20 bp, Artificial Sequence
  Description of Artificial Sequence: Synthetic oligonucleotide
  Target: ATXN1; (-) strand; PAM type: YTN; PAM sequence: TTC
tgtaggagttatttacggat

SEQ ID NO: 192483 - DNA, 20 bp, Artificial Sequence
  Description of Artificial Sequence: Synthetic oligonucleotide
  Target: ATXN1; (-) strand; PAM type: YTN; PAM sequence: CTT
ctgtaggagttatttacgga

SEQ ID NO: 192484 - DNA, 20 bp, Artificial Sequence
  Description of Artificial Sequence: Synthetic oligonucleotide
  Target: ATXN1; (-) strand; PAM type: YTN; PAM sequence: TTG
tgtcttctgtaggagttatt

SEQ ID NO: 192485 - DNA, 20 bp, Artificial Sequence
  Description of Artificial Sequence: Synthetic oligonucleotide
  Target: ATXN1; (-) strand; PAM type: YTN; PAM sequence: TTA
gagcaaattgtgtcttctgt

SEQ ID NO: 192486 - DNA, 20 bp, Artificial Sequence
  Description of Artificial Sequence: Synthetic oligonucleotide
  Target: ATXN1; (-) strand; PAM type: YTN; PAM sequence: CTC
caaaacattagagcaaattg

SEQ ID NO: 192487 - DNA, 20 bp, Artificial Sequence
  Description of Artificial Sequence: Synthetic oligonucleotide
  Target: ATXN1; (-) strand; PAM type: YTN; PAM sequence: TTC
catagctccaaaacattaga

SEQ ID NO: 192488 - DNA, 20 bp, Artificial Sequence
  Description of Artificial Sequence: Synthetic oligonucleotide
  Target: ATXN1; (-) strand; PAM type: YTN; PAM sequence: CTG
tgatcataataaattccata

SEQ ID NO: 192489 - DNA, 20 bp, Artificial Sequence
  Description of Artificial Sequence: Synthetic oligonucleotide
  Target: ATXN1; (-) strand; PAM type: YTN; PAM sequence: TTC
tgtgatcataataaattcca

SEQ ID NO: 192490 - DNA, 20 bp, Artificial Sequence
  Description of Artificial Sequence: Synthetic oligonucleotide
  Target: ATXN1; (-) strand; PAM type: YTN; PAM sequence: CTG
gttctgtgatcataataaat

SEQ ID NO: 192491 - DNA, 20 bp, Artificial Sequence
  Description of Artificial Sequence: Synthetic oligonucleotide
  Target: ATXN1; (-) strand; PAM type: YTN; PAM sequence: TTC
ctggttctgtgatcataata

SEQ ID NO: 192492 - DNA, 20 bp, Artificial Sequence
  Description of Artificial Sequence: Synthetic oligonucleotide
  Target: ATXN1; (-) strand; PAM type: YTN; PAM sequence: TTT
cctggttctgtgatcataat

SEQ ID NO: 192493 - DNA, 20 bp, Artificial Sequence
  Description of Artificial Sequence: Synthetic oligonucleotide
  Target: ATXN1; (-) strand; PAM type: YTN; PAM sequence: CTA
tttcctggttctgtgatcat

SEQ ID NO: 192494 - DNA, 20 bp, Artificial Sequence
  Description of Artificial Sequence: Synthetic oligonucleotide
  Target: ATXN1; (-) strand; PAM type: YTN; PAM sequence: TTC
agctatttcctggttctgtg

SEQ ID NO: 192495 - DNA, 20 bp, Artificial Sequence
  Description of Artificial Sequence: Synthetic oligonucleotide
  Target: ATXN1; (-) strand; PAM type: YTN; PAM sequence: TTC
acattcagctatttcctggt

SEQ ID NO: 192496 - DNA, 20 bp, Artificial Sequence
  Description of Artificial Sequence: Synthetic oligonucleotide
  Target: ATXN1; (-) strand; PAM type: YTN; PAM sequence: TTT
cacattcagctatttcctgg

SEQ ID NO: 192497 - DNA, 20 bp, Artificial Sequence
  Description of Artificial Sequence: Synthetic oligonucleotide
  Target: ATXN1; (-) strand; PAM type: YTN; PAM sequence: TTT
tcacattcagctatttcctg

SEQ ID NO: 192498 - DNA, 20 bp, Artificial Sequence
  Description of Artificial Sequence: Synthetic oligonucleotide
  Target: ATXN1; (-) strand; PAM type: YTN; PAM sequence: CTG
ttttcacattcagctatttc

SEQ ID NO: 192499 - DNA, 20 bp, Artificial Sequence
  Description of Artificial Sequence: Synthetic oligonucleotide
  Target: ATXN1; (-) strand; PAM type: YTN; PAM sequence: TTC
ctgttttcacattcagctat

SEQ ID NO: 192500 - DNA, 20 bp, Artificial Sequence
  Description of Artificial Sequence: Synthetic oligonucleotide
  Target: ATXN1; (-) strand; PAM type: YTN; PAM sequence: TTG
agatgttcctgttttcacat

SEQ ID NO: 192501 - DNA, 20 bp, Artificial Sequence
  Description of Artificial Sequence: Synthetic oligonucleotide
  Target: ATXN1; (-) strand; PAM type: YTN; PAM sequence: TTT
gagatgttcctgttttcaca

SEQ ID NO: 192502 - DNA, 20 bp, Artificial Sequence
  Description of Artificial Sequence: Synthetic oligonucleotide
  Target: ATXN1; (-) strand; PAM type: YTN; PAM sequence: CTG
aggggtgatttgagatgttc

SEQ ID NO: 192503 - DNA, 20 bp, Artificial Sequence
  Description of Artificial Sequence: Synthetic oligonucleotide
  Target: ATXN1; (-) strand; PAM type: YTN; PAM sequence: TTA
gagctgaggggtgatttgag

SEQ ID NO: 192504 - DNA, 20 bp, Artificial Sequence
  Description of Artificial Sequence: Synthetic oligonucleotide
  Target: ATXN1; (-) strand; PAM type: YTN; PAM sequence: CTT
agagctgaggggtgatttga

SEQ ID NO: 192505 - DNA, 20 bp, Artificial Sequence
  Description of Artificial Sequence: Synthetic oligonucleotide
  Target: ATXN1; (-) strand; PAM type: YTN; PAM sequence: TTC
ttagagctgaggggtgattt

SEQ ID NO: 192506 - DNA, 20 bp, Artificial Sequence
  Description of Artificial Sequence: Synthetic oligonucleotide
  Target: ATXN1; (-) strand; PAM type: YTN; PAM sequence: CTT
cttagagctgaggggtgatt

SEQ ID NO: 192507 - DNA, 20 bp, Artificial Sequence
  Description of Artificial Sequence: Synthetic oligonucleotide
  Target: ATXN1; (-) strand; PAM type: YTN; PAM sequence: CTC
ttcttagagctgaggggtga

SEQ ID NO: 192508 - DNA, 20 bp, Artificial Sequence
  Description of Artificial Sequence: Synthetic oligonucleotide
  Target: ATXN1; (-) strand; PAM type: YTN; PAM sequence: TTA
ctcttcttagagctgagggg

SEQ ID NO: 192509 - DNA, 20 bp, Artificial Sequence
  Description of Artificial Sequence: Synthetic oligonucleotide
  Target: ATXN1; (-) strand; PAM type: YTN; PAM sequence: TTG
aaatgcgttactcttcttag

SEQ ID NO: 192510 - DNA, 20 bp, Artificial Sequence
  Description of Artificial Sequence: Synthetic oligonucleotide
  Target: ATXN1; (-) strand; PAM type: YTN; PAM sequence: TTT
gaaatgcgttactcttctta

SEQ ID NO: 192511 - DNA, 20 bp, Artificial Sequence
  Description of Artificial Sequence: Synthetic oligonucleotide
  Target: ATXN1; (-) strand; PAM type: YTN; PAM sequence: TTA
atttgaaatgcgttactctt

SEQ ID NO: 192512 - DNA, 20 bp, Artificial Sequence
  Description of Artificial Sequence: Synthetic oligonucleotide
  Target: ATXN1; (-) strand; PAM type: YTN; PAM sequence: TTT
aatttgaaatgcgttactct

SEQ ID NO: 192513 - DNA, 20 bp, Artificial Sequence
  Description of Artificial Sequence: Synthetic oligonucleotide
  Target: ATXN1; (-) strand; PAM type: YTN; PAM sequence: TTT
taatttgaaatgcgttactc

SEQ ID NO: 192514 - DNA, 20 bp, Artificial Sequence
  Description of Artificial Sequence: Synthetic oligonucleotide
  Target: ATXN1; (-) strand; PAM type: YTN; PAM sequence: CTT
ttaatttgaaatgcgttact

SEQ ID NO: 192515 - DNA, 20 bp, Artificial Sequence
  Description of Artificial Sequence: Synthetic oligonucleotide
  Target: ATXN1; (-) strand; PAM type: YTN; PAM sequence: TTG
cttttaatttgaaatgcgtt

SEQ ID NO: 192516 - DNA, 20 bp, Artificial Sequence
  Description of Artificial Sequence: Synthetic oligonucleotide
  Target: ATXN1; (-) strand; PAM type: YTN; PAM sequence: TTT
gcttttaatttgaaatgcgt

SEQ ID NO: 192517 - DNA, 20 bp, Artificial Sequence
  Description of Artificial Sequence: Synthetic oligonucleotide
  Target: ATXN1; (-) strand; PAM type: YTN; PAM sequence: CTT
tgcttttaatttgaaatgcg

SEQ ID NO: 192518 - DNA, 20 bp, Artificial Sequence
  Description of Artificial Sequence: Synthetic oligonucleotide
  Target: ATXN1; (-) strand; PAM type: YTN; PAM sequence: TTG
agagagaacagtaaacacag

SEQ ID NO: 192519 - DNA, 20 bp, Artificial Sequence
  Description of Artificial Sequence: Synthetic oligonucleotide
  Target: ATXN1; (-) strand; PAM type: YTN; PAM sequence: CTC
attgagagagaacagtaaac

SEQ ID NO: 192520 - DNA, 20 bp, Artificial Sequence
  Description of Artificial Sequence: Synthetic oligonucleotide
  Target: ATXN1; (-) strand; PAM type: YTN; PAM sequence: CTG
ggagtgcaggcccctcattg

SEQ ID NO: 192521 - DNA, 20 bp, Artificial Sequence
  Description of Artificial Sequence: Synthetic oligonucleotide
  Target: ATXN1; (-) strand; PAM type: YTN; PAM sequence: CTG
tcctgggagtgcaggcccct

SEQ ID NO: 192522 - DNA, 20 bp, Artificial Sequence
  Description of Artificial Sequence: Synthetic oligonucleotide
  Target: ATXN1; (-) strand; PAM type: YTN; PAM sequence: CTG
acactgtcctgggagtgcag

SEQ ID NO: 192523 - DNA, 20 bp, Artificial Sequence
  Description of Artificial Sequence: Synthetic oligonucleotide
  Target: ATXN1; (-) strand; PAM type: YTN; PAM sequence: CTA
agtatgctgacactgtcctg

SEQ ID NO: 192524 - DNA, 20 bp, Artificial Sequence
  Description of Artificial Sequence: Synthetic oligonucleotide
  Target: ATXN1; (-) strand; PAM type: YTN; PAM sequence: TTG
aaaagctaagtatgctgaca

SEQ ID NO: 192525 - DNA, 20 bp, Artificial Sequence
  Description of Artificial Sequence: Synthetic oligonucleotide
  Target: ATXN1; (-) strand; PAM type: YTN; PAM sequence: TTT
gaaaagctaagtatgctgac

SEQ ID NO: 192526 - DNA, 20 bp, Artificial Sequence
  Description of Artificial Sequence: Synthetic oligonucleotide
  Target: ATXN1; (-) strand; PAM type: YTN; PAM sequence: TTA
gtatttgaaaagctaagtat

SEQ ID NO: 192527 - DNA, 20 bp, Artificial Sequence
  Description of Artificial Sequence: Synthetic oligonucleotide
  Target: ATXN1; (-) strand; PAM type: YTN; PAM sequence: TTT
agtatttgaaaagctaagta

SEQ ID NO: 192528 - DNA, 20 bp, Artificial Sequence
  Description of Artificial Sequence: Synthetic oligonucleotide
  Target: ATXN1; (-) strand; PAM type: YTN; PAM sequence: TTA
tttagtatttgaaaagctaa

SEQ ID NO: 192529 - DNA, 20 bp, Artificial Sequence
  Description of Artificial Sequence: Synthetic oligonucleotide
  Target: ATXN1; (-) strand; PAM type: YTN; PAM sequence: TTT
atttagtatttgaaaagcta

SEQ ID NO: 192530 - DNA, 20 bp, Artificial Sequence
  Description of Artificial Sequence: Synthetic oligonucleotide
  Target: ATXN1; (-) strand; PAM type: YTN; PAM sequence: TTT
tatttagtatttgaaaagct

SEQ ID NO: 192531 - DNA, 20 bp, Artificial Sequence
  Description of Artificial Sequence: Synthetic oligonucleotide
  Target: ATXN1; (-) strand; PAM type: YTN; PAM sequence: TTT
ttatttagtatttgaaaagc

SEQ ID NO: 192532 - DNA, 20 bp, Artificial Sequence
  Description of Artificial Sequence: Synthetic oligonucleotide
  Target: ATXN1; (-) strand; PAM type: YTN; PAM sequence: TTG
tttttatttagtatttgaaa

SEQ ID NO: 192533 - DNA, 20 bp, Artificial Sequence
  Description of Artificial Sequence: Synthetic oligonucleotide
  Target: ATXN1; (-) strand; PAM type: YTN; PAM sequence: CTG
ttgtttttatttagtatttg

SEQ ID NO: 192534 - DNA, 20 bp, Artificial Sequence
  Description of Artificial Sequence: Synthetic oligonucleotide
  Target: ATXN1; (-) strand; PAM type: YTN; PAM sequence: TTG
gagatgctgttgtttttatt

SEQ ID NO: 192535 - DNA, 20 bp, Artificial Sequence
  Description of Artificial Sequence: Synthetic oligonucleotide
  Target: ATXN1; (-) strand; PAM type: YTN; PAM sequence: CTT
ggagatgctgttgtttttat

SEQ ID NO: 192536 - DNA, 20 bp, Artificial Sequence
  Description of Artificial Sequence: Synthetic oligonucleotide
  Target: ATXN1; (-) strand; PAM type: YTN; PAM sequence: TTA
gaacttggagatgctgttgt

SEQ ID NO: 192537 - DNA, 20 bp, Artificial Sequence
  Description of Artificial Sequence: Synthetic oligonucleotide
  Target: ATXN1; (-) strand; PAM type: YTN; PAM sequence: CTT
agaacttggagatgctgttg

SEQ ID NO: 192538 - DNA, 20 bp, Artificial Sequence
  Description of Artificial Sequence: Synthetic oligonucleotide
  Target: ATXN1; (-) strand; PAM type: YTN; PAM sequence: TTA
taaatgcttagaacttggag

SEQ ID NO: 192539 - DNA, 20 bp, Artificial Sequence
  Description of Artificial Sequence: Synthetic oligonucleotide
  Target: ATXN1; (-) strand; PAM type: YTN; PAM sequence: TTT
ataaatgcttagaacttgga

SEQ ID NO: 192540 - DNA, 20 bp, Artificial Sequence
  Description of Artificial Sequence: Synthetic oligonucleotide
  Target: ATXN1; (-) strand; PAM type: YTN; PAM sequence: TTT
tataaatgcttagaacttgg

SEQ ID NO: 192541 - DNA, 20 bp, Artificial Sequence
  Description of Artificial Sequence: Synthetic oligonucleotide
  Target: ATXN1; (-) strand; PAM type: YTN; PAM sequence: CTT
ttataaatgcttagaacttg

SEQ ID NO: 192542 - DNA, 20 bp, Artificial Sequence
  Description of Artificial Sequence: Synthetic oligonucleotide
  Target: ATXN1; (-) strand; PAM type: YTN; PAM sequence: TTA
aaagagaataccttttataa

SEQ ID NO: 192543 - DNA, 20 bp, Artificial Sequence
  Description of Artificial Sequence: Synthetic oligonucleotide
  Target: ATXN1; (-) strand; PAM type: YTN; PAM sequence: TTT
aaaagagaataccttttata

SEQ ID NO: 192544 - DNA, 20 bp, Artificial Sequence
  Description of Artificial Sequence: Synthetic oligonucleotide
  Target: ATXN1; (-) strand; PAM type: YTN; PAM sequence: CTT
taaaagagaataccttttat

SEQ ID NO: 192545 - DNA, 20 bp, Artificial Sequence
  Description of Artificial Sequence: Synthetic oligonucleotide
  Target: ATXN1; (-) strand; PAM type: YTN; PAM sequence: TTA
tctttaaaagagaatacctt

SEQ ID NO: 192546 - DNA, 20 bp, Artificial Sequence
  Description of Artificial Sequence: Synthetic oligonucleotide
  Target: ATXN1; (-) strand; PAM type: YTN; PAM sequence: TTT
atctttaaaagagaatacct

SEQ ID NO: 192547 - DNA, 20 bp, Artificial Sequence
  Description of Artificial Sequence: Synthetic oligonucleotide
  Target: ATXN1; (-) strand; PAM type: YTN; PAM sequence: CTT
tatctttaaaagagaatacc

SEQ ID NO: 192548 - DNA, 20 bp, Artificial Sequence
  Description of Artificial Sequence: Synthetic oligonucleotide
  Target: ATXN1; (-) strand; PAM type: YTN; PAM sequence: TTG
tctttatctttaaaagagaa

SEQ ID NO: 192549 - DNA, 20 bp, Artificial Sequence
  Description of Artificial Sequence: Synthetic oligonucleotide
  Target: ATXN1; (-) strand; PAM type: YTN; PAM sequence: CTT
gtctttatctttaaaagaga

SEQ ID NO: 192550 - DNA, 20 bp, Artificial Sequence
  Description of Artificial Sequence: Synthetic oligonucleotide
  Target: ATXN1; (-) strand; PAM type: YTN; PAM sequence: CTA
aacttgtctttatctttaaa

SEQ ID NO: 192551 - DNA, 20 bp, Artificial Sequence
  Description of Artificial Sequence: Synthetic oligonucleotide
  Target: ATXN1; (-) strand; PAM type: YTN; PAM sequence: TTC
taaacttgtctttatcttta

SEQ ID NO: 192552 - DNA, 20 bp, Artificial Sequence
  Description of Artificial Sequence: Synthetic oligonucleotide
  Target: ATXN1; (-) strand; PAM type: YTN; PAM sequence: CTT
ctaaacttgtctttatcttt

SEQ ID NO: 192553 - DNA, 20 bp, Artificial Sequence
  Description of Artificial Sequence: Synthetic oligonucleotide
  Target: ATXN1; (-) strand; PAM type: YTN; PAM sequence: CTG
ccttctaaacttgtctttat

SEQ ID NO: 192554 - DNA, 20 bp, Artificial Sequence
  Description of Artificial Sequence: Synthetic oligonucleotide
  Target: ATXN1; (-) strand; PAM type: YTN; PAM sequence: TTG
cgacaaaaaaaggggcctgc

SEQ ID NO: 192555 - DNA, 20 bp, Artificial Sequence
  Description of Artificial Sequence: Synthetic oligonucleotide
  Target: ATXN1; (-) strand; PAM type: YTN; PAM sequence: TTA
accgattgcgacaaaaaaag

SEQ ID NO: 192556 - DNA, 20 bp, Artificial Sequence
  Description of Artificial Sequence: Synthetic oligonucleotide
  Target: ATXN1; (-) strand; PAM type: YTN; PAM sequence: TTT
aaccgattgcgacaaaaaaa

SEQ ID NO: 192557 - DNA, 20 bp, Artificial Sequence
  Description of Artificial Sequence: Synthetic oligonucleotide
  Target: ATXN1; (-) strand; PAM type: YTN; PAM sequence: TTT
taaccgattgcgacaaaaaa

SEQ ID NO: 192558 - DNA, 20 bp, Artificial Sequence
  Description of Artificial Sequence: Synthetic oligonucleotide
  Target: ATXN1; (-) strand; PAM type: YTN; PAM sequence: TTT
ttaaccgattgcgacaaaaa

SEQ ID NO: 192559 - DNA, 20 bp, Artificial Sequence
  Description of Artificial Sequence: Synthetic oligonucleotide
  Target: ATXN1; (-) strand; PAM type: YTN; PAM sequence: CTT
tttaaccgattgcgacaaaa

SEQ ID NO: 192560 - DNA, 20 bp, Artificial Sequence
  Description of Artificial Sequence: Synthetic oligonucleotide
  Target: ATXN1; (-) strand; PAM type: YTN; PAM sequence: TTC
actttttaaccgattgcgac

SEQ ID NO: 192561 - DNA, 20 bp, Artificial Sequence
  Description of Artificial Sequence: Synthetic oligonucleotide
  Target: ATXN1; (-) strand; PAM type: YTN; PAM sequence: CTT
cactttttaaccgattgcga

SEQ ID NO: 192562 - DNA, 20 bp, Artificial Sequence
  Description of Artificial Sequence: Synthetic oligonucleotide
  Target: ATXN1; (-) strand; PAM type: YTN; PAM sequence: CTC
ttcactttttaaccgattgc

SEQ ID NO: 192563 - DNA, 20 bp, Artificial Sequence
  Description of Artificial Sequence: Synthetic oligonucleotide
  Target: ATXN1; (-) strand; PAM type: YTN; PAM sequence: TTC
tcttcactttttaaccgatt

SEQ ID NO: 192564 - DNA, 20 bp, Artificial Sequence
  Description of Artificial Sequence: Synthetic oligonucleotide
  Target: ATXN1; (-) strand; PAM type: YTN; PAM sequence: TTT
ctcttcactttttaaccgat

SEQ ID NO: 192565 - DNA, 20 bp, Artificial Sequence
  Description of Artificial Sequence: Synthetic oligonucleotide
  Target: ATXN1; (-) strand; PAM type: YTN; PAM sequence: CTA
tttctcttcactttttaacc

SEQ ID NO: 192566 - DNA, 20 bp, Artificial Sequence
  Description of Artificial Sequence: Synthetic oligonucleotide
  Target: ATXN1; (-) strand; PAM type: YTN; PAM sequence: TTC
tatttctcttcactttttaa

SEQ ID NO: 192567 - DNA, 20 bp, Artificial Sequence
  Description of Artificial Sequence: Synthetic oligonucleotide
  Target: ATXN1; (-) strand; PAM type: YTN; PAM sequence: TTC
agcccattctatttctcttc

SEQ ID NO: 192568 - DNA, 20 bp, Artificial Sequence
  Description of Artificial Sequence: Synthetic oligonucleotide
  Target: ATXN1; (-) strand; PAM type: YTN; PAM sequence: TTG
ttcagcccattctatttctc

SEQ ID NO: 192569 - DNA, 20 bp, Artificial Sequence
  Description of Artificial Sequence: Synthetic oligonucleotide
  Target: ATXN1; (-) strand; PAM type: YTN; PAM sequence: TTT
gttcagcccattctatttct

SEQ ID NO: 192570 - DNA, 20 bp, Artificial Sequence
  Description of Artificial Sequence: Synthetic oligonucleotide
  Target: ATXN1; (-) strand; PAM type: YTN; PAM sequence: TTT
tgttcagcccattctatttc

SEQ ID NO: 192571 - DNA, 20 bp, Artificial Sequence
  Description of Artificial Sequence: Synthetic oligonucleotide
  Target: ATXN1; (-) strand; PAM type: YTN; PAM sequence: CTA
tatattttgttcagcccatt

SEQ ID NO: 192572 - DNA, 20 bp, Artificial Sequence
  Description of Artificial Sequence: Synthetic oligonucleotide
  Target: ATXN1; (-) strand; PAM type: YTN; PAM sequence: CTG
ctatatattttgttcagccc

SEQ ID NO: 192573 - DNA, 20 bp, Artificial Sequence
  Description of Artificial Sequence: Synthetic oligonucleotide
  Target: ATXN1; (-) strand; PAM type: YTN; PAM sequence: TTA
gaaaaagcagaccacagagc

SEQ ID NO: 192574 - DNA, 20 bp, Artificial Sequence
  Description of Artificial Sequence: Synthetic oligonucleotide
  Target: ATXN1; (-) strand; PAM type: YTN; PAM sequence: TTT
agaaaaagcagaccacagag

SEQ ID NO: 192575 - DNA, 20 bp, Artificial Sequence
  Description of Artificial Sequence: Synthetic oligonucleotide
  Target: ATXN1; (-) strand; PAM type: YTN; PAM sequence: TTT
tagaaaaagcagaccacaga

SEQ ID NO: 192576 - DNA, 20 bp, Artificial Sequence
  Description of Artificial Sequence: Synthetic oligonucleotide
  Target: ATXN1; (-) strand; PAM type: YTN; PAM sequence: CTT
ttagaaaaagcagaccacag

SEQ ID NO: 192577 - DNA, 20 bp, Artificial Sequence
  Description of Artificial Sequence: Synthetic oligonucleotide
  Target: ATXN1; (-) strand; PAM type: YTN; PAM sequence: CTG
tgggcagaacttttagaaaa

SEQ ID NO: 192578 - DNA, 20 bp, Artificial Sequence
  Description of Artificial Sequence: Synthetic oligonucleotide
  Target: ATXN1; (-) strand; PAM type: YTN; PAM sequence: CTG
aaaatctgtgggcagaactt

SEQ ID NO: 192579 - DNA, 20 bp, Artificial Sequence
  Description of Artificial Sequence: Synthetic oligonucleotide
  Target: ATXN1; (-) strand; PAM type: YTN; PAM sequence: TTG
gtgtctgaaaatctgtgggc

SEQ ID NO: 192580 - DNA, 20 bp, Artificial Sequence
  Description of Artificial Sequence: Synthetic oligonucleotide
  Target: ATXN1; (-) strand; PAM type: YTN; PAM sequence: CTG
ttggtgtctgaaaatctgtg

SEQ ID NO: 192581 - DNA, 20 bp, Artificial Sequence
  Description of Artificial Sequence: Synthetic oligonucleotide
  Target: ATXN1; (-) strand; PAM type: YTN; PAM sequence: TTG
ctgttggtgtctgaaaatct

SEQ ID NO: 192582 - DNA, 20 bp, Artificial Sequence
  Description of Artificial Sequence: Synthetic oligonucleotide
  Target: ATXN1; (-) strand; PAM type: YTN; PAM sequence: TTG
ttgctgttggtgtctgaaaa

SEQ ID NO: 192583 - DNA, 20 bp, Artificial Sequence
  Description of Artificial Sequence: Synthetic oligonucleotide
  Target: ATXN1; (-) strand; PAM type: YTN; PAM sequence: TTT
gttgctgttggtgtctgaaa

SEQ ID NO: 192584 - DNA, 20 bp, Artificial Sequence
  Description of Artificial Sequence: Synthetic oligonucleotide
  Target: ATXN1; (-) strand; PAM type: YTN; PAM sequence: CTG
tttgttgctgttggtgtctg

SEQ ID NO: 192585 - DNA, 20 bp, Artificial Sequence
  Description of Artificial Sequence: Synthetic oligonucleotide
  Target: ATXN1; (-) strand; PAM type: YTN; PAM sequence: TTG
caggagggagggaatgactg

SEQ ID NO: 192586 - DNA, 20 bp, Artificial Sequence
  Description of Artificial Sequence: Synthetic oligonucleotide
  Target: ATXN1; (-) strand; PAM type: YTN; PAM sequence: CTT
gcaggagggagggaatgact

SEQ ID NO: 192587 - DNA, 20 bp, Artificial Sequence
  Description of Artificial Sequence: Synthetic oligonucleotide
  Target: ATXN1; (-) strand; PAM type: YTN; PAM sequence: CTC
acttgcaggagggagggaat

SEQ ID NO: 192588 - DNA, 20 bp, Artificial Sequence
  Description of Artificial Sequence: Synthetic oligonucleotide
  Target: ATXN1; (-) strand; PAM type: YTN; PAM sequence: CTG
tcaccctcacttgcaggagg

SEQ ID NO: 192589 - DNA, 20 bp, Artificial Sequence
  Description of Artificial Sequence: Synthetic oligonucleotide
  Target: ATXN1; (-) strand; PAM type: YTN; PAM sequence: TTG
gctgtcaccctcacttgcag

SEQ ID NO: 192590 - DNA, 20 bp, Artificial Sequence
  Description of Artificial Sequence: Synthetic oligonucleotide
  Target: ATXN1; (-) strand; PAM type: YTN; PAM sequence: CTG
gcattggctgtcaccctcac

SEQ ID NO: 192591 - DNA, 20 bp, Artificial Sequence
  Description of Artificial Sequence: Synthetic oligonucleotide
  Target: ATXN1; (-) strand; PAM type: YTN; PAM sequence: CTC
ctggcattggctgtcaccct

SEQ ID NO: 192592 - DNA, 20 bp, Artificial Sequence
  Description of Artificial Sequence: Synthetic oligonucleotide
  Target: ATXN1; (-) strand; PAM type: YTN; PAM sequence: CTG
tagctcctggcattggctgt

SEQ ID NO: 192593 - DNA, 20 bp, Artificial Sequence
  Description of Artificial Sequence: Synthetic oligonucleotide
  Target: ATXN1; (-) strand; PAM type: YTN; PAM sequence: TTG
ctgtagctcctggcattggc

SEQ ID NO: 192594 - DNA, 20 bp, Artificial Sequence
  Description of Artificial Sequence: Synthetic oligonucleotide
  Target: ATXN1; (-) strand; PAM type: YTN; PAM sequence: CTG
ttgctgtagctcctggcatt

SEQ ID NO: 192595 - DNA, 20 bp, Artificial Sequence
  Description of Artificial Sequence: Synthetic oligonucleotide
  Target: ATXN1; (-) strand; PAM type: YTN; PAM sequence: TTC
tgttgctgtagctcctggca

SEQ ID NO: 192596 - DNA, 20 bp, Artificial Sequence
  Description of Artificial Sequence: Synthetic oligonucleotide
  Target: ATXN1; (-) strand; PAM type: YTN; PAM sequence: CTT
ctgttgctgtagctcctggc

SEQ ID NO: 192597 - DNA, 20 bp, Artificial Sequence
  Description of Artificial Sequence: Synthetic oligonucleotide
  Target: ATXN1; (-) strand; PAM type: YTN; PAM sequence: TTC
ttctgttgctgtagctcctg

SEQ ID NO: 192598 - DNA, 20 bp, Artificial Sequence
  Description of Artificial Sequence: Synthetic oligonucleotide
  Target: ATXN1; (-) strand; PAM type: YTN; PAM sequence: TTA
aagtacattcttctgttgct

SEQ ID NO: 192599 - DNA, 20 bp, Artificial Sequence
  Description of Artificial Sequence: Synthetic oligonucleotide
  Target: ATXN1; (-) strand; PAM type: YTN; PAM sequence: TTT
aaagtacattcttctgttgc

SEQ ID NO: 192600 - DNA, 20 bp, Artificial Sequence
  Description of Artificial Sequence: Synthetic oligonucleotide
  Target: ATXN1; (-) strand; PAM type: YTN; PAM sequence: TTT
taaagtacattcttctgttg

SEQ ID NO: 192601 - DNA, 20 bp, Artificial Sequence
  Description of Artificial Sequence: Synthetic oligonucleotide
  Target: ATXN1; (-) strand; PAM type: YTN; PAM sequence: CTT
ttaaagtacattcttctgtt

SEQ ID NO: 192602 - DNA, 20 bp, Artificial Sequence
  Description of Artificial Sequence: Synthetic oligonucleotide
  Target: ATXN1; (-) strand; PAM type: YTN; PAM sequence: CTC
ttttaaagtacattcttctg

SEQ ID NO: 192603 - DNA, 20 bp, Artificial Sequence
  Description of Artificial Sequence: Synthetic oligonucleotide
  Target: ATXN1; (-) strand; PAM type: YTN; PAM sequence: CTC
tcttttaaagtacattcttc

SEQ ID NO: 192604 - DNA, 20 bp, Artificial Sequence
  Description of Artificial Sequence: Synthetic oligonucleotide
  Target: ATXN1; (-) strand; PAM type: YTN; PAM sequence: CTG
tctctcttttaaagtacatt

SEQ ID NO: 192605 - DNA, 20 bp, Artificial Sequence
  Description of Artificial Sequence: Synthetic oligonucleotide
  Target: ATXN1; (-) strand; PAM type: YTN; PAM sequence: CTC
ctgtctctcttttaaagtac

SEQ ID NO: 192606 - DNA, 20 bp, Artificial Sequence
  Description of Artificial Sequence: Synthetic oligonucleotide
  Target: ATXN1; (-) strand; PAM type: YTN; PAM sequence: TTC
tcctgtctctcttttaaagt

SEQ ID NO: 192607 - DNA, 20 bp, Artificial Sequence
  Description of Artificial Sequence: Synthetic oligonucleotide
  Target: ATXN1; (-) strand; PAM type: YTN; PAM sequence: CTA
agccattctcctgtctctct

SEQ ID NO: 192608 - DNA, 20 bp, Artificial Sequence
  Description of Artificial Sequence: Synthetic oligonucleotide
  Target: ATXN1; (-) strand; PAM type: YTN; PAM sequence: TTA
ggaggtgatggtgatggcag

SEQ ID NO: 192609 - DNA, 20 bp, Artificial Sequence
  Description of Artificial Sequence: Synthetic oligonucleotide
  Target: ATXN1; (-) strand; PAM type: YTN; PAM sequence: CTG
gttaggaggtgatggtgatg

SEQ ID NO: 192610 - DNA, 20 bp, Artificial Sequence
  Description of Artificial Sequence: Synthetic oligonucleotide
  Target: ATXN1; (-) strand; PAM type: YTN; PAM sequence: TTC
tggttaggaggtgatggtga

SEQ ID NO: 192611 - DNA, 20 bp, Artificial Sequence
  Description of Artificial Sequence: Synthetic oligonucleotide
  Target: ATXN1; (-) strand; PAM type: YTN; PAM sequence: TTT
ctggttaggaggtgatggtg

SEQ ID NO: 192612 - DNA, 20 bp, Artificial Sequence
  Description of Artificial Sequence: Synthetic oligonucleotide
  Target: ATXN1; (-) strand; PAM type: YTN; PAM sequence: TTG
tcatttctggttaggaggtg

SEQ ID NO: 192613 - DNA, 20 bp, Artificial Sequence
  Description of Artificial Sequence: Synthetic oligonucleotide
  Target: ATXN1; (-) strand; PAM type: YTN; PAM sequence: TTG
ttgtcatttctggttaggag

SEQ ID NO: 192614 - DNA, 20 bp, Artificial Sequence
  Description of Artificial Sequence: Synthetic oligonucleotide
  Target: ATXN1; (-) strand; PAM type: YTN; PAM sequence: CTT
gttgtcatttctggttagga

SEQ ID NO: 192615 - DNA, 20 bp, Artificial Sequence
  Description of Artificial Sequence: Synthetic oligonucleotide
  Target: ATXN1; (-) strand; PAM type: YTN; PAM sequence: CTG
cttgttgtcatttctggtta

SEQ ID NO: 192616 - DNA, 20 bp, Artificial Sequence
  Description of Artificial Sequence: Synthetic oligonucleotide
  Target: ATXN1; (-) strand; PAM type: YTN; PAM sequence: CTA
gaaagtgctgcttgttgtca

SEQ ID NO: 192617 - DNA, 20 bp, Artificial Sequence
  Description of Artificial Sequence: Synthetic oligonucleotide
  Target: ATXN1; (-) strand; PAM type: YTN; PAM sequence: TTC
ctagaaagtgctgcttgttg

SEQ ID NO: 192618 - DNA, 20 bp, Artificial Sequence
  Description of Artificial Sequence: Synthetic oligonucleotide
  Target: ATXN1; (-) strand; PAM type: YTN; PAM sequence: CTA
acaaattcctagaaagtgct

SEQ ID NO: 192619 - DNA, 20 bp, Artificial Sequence
  Description of Artificial Sequence: Synthetic oligonucleotide
  Target: ATXN1; (-) strand; PAM type: YTN; PAM sequence: TTG
gtcaaaagagaaacgtgagt

SEQ ID NO: 192620 - DNA, 20 bp, Artificial Sequence
  Description of Artificial Sequence: Synthetic oligonucleotide
  Target: ATXN1; (-) strand; PAM type: YTN; PAM sequence: TTT
ggtcaaaagagaaacgtgag

SEQ ID NO: 192621 - DNA, 20 bp, Artificial Sequence
  Description of Artificial Sequence: Synthetic oligonucleotide
  Target: ATXN1; (-) strand; PAM type: YTN; PAM sequence: CTA
aataatatttggtcaaaaga

SEQ ID NO: 192622 - DNA, 20 bp, Artificial Sequence
  Description of Artificial Sequence: Synthetic oligonucleotide
  Target: ATXN1; (-) strand; PAM type: YTN; PAM sequence: TTA
ctaaataatatttggtcaaa

SEQ ID NO: 192623 - DNA, 20 bp, Artificial Sequence
  Description of Artificial Sequence: Synthetic oligonucleotide
  Target: ATXN1; (-) strand; PAM type: YTN; PAM sequence: CTT
actaaataatatttggtcaa

SEQ ID NO: 192624 - DNA, 20 bp, Artificial Sequence
  Description of Artificial Sequence: Synthetic oligonucleotide
  Target: ATXN1; (-) strand; PAM type: YTN; PAM sequence: CTC
aaccacatcttactaaataa

SEQ ID NO: 192625 - DNA, 20 bp, Artificial Sequence
  Description of Artificial Sequence: Synthetic oligonucleotide
  Target: ATXN1; (-) strand; PAM type: YTN; PAM sequence: TTC
ccaggggccactcaaccaca

SEQ ID NO: 192626 - DNA, 20 bp, Artificial Sequence
  Description of Artificial Sequence: Synthetic oligonucleotide
  Target: ATXN1; (-) strand; PAM type: YTN; PAM sequence: TTC
aatggtgattcccaggggcc

SEQ ID NO: 192627 - DNA, 20 bp, Artificial Sequence
  Description of Artificial Sequence: Synthetic oligonucleotide
  Target: ATXN1; (-) strand; PAM type: YTN; PAM sequence: TTT
caatggtgattcccaggggc

SEQ ID NO: 192628 - DNA, 20 bp, Artificial Sequence
  Description of Artificial Sequence: Synthetic oligonucleotide
  Target: ATXN1; (-) strand; PAM type: YTN; PAM sequence: CTG
tttcaatggtgattcccagg

SEQ ID NO: 192629 - DNA, 20 bp, Artificial Sequence
  Description of Artificial Sequence: Synthetic oligonucleotide
  Target: ATXN1; (-) strand; PAM type: YTN; PAM sequence: TTC
tgtttcaatggtgattccca

SEQ ID NO: 192630 - DNA, 20 bp, Artificial Sequence
  Description of Artificial Sequence: Synthetic oligonucleotide
  Target: ATXN1; (-) strand; PAM type: YTN; PAM sequence: CTT
ctgtttcaatggtgattccc

SEQ ID NO: 192631 - DNA, 20 bp, Artificial Sequence
  Description of Artificial Sequence: Synthetic oligonucleotide
  Target: ATXN1; (-) strand; PAM type: YTN; PAM sequence: TTA
gaaagccttctgtttcaatg

SEQ ID NO: 192632 - DNA, 20 bp, Artificial Sequence
  Description of Artificial Sequence: Synthetic oligonucleotide
  Target: ATXN1; (-) strand; PAM type: YTN; PAM sequence: CTT
agaaagccttctgtttcaat

SEQ ID NO: 192633 - DNA, 20 bp, Artificial Sequence
  Description of Artificial Sequence: Synthetic oligonucleotide
  Target: ATXN1; (-) strand; PAM type: YTN; PAM sequence: TTA
cttagaaagccttctgtttc

SEQ ID NO: 192634 - DNA, 20 bp, Artificial Sequence
  Description of Artificial Sequence: Synthetic oligonucleotide
  Target: ATXN1; (-) strand; PAM type: YTN; PAM sequence: TTT
acttagaaagccttctgttt

SEQ ID NO: 192635 - DNA, 20 bp, Artificial Sequence
  Description of Artificial Sequence: Synthetic oligonucleotide
  Target: ATXN1; (-) strand; PAM type: YTN; PAM sequence: TTT
tacttagaaagccttctgtt

SEQ ID NO: 192636 - DNA, 20 bp, Artificial Sequence
  Description of Artificial Sequence: Synthetic oligonucleotide
  Target: ATXN1; (-) strand; PAM type: YTN; PAM sequence: CTG
aacagatattttacttagaa

SEQ ID NO: 192637 - DNA, 20 bp, Artificial Sequence
  Description of Artificial Sequence: Synthetic oligonucleotide
  Target: ATXN1; (-) strand; PAM type: YTN; PAM sequence: CTG
caagaacagatactgaacag

SEQ ID NO: 192638 - DNA, 20 bp, Artificial Sequence
  Description of Artificial Sequence: Synthetic oligonucleotide
  Target: ATXN1; (-) strand; PAM type: YTN; PAM sequence: TTG
cactgcaagaacagatactg

SEQ ID NO: 192639 - DNA, 20 bp, Artificial Sequence
  Description of Artificial Sequence: Synthetic oligonucleotide
  Target: ATXN1; (-) strand; PAM type: YTN; PAM sequence: TTT
gcactgcaagaacagatact

SEQ ID NO: 192640 - DNA, 20 bp, Artificial Sequence
  Description of Artificial Sequence: Synthetic oligonucleotide
  Target: ATXN1; (-) strand; PAM type: YTN; PAM sequence: CTT
tgcactgcaagaacagatac

SEQ ID NO: 192641 - DNA, 20 bp, Artificial Sequence
  Description of Artificial Sequence: Synthetic oligonucleotide
  Target: ATXN1; (-) strand; PAM type: YTN; PAM sequence: TTG
aaatgtgctttgcactgcaa

SEQ ID NO: 192642 - DNA, 20 bp, Artificial Sequence
  Description of Artificial Sequence: Synthetic oligonucleotide
  Target: ATXN1; (-) strand; PAM type: YTN; PAM sequence: TTT
gaaatgtgctttgcactgca

SEQ ID NO: 192643 - DNA, 20 bp, Artificial Sequence
  Description of Artificial Sequence: Synthetic oligonucleotide
  Target: ATXN1; (-) strand; PAM type: YTN; PAM sequence: TTT
tgaaatgtgctttgcactgc

SEQ ID NO: 192644 - DNA, 20 bp, Artificial Sequence
  Description of Artificial Sequence: Synthetic oligonucleotide
  Target: ATXN1; (-) strand; PAM type: YTN; PAM sequence: CTT
ttgaaatgtgctttgcactg

SEQ ID NO: 192645 - DNA, 20 bp, Artificial Sequence
  Description of Artificial Sequence: Synthetic oligonucleotide
  Target: ATXN1; (-) strand; PAM type: YTN; PAM sequence: CTG
aacttttgaaatgtgctttg

SEQ ID NO: 192646 - DNA, 20 bp, Artificial Sequence
  Description of Artificial Sequence: Synthetic oligonucleotide
  Target: ATXN1; (-) strand; PAM type: YTN; PAM sequence: TTG
gctgaacttttgaaatgtgc

SEQ ID NO: 192647 - DNA, 20 bp, Artificial Sequence
  Description of Artificial Sequence: Synthetic oligonucleotide
  Target: ATXN1; (-) strand; PAM type: YTN; PAM sequence: CTA
gccgttggctgaacttttga

SEQ ID NO: 192648 - DNA, 20 bp, Artificial Sequence
  Description of Artificial Sequence: Synthetic oligonucleotide
  Target: ATXN1; (-) strand; PAM type: YTN; PAM sequence: TTC
ctagccgttggctgaacttt

SEQ ID NO: 192649 - DNA, 20 bp, Artificial Sequence
  Description of Artificial Sequence: Synthetic oligonucleotide
  Target: ATXN1; (-) strand; PAM type: YTN; PAM sequence: TTT
cctagccgttggctgaactt

SEQ ID NO: 192650 - DNA, 20 bp, Artificial Sequence
  Description of Artificial Sequence: Synthetic oligonucleotide
  Target: ATXN1; (-) strand; PAM type: YTN; PAM sequence: TTT
tcctagccgttggctgaact

SEQ ID NO: 192651 - DNA, 20 bp, Artificial Sequence
  Description of Artificial Sequence: Synthetic oligonucleotide
  Target: ATXN1; (-) strand; PAM type: YTN; PAM sequence: CTG
cgtgccccaaacattttcct

SEQ ID NO: 192652 - DNA, 20 bp, Artificial Sequence
  Description of Artificial Sequence: Synthetic oligonucleotide
  Target: ATXN1; (-) strand; PAM type: YTN; PAM sequence: TTC
tgcgtgccccaaacattttc

SEQ ID NO: 192653 - DNA, 20 bp, Artificial Sequence
  Description of Artificial Sequence: Synthetic oligonucleotide
  Target: ATXN1; (-) strand; PAM type: YTN; PAM sequence: TTG
gcgtagaagggattctgcgt

SEQ ID NO: 192654 - DNA, 20 bp, Artificial Sequence
  Description of Artificial Sequence: Synthetic oligonucleotide
  Target: ATXN1; (-) strand; PAM type: YTN; PAM sequence: CTG
ttggcgtagaagggattctg

SEQ ID NO: 192655 - DNA, 20 bp, Artificial Sequence
  Description of Artificial Sequence: Synthetic oligonucleotide
  Target: ATXN1; (-) strand; PAM type: YTN; PAM sequence: TTC
tgttggcgtagaagggattc

SEQ ID NO: 192656 - DNA, 20 bp, Artificial Sequence
  Description of Artificial Sequence: Synthetic oligonucleotide
  Target: ATXN1; (-) strand; PAM type: YTN; PAM sequence: TTA
gttctgttggcgtagaaggg

SEQ ID NO: 192657 - DNA, 20 bp, Artificial Sequence
  Description of Artificial Sequence: Synthetic oligonucleotide
  Target: ATXN1; (-) strand; PAM type: YTN; PAM sequence: CTG
aaaaatgcatacatgagatt

SEQ ID NO: 192658 - DNA, 20 bp, Artificial Sequence
  Description of Artificial Sequence: Synthetic oligonucleotide
  Target: ATXN1; (-) strand; PAM type: YTN; PAM sequence: CTC
aggagctgaaaaatgcatac

SEQ ID NO: 192659 - DNA, 20 bp, Artificial Sequence
  Description of Artificial Sequence: Synthetic oligonucleotide
  Target: ATXN1; (-) strand; PAM type: YTN; PAM sequence: CTC
aactcaggagctgaaaaatg

SEQ ID NO: 192660 - DNA, 20 bp, Artificial Sequence
  Description of Artificial Sequence: Synthetic oligonucleotide
  Target: ATXN1; (-) strand; PAM type: YTN; PAM sequence: TTC
tcaactcaggagctgaaaaa

SEQ ID NO: 192661 - DNA, 20 bp, Artificial Sequence
  Description of Artificial Sequence: Synthetic oligonucleotide
  Target: ATXN1; (-) strand; PAM type: YTN; PAM sequence: CTT
ctcaactcaggagctgaaaa

SEQ ID NO: 192662 - DNA, 20 bp, Artificial Sequence
  Description of Artificial Sequence: Synthetic oligonucleotide
  Target: ATXN1; (-) strand; PAM type: YTN; PAM sequence: TTA
atatgtcttctcaactcagg

SEQ ID NO: 192663 - DNA, 20 bp, Artificial Sequence
  Description of Artificial Sequence: Synthetic oligonucleotide
  Target: ATXN1; (-) strand; PAM type: YTN; PAM sequence: TTT
aatatgtcttctcaactcag

SEQ ID NO: 192664 - DNA, 20 bp, Artificial Sequence
  Description of Artificial Sequence: Synthetic oligonucleotide
  Target: ATXN1; (-) strand; PAM type: YTN; PAM sequence: TTT
taatatgtcttctcaactca

SEQ ID NO: 192665 - DNA, 20 bp, Artificial Sequence
  Description of Artificial Sequence: Synthetic oligonucleotide
  Target: ATXN1; (-) strand; PAM type: YTN; PAM sequence: TTT
ttaatatgtcttctcaactc

SEQ ID NO: 192666 - DNA, 20 bp, Artificial Sequence
  Description of Artificial Sequence: Synthetic oligonucleotide
  Target: ATXN1; (-) strand; PAM type: YTN; PAM sequence: CTG
ggtttttaatatgtcttctc

SEQ ID NO: 192667 - DNA, 20 bp, Artificial Sequence
  Description of Artificial Sequence: Synthetic oligonucleotide
  Target: ATXN1; (-) strand; PAM type: YTN; PAM sequence: TTG
ctgggtttttaatatgtctt

SEQ ID NO: 192668 - DNA, 20 bp, Artificial Sequence
  Description of Artificial Sequence: Synthetic oligonucleotide
  Target: ATXN1; (-) strand; PAM type: YTN; PAM sequence: TTA
atgaagataaacatgttgct

SEQ ID NO: 192669 - DNA, 20 bp, Artificial Sequence
  Description of Artificial Sequence: Synthetic oligonucleotide
  Target: ATXN1; (-) strand; PAM type: YTN; PAM sequence: TTT
aatgaagataaacatgttgc

SEQ ID NO: 192670 - DNA, 20 bp, Artificial Sequence
  Description of Artificial Sequence: Synthetic oligonucleotide
  Target: ATXN1; (-) strand; PAM type: YTN; PAM sequence: CTG
tttaatgaagataaacatgt

SEQ ID NO: 192671 - DNA, 20 bp, Artificial Sequence
  Description of Artificial Sequence: Synthetic oligonucleotide
  Target: ATXN1; (-) strand; PAM type: YTN; PAM sequence: TTG
ctgtttaatgaagataaaca

SEQ ID NO: 192672 - DNA, 20 bp, Artificial Sequence
  Description of Artificial Sequence: Synthetic oligonucleotide
  Target: ATXN1; (-) strand; PAM type: YTN; PAM sequence: TTT
gctgtttaatgaagataaac

SEQ ID NO: 192673 - DNA, 20 bp, Artificial Sequence
  Description of Artificial Sequence: Synthetic oligonucleotide
  Target: ATXN1; (-) strand; PAM type: YTN; PAM sequence: TTG
aaaggacatttgctgtttaa

SEQ ID NO: 192674 - DNA, 20 bp, Artificial Sequence
  Description of Artificial Sequence: Synthetic oligonucleotide
  Target: ATXN1; (-) strand; PAM type: YTN; PAM sequence: TTT
gaaaggacatttgctgttta

SEQ ID NO: 192675 - DNA, 20 bp, Artificial Sequence
  Description of Artificial Sequence: Synthetic oligonucleotide
  Target: ATXN1; (-) strand; PAM type: YTN; PAM sequence: TTG
tttgaaaggacatttgctgt

SEQ ID NO: 192676 - DNA, 20 bp, Artificial Sequence
  Description of Artificial Sequence: Synthetic oligonucleotide
  Target: ATXN1; (-) strand; PAM type: YTN; PAM sequence: TTG
tatattgtttgaaaggacat

SEQ ID NO: 192677 - DNA, 20 bp, Artificial Sequence
  Description of Artificial Sequence: Synthetic oligonucleotide
  Target: ATXN1; (-) strand; PAM type: YTN; PAM sequence: CTG
ttgtatattgtttgaaagga

SEQ ID NO: 192678 - DNA, 20 bp, Artificial Sequence
  Description of Artificial Sequence: Synthetic oligonucleotide
  Target: ATXN1; (-) strand; PAM type: YTN; PAM sequence: CTG
ccctgttgtatattgtttga

SEQ ID NO: 192679 - DNA, 20 bp, Artificial Sequence
  Description of Artificial Sequence: Synthetic oligonucleotide
  Target: ATXN1; (-) strand; PAM type: YTN; PAM sequence: CTC
tgccctgttgtatattgttt

SEQ ID NO: 192680 - DNA, 20 bp, Artificial Sequence
  Description of Artificial Sequence: Synthetic oligonucleotide
  Target: ATXN1; (-) strand; PAM type: YTN; PAM sequence: TTA
gcacaaacagtgatctctgc

SEQ ID NO: 192681 - DNA, 20 bp, Artificial Sequence
  Description of Artificial Sequence: Synthetic oligonucleotide
  Target: ATXN1; (-) strand; PAM type: YTN; PAM sequence: TTC
cattagcacaaacagtgatc

SEQ ID NO: 192682 - DNA, 20 bp, Artificial Sequence
  Description of Artificial Sequence: Synthetic oligonucleotide
  Target: ATXN1; (-) strand; PAM type: YTN; PAM sequence: TTT
ccattagcacaaacagtgat

SEQ ID NO: 192683 - DNA, 20 bp, Artificial Sequence
  Description of Artificial Sequence: Synthetic oligonucleotide
  Target: ATXN1; (-) strand; PAM type: YTN; PAM sequence: CTT
tccattagcacaaacagtga

SEQ ID NO: 192684 - DNA, 20 bp, Artificial Sequence
  Description of Artificial Sequence: Synthetic oligonucleotide
  Target: ATXN1; (-) strand; PAM type: YTN; PAM sequence: TTG
atcactttccattagcacaa

SEQ ID NO: 192685 - DNA, 20 bp, Artificial Sequence
  Description of Artificial Sequence: Synthetic oligonucleotide
  Target: ATXN1; (-) strand; PAM type: YTN; PAM sequence: TTT
gatcactttccattagcaca

SEQ ID NO: 192686 - DNA, 20 bp, Artificial Sequence
  Description of Artificial Sequence: Synthetic oligonucleotide
  Target: ATXN1; (-) strand; PAM type: YTN; PAM sequence: TTT
tgatcactttccattagcac

SEQ ID NO: 192687 - DNA, 20 bp, Artificial Sequence
  Description of Artificial Sequence: Synthetic oligonucleotide
  Target: ATXN1; (-) strand; PAM type: YTN; PAM sequence: CTT
ttgatcactttccattagca

SEQ ID NO: 192688 - DNA, 20 bp, Artificial Sequence
  Description of Artificial Sequence: Synthetic oligonucleotide
  Target: ATXN1; (-) strand; PAM type: YTN; PAM sequence: TTG
gggcttttgatcactttcca

SEQ ID NO: 192689 - DNA, 20 bp, Artificial Sequence
  Description of Artificial Sequence: Synthetic oligonucleotide
  Target: ATXN1; (-) strand; PAM type: YTN; PAM sequence: CTT
ggggcttttgatcactttcc

SEQ ID NO: 192690 - DNA, 20 bp, Artificial Sequence
  Description of Artificial Sequence: Synthetic oligonucleotide
  Target: ATXN1; (-) strand; PAM type: YTN; PAM sequence: CTA
accaaagaatcttggggctt

SEQ ID NO: 192691 - DNA, 20 bp, Artificial Sequence
  Description of Artificial Sequence: Synthetic oligonucleotide
  Target: ATXN1; (-) strand; PAM type: YTN; PAM sequence: TTC
agagtcagctaaccaaagaa

SEQ ID NO: 192692 - DNA, 20 bp, Artificial Sequence
  Description of Artificial Sequence: Synthetic oligonucleotide
  Target: ATXN1; (-) strand; PAM type: YTN; PAM sequence: CTT
cagagtcagctaaccaaaga

SEQ ID NO: 192693 - DNA, 20 bp, Artificial Sequence
  Description of Artificial Sequence: Synthetic oligonucleotide
  Target: ATXN1; (-) strand; PAM type: YTN; PAM sequence: CTC
aagcacgagcaggcttcaga

SEQ ID NO: 192694 - DNA, 20 bp, Artificial Sequence
  Description of Artificial Sequence: Synthetic oligonucleotide
  Target: ATXN1; (-) strand; PAM type: YTN; PAM sequence: TTG
tgtagaaactcaagcacgag

SEQ ID NO: 192695 - DNA, 20 bp, Artificial Sequence
  Description of Artificial Sequence: Synthetic oligonucleotide
  Target: ATXN1; (-) strand; PAM type: YTN; PAM sequence: TTT
gtgtagaaactcaagcacga

SEQ ID NO: 192696 - DNA, 20 bp, Artificial Sequence
  Description of Artificial Sequence: Synthetic oligonucleotide
  Target: ATXN1; (-) strand; PAM type: YTN; PAM sequence: CTT
tgtgtagaaactcaagcacg

SEQ ID NO: 192697 - DNA, 20 bp, Artificial Sequence
  Description of Artificial Sequence: Synthetic oligonucleotide
  Target: ATXN1; (-) strand; PAM type: YTN; PAM sequence: TTG
atgtactttgtgtagaaact

SEQ ID NO: 192698 - DNA, 20 bp, Artificial Sequence
  Description of Artificial Sequence: Synthetic oligonucleotide
  Target: ATXN1; (-) strand; PAM type: YTN; PAM sequence: TTT
gatgtactttgtgtagaaac

SEQ ID NO: 192699 - DNA, 20 bp, Artificial Sequence
  Description of Artificial Sequence: Synthetic oligonucleotide
  Target: ATXN1; (-) strand; PAM type: YTN; PAM sequence: TTT
tgatgtactttgtgtagaaa

SEQ ID NO: 192700 - DNA, 20 bp, Artificial Sequence
  Description of Artificial Sequence: Synthetic oligonucleotide
  Target: ATXN1; (-) strand; PAM type: YTN; PAM sequence: CTT
ttgatgtactttgtgtagaa

SEQ ID NO: 192701 - DNA, 20 bp, Artificial Sequence
  Description of Artificial Sequence: Synthetic oligonucleotide
  Target: ATXN1; (-) strand; PAM type: YTN; PAM sequence: TTC
ttttgatgtactttgtgtag

SEQ ID NO: 192702 - DNA, 20 bp, Artificial Sequence
  Description of Artificial Sequence: Synthetic oligonucleotide
  Target: ATXN1; (-) strand; PAM type: YTN; PAM sequence: CTA
tattcttttgatgtactttg

SEQ ID NO: 192703 - DNA, 20 bp, Artificial Sequence
  Description of Artificial Sequence: Synthetic oligonucleotide
  Target: ATXN1; (-) strand; PAM type: YTN; PAM sequence: CTC
cagtgatatctatattcttt

SEQ ID NO: 192704 - DNA, 20 bp, Artificial Sequence
  Description of Artificial Sequence: Synthetic oligonucleotide
  Target: ATXN1; (-) strand; PAM type: YTN; PAM sequence: TTA
gaatctccagtgatatctat

SEQ ID NO: 192705 - DNA, 20 bp, Artificial Sequence
  Description of Artificial Sequence: Synthetic oligonucleotide
  Target: ATXN1; (-) strand; PAM type: YTN; PAM sequence: TTT
agaatctccagtgatatcta

SEQ ID NO: 192706 - DNA, 20 bp, Artificial Sequence
  Description of Artificial Sequence: Synthetic oligonucleotide
  Target: ATXN1; (-) strand; PAM type: YTN; PAM sequence: TTA
aacatttagaatctccagtg

SEQ ID NO: 192707 - DNA, 20 bp, Artificial Sequence
  Description of Artificial Sequence: Synthetic oligonucleotide
  Target: ATXN1; (-) strand; PAM type: YTN; PAM sequence: TTT
aaacatttagaatctccagt

SEQ ID NO: 192708 - DNA, 20 bp, Artificial Sequence
  Description of Artificial Sequence: Synthetic oligonucleotide
  Target: ATXN1; (-) strand; PAM type: YTN; PAM sequence: CTT
taaacatttagaatctccag

SEQ ID NO: 192709 - DNA, 20 bp, Artificial Sequence
  Description of Artificial Sequence: Synthetic oligonucleotide
  Target: ATXN1; (-) strand; PAM type: YTN; PAM sequence: CTA
gagactttaaacatttagaa

SEQ ID NO: 192710 - DNA, 20 bp, Artificial Sequence
  Description of Artificial Sequence: Synthetic oligonucleotide
  Target: ATXN1; (-) strand; PAM type: YTN; PAM sequence: CTA
gtcctagagactttaaacat

SEQ ID NO: 192711 - DNA, 20 bp, Artificial Sequence
  Description of Artificial Sequence: Synthetic oligonucleotide
  Target: ATXN1; (-) strand; PAM type: YTN; PAM sequence: TTG
ctagtcctagagactttaaa

SEQ ID NO: 192712 - DNA, 20 bp, Artificial Sequence
  Description of Artificial Sequence: Synthetic oligonucleotide
  Target: ATXN1; (-) strand; PAM type: YTN; PAM sequence: CTT
gctagtcctagagactttaa

SEQ ID NO: 192713 - DNA, 20 bp, Artificial Sequence
  Description of Artificial Sequence: Synthetic oligonucleotide
  Target: ATXN1; (-) strand; PAM type: YTN; PAM sequence: TTC
ttgctagtcctagagacttt

SEQ ID NO: 192714 - DNA, 20 bp, Artificial Sequence
  Description of Artificial Sequence: Synthetic oligonucleotide
  Target: ATXN1; (-) strand; PAM type: YTN; PAM sequence: TTT
cttgctagtcctagagactt

SEQ ID NO: 192715 - DNA, 20 bp, Artificial Sequence
  Description of Artificial Sequence: Synthetic oligonucleotide
  Target: ATXN1; (-) strand; PAM type: YTN; PAM sequence: TTT
tcttgctagtcctagagact

SEQ ID NO: 192716 - DNA, 20 bp, Artificial Sequence
  Description of Artificial Sequence: Synthetic oligonucleotide
  Target: ATXN1; (-) strand; PAM type: YTN; PAM sequence: TTC
aagcatattttcttgctagt

SEQ ID NO: 192717 - DNA, 20 bp, Artificial Sequence
  Description of Artificial Sequence: Synthetic oligonucleotide
  Target: ATXN1; (-) strand; PAM type: YTN; PAM sequence: TTT
caagcatattttcttgctag

SEQ ID NO: 192718 - DNA, 20 bp, Artificial Sequence
  Description of Artificial Sequence: Synthetic oligonucleotide
  Target: ATXN1; (-) strand; PAM type: YTN; PAM sequence: CTA
tagtttcaagcatattttct

SEQ ID NO: 192719 - DNA, 20 bp, Artificial Sequence
  Description of Artificial Sequence: Synthetic oligonucleotide
  Target: ATXN1; (-) strand; PAM type: YTN; PAM sequence: TTC
ctatagtttcaagcatattt

SEQ ID NO: 192720 - DNA, 20 bp, Artificial Sequence
  Description of Artificial Sequence: Synthetic oligonucleotide
  Target: ATXN1; (-) strand; PAM type: YTN; PAM sequence: TTT
cctatagtttcaagcatatt

SEQ ID NO: 192721 - DNA, 20 bp, Artificial Sequence
  Description of Artificial Sequence: Synthetic oligonucleotide
  Target: ATXN1; (-) strand; PAM type: YTN; PAM sequence: TTC
cccatttcctatagtttcaa

SEQ ID NO: 192722 - DNA, 20 bp, Artificial Sequence
  Description of Artificial Sequence: Synthetic oligonucleotide
  Target: ATXN1; (-) strand; PAM type: YTN; PAM sequence: CTG
ttccccatttcctatagttt

SEQ ID NO: 192723 - DNA, 20 bp, Artificial Sequence
  Description of Artificial Sequence: Synthetic oligonucleotide
  Target: ATXN1; (-) strand; PAM type: YTN; PAM sequence: TTC
tgttccccatttcctatagt

SEQ ID NO: 192724 - DNA, 20 bp, Artificial Sequence
  Description of Artificial Sequence: Synthetic oligonucleotide
  Target: ATXN1; (-) strand; PAM type: YTN; PAM sequence: TTA
cagggaaaaggtggaagtca

SEQ ID NO: 192725 - DNA, 20 bp, Artificial Sequence
  Description of Artificial Sequence: Synthetic oligonucleotide
  Target: ATXN1; (-) strand; PAM type: YTN; PAM sequence: TTG
tgttacagggaaaaggtgga

SEQ ID NO: 192726 - DNA, 20 bp, Artificial Sequence
  Description of Artificial Sequence: Synthetic oligonucleotide
  Target: ATXN1; (-) strand; PAM type: YTN; PAM sequence: TTG
taatgtattgtgttacaggg

SEQ ID NO: 192727 - DNA, 20 bp, Artificial Sequence
  Description of Artificial Sequence: Synthetic oligonucleotide
  Target: ATXN1; (-) strand; PAM type: YTN; PAM sequence: TTA
tagattgtaatgtattgtgt

SEQ ID NO: 192728 - DNA, 20 bp, Artificial Sequence
  Description of Artificial Sequence: Synthetic oligonucleotide
  Target: ATXN1; (-) strand; PAM type: YTN; PAM sequence: TTT
atagattgtaatgtattgtg

SEQ ID NO: 192729 - DNA, 20 bp, Artificial Sequence
  Description of Artificial Sequence: Synthetic oligonucleotide
  Target: ATXN1; (-) strand; PAM type: YTN; PAM sequence: CTA
tttatagattgtaatgtatt

SEQ ID NO: 192730 - DNA, 20 bp, Artificial Sequence
  Description of Artificial Sequence: Synthetic oligonucleotide
  Target: ATXN1; (-) strand; PAM type: YTN; PAM sequence: CTA
agctatttatagattgtaat

SEQ ID NO: 192731 - DNA, 20 bp, Artificial Sequence
  Description of Artificial Sequence: Synthetic oligonucleotide
  Target: ATXN1; (-) strand; PAM type: YTN; PAM sequence: TTA
aacagacagcctaagctatt

SEQ ID NO: 192732 - DNA, 20 bp, Artificial Sequence
  Description of Artificial Sequence: Synthetic oligonucleotide
  Target: ATXN1; (-) strand; PAM type: YTN; PAM sequence: TTT
aaacagacagcctaagctat

SEQ ID NO: 192733 - DNA, 20 bp, Artificial Sequence
  Description of Artificial Sequence: Synthetic oligonucleotide
  Target: ATXN1; (-) strand; PAM type: YTN; PAM sequence: TTC
cgggggaggtgcatatttaa

SEQ ID NO: 192734 - DNA, 20 bp, Artificial Sequence
  Description of Artificial Sequence: Synthetic oligonucleotide
  Target: ATXN1; (-) strand; PAM type: YTN; PAM sequence: TTT
ccgggggaggtgcatattta

SEQ ID NO: 192735 - DNA, 20 bp, Artificial Sequence
  Description of Artificial Sequence: Synthetic oligonucleotide
  Target: ATXN1; (-) strand; PAM type: YTN; PAM sequence: TTT
tccgggggaggtgcatattt

SEQ ID NO: 192736 - DNA, 20 bp, Artificial Sequence
  Description of Artificial Sequence: Synthetic oligonucleotide
  Target: ATXN1; (-) strand; PAM type: YTN; PAM sequence: CTT
ttccgggggaggtgcatatt

SEQ ID NO: 192737 - DNA, 20 bp, Artificial Sequence
  Description of Artificial Sequence: Synthetic oligonucleotide
  Target: ATXN1; (-) strand; PAM type: YTN; PAM sequence: CTA
tcttttccgggggaggtgca

SEQ ID NO: 192738 - DNA, 20 bp, Artificial Sequence
  Description of Artificial Sequence: Synthetic oligonucleotide
  Target: ATXN1; (-) strand; PAM type: YTN; PAM sequence: CTC
tatcttttccgggggaggtg

SEQ ID NO: 192739 - DNA, 20 bp, Artificial Sequence
  Description of Artificial Sequence: Synthetic oligonucleotide
  Target: ATXN1; (-) strand; PAM type: YTN; PAM sequence: TTG
caaatagcaagatgatcgga

SEQ ID NO: 192740 - DNA, 20 bp, Artificial Sequence
  Description of Artificial Sequence: Synthetic oligonucleotide
  Target: ATXN1; (-) strand; PAM type: YTN; PAM sequence: CTT
gcaaatagcaagatgatcgg

SEQ ID NO: 192741 - DNA, 20 bp, Artificial Sequence
  Description of Artificial Sequence: Synthetic oligonucleotide
  Target: ATXN1; (-) strand; PAM type: YTN; PAM sequence: TTC
cttgcaaatagcaagatgat

SEQ ID NO: 192742 - DNA, 20 bp, Artificial Sequence
  Description of Artificial Sequence: Synthetic oligonucleotide
  Target: ATXN1; (-) strand; PAM type: YTN; PAM sequence: TTG
tgagtaagattccttgcaaa

SEQ ID NO: 192743 - DNA, 20 bp, Artificial Sequence
  Description of Artificial Sequence: Synthetic oligonucleotide
  Target: ATXN1; (-) strand; PAM type: YTN; PAM sequence: TTT
gtgagtaagattccttgcaa

SEQ ID NO: 192744 - DNA, 20 bp, Artificial Sequence
  Description of Artificial Sequence: Synthetic oligonucleotide
  Target: ATXN1; (-) strand; PAM type: YTN; PAM sequence: TTG
atttgtgagtaagattcctt

SEQ ID NO: 192745 - DNA, 20 bp, Artificial Sequence
  Description of Artificial Sequence: Synthetic oligonucleotide
  Target: ATXN1; (-) strand; PAM type: YTN; PAM sequence: TTA
gattgatttgtgagtaagat

SEQ ID NO: 192746 - DNA, 20 bp, Artificial Sequence
  Description of Artificial Sequence: Synthetic oligonucleotide
  Target: ATXN1; (-) strand; PAM type: YTN; PAM sequence: CTG
ttagattgatttgtgagtaa

SEQ ID NO: 192747 - DNA, 20 bp, Artificial Sequence
  Description of Artificial Sequence: Synthetic oligonucleotide
  Target: ATXN1; (-) strand; PAM type: YTN; PAM sequence: TTA
catccccataatatcaccgt

SEQ ID NO: 192748 - DNA, 20 bp, Artificial Sequence
  Description of Artificial Sequence: Synthetic oligonucleotide
  Target: ATXN1; (-) strand; PAM type: YTN; PAM sequence: TTT
acatccccataatatcaccg

SEQ ID NO: 192749 - DNA, 20 bp, Artificial Sequence
  Description of Artificial Sequence: Synthetic oligonucleotide
  Target: ATXN1; (-) strand; PAM type: YTN; PAM sequence: TTT
tacatccccataatatcacc

SEQ ID NO: 192750 - DNA, 20 bp, Artificial Sequence
  Description of Artificial Sequence: Synthetic oligonucleotide
  Target: ATXN1; (-) strand; PAM type: YTN; PAM sequence: CTT
ttacatccccataatatcac

SEQ ID NO: 192751 - DNA, 20 bp, Artificial Sequence
  Description of Artificial Sequence: Synthetic oligonucleotide
  Target: ATXN1; (-) strand; PAM type: YTN; PAM sequence: TTC
agtcccttttacatccccat

SEQ ID NO: 192752 - DNA, 20 bp, Artificial Sequence
  Description of Artificial Sequence: Synthetic oligonucleotide
  Target: ATXN1; (-) strand; PAM type: YTN; PAM sequence: TTT
cagtcccttttacatcccca

SEQ ID NO: 192753 - DNA, 20 bp, Artificial Sequence
  Description of Artificial Sequence: Synthetic oligonucleotide
  Target: ATXN1; (-) strand; PAM type: YTN; PAM sequence: TTG
atcatttcagtcccttttac

SEQ ID NO: 192754 - DNA, 20 bp, Artificial Sequence
  Description of Artificial Sequence: Synthetic oligonucleotide
  Target: ATXN1; (-) strand; PAM type: YTN; PAM sequence: CTT
gatcatttcagtccctttta

SEQ ID NO: 192755 - DNA, 20 bp, Artificial Sequence
  Description of Artificial Sequence: Synthetic oligonucleotide
  Target: ATXN1; (-) strand; PAM type: YTN; PAM sequence: CTC
ttgatcatttcagtcccttt

SEQ ID NO: 192756 - DNA, 20 bp, Artificial Sequence
  Description of Artificial Sequence: Synthetic oligonucleotide
  Target: ATXN1; (-) strand; PAM type: YTN; PAM sequence: TTG
gaagacacgtgacgctcttg

SEQ ID NO: 192757 - DNA, 20 bp, Artificial Sequence
  Description of Artificial Sequence: Synthetic oligonucleotide
  Target: ATXN1; (-) strand; PAM type: YTN; PAM sequence: CTT
ggaagacacgtgacgctctt

SEQ ID NO: 192758 - DNA, 20 bp, Artificial Sequence
  Description of Artificial Sequence: Synthetic oligonucleotide
  Target: ATXN1; (-) strand; PAM type: YTN; PAM sequence: TTG
gcttggaagacacgtgacgc

SEQ ID NO: 192759 - DNA, 20 bp, Artificial Sequence
  Description of Artificial Sequence: Synthetic oligonucleotide
  Target: ATXN1; (-) strand; PAM type: YTN; PAM sequence: CTT
ggcttggaagacacgtgacg

SEQ ID NO: 192760 - DNA, 20 bp, Artificial Sequence
  Description of Artificial Sequence: Synthetic oligonucleotide
  Target: ATXN1; (-) strand; PAM type: YTN; PAM sequence: TTC
aaaccagcaaggcataggac

SEQ ID NO: 192761 - DNA, 20 bp, Artificial Sequence
  Description of Artificial Sequence: Synthetic oligonucleotide
  Target: ATXN1; (-) strand; PAM type: YTN; PAM sequence: CTT
caaaccagcaaggcatagga

SEQ ID NO: 192762 - DNA, 20 bp, Artificial Sequence
  Description of Artificial Sequence: Synthetic oligonucleotide
  Target: ATXN1; (-) strand; PAM type: YTN; PAM sequence: TTC
ttcaaaccagcaaggcatag

SEQ ID NO: 192763 - DNA, 20 bp, Artificial Sequence
  Description of Artificial Sequence: Synthetic oligonucleotide
  Target: ATXN1; (-) strand; PAM type: YTN; PAM sequence: CTT
cttcaaaccagcaaggcata

SEQ ID NO: 192764 - DNA, 20 bp, Artificial Sequence
  Description of Artificial Sequence: Synthetic oligonucleotide
  Target: ATXN1; (-) strand; PAM type: YTN; PAM sequence: CTC
ccacttcttcaaaccagcaa

SEQ ID NO: 192765 - DNA, 20 bp, Artificial Sequence
  Description of Artificial Sequence: Synthetic oligonucleotide
  Target: ATXN1; (-) strand; PAM type: YTN; PAM sequence: TTC
tcccacttcttcaaaccagc

SEQ ID NO: 192766 - DNA, 20 bp, Artificial Sequence
  Description of Artificial Sequence: Synthetic oligonucleotide
  Target: ATXN1; (-) strand; PAM type: YTN; PAM sequence: TTT
ctcccacttcttcaaaccag

SEQ ID NO: 192767 - DNA, 20 bp, Artificial Sequence
  Description of Artificial Sequence: Synthetic oligonucleotide
  Target: ATXN1; (-) strand; PAM type: YTN; PAM sequence: TTG
atgaagtttctcccacttct

SEQ ID NO: 192768 - DNA, 20 bp, Artificial Sequence
  Description of Artificial Sequence: Synthetic oligonucleotide
  Target: ATXN1; (-) strand; PAM type: YTN; PAM sequence: CTT
gatgaagtttctcccacttc

SEQ ID NO: 192769 - DNA, 20 bp, Artificial Sequence
  Description of Artificial Sequence: Synthetic oligonucleotide
  Target: ATXN1; (-) strand; PAM type: YTN; PAM sequence: CTC
ttgatgaagtttctcccact

SEQ ID NO: 192770 - DNA, 20 bp, Artificial Sequence
  Description of Artificial Sequence: Synthetic oligonucleotide
  Target: ATXN1; (-) strand; PAM type: YTN; PAM sequence: CTG
ctcttgatgaagtttctccc

SEQ ID NO: 192771 - DNA, 20 bp, Artificial Sequence
  Description of Artificial Sequence: Synthetic oligonucleotide
  Target: ATXN1; (-) strand; PAM type: YTN; PAM sequence: TTG
ctgctcttgatgaagtttct

SEQ ID NO: 192772 - DNA, 20 bp, Artificial Sequence
  Description of Artificial Sequence: Synthetic oligonucleotide
  Target: ATXN1; (-) strand; PAM type: YTN; PAM sequence: CTG
agttgctgctcttgatgaag

SEQ ID NO: 192773 - DNA, 20 bp, Artificial Sequence
  Description of Artificial Sequence: Synthetic oligonucleotide
  Target: ATXN1; (-) strand; PAM type: YTN; PAM sequence: CTG
gtggacagacacctgagttg

SEQ ID NO: 192774 - DNA, 20 bp, Artificial Sequence
  Description of Artificial Sequence: Synthetic oligonucleotide
  Target: ATXN1; (-) strand; PAM type: YTN; PAM sequence: CTC
tggtggacagacacctgagt

SEQ ID NO: 192775 - DNA, 20 bp, Artificial Sequence
  Description of Artificial Sequence: Synthetic oligonucleotide
  Target: ATXN1; (-) strand; PAM type: YTN; PAM sequence: TTA
ctctggtggacagacacctg

SEQ ID NO: 192776 - DNA, 20 bp, Artificial Sequence
  Description of Artificial Sequence: Synthetic oligonucleotide
  Target: ATXN1; (-) strand; PAM type: YTN; PAM sequence: CTT
actctggtggacagacacct

SEQ ID NO: 192777 - DNA, 20 bp, Artificial Sequence
  Description of Artificial Sequence: Synthetic oligonucleotide
  Target: ATXN1; (-) strand; PAM type: YTN; PAM sequence: CTG
cttactctggtggacagaca

SEQ ID NO: 192778 - DNA, 20 bp, Artificial Sequence
  Description of Artificial Sequence: Synthetic oligonucleotide
  Target: ATXN1; (-) strand; PAM type: YTN; PAM sequence: CTC
ctgcttactctggtggacag

SEQ ID NO: 192779 - DNA, 20 bp, Artificial Sequence
  Description of Artificial Sequence: Synthetic oligonucleotide
  Target: ATXN1; (-) strand; PAM type: YTN; PAM sequence: CTG
gtcagaacctcctgcttact

SEQ ID NO: 192780 - DNA, 20 bp, Artificial Sequence
  Description of Artificial Sequence: Synthetic oligonucleotide
  Target: ATXN1; (-) strand; PAM type: YTN; PAM sequence: TTG
ctggtcagaacctcctgctt

SEQ ID NO: 192781 - DNA, 20 bp, Artificial Sequence
  Description of Artificial Sequence: Synthetic oligonucleotide
  Target: ATXN1; (-) strand; PAM type: YTN; PAM sequence: CTT
gctggtcagaacctcctgct

SEQ ID NO: 192782 - DNA, 20 bp, Artificial Sequence
  Description of Artificial Sequence: Synthetic oligonucleotide
  Target: ATXN1; (-) strand; PAM type: YTN; PAM sequence: CTA
cccttgctggtcagaacctc

SEQ ID NO: 192783 - DNA, 20 bp, Artificial Sequence
  Description of Artificial Sequence: Synthetic oligonucleotide
  Target: ATXN1; (-) strand; PAM type: YTN; PAM sequence: CTA
ggctacccttgctggtcaga

SEQ ID NO: 192784 - DNA, 20 bp, Artificial Sequence
  Description of Artificial Sequence: Synthetic oligonucleotide
  Target: ATXN1; (-) strand; PAM type: YTN; PAM sequence: CTC
ccatgccctaggctaccctt

SEQ ID NO: 192785 - DNA, 20 bp, Artificial Sequence
  Description of Artificial Sequence: Synthetic oligonucleotide
  Target: ATXN1; (-) strand; PAM type: YTN; PAM sequence: CTC
cctcccatgccctaggctac

SEQ ID NO: 192786 - DNA, 20 bp, Artificial Sequence
  Description of Artificial Sequence: Synthetic oligonucleotide
  Target: ATXN1; (-) strand; PAM type: YTN; PAM sequence: CTC
cctccctcccatgccctagg

SEQ ID NO: 192787 - DNA, 20 bp, Artificial Sequence
  Description of Artificial Sequence: Synthetic oligonucleotide
  Target: ATXN1; (-) strand; PAM type: YTN; PAM sequence: CTG
tctccctccctcccatgccc

SEQ ID NO: 192788 - DNA, 20 bp, Artificial Sequence
  Description of Artificial Sequence: Synthetic oligonucleotide
  Target: ATXN1; (-) strand; PAM type: YTN; PAM sequence: TTA
aagtcactgtctccctccct

SEQ ID NO: 192789 - DNA, 20 bp, Artificial Sequence
  Description of Artificial Sequence: Synthetic oligonucleotide
  Target: ATXN1; (-) strand; PAM type: YTN; PAM sequence: TTT
aaagtcactgtctccctccc

SEQ ID NO: 192790 - DNA, 20 bp, Artificial Sequence
  Description of Artificial Sequence: Synthetic oligonucleotide
  Target: ATXN1; (-) strand; PAM type: YTN; PAM sequence: CTT
taaagtcactgtctccctcc

SEQ ID NO: 192791 - DNA, 20 bp, Artificial Sequence
  Description of Artificial Sequence: Synthetic oligonucleotide
  Target: ATXN1; (-) strand; PAM type: YTN; PAM sequence: CTG
ggcagaggtgcaggaagtgt

SEQ ID NO: 192792 - DNA, 20 bp, Artificial Sequence
  Description of Artificial Sequence: Synthetic oligonucleotide
  Target: ATXN1; (-) strand; PAM type: YTN; PAM sequence: CTC
tgggcagaggtgcaggaagt

SEQ ID NO: 192793 - DNA, 20 bp, Artificial Sequence
  Description of Artificial Sequence: Synthetic oligonucleotide
  Target: ATXN1; (-) strand; PAM type: YTN; PAM sequence: CTG
tggagcagccacctctgggc

SEQ ID NO: 192794 - DNA, 20 bp, Artificial Sequence
  Description of Artificial Sequence: Synthetic oligonucleotide
  Target: ATXN1; (-) strand; PAM type: YTN; PAM sequence: TTG
ggtctgtggagcagccacct

SEQ ID NO: 192795 - DNA, 20 bp, Artificial Sequence
  Description of Artificial Sequence: Synthetic oligonucleotide
  Target: ATXN1; (-) strand; PAM type: YTN; PAM sequence: CTT
gggtctgtggagcagccacc

SEQ ID NO: 192796 - DNA, 20 bp, Artificial Sequence
  Description of Artificial Sequence: Synthetic oligonucleotide
  Target: ATXN1; (-) strand; PAM type: YTN; PAM sequence: CTG
cttgggtctgtggagcagcc

SEQ ID NO: 192797 - DNA, 20 bp, Artificial Sequence
  Description of Artificial Sequence: Synthetic oligonucleotide
  Target: ATXN1; (-) strand; PAM type: YTN; PAM sequence: TTC
tgcttgggtctgtggagcag

SEQ ID NO: 192798 - DNA, 20 bp, Artificial Sequence
  Description of Artificial Sequence: Synthetic oligonucleotide
  Target: ATXN1; (-) strand; PAM type: YTN; PAM sequence: TTT
ctgcttgggtctgtggagca

SEQ ID NO: 192799 - DNA, 20 bp, Artificial Sequence
  Description of Artificial Sequence: Synthetic oligonucleotide
  Target: ATXN1; (-) strand; PAM type: YTN; PAM sequence: CTT
tctgcttgggtctgtggagc

SEQ ID NO: 192800 - DNA, 20 bp, Artificial Sequence
  Description of Artificial Sequence: Synthetic oligonucleotide
  Target: ATXN1; (-) strand; PAM type: YTN; PAM sequence: CTG
ctttctgcttgggtctgtgg

SEQ ID NO: 192801 - DNA, 20 bp, Artificial Sequence
  Description of Artificial Sequence: Synthetic oligonucleotide
  Target: ATXN1; (-) strand; PAM type: YTN; PAM sequence: TTG
tctgctttctgcttgggtct

SEQ ID NO: 192802 - DNA, 20 bp, Artificial Sequence
  Description of Artificial Sequence: Synthetic oligonucleotide
  Target: ATXN1; (-) strand; PAM type: YTN; PAM sequence: CTT
gtctgctttctgcttgggtc

SEQ ID NO: 192803 - DNA, 20 bp, Artificial Sequence
  Description of Artificial Sequence: Synthetic oligonucleotide
  Target: ATXN1; (-) strand; PAM type: YTN; PAM sequence: TTC
ttgtctgctttctgcttggg

SEQ ID NO: 192804 - DNA, 20 bp, Artificial Sequence
  Description of Artificial Sequence: Synthetic oligonucleotide
  Target: ATXN1; (-) strand; PAM type: YTN; PAM sequence: TTT
cttgtctgctttctgcttgg

SEQ ID NO: 192805 - DNA, 20 bp, Artificial Sequence
  Description of Artificial Sequence: Synthetic oligonucleotide
  Target: ATXN1; (-) strand; PAM type: YTN; PAM sequence: CTT
tcttgtctgctttctgcttg

SEQ ID NO: 192806 - DNA, 20 bp, Artificial Sequence
  Description of Artificial Sequence: Synthetic oligonucleotide
  Target: ATXN1; (-) strand; PAM type: YTN; PAM sequence: TTG
cctttcttgtctgctttctg

SEQ ID NO: 192807 - DNA, 20 bp, Artificial Sequence
  Description of Artificial Sequence: Synthetic oligonucleotide
  Target: ATXN1; (-) strand; PAM type: YTN; PAM sequence: CTT
gcctttcttgtctgctttct

SEQ ID NO: 192808 - DNA, 20 bp, Artificial Sequence
  Description of Artificial Sequence: Synthetic oligonucleotide
  Target: ATXN1; (-) strand; PAM type: YTN; PAM sequence: CTG
acatcttgcctttcttgtct

SEQ ID NO: 192809 - DNA, 20 bp, Artificial Sequence
  Description of Artificial Sequence: Synthetic oligonucleotide
  Target: ATXN1; (-) strand; PAM type: YTN; PAM sequence: TTC
ctgacatcttgcctttcttg

SEQ ID NO: 192810 - DNA, 20 bp, Artificial Sequence
  Description of Artificial Sequence: Synthetic oligonucleotide
  Target: ATXN1; (-) strand; PAM type: YTN; PAM sequence: CTG
ggagagaagagaattcctga

SEQ ID NO: 192811 - DNA, 20 bp, Artificial Sequence
  Description of Artificial Sequence: Synthetic oligonucleotide
  Target: ATXN1; (-) strand; PAM type: YTN; PAM sequence: CTA
ctgggagagaagagaattcc

SEQ ID NO: 192812 - DNA, 20 bp, Artificial Sequence
  Description of Artificial Sequence: Synthetic oligonucleotide
  Target: ATXN1; (-) strand; PAM type: YTN; PAM sequence: CTA
gaacaggaaagatgctactg

SEQ ID NO: 192813 - DNA, 20 bp, Artificial Sequence
  Description of Artificial Sequence: Synthetic oligonucleotide
  Target: ATXN1; (-) strand; PAM type: YTN; PAM sequence: TTA
ggctagaacaggaaagatgc

SEQ ID NO: 192814 - DNA, 20 bp, Artificial Sequence
  Description of Artificial Sequence: Synthetic oligonucleotide
  Target: ATXN1; (-) strand; PAM type: YTN; PAM sequence: TTT
aggctagaacaggaaagatg

SEQ ID NO: 192815 - DNA, 20 bp, Artificial Sequence
  Description of Artificial Sequence: Synthetic oligonucleotide
  Target: ATXN1; (-) strand; PAM type: YTN; PAM sequence: CTG
catttaggctagaacaggaa

SEQ ID NO: 192816 - DNA, 20 bp, Artificial Sequence
  Description of Artificial Sequence: Synthetic oligonucleotide
  Target: ATXN1; (-) strand; PAM type: YTN; PAM sequence: TTC
ccctgcatttaggctagaac

SEQ ID NO: 192817 - DNA, 20 bp, Artificial Sequence
  Description of Artificial Sequence: Synthetic oligonucleotide
  Target: ATXN1; (-) strand; PAM type: YTN; PAM sequence: TTT
cccctgcatttaggctagaa

SEQ ID NO: 192818 - DNA, 20 bp, Artificial Sequence
  Description of Artificial Sequence: Synthetic oligonucleotide
  Target: ATXN1; (-) strand; PAM type: YTN; PAM sequence: TTT
tcccctgcatttaggctaga

SEQ ID NO: 192819 - DNA, 20 bp, Artificial Sequence
  Description of Artificial Sequence: Synthetic oligonucleotide
  Target: ATXN1; (-) strand; PAM type: YTN; PAM sequence: TTT
ttcccctgcatttaggctag

SEQ ID NO: 192820 - DNA, 20 bp, Artificial Sequence
  Description of Artificial Sequence: Synthetic oligonucleotide
  Target: ATXN1; (-) strand; PAM type: YTN; PAM sequence: CTT
tttcccctgcatttaggcta

SEQ ID NO: 192821 - DNA, 20 bp, Artificial Sequence
  Description of Artificial Sequence: Synthetic oligonucleotide
  Target: ATXN1; (-) strand; PAM type: YTN; PAM sequence: CTC
agccccaaatctttttcccc

SEQ ID NO: 192822 - DNA, 20 bp, Artificial Sequence
  Description of Artificial Sequence: Synthetic oligonucleotide
  Target: ATXN1; (-) strand; PAM type: YTN; PAM sequence: TTC
agaggtgcctcagccccaaa

SEQ ID NO: 192823 - DNA, 20 bp, Artificial Sequence
  Description of Artificial Sequence: Synthetic oligonucleotide
  Target: ATXN1; (-) strand; PAM type: YTN; PAM sequence: CTG
ggattcagaggtgcctcagc

SEQ ID NO: 192824 - DNA, 20 bp, Artificial Sequence
  Description of Artificial Sequence: Synthetic oligonucleotide
  Target: ATXN1; (-) strand; PAM type: YTN; PAM sequence: CTC
cctgggattcagaggtgcct

SEQ ID NO: 192825 - DNA, 20 bp, Artificial Sequence
  Description of Artificial Sequence: Synthetic oligonucleotide
  Target: ATXN1; (-) strand; PAM type: YTN; PAM sequence: CTG
agctccctgggattcagagg

SEQ ID NO: 192826 - DNA, 20 bp, Artificial Sequence
  Description of Artificial Sequence: Synthetic oligonucleotide
  Target: ATXN1; (-) strand; PAM type: YTN; PAM sequence: CTC
ctgagctccctgggattcag

SEQ ID NO: 192827 - DNA, 20 bp, Artificial Sequence
  Description of Artificial Sequence: Synthetic oligonucleotide
  Target: ATXN1; (-) strand; PAM type: YTN; PAM sequence: CTC
caaggaatcagagtgagctc

SEQ ID NO: 192828 - DNA, 20 bp, Artificial Sequence
  Description of Artificial Sequence: Synthetic oligonucleotide
  Target: ATXN1; (-) strand; PAM type: YTN; PAM sequence: TTC
agctccaaggaatcagagtg

SEQ ID NO: 192829 - DNA, 20 bp, Artificial Sequence
  Description of Artificial Sequence: Synthetic oligonucleotide
  Target: ATXN1; (-) strand; PAM type: YTN; PAM sequence: CTT
cagctccaaggaatcagagt

SEQ ID NO: 192830 - DNA, 20 bp, Artificial Sequence
  Description of Artificial Sequence: Synthetic oligonucleotide
  Target: ATXN1; (-) strand; PAM type: YTN; PAM sequence: CTC
ttcagctccaaggaatcaga

SEQ ID NO: 192831 - DNA, 20 bp, Artificial Sequence
  Description of Artificial Sequence: Synthetic oligonucleotide
  Target: ATXN1; (-) strand; PAM type: YTN; PAM sequence: TTG
cacacagcaactcttcagct

SEQ ID NO: 192832 - DNA, 20 bp, Artificial Sequence
  Description of Artificial Sequence: Synthetic oligonucleotide
  Target: ATXN1; (-) strand; PAM type: YTN; PAM sequence: CTT
gcacacagcaactcttcagc

SEQ ID NO: 192833 - DNA, 20 bp, Artificial Sequence
  Description of Artificial Sequence: Synthetic oligonucleotide
  Target: ATXN1; (-) strand; PAM type: YTN; PAM sequence: CTG
tgtgcagcttgcacacagca

SEQ ID NO: 192834 - DNA, 20 bp, Artificial Sequence
  Description of Artificial Sequence: Synthetic oligonucleotide
  Target: ATXN1; (-) strand; PAM type: YTN; PAM sequence: CTA
cggctgtgtgcagcttgcac

SEQ ID NO: 192835 - DNA, 20 bp, Artificial Sequence
  Description of Artificial Sequence: Synthetic oligonucleotide
  Target: ATXN1; (-) strand; PAM type: YTN; PAM sequence: CTA
atgagagacgctacggctgt

SEQ ID NO: 192836 - DNA, 20 bp, Artificial Sequence
  Description of Artificial Sequence: Synthetic oligonucleotide
  Target: ATXN1; (-) strand; PAM type: YTN; PAM sequence: CTA
gtggtagaagagagtctaat

SEQ ID NO: 192837 - DNA, 20 bp, Artificial Sequence
  Description of Artificial Sequence: Synthetic oligonucleotide
  Target: ATXN1; (-) strand; PAM type: YTN; PAM sequence: CTC
tagtggtagaagagagtcta

SEQ ID NO: 192838 - DNA, 20 bp, Artificial Sequence
  Description of Artificial Sequence: Synthetic oligonucleotide
  Target: ATXN1; (-) strand; PAM type: YTN; PAM sequence: CTG
gctctagtggtagaagagag

SEQ ID NO: 192839 - DNA, 20 bp, Artificial Sequence
  Description of Artificial Sequence: Synthetic oligonucleotide
  Target: ATXN1; (-) strand; PAM type: YTN; PAM sequence: CTG
cctggctctagtggtagaag

SEQ ID NO: 192840 - DNA, 20 bp, Artificial Sequence
  Description of Artificial Sequence: Synthetic oligonucleotide
  Target: ATXN1; (-) strand; PAM type: YTN; PAM sequence: TTC
atagctgcctggctctagtg

SEQ ID NO: 192841 - DNA, 20 bp, Artificial Sequence
  Description of Artificial Sequence: Synthetic oligonucleotide
  Target: ATXN1; (-) strand; PAM type: YTN; PAM sequence: CTT
catagctgcctggctctagt

SEQ ID NO: 192842 - DNA, 20 bp, Artificial Sequence
  Description of Artificial Sequence: Synthetic oligonucleotide
  Target: ATXN1; (-) strand; PAM type: YTN; PAM sequence: CTC
ttcatagctgcctggctcta

SEQ ID NO: 192843 - DNA, 20 bp, Artificial Sequence
  Description of Artificial Sequence: Synthetic oligonucleotide
  Target: ATXN1; (-) strand; PAM type: YTN; PAM sequence: CTG
gtcatgtcactcttcatagc

SEQ ID NO: 192844 - DNA, 20 bp, Artificial Sequence
  Description of Artificial Sequence: Synthetic oligonucleotide
  Target: ATXN1; (-) strand; PAM type: YTN; PAM sequence: CTG
gctggtcatgtcactcttca

SEQ ID NO: 192845 - DNA, 20 bp, Artificial Sequence
  Description of Artificial Sequence: Synthetic oligonucleotide
  Target: ATXN1; (-) strand; PAM type: YTN; PAM sequence: CTG
gggctggctggtcatgtcac

SEQ ID NO: 192846 - DNA, 20 bp, Artificial Sequence
  Description of Artificial Sequence: Synthetic oligonucleotide
  Target: ATXN1; (-) strand; PAM type: YTN; PAM sequence: TTC
tggggctggctggtcatgtc

SEQ ID NO: 192847 - DNA, 20 bp, Artificial Sequence
  Description of Artificial Sequence: Synthetic oligonucleotide
  Target: ATXN1; (-) strand; PAM type: YTN; PAM sequence: TTT
ctggggctggctggtcatgt

SEQ ID NO: 192848 - DNA, 20 bp, Artificial Sequence
  Description of Artificial Sequence: Synthetic oligonucleotide
  Target: ATXN1; (-) strand; PAM type: YTN; PAM sequence: CTT
tctggggctggctggtcatg

SEQ ID NO: 192849 - DNA, 20 bp, Artificial Sequence
  Description of Artificial Sequence: Synthetic oligonucleotide
  Target: ATXN1; (-) strand; PAM type: YTN; PAM sequence: TTG
ctttctggggctggctggtc

SEQ ID NO: 192850 - DNA, 20 bp, Artificial Sequence
  Description of Artificial Sequence: Synthetic oligonucleotide
  Target: ATXN1; (-) strand; PAM type: YTN; PAM sequence: TTT
gctttctggggctggctggt

SEQ ID NO: 192851 - DNA, 20 bp, Artificial Sequence
  Description of Artificial Sequence: Synthetic oligonucleotide
  Target: ATXN1; (-) strand; PAM type: YTN; PAM sequence: TTT
tgctttctggggctggctgg

SEQ ID NO: 192852 - DNA, 20 bp, Artificial Sequence
  Description of Artificial Sequence: Synthetic oligonucleotide
  Target: ATXN1; (-) strand; PAM type: YTN; PAM sequence: TTC
ccgttttgctttctggggct

SEQ ID NO: 192853 - DNA, 20 bp, Artificial Sequence
  Description of Artificial Sequence: Synthetic oligonucleotide
  Target: ATXN1; (-) strand; PAM type: YTN; PAM sequence: TTG
cattcccgttttgctttctg

SEQ ID NO: 192854 - DNA, 20 bp, Artificial Sequence
  Description of Artificial Sequence: Synthetic oligonucleotide
  Target: ATXN1; (-) strand; PAM type: YTN; PAM sequence: TTG
attgcattcccgttttgctt

SEQ ID NO: 192855 - DNA, 20 bp, Artificial Sequence
  Description of Artificial Sequence: Synthetic oligonucleotide
  Target: ATXN1; (-) strand; PAM type: YTN; PAM sequence: TTG
atgggcgagaggaggcatgt

SEQ ID NO: 192856 - DNA, 20 bp, Artificial Sequence
  Description of Artificial Sequence: Synthetic oligonucleotide
  Target: ATXN1; (-) strand; PAM type: YTN; PAM sequence: TTT
gatgggcgagaggaggcatg

SEQ ID NO: 192857 - DNA, 20 bp, Artificial Sequence
  Description of Artificial Sequence: Synthetic oligonucleotide
  Target: ATXN1; (-) strand; PAM type: YTN; PAM sequence: CTG
tttgatgggcgagaggaggc

SEQ ID NO: 192858 - DNA, 20 bp, Artificial Sequence
  Description of Artificial Sequence: Synthetic oligonucleotide
  Target: ATXN1; (-) strand; PAM type: YTN; PAM sequence: TTG
ggagaaaggaggaagaaagc

SEQ ID NO: 192859 - DNA, 20 bp, Artificial Sequence
  Description of Artificial Sequence: Synthetic oligonucleotide
  Target: ATXN1; (-) strand; PAM type: YTN; PAM sequence: TTT
gggagaaaggaggaagaaag

SEQ ID NO: 192860 - DNA, 20 bp, Artificial Sequence
  Description of Artificial Sequence: Synthetic oligonucleotide
  Target: ATXN1; (-) strand; PAM type: YTN; PAM sequence: TTG
atttgggagaaaggaggaag

SEQ ID NO: 192861 - DNA, 20 bp, Artificial Sequence
  Description of Artificial Sequence: Synthetic oligonucleotide
  Target: ATXN1; (-) strand; PAM type: YTN; PAM sequence: TTT
gatttgggagaaaggaggaa

SEQ ID NO: 192862 - DNA, 20 bp, Artificial Sequence
  Description of Artificial Sequence: Synthetic oligonucleotide
  Target: ATXN1; (-) strand; PAM type: YTN; PAM sequence: TTT
tgatttgggagaaaggagga

SEQ ID NO: 192863 - DNA, 20 bp, Artificial Sequence
  Description of Artificial Sequence: Synthetic oligonucleotide
  Target: ATXN1; (-) strand; PAM type: YTN; PAM sequence: TTG
tgatccaacaagagggagtc

SEQ ID NO: 192864 - DNA, 20 bp, Artificial Sequence
  Description of Artificial Sequence: Synthetic oligonucleotide
  Target: ATXN1; (-) strand; PAM type: YTN; PAM sequence: TTT
gtgatccaacaagagggagt

SEQ ID NO: 192865 - DNA, 20 bp, Artificial Sequence
  Description of Artificial Sequence: Synthetic oligonucleotide
  Target: ATXN1; (-) strand; PAM type: YTN; PAM sequence: CTT
tgtgatccaacaagagggag

SEQ ID NO: 192866 - DNA, 20 bp, Artificial Sequence
  Description of Artificial Sequence: Synthetic oligonucleotide
  Target: ATXN1; (-) strand; PAM type: YTN; PAM sequence: CTC
tttgtgatccaacaagaggg

SEQ ID NO: 192867 - DNA, 20 bp, Artificial Sequence
  Description of Artificial Sequence: Synthetic oligonucleotide
  Target: ATXN1; (-) strand; PAM type: YTN; PAM sequence: TTG
ctctttgtgatccaacaaga

SEQ ID NO: 192868 - DNA, 20 bp, Artificial Sequence
  Description of Artificial Sequence: Synthetic oligonucleotide
  Target: ATXN1; (-) strand; PAM type: YTN; PAM sequence: CTT
gctctttgtgatccaacaag

SEQ ID NO: 192869 - DNA, 20 bp, Artificial Sequence
  Description of Artificial Sequence: Synthetic oligonucleotide
  Target: ATXN1; (-) strand; PAM type: YTN; PAM sequence: TTC
ttgctctttgtgatccaaca

SEQ ID NO: 192870 - DNA, 20 bp, Artificial Sequence
  Description of Artificial Sequence: Synthetic oligonucleotide
  Target: ATXN1; (-) strand; PAM type: YTN; PAM sequence: TTG
cgttcttgctctttgtgatc

SEQ ID NO: 192871 - DNA, 20 bp, Artificial Sequence
  Description of Artificial Sequence: Synthetic oligonucleotide
  Target: ATXN1; (-) strand; PAM type: YTN; PAM sequence: CTG
cacattgcgttcttgctctt

SEQ ID NO: 192872 - DNA, 20 bp, Artificial Sequence
  Description of Artificial Sequence: Synthetic oligonucleotide
  Target: ATXN1; (-) strand; PAM type: YTN; PAM sequence: CTA
ctgcacattgcgttcttgct

SEQ ID NO: 192873 - DNA, 20 bp, Artificial Sequence
  Description of Artificial Sequence: Synthetic oligonucleotide
  Target: ATXN1; (-) strand; PAM type: YTN; PAM sequence: CTC
cacaaggctactgcacattg

SEQ ID NO: 192874 - DNA, 20 bp, Artificial Sequence
  Description of Artificial Sequence: Synthetic oligonucleotide
  Target: ATXN1; (-) strand; PAM type: YTN; PAM sequence: TTA
agctccacaaggctactgca

SEQ ID NO: 192875 - DNA, 20 bp, Artificial Sequence
  Description of Artificial Sequence: Synthetic oligonucleotide
  Target: ATXN1; (-) strand; PAM type: YTN; PAM sequence: TTT
aagctccacaaggctactgc

SEQ ID NO: 192876 - DNA, 20 bp, Artificial Sequence
  Description of Artificial Sequence: Synthetic oligonucleotide
  Target: ATXN1; (-) strand; PAM type: YTN; PAM sequence: TTT
taagctccacaaggctactg

SEQ ID NO: 192877 - DNA, 20 bp, Artificial Sequence
  Description of Artificial Sequence: Synthetic oligonucleotide
  Target: ATXN1; (-) strand; PAM type: YTN; PAM sequence: TTT
ttaagctccacaaggctact

SEQ ID NO: 192878 - DNA, 20 bp, Artificial Sequence
  Description of Artificial Sequence: Synthetic oligonucleotide
  Target: ATXN1; (-) strand; PAM type: YTN; PAM sequence: TTT
tttaagctccacaaggctac

SEQ ID NO: 192879 - DNA, 20 bp, Artificial Sequence
  Description of Artificial Sequence: Synthetic oligonucleotide
  Target: ATXN1; (-) strand; PAM type: YTN; PAM sequence: TTT
ttttaagctccacaaggcta

SEQ ID NO: 192880 - DNA, 20 bp, Artificial Sequence
  Description of Artificial Sequence: Synthetic oligonucleotide
  Target: ATXN1; (-) strand; PAM type: YTN; PAM sequence: TTT
tttttaagctccacaaggct

SEQ ID NO: 192881 - DNA, 20 bp, Artificial Sequence
  Description of Artificial Sequence: Synthetic oligonucleotide
  Target: ATXN1; (-) strand; PAM type: YTN; PAM sequence: CTT
ttttttaagctccacaaggc

SEQ ID NO: 192882 - DNA, 20 bp, Artificial Sequence
  Description of Artificial Sequence: Synthetic oligonucleotide
  Target: ATXN1; (-) strand; PAM type: YTN; PAM sequence: TTC
ttttttttaagctccacaag

SEQ ID NO: 192883 - DNA, 20 bp, Artificial Sequence
  Description of Artificial Sequence: Synthetic oligonucleotide
  Target: ATXN1; (-) strand; PAM type: YTN; PAM sequence: TTT
cttttttttaagctccacaa

SEQ ID NO: 192884 - DNA, 20 bp, Artificial Sequence
  Description of Artificial Sequence: Synthetic oligonucleotide
  Target: ATXN1; (-) strand; PAM type: YTN; PAM sequence: TTT
tcttttttttaagctccaca

SEQ ID NO: 192885 - DNA, 20 bp, Artificial Sequence
  Description of Artificial Sequence: Synthetic oligonucleotide
  Target: ATXN1; (-) strand; PAM type: YTN; PAM sequence: TTT
ttcttttttttaagctccac

SEQ ID NO: 192886 - DNA, 20 bp, Artificial Sequence
  Description of Artificial Sequence: Synthetic oligonucleotide
  Target: ATXN1; (-) strand; PAM type: YTN; PAM sequence: TTG
tttttcttttttttaagctc

SEQ ID NO: 192887 - DNA, 20 bp, Artificial Sequence
  Description of Artificial Sequence: Synthetic oligonucleotide
  Target: ATXN1; (-) strand; PAM type: YTN; PAM sequence: TTT
gtttttcttttttttaagct

SEQ ID NO: 192888 - DNA, 20 bp, Artificial Sequence
  Description of Artificial Sequence: Synthetic oligonucleotide
  Target: ATXN1; (-) strand; PAM type: YTN; PAM sequence: TTT
tgtttttcttttttttaagc

SEQ ID NO: 192889 - DNA, 20 bp, Artificial Sequence
  Description of Artificial Sequence: Synthetic oligonucleotide
  Target: ATXN1; (-) strand; PAM type: YTN; PAM sequence: TTT
ttgtttttcttttttttaag

SEQ ID NO: 192890 - DNA, 20 bp, Artificial Sequence
  Description of Artificial Sequence: Synthetic oligonucleotide
  Target: ATXN1; (-) strand; PAM type: YTN; PAM sequence: TTT
tttgtttttcttttttttaa

SEQ ID NO: 192891 - DNA, 20 bp, Artificial Sequence
  Description of Artificial Sequence: Synthetic oligonucleotide
  Target: ATXN1; (-) strand; PAM type: YTN; PAM sequence: TTT
ttttgtttttctttttttta

SEQ ID NO: 192892 - DNA, 20 bp, Artificial Sequence
  Description of Artificial Sequence: Synthetic oligonucleotide
  Target: ATXN1; (-) strand; PAM type: YTN; PAM sequence: CTT
tttttgtttttctttttttt

SEQ ID NO: 192893 - DNA, 20 bp, Artificial Sequence
  Description of Artificial Sequence: Synthetic oligonucleotide
  Target: ATXN1; (-) strand; PAM type: YTN; PAM sequence: CTG
acagtctttttttgtttttc

SEQ ID NO: 192894 - DNA, 20 bp, Artificial Sequence
  Description of Artificial Sequence: Synthetic oligonucleotide
  Target: ATXN1; (-) strand; PAM type: YTN; PAM sequence: TTG
caagctgacagtcttttttt

SEQ ID NO: 192895 - DNA, 20 bp, Artificial Sequence
  Description of Artificial Sequence: Synthetic oligonucleotide
  Target: ATXN1; (-) strand; PAM type: YTN; PAM sequence: CTT
gcaagctgacagtctttttt

SEQ ID NO: 192896 - DNA, 20 bp, Artificial Sequence
  Description of Artificial Sequence: Synthetic oligonucleotide
  Target: ATXN1; (-) strand; PAM type: YTN; PAM sequence: TTC
ttgcaagctgacagtctttt

SEQ ID NO: 192897 - DNA, 20 bp, Artificial Sequence
  Description of Artificial Sequence: Synthetic oligonucleotide
  Target: ATXN1; (-) strand; PAM type: YTN; PAM sequence: TTG
gtaaaattcttgcaagctga

SEQ ID NO: 192898 - DNA, 20 bp, Artificial Sequence
  Description of Artificial Sequence: Synthetic oligonucleotide
  Target: ATXN1; (-) strand; PAM type: YTN; PAM sequence: TTG
ccggttggtaaaattcttgc

SEQ ID NO: 192899 - DNA, 20 bp, Artificial Sequence
  Description of Artificial Sequence: Synthetic oligonucleotide
  Target: ATXN1; (-) strand; PAM type: YTN; PAM sequence: CTT
gccggttggtaaaattcttg

SEQ ID NO: 192900 - DNA, 20 bp, Artificial Sequence
  Description of Artificial Sequence: Synthetic oligonucleotide
  Target: ATXN1; (-) strand; PAM type: YTN; PAM sequence: CTG
ggacatgaggggtaatgtct

SEQ ID NO: 192901 - DNA, 20 bp, Artificial Sequence
  Description of Artificial Sequence: Synthetic oligonucleotide
  Target: ATXN1; (-) strand; PAM type: YTN; PAM sequence: CTC
tgggacatgaggggtaatgt

SEQ ID NO: 192902 - DNA, 20 bp, Artificial Sequence
  Description of Artificial Sequence: Synthetic oligonucleotide
  Target: ATXN1; (-) strand; PAM type: YTN; PAM sequence: CTA
tggctctgggacatgagggg

SEQ ID NO: 192903 - DNA, 20 bp, Artificial Sequence
  Description of Artificial Sequence: Synthetic oligonucleotide
  Target: ATXN1; (-) strand; PAM type: YTN; PAM sequence: CTC
cctatggctctgggacatga

SEQ ID NO: 192904 - DNA, 20 bp, Artificial Sequence
  Description of Artificial Sequence: Synthetic oligonucleotide
  Target: ATXN1; (-) strand; PAM type: YTN; PAM sequence: CTC
agacgcagcctccctatggc

SEQ ID NO: 192905 - DNA, 20 bp, Artificial Sequence
  Description of Artificial Sequence: Synthetic oligonucleotide
  Target: ATXN1; (-) strand; PAM type: YTN; PAM sequence: CTC
tcagacgcagcctccctatg

SEQ ID NO: 192906 - DNA, 20 bp, Artificial Sequence
  Description of Artificial Sequence: Synthetic oligonucleotide
  Target: ATXN1; (-) strand; PAM type: YTN; PAM sequence: CTC
gctctcagacgcagcctccc

SEQ ID NO: 192907 - DNA, 20 bp, Artificial Sequence
  Description of Artificial Sequence: Synthetic oligonucleotide
  Target: ATXN1; (-) strand; PAM type: YTN; PAM sequence: CTG
gtgtgcctcgctctcagacg

SEQ ID NO: 192908 - DNA, 20 bp, Artificial Sequence
  Description of Artificial Sequence: Synthetic oligonucleotide
  Target: ATXN1; (-) strand; PAM type: YTN; PAM sequence: CTG
ctggtgtgcctcgctctcag

SEQ ID NO: 192909 - DNA, 20 bp, Artificial Sequence
  Description of Artificial Sequence: Synthetic oligonucleotide
  Target: ATXN1; (-) strand; PAM type: YTN; PAM sequence: CTC
ctgctggtgtgcctcgctct

SEQ ID NO: 192910 - DNA, 20 bp, Artificial Sequence
  Description of Artificial Sequence: Synthetic oligonucleotide
  Target: ATXN1; (-) strand; PAM type: YTN; PAM sequence: CTC
tcctgctggtgtgcctcgct

SEQ ID NO: 192911 - DNA, 20 bp, Artificial Sequence
  Description of Artificial Sequence: Synthetic oligonucleotide
  Target: ATXN1; (-) strand; PAM type: YTN; PAM sequence: CTC
tctcctgctggtgtgcctcg

SEQ ID NO: 192912 - DNA, 20 bp, Artificial Sequence
  Description of Artificial Sequence: Synthetic oligonucleotide
  Target: ATXN1; (-) strand; PAM type: YTN; PAM sequence: CTG
tctctctcctgctggtgtgc

SEQ ID NO: 192913 - DNA, 20 bp, Artificial Sequence
  Description of Artificial Sequence: Synthetic oligonucleotide
  Target: ATXN1; (-) strand; PAM type: YTN; PAM sequence: TTC
accatccacccatgagaact

SEQ ID NO: 192914 - DNA, 20 bp, Artificial Sequence
  Description of Artificial Sequence: Synthetic oligonucleotide
  Target: ATXN1; (-) strand; PAM type: YTN; PAM sequence: TTG
ataagagagggttcaccatc

SEQ ID NO: 192915 - DNA, 20 bp, Artificial Sequence
  Description of Artificial Sequence: Synthetic oligonucleotide
  Target: ATXN1; (-) strand; PAM type: YTN; PAM sequence: CTG
ttgataagagagggttcacc

SEQ ID NO: 192916 - DNA, 20 bp, Artificial Sequence
  Description of Artificial Sequence: Synthetic oligonucleotide
  Target: ATXN1; (-) strand; PAM type: YTN; PAM sequence: CTA
gctgttgataagagagggtt

SEQ ID NO: 192917 - DNA, 20 bp, Artificial Sequence
  Description of Artificial Sequence: Synthetic oligonucleotide
  Target: ATXN1; (-) strand; PAM type: YTN; PAM sequence: CTG
agtctagctgttgataagag

SEQ ID NO: 192918 - DNA, 20 bp, Artificial Sequence
  Description of Artificial Sequence: Synthetic oligonucleotide
  Target: ATXN1; (-) strand; PAM type: YTN; PAM sequence: TTG
ctgagtctagctgttgataa

SEQ ID NO: 192919 - DNA, 20 bp, Artificial Sequence
  Description of Artificial Sequence: Synthetic oligonucleotide
  Target: ATXN1; (-) strand; PAM type: YTN; PAM sequence: TTG
aatgtgggcgagaaagtaaa

SEQ ID NO: 192920 - DNA, 20 bp, Artificial Sequence
  Description of Artificial Sequence: Synthetic oligonucleotide
  Target: ATXN1; (-) strand; PAM type: YTN; PAM sequence: TTT
gaatgtgggcgagaaagtaa

SEQ ID NO: 192921 - DNA, 20 bp, Artificial Sequence
  Description of Artificial Sequence: Synthetic oligonucleotide
  Target: ATXN1; (-) strand; PAM type: YTN; PAM sequence: CTA
gtggagataaaatggtttga

SEQ ID NO: 192922 - DNA, 20 bp, Artificial Sequence
  Description of Artificial Sequence: Synthetic oligonucleotide
  Target: ATXN1; (-) strand; PAM type: YTN; PAM sequence: CTC
tagtggagataaaatggttt

SEQ ID NO: 192923 - DNA, 20 bp, Artificial Sequence
  Description of Artificial Sequence: Synthetic oligonucleotide
  Target: ATXN1; (-) strand; PAM type: YTN; PAM sequence: CTG
gccctctagtggagataaaa

SEQ ID NO: 192924 - DNA, 20 bp, Artificial Sequence
  Description of Artificial Sequence: Synthetic oligonucleotide
  Target: ATXN1; (-) strand; PAM type: YTN; PAM sequence: CTC
catcctggccctctagtgga

SEQ ID NO: 192925 - DNA, 20 bp, Artificial Sequence
  Description of Artificial Sequence: Synthetic oligonucleotide
  Target: ATXN1; (-) strand; PAM type: YTN; PAM sequence: TTC
atctccatcctggccctcta

SEQ ID NO: 192926 - DNA, 20 bp, Artificial Sequence
  Description of Artificial Sequence: Synthetic oligonucleotide
  Target: ATXN1; (-) strand; PAM type: YTN; PAM sequence: TTT
catctccatcctggccctct

SEQ ID NO: 192927 - DNA, 20 bp, Artificial Sequence
  Description of Artificial Sequence: Synthetic oligonucleotide
  Target: ATXN1; (-) strand; PAM type: YTN; PAM sequence: CTG
aaatttcatctccatcctgg

SEQ ID NO: 192928 - DNA, 20 bp, Artificial Sequence
  Description of Artificial Sequence: Synthetic oligonucleotide
  Target: ATXN1; (-) strand; PAM type: YTN; PAM sequence: CTG
ccaggctgaaatttcatctc

SEQ ID NO: 192929 - DNA, 20 bp, Artificial Sequence
  Description of Artificial Sequence: Synthetic oligonucleotide
  Target: ATXN1; (-) strand; PAM type: YTN; PAM sequence: TTA
aatcagcagcaaaactgcca

SEQ ID NO: 192930 - DNA, 20 bp, Artificial Sequence
  Description of Artificial Sequence: Synthetic oligonucleotide
  Target: ATXN1; (-) strand; PAM type: YTN; PAM sequence: CTT
aaatcagcagcaaaactgcc

SEQ ID NO: 192931 - DNA, 20 bp, Artificial Sequence
  Description of Artificial Sequence: Synthetic oligonucleotide
  Target: ATXN1; (-) strand; PAM type: YTN; PAM sequence: TTA
ggatcaaatcttaaatcagc

SEQ ID NO: 192932 - DNA, 20 bp, Artificial Sequence
  Description of Artificial Sequence: Synthetic oligonucleotide
  Target: ATXN1; (-) strand; PAM type: YTN; PAM sequence: TTT
aggatcaaatcttaaatcag

SEQ ID NO: 192933 - DNA, 20 bp, Artificial Sequence
  Description of Artificial Sequence: Synthetic oligonucleotide
  Target: ATXN1; (-) strand; PAM type: YTN; PAM sequence: CTC
cccaaggtttaggatcaaat

SEQ ID NO: 192934 - DNA, 20 bp, Artificial Sequence
  Description of Artificial Sequence: Synthetic oligonucleotide
  Target: ATXN1; (-) strand; PAM type: YTN; PAM sequence: CTC
cctccccaaggtttaggatc

SEQ ID NO: 192935 - DNA, 20 bp, Artificial Sequence
  Description of Artificial Sequence: Synthetic oligonucleotide
  Target: ATXN1; (-) strand; PAM type: YTN; PAM sequence: TTC
gagccctccctccccaaggt

SEQ ID NO: 192936 - DNA, 20 bp, Artificial Sequence
  Description of Artificial Sequence: Synthetic oligonucleotide
  Target: ATXN1; (-) strand; PAM type: YTN; PAM sequence: CTT
cgagccctccctccccaagg

SEQ ID NO: 192937 - DNA, 20 bp, Artificial Sequence
  Description of Artificial Sequence: Synthetic oligonucleotide
  Target: ATXN1; (-) strand; PAM type: YTN; PAM sequence: TTC
cttcgagccctccctcccca

SEQ ID NO: 192938 - DNA, 20 bp, Artificial Sequence
  Description of Artificial Sequence: Synthetic oligonucleotide
  Target: ATXN1; (-) strand; PAM type: YTN; PAM sequence: CTT
ccttcgagccctccctcccc

SEQ ID NO: 192939 - DNA, 20 bp, Artificial Sequence
  Description of Artificial Sequence: Synthetic oligonucleotide
  Target: ATXN1; (-) strand; PAM type: YTN; PAM sequence: CTC
ccttccttcgagccctccct

SEQ ID NO: 192940 - DNA, 20 bp, Artificial Sequence
  Description of Artificial Sequence: Synthetic oligonucleotide
  Target: ATXN1; (-) strand; PAM type: YTN; PAM sequence: TTA
accccacctcccttccttcg

SEQ ID NO: 192941 - DNA, 20 bp, Artificial Sequence
  Description of Artificial Sequence: Synthetic oligonucleotide
  Target: ATXN1; (-) strand; PAM type: YTN; PAM sequence: CTT
aaccccacctcccttccttc

SEQ ID NO: 192942 - DNA, 20 bp, Artificial Sequence
  Description of Artificial Sequence: Synthetic oligonucleotide
  Target: ATXN1; (-) strand; PAM type: YTN; PAM sequence: TTG
ccttaaccccacctcccttc

SEQ ID NO: 192943 - DNA, 20 bp, Artificial Sequence
  Description of Artificial Sequence: Synthetic oligonucleotide
  Target: ATXN1; (-) strand; PAM type: YTN; PAM sequence: CTG
agttgccttaaccccacctc

SEQ ID NO: 192944 - DNA, 20 bp, Artificial Sequence
  Description of Artificial Sequence: Synthetic oligonucleotide
  Target: ATXN1; (-) strand; PAM type: YTN; PAM sequence: CTG
ggacccagatatgcccacgt

SEQ ID NO: 192945 - DNA, 20 bp, Artificial Sequence
  Description of Artificial Sequence: Synthetic oligonucleotide
  Target: ATXN1; (-) strand; PAM type: YTN; PAM sequence: TTG
cctgggacccagatatgccc

SEQ ID NO: 192946 - DNA, 20 bp, Artificial Sequence
  Description of Artificial Sequence: Synthetic oligonucleotide
  Target: ATXN1; (-) strand; PAM type: YTN; PAM sequence: CTG
tggcagaacccagggattgc

SEQ ID NO: 192947 - DNA, 20 bp, Artificial Sequence
  Description of Artificial Sequence: Synthetic oligonucleotide
  Target: ATXN1; (-) strand; PAM type: YTN; PAM sequence: TTA
ataacagtgtcatcccatga

SEQ ID NO: 192948 - DNA, 20 bp, Artificial Sequence
  Description of Artificial Sequence: Synthetic oligonucleotide
  Target: ATXN1; (-) strand; PAM type: YTN; PAM sequence: TTT
aataacagtgtcatcccatg

SEQ ID NO: 192949 - DNA, 20 bp, Artificial Sequence
  Description of Artificial Sequence: Synthetic oligonucleotide
  Target: ATXN1; (-) strand; PAM type: YTN; PAM sequence: TTT
taataacagtgtcatcccat

SEQ ID NO: 192950 - DNA, 20 bp, Artificial Sequence
  Description of Artificial Sequence: Synthetic oligonucleotide
  Target: ATXN1; (-) strand; PAM type: YTN; PAM sequence: TTA
ttttaataacagtgtcatcc

SEQ ID NO: 192951 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgccgtggatatta

SEQ ID NO: 192952 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgccgtgga

SEQ ID NO: 192953 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgccgtgg

SEQ ID NO: 192954 - DNA, 20 bp, Artificial Sequence
  Description of Artificial Sequence: Synthetic oligonucleotide
  Target: ATXN1; (-) strand; PAM type: YTN; PAM sequence: CTG
cccaccttggcctcccaaag

SEQ ID NO: 192955 - DNA, 20 bp, Artificial Sequence
  Description of Artificial Sequence: Synthetic oligonucleotide
  Target: ATXN1; (-) strand; PAM type: YTN; PAM sequence: CTC
gtgatctgcccaccttggcc

SEQ ID NO: 192956 - DNA, 20 bp, Artificial Sequence
  Description of Artificial Sequence: Synthetic oligonucleotide
  Target: ATXN1; (-) strand; PAM type: YTN; PAM sequence: TTG
acctcgtgatctgcccacct

SEQ ID NO: 192957 - DNA, 20 bp, Artificial Sequence
  Description of Artificial Sequence: Synthetic oligonucleotide
  Target: ATXN1; (-) strand; PAM type: YTN; PAM sequence: CTT
gacctcgtgatctgcccacc

SEQ ID NO: 192958 - DNA, 20 bp, Artificial Sequence
  Description of Artificial Sequence: Synthetic oligonucleotide
  Target: ATXN1; (-) strand; PAM type: YTN; PAM sequence: CTC
ttgacctcgtgatctgccca

SEQ ID NO: 192959 - DNA, 20 bp, Artificial Sequence
  Description of Artificial Sequence: Synthetic oligonucleotide
  Target: ATXN1; (-) strand; PAM type: YTN; PAM sequence: CTC
gatctcttgacctcgtgatc

SEQ ID NO: 192960 - DNA, 20 bp, Artificial Sequence
  Description of Artificial Sequence: Synthetic oligonucleotide
  Target: ATXN1; (-) strand; PAM type: YTN; PAM sequence: CTG
gtctcgatctcttgacctcg

SEQ ID NO: 192961 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcgatctc

SEQ ID NO: 192962 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctggt

SEQ ID NO: 192963 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctgg

SEQ ID NO: 192964 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcacca

SEQ ID NO: 192965 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcacc

SEQ ID NO: 192966 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 192967 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 192968 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 192969 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 192970 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 192971 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 192972 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagat

SEQ ID NO: 192973 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttagtag

SEQ ID NO: 192974 - DNA, 20 bp, Artificial Sequence
  Description of Artificial Sequence: Synthetic oligonucleotide
  Target: ATXN1; (-) strand; PAM type: YTN; PAM sequence: CTG
gctaattttttgtattttta

SEQ ID NO: 192975 - DNA, 20 bp, Artificial Sequence
  Description of Artificial Sequence: Synthetic oligonucleotide
  Target: ATXN1; (-) strand; PAM type: YTN; PAM sequence: CTC
ccaccaccacgcctggctaa

SEQ ID NO: 192976 - DNA, 20 bp, Artificial Sequence
  Description of Artificial Sequence: Synthetic oligonucleotide
  Target: ATXN1; (-) strand; PAM type: YTN; PAM sequence: TTA
cagcctcccaccaccacgcc

SEQ ID NO: 192977 - DNA, 20 bp, Artificial Sequence
  Description of Artificial Sequence: Synthetic oligonucleotide
  Target: ATXN1; (-) strand; PAM type: YTN; PAM sequence: CTG
ggattacagcctcccaccac

SEQ ID NO: 192978 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 192979 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 192980 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 192981 - DNA, 20 bp, Artificial Sequence
  Description of Artificial Sequence: Synthetic oligonucleotide
  Target: ATXN1; (-) strand; PAM type: YTN; PAM sequence: TTC
acctgcctcagcctcccaag

SEQ ID NO: 192982 - DNA, 20 bp, Artificial Sequence
  Description of Artificial Sequence: Synthetic oligonucleotide
  Target: ATXN1; (-) strand; PAM type: YTN; PAM sequence: TTC
aagtgattcacctgcctcag

SEQ ID NO: 192983 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgattcacc

SEQ ID NO: 192984 - DNA, 20 bp, Artificial Sequence
  Description of Artificial Sequence: Synthetic oligonucleotide
  Target: ATXN1; (-) strand; PAM type: YTN; PAM sequence: CTG
cctcccgggttcaagtgatt

SEQ ID NO: 192985 - DNA, 20 bp, Artificial Sequence
  Description of Artificial Sequence: Synthetic oligonucleotide
  Target: ATXN1; (-) strand; PAM type: YTN; PAM sequence: CTC
tgcctcccgggttcaagtga

SEQ ID NO: 192986 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccgggtt

SEQ ID NO: 192987 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctcccg

SEQ ID NO: 192988 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctctgcc

SEQ ID NO: 192989 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgtgatctc

SEQ ID NO: 192990 - DNA, 20 bp, Artificial Sequence
  Description of Artificial Sequence: Synthetic oligonucleotide
  Target: ATXN1; (-) strand; PAM type: YTN; PAM sequence: CTG
tcgccaggctggagtgcagt

SEQ ID NO: 192991 - DNA, 20 bp, Artificial Sequence
  Description of Artificial Sequence: Synthetic oligonucleotide
  Target: ATXN1; (-) strand; PAM type: YTN; PAM sequence: CTC
tgtcgccaggctggagtgca

SEQ ID NO: 192992 - DNA, 20 bp, Artificial Sequence
  Description of Artificial Sequence: Synthetic oligonucleotide
  Target: ATXN1; (-) strand; PAM type: YTN; PAM sequence: CTC
gctctgtcgccaggctggag

SEQ ID NO: 192993 - DNA, 20 bp, Artificial Sequence
  Description of Artificial Sequence: Synthetic oligonucleotide
  Target: ATXN1; (-) strand; PAM type: YTN; PAM sequence: TTG
agacagagcctcgctctgtc

SEQ ID NO: 192994 - DNA, 20 bp, Artificial Sequence
  Description of Artificial Sequence: Synthetic oligonucleotide
  Target: ATXN1; (-) strand; PAM type: YTN; PAM sequence: TTT
gagacagagcctcgctctgt

SEQ ID NO: 192995 - DNA, 20 bp, Artificial Sequence
  Description of Artificial Sequence: Synthetic oligonucleotide
  Target: ATXN1; (-) strand; PAM type: YTN; PAM sequence: TTT
tgagacagagcctcgctctg

SEQ ID NO: 192996 - DNA, 20 bp, Artificial Sequence
  Description of Artificial Sequence: Synthetic oligonucleotide
  Target: ATXN1; (-) strand; PAM type: YTN; PAM sequence: TTA
ttttgagacagagcctcgct

SEQ ID NO: 192997 - DNA, 20 bp, Artificial Sequence
  Description of Artificial Sequence: Synthetic oligonucleotide
  Target: ATXN1; (-) strand; PAM type: YTN; PAM sequence: TTA
ttattttgagacagagcctc

SEQ ID NO: 192998 - DNA, 20 bp, Artificial Sequence
  Description of Artificial Sequence: Synthetic oligonucleotide
  Target: ATXN1; (-) strand; PAM type: YTN; PAM sequence: TTA
ttattattttgagacagagc

SEQ ID NO: 192999 - DNA, 20 bp, Artificial Sequence
  Description of Artificial Sequence: Synthetic oligonucleotide
  Target: ATXN1; (-) strand; PAM type: YTN; PAM sequence: TTA
ttattattattttgagacag

SEQ ID NO: 193000 - DNA, 20 bp, Artificial Sequence
  Description of Artificial Sequence: Synthetic oligonucleotide
  Target: ATXN1; (-) strand; PAM type: YTN; PAM sequence: TTA
ttattattattattttgaga

SEQ ID NO: 193001 - DNA, 20 bp, Artificial Sequence
  Description of Artificial Sequence: Synthetic oligonucleotide
  Target: ATXN1; (-) strand; PAM type: YTN; PAM sequence: TTA
ttattattattattattttg

SEQ ID NO: 193002 - DNA, 20 bp, Artificial Sequence
  Description of Artificial Sequence: Synthetic oligonucleotide
  Target: ATXN1; (-) strand; PAM type: YTN; PAM sequence: TTA
attattattattattattat

SEQ ID NO: 193003 - DNA, 20 bp, Artificial Sequence
  Description of Artificial Sequence: Synthetic oligonucleotide
  Target: ATXN1; (-) strand; PAM type: YTN; PAM sequence: TTA
ttaattattattattattat

SEQ ID NO: 193004 - DNA, 20 bp, Artificial Sequence
  Description of Artificial Sequence: Synthetic oligonucleotide
  Target: ATXN1; (-) strand; PAM type: YTN; PAM sequence: TTA
ttattaattattattattat

SEQ ID NO: 193005 - DNA, 20 bp, Artificial Sequence
  Description of Artificial Sequence: Synthetic oligonucleotide
  Target: ATXN1; (-) strand; PAM type: YTN; PAM sequence: TTA
ttattattaattattattat

SEQ ID NO: 193006 - DNA, 20 bp, Artificial Sequence
  Description of Artificial Sequence: Synthetic oligonucleotide
  Target: ATXN1; (-) strand; PAM type: YTN; PAM sequence: TTA
tggatattattattattaat

SEQ ID NO: 193007 - DNA, 20 bp, Artificial Sequence
  Description of Artificial Sequence: Synthetic oligonucleotide
  Target: ATXN1; (-) strand; PAM type: YTN; PAM sequence: TTT
atggatattattattattaa

SEQ ID NO: 193008 - DNA, 20 bp, Artificial Sequence
  Description of Artificial Sequence: Synthetic oligonucleotide
  Target: ATXN1; (-) strand; PAM type: YTN; PAM sequence: CTT
tatggatattattattatta

SEQ ID NO: 193009 - DNA, 20 bp, Artificial Sequence
  Description of Artificial Sequence: Synthetic oligonucleotide
  Target: ATXN1; (-) strand; PAM type: YTN; PAM sequence: TTG
tactttatggatattattat

SEQ ID NO: 193010 - DNA, 20 bp, Artificial Sequence
  Description of Artificial Sequence: Synthetic oligonucleotide
  Target: ATXN1; (-) strand; PAM type: YTN; PAM sequence: CTG
tgttgtactttatggatatt

SEQ ID NO: 193011 - DNA, 20 bp, Artificial Sequence
  Description of Artificial Sequence: Synthetic oligonucleotide
  Target: ATXN1; (-) strand; PAM type: YTN; PAM sequence: CTA
ccgaaggtgtcctgtgttgt

SEQ ID NO: 193012 - DNA, 20 bp, Artificial Sequence
  Description of Artificial Sequence: Synthetic oligonucleotide
  Target: ATXN1; (-) strand; PAM type: YTN; PAM sequence: CTA
ggtggctaccgaaggtgtcc

SEQ ID NO: 193013 - DNA, 20 bp, Artificial Sequence
  Description of Artificial Sequence: Synthetic oligonucleotide
  Target: ATXN1; (-) strand; PAM type: YTN; PAM sequence: TTG
agcctaggtggctaccgaag

SEQ ID NO: 193014 - DNA, 20 bp, Artificial Sequence
  Description of Artificial Sequence: Synthetic oligonucleotide
  Target: ATXN1; (-) strand; PAM type: YTN; PAM sequence: TTT
gagcctaggtggctaccgaa

SEQ ID NO: 193015 - DNA, 20 bp, Artificial Sequence
  Description of Artificial Sequence: Synthetic oligonucleotide
  Target: ATXN1; (-) strand; PAM type: YTN; PAM sequence: TTT
tgagcctaggtggctaccga

SEQ ID NO: 193016 - DNA, 20 bp, Artificial Sequence
  Description of Artificial Sequence: Synthetic oligonucleotide
  Target: ATXN1; (-) strand; PAM type: YTN; PAM sequence: TTT
ttgagcctaggtggctaccg

SEQ ID NO: 193017 - DNA, 20 bp, Artificial Sequence
  Description of Artificial Sequence: Synthetic oligonucleotide
  Target: ATXN1; (-) strand; PAM type: YTN; PAM sequence: TTA
gaaacaatgaaaggaatgga

SEQ ID NO: 193018 - DNA, 20 bp, Artificial Sequence
  Description of Artificial Sequence: Synthetic oligonucleotide
  Target: ATXN1; (-) strand; PAM type: YTN; PAM sequence: CTG
ggtattagaaacaatgaaag

SEQ ID NO: 193019 - DNA, 20 bp, Artificial Sequence
  Description of Artificial Sequence: Synthetic oligonucleotide
  Target: ATXN1; (-) strand; PAM type: YTN; PAM sequence: CTG
agcaactgggtattagaaac

SEQ ID NO: 193020 - DNA, 20 bp, Artificial Sequence
  Description of Artificial Sequence: Synthetic oligonucleotide
  Target: ATXN1; (-) strand; PAM type: YTN; PAM sequence: TTG
aacaaactgagcaactgggt

SEQ ID NO: 193021 - DNA, 20 bp, Artificial Sequence
  Description of Artificial Sequence: Synthetic oligonucleotide
  Target: ATXN1; (-) strand; PAM type: YTN; PAM sequence: CTA
caaagaaagagttgaacaaa

SEQ ID NO: 193022 - DNA, 20 bp, Artificial Sequence
  Description of Artificial Sequence: Synthetic oligonucleotide
  Target: ATXN1; (-) strand; PAM type: YTN; PAM sequence: TTA
caaagggaccgatgtggagg

SEQ ID NO: 193023 - DNA, 20 bp, Artificial Sequence
  Description of Artificial Sequence: Synthetic oligonucleotide
  Target: ATXN1; (-) strand; PAM type: YTN; PAM sequence: CTG
tgggcgtgttacaaagggac

SEQ ID NO: 193024 - DNA, 20 bp, Artificial Sequence
  Description of Artificial Sequence: Synthetic oligonucleotide
  Target: ATXN1; (-) strand; PAM type: YTN; PAM sequence: CTA
ctgtgggcgtgttacaaagg

SEQ ID NO: 193025 - DNA, 20 bp, Artificial Sequence
  Description of Artificial Sequence: Synthetic oligonucleotide
  Target: ATXN1; (-) strand; PAM type: YTN; PAM sequence: TTG
agaactactgtgggcgtgtt

SEQ ID NO: 193026 - DNA, 20 bp, Artificial Sequence
  Description of Artificial Sequence: Synthetic oligonucleotide
  Target: ATXN1; (-) strand; PAM type: YTN; PAM sequence: TTT
gagaactactgtgggcgtgt

SEQ ID NO: 193027 - DNA, 20 bp, Artificial Sequence
  Description of Artificial Sequence: Synthetic oligonucleotide
  Target: ATXN1; (-) strand; PAM type: YTN; PAM sequence: TTT
tgagaactactgtgggcgtg

SEQ ID NO: 193028 - DNA, 20 bp, Artificial Sequence
  Description of Artificial Sequence: Synthetic oligonucleotide
  Target: ATXN1; (-) strand; PAM type: YTN; PAM sequence: TTG
caggcgtaaggagataaggt

SEQ ID NO: 193029 - DNA, 20 bp, Artificial Sequence
  Description of Artificial Sequence: Synthetic oligonucleotide
  Target: ATXN1; (-) strand; PAM type: YTN; PAM sequence: CTG
gggtcccagagggaaggcag

SEQ ID NO: 193030 - DNA, 20 bp, Artificial Sequence
  Description of Artificial Sequence: Synthetic oligonucleotide
  Target: ATXN1; (-) strand; PAM type: YTN; PAM sequence: CTG
tgtccatatcccgtgagatg

SEQ ID NO: 193031 - DNA, 20 bp, Artificial Sequence
  Description of Artificial Sequence: Synthetic oligonucleotide
  Target: ATXN1; (-) strand; PAM type: YTN; PAM sequence: TTA
cagctgtgtccatatcccgt

SEQ ID NO: 193032 - DNA, 20 bp, Artificial Sequence
  Description of Artificial Sequence: Synthetic oligonucleotide
  Target: ATXN1; (-) strand; PAM type: YTN; PAM sequence: TTT
acagctgtgtccatatcccg

SEQ ID NO: 193033 - DNA, 20 bp, Artificial Sequence
  Description of Artificial Sequence: Synthetic oligonucleotide
  Target: ATXN1; (-) strand; PAM type: YTN; PAM sequence: CTT
tacagctgtgtccatatccc

SEQ ID NO: 193034 - DNA, 20 bp, Artificial Sequence
  Description of Artificial Sequence: Synthetic oligonucleotide
  Target: ATXN1; (-) strand; PAM type: YTN; PAM sequence: TTA
gtgagatgagctttacagct

SEQ ID NO: 193035 - DNA, 20 bp, Artificial Sequence
  Description of Artificial Sequence: Synthetic oligonucleotide
  Target: ATXN1; (-) strand; PAM type: YTN; PAM sequence: TTT
agtgagatgagctttacagc

SEQ ID NO: 193036 - DNA, 20 bp, Artificial Sequence
  Description of Artificial Sequence: Synthetic oligonucleotide
  Target: ATXN1; (-) strand; PAM type: YTN; PAM sequence: TTT
tagtgagatgagctttacag

SEQ ID NO: 193037 - DNA, 20 bp, Artificial Sequence
  Description of Artificial Sequence: Synthetic oligonucleotide
  Target: ATXN1; (-) strand; PAM type: YTN; PAM sequence: TTG
gggatgtgaagaaccatgtt

SEQ ID NO: 193038 - DNA, 20 bp, Artificial Sequence
  Description of Artificial Sequence: Synthetic oligonucleotide
  Target: ATXN1; (-) strand; PAM type: YTN; PAM sequence: TTC
aacaagttggggatgtgaag

SEQ ID NO: 193039 - DNA, 20 bp, Artificial Sequence
  Description of Artificial Sequence: Synthetic oligonucleotide
  Target: ATXN1; (-) strand; PAM type: YTN; PAM sequence: TTT
caacaagttggggatgtgaa

SEQ ID NO: 193040 - DNA, 20 bp, Artificial Sequence
  Description of Artificial Sequence: Synthetic oligonucleotide
  Target: ATXN1; (-) strand; PAM type: YTN; PAM sequence: TTT
tcaacaagttggggatgtga

SEQ ID NO: 193041 - DNA, 20 bp, Artificial Sequence
  Description of Artificial Sequence: Synthetic oligonucleotide
  Target: ATXN1; (-) strand; PAM type: YTN; PAM sequence: TTT
ttcaacaagttggggatgtg

SEQ ID NO: 193042 - DNA, 20 bp, Artificial Sequence
  Description of Artificial Sequence: Synthetic oligonucleotide
  Target: ATXN1; (-) strand; PAM type: YTN; PAM sequence: CTG
gagatttttcaacaagttgg

SEQ ID NO: 193043 - DNA, 20 bp, Artificial Sequence
  Description of Artificial Sequence: Synthetic oligonucleotide
  Target: ATXN1; (-) strand; PAM type: YTN; PAM sequence: TTG
gcagtcactggagatttttc

SEQ ID NO: 193044 - DNA, 20 bp, Artificial Sequence
  Description of Artificial Sequence: Synthetic oligonucleotide
  Target: ATXN1; (-) strand; PAM type: YTN; PAM sequence: CTG
ggggttggcagtcactggag

SEQ ID NO: 193045 - DNA, 20 bp, Artificial Sequence
  Description of Artificial Sequence: Synthetic oligonucleotide
  Target: ATXN1; (-) strand; PAM type: YTN; PAM sequence: CTG
aactgggggttggcagtcac

SEQ ID NO: 193046 - DNA, 20 bp, Artificial Sequence
  Description of Artificial Sequence: Synthetic oligonucleotide
  Target: ATXN1; (-) strand; PAM type: YTN; PAM sequence: CTG
tggggaggggtcctgaactg

SEQ ID NO: 193047 - DNA, 20 bp, Artificial Sequence
  Description of Artificial Sequence: Synthetic oligonucleotide
  Target: ATXN1; (-) strand; PAM type: YTN; PAM sequence: CTG
tgtaaatgggcagtgctgtg

SEQ ID NO: 193048 - DNA, 20 bp, Artificial Sequence
  Description of Artificial Sequence: Synthetic oligonucleotide
  Target: ATXN1; (-) strand; PAM type: YTN; PAM sequence: TTG
ggggtggtagtggtagggag

SEQ ID NO: 193049 - DNA, 20 bp, Artificial Sequence
  Description of Artificial Sequence: Synthetic oligonucleotide
  Target: ATXN1; (-) strand; PAM type: YTN; PAM sequence: TTT
gggggtggtagtggtaggga

SEQ ID NO: 193050 - DNA, 20 bp, Artificial Sequence
  Description of Artificial Sequence: Synthetic oligonucleotide
  Target: ATXN1; (-) strand; PAM type: YTN; PAM sequence: TTG
tggtttgggggtggtagtgg

SEQ ID NO: 193051 - DNA, 20 bp, Artificial Sequence
  Description of Artificial Sequence: Synthetic oligonucleotide
  Target: ATXN1; (-) strand; PAM type: YTN; PAM sequence: TTT
gtggtttgggggtggtagtg

SEQ ID NO: 193052 - DNA, 20 bp, Artificial Sequence
  Description of Artificial Sequence: Synthetic oligonucleotide
  Target: ATXN1; (-) strand; PAM type: YTN; PAM sequence: TTG
gtttgtggtttgggggtggt

SEQ ID NO: 193053 - DNA, 20 bp, Artificial Sequence
  Description of Artificial Sequence: Synthetic oligonucleotide
  Target: ATXN1; (-) strand; PAM type: YTN; PAM sequence: TTG
ttggtttgtggtttgggggt

SEQ ID NO: 193054 - DNA, 20 bp, Artificial Sequence
  Description of Artificial Sequence: Synthetic oligonucleotide
  Target: ATXN1; (-) strand; PAM type: YTN; PAM sequence: CTT
gttggtttgtggtttggggg

SEQ ID NO: 193055 - DNA, 20 bp, Artificial Sequence
  Description of Artificial Sequence: Synthetic oligonucleotide
  Target: ATXN1; (-) strand; PAM type: YTN; PAM sequence: TTC
ttgttggtttgtggtttggg

SEQ ID NO: 193056 - DNA, 20 bp, Artificial Sequence
  Description of Artificial Sequence: Synthetic oligonucleotide
  Target: ATXN1; (-) strand; PAM type: YTN; PAM sequence: CTT
cttgttggtttgtggtttgg

SEQ ID NO: 193057 - DNA, 20 bp, Artificial Sequence
  Description of Artificial Sequence: Synthetic oligonucleotide
  Target: ATXN1; (-) strand; PAM type: YTN; PAM sequence: TTC
ccaggacacggtgcttcttg

SEQ ID NO: 193058 - DNA, 20 bp, Artificial Sequence
  Description of Artificial Sequence: Synthetic oligonucleotide
  Target: ATXN1; (-) strand; PAM type: YTN; PAM sequence: CTG
acagattcccaggacacggt

SEQ ID NO: 193059 - DNA, 20 bp, Artificial Sequence
  Description of Artificial Sequence: Synthetic oligonucleotide
  Target: ATXN1; (-) strand; PAM type: YTN; PAM sequence: CTG
agtcccagccactgacagat

SEQ ID NO: 193060 - DNA, 20 bp, Artificial Sequence
  Description of Artificial Sequence: Synthetic oligonucleotide
  Target: ATXN1; (-) strand; PAM type: YTN; PAM sequence: CTG
cgaggaggactgagtcccag

SEQ ID NO: 193061 - DNA, 20 bp, Artificial Sequence
  Description of Artificial Sequence: Synthetic oligonucleotide
  Target: ATXN1; (-) strand; PAM type: YTN; PAM sequence: CTG
cctgcgaggaggactgagtc

SEQ ID NO: 193062 - DNA, 20 bp, Artificial Sequence
  Description of Artificial Sequence: Synthetic oligonucleotide
  Target: ATXN1; (-) strand; PAM type: YTN; PAM sequence: TTA
tgtggtgaagagaaacctgc

SEQ ID NO: 193063 - DNA, 20 bp, Artificial Sequence
  Description of Artificial Sequence: Synthetic oligonucleotide
  Target: ATXN1; (-) strand; PAM type: YTN; PAM sequence: CTA
cgtgtgtattatgtggtgaa

SEQ ID NO: 193064 - DNA, 20 bp, Artificial Sequence
  Description of Artificial Sequence: Synthetic oligonucleotide
  Target: ATXN1; (-) strand; PAM type: YTN; PAM sequence: TTC
gctacgtgtgtattatgtgg

SEQ ID NO: 193065 - DNA, 20 bp, Artificial Sequence
  Description of Artificial Sequence: Synthetic oligonucleotide
  Target: ATXN1; (-) strand; PAM type: YTN; PAM sequence: CTC
aaccacattcgctacgtgtg

SEQ ID NO: 193066 - DNA, 20 bp, Artificial Sequence
  Description of Artificial Sequence: Synthetic oligonucleotide
  Target: ATXN1; (-) strand; PAM type: YTN; PAM sequence: TTG
gacagggagataggggtcac

SEQ ID NO: 193067 - DNA, 20 bp, Artificial Sequence
  Description of Artificial Sequence: Synthetic oligonucleotide
  Target: ATXN1; (-) strand; PAM type: YTN; PAM sequence: CTT
ggacagggagataggggtca

SEQ ID NO: 193068 - DNA, 20 bp, Artificial Sequence
  Description of Artificial Sequence: Synthetic oligonucleotide
  Target: ATXN1; (-) strand; PAM type: YTN; PAM sequence: CTG
ccttggacagggagataggg

SEQ ID NO: 193069 - DNA, 20 bp, Artificial Sequence
  Description of Artificial Sequence: Synthetic oligonucleotide
  Target: ATXN1; (-) strand; PAM type: YTN; PAM sequence: CTC
atagagagaaagggggagac

SEQ ID NO: 193070 - DNA, 20 bp, Artificial Sequence
  Description of Artificial Sequence: Synthetic oligonucleotide
  Target: ATXN1; (-) strand; PAM type: YTN; PAM sequence: CTC
aacacggagaatggacagct

SEQ ID NO: 193071 - DNA, 20 bp, Artificial Sequence
  Description of Artificial Sequence: Synthetic oligonucleotide
  Target: ATXN1; (-) strand; PAM type: YTN; PAM sequence: CTC
cgtgtaggactcaacacgga

SEQ ID NO: 193072 - DNA, 20 bp, Artificial Sequence
  Description of Artificial Sequence: Synthetic oligonucleotide
  Target: ATXN1; (-) strand; PAM type: YTN; PAM sequence: CTA
acatgtaaagtaagtgggaa

SEQ ID NO: 193073 - DNA, 20 bp, Artificial Sequence
  Description of Artificial Sequence: Synthetic oligonucleotide
  Target: ATXN1; (-) strand; PAM type: YTN; PAM sequence: CTG
aggaaaacacagcaatctaa

SEQ ID NO: 193074 - DNA, 20 bp, Artificial Sequence
  Description of Artificial Sequence: Synthetic oligonucleotide
  Target: ATXN1; (-) strand; PAM type: YTN; PAM sequence: TTC
cagacaggggccacgcatat

SEQ ID NO: 193075 - DNA, 20 bp, Artificial Sequence
  Description of Artificial Sequence: Synthetic oligonucleotide
  Target: ATXN1; (-) strand; PAM type: YTN; PAM sequence: CTT
ccagacaggggccacgcata

SEQ ID NO: 193076 - DNA, 20 bp, Artificial Sequence
  Description of Artificial Sequence: Synthetic oligonucleotide
  Target: ATXN1; (-) strand; PAM type: YTN; PAM sequence: CTC
cagatcaacgaagaggggct

SEQ ID NO: 193077 - DNA, 20 bp, Artificial Sequence
  Description of Artificial Sequence: Synthetic oligonucleotide
  Target: ATXN1; (-) strand; PAM type: YTN; PAM sequence: TTC
agctccagatcaacgaagag

SEQ ID NO: 193078 - DNA, 20 bp, Artificial Sequence
  Description of Artificial Sequence: Synthetic oligonucleotide
  Target: ATXN1; (-) strand; PAM type: YTN; PAM sequence: CTG
gtgaacagaccacaattcag

SEQ ID NO: 193079 - DNA, 20 bp, Artificial Sequence
  Description of Artificial Sequence: Synthetic oligonucleotide
  Target: ATXN1; (-) strand; PAM type: YTN; PAM sequence: CTG
gggtcctggtgaacagacca

SEQ ID NO: 193080 - DNA, 20 bp, Artificial Sequence
  Description of Artificial Sequence: Synthetic oligonucleotide
  Target: ATXN1; (-) strand; PAM type: YTN; PAM sequence: TTC
atctggggtcctggtgaaca

SEQ ID NO: 193081 - DNA, 20 bp, Artificial Sequence
  Description of Artificial Sequence: Synthetic oligonucleotide
  Target: ATXN1; (-) strand; PAM type: YTN; PAM sequence: TTT
catctggggtcctggtgaac

SEQ ID NO: 193082 - DNA, 20 bp, Artificial Sequence
  Description of Artificial Sequence: Synthetic oligonucleotide
  Target: ATXN1; (-) strand; PAM type: YTN; PAM sequence: CTT
tcatctggggtcctggtgaa

SEQ ID NO: 193083 - DNA, 20 bp, Artificial Sequence
  Description of Artificial Sequence: Synthetic oligonucleotide
  Target: ATXN1; (-) strand; PAM type: YTN; PAM sequence: TTC
atctttcatctggggtcctg

SEQ ID NO: 193084 - DNA, 20 bp, Artificial Sequence
  Description of Artificial Sequence: Synthetic oligonucleotide
  Target: ATXN1; (-) strand; PAM type: YTN; PAM sequence: TTT
catctttcatctggggtcct

SEQ ID NO: 193085 - DNA, 20 bp, Artificial Sequence
  Description of Artificial Sequence: Synthetic oligonucleotide
  Target: ATXN1; (-) strand; PAM type: YTN; PAM sequence: CTT
tcatctttcatctggggtcc

SEQ ID NO: 193086 - DNA, 20 bp, Artificial Sequence
  Description of Artificial Sequence: Synthetic oligonucleotide
  Target: ATXN1; (-) strand; PAM type: YTN; PAM sequence: CTC
atgctttcatctttcatctg

SEQ ID NO: 193087 - DNA, 20 bp, Artificial Sequence
  Description of Artificial Sequence: Synthetic oligonucleotide
  Target: ATXN1; (-) strand; PAM type: YTN; PAM sequence: CTC
tcatgctttcatctttcatc

SEQ ID NO: 193088 - DNA, 20 bp, Artificial Sequence
  Description of Artificial Sequence: Synthetic oligonucleotide
  Target: ATXN1; (-) strand; PAM type: YTN; PAM sequence: TTC
tctcatgctttcatctttca

SEQ ID NO: 193089 - DNA, 20 bp, Artificial Sequence
  Description of Artificial Sequence: Synthetic oligonucleotide
  Target: ATXN1; (-) strand; PAM type: YTN; PAM sequence: CTT
ctctcatgctttcatctttc

SEQ ID NO: 193090 - DNA, 20 bp, Artificial Sequence
  Description of Artificial Sequence: Synthetic oligonucleotide
  Target: ATXN1; (-) strand; PAM type: YTN; PAM sequence: CTG
catccgcttctctcatgctt

SEQ ID NO: 193091 - DNA, 20 bp, Artificial Sequence
  Description of Artificial Sequence: Synthetic oligonucleotide
  Target: ATXN1; (-) strand; PAM type: YTN; PAM sequence: CTC
ctgcatccgcttctctcatg

SEQ ID NO: 193092 - DNA, 20 bp, Artificial Sequence
  Description of Artificial Sequence: Synthetic oligonucleotide
  Target: ATXN1; (-) strand; PAM type: YTN; PAM sequence: CTA
taccatccccctcctgcatc

SEQ ID NO: 193093 - DNA, 20 bp, Artificial Sequence
  Description of Artificial Sequence: Synthetic oligonucleotide
  Target: ATXN1; (-) strand; PAM type: YTN; PAM sequence: TTC
catcccaggtgtatggacca

SEQ ID NO: 193094 - DNA, 20 bp, Artificial Sequence
  Description of Artificial Sequence: Synthetic oligonucleotide
  Target: ATXN1; (-) strand; PAM type: YTN; PAM sequence: TTC
catgattccatcccaggtgt

SEQ ID NO: 193095 - DNA, 20 bp, Artificial Sequence
  Description of Artificial Sequence: Synthetic oligonucleotide
  Target: ATXN1; (-) strand; PAM type: YTN; PAM sequence: CTT
ccatgattccatcccaggtg

SEQ ID NO: 193096 - DNA, 20 bp, Artificial Sequence
  Description of Artificial Sequence: Synthetic oligonucleotide
  Target: ATXN1; (-) strand; PAM type: YTN; PAM sequence: CTG
ggatgcttccatgattccat

SEQ ID NO: 193097 - DNA, 20 bp, Artificial Sequence
  Description of Artificial Sequence: Synthetic oligonucleotide
  Target: ATXN1; (-) strand; PAM type: YTN; PAM sequence: CTG
tctgggatgcttccatgatt

SEQ ID NO: 193098 - DNA, 20 bp, Artificial Sequence
  Description of Artificial Sequence: Synthetic oligonucleotide
  Target: ATXN1; (-) strand; PAM type: YTN; PAM sequence: TTA
acctgtctgggatgcttcca

SEQ ID NO: 193099 - DNA, 20 bp, Artificial Sequence
  Description of Artificial Sequence: Synthetic oligonucleotide
  Target: ATXN1; (-) strand; PAM type: YTN; PAM sequence: TTA
aggcaaagttaacctgtctg

SEQ ID NO: 193100 - DNA, 20 bp, Artificial Sequence
  Description of Artificial Sequence: Synthetic oligonucleotide
  Target: ATXN1; (-) strand; PAM type: YTN; PAM sequence: TTA
ttaaggcaaagttaacctgt

SEQ ID NO: 193101 - DNA, 20 bp, Artificial Sequence
  Description of Artificial Sequence: Synthetic oligonucleotide
  Target: ATXN1; (-) strand; PAM type: YTN; PAM sequence: TTT
attaaggcaaagttaacctg

SEQ ID NO: 193102 - DNA, 20 bp, Artificial Sequence
  Description of Artificial Sequence: Synthetic oligonucleotide
  Target: ATXN1; (-) strand; PAM type: YTN; PAM sequence: CTT
tattaaggcaaagttaacct

SEQ ID NO: 193103 - DNA, 20 bp, Artificial Sequence
  Description of Artificial Sequence: Synthetic oligonucleotide
  Target: ATXN1; (-) strand; PAM type: YTN; PAM sequence: TTA
agaagctttattaaggcaaa

SEQ ID NO: 193104 - DNA, 20 bp, Artificial Sequence
  Description of Artificial Sequence: Synthetic oligonucleotide
  Target: ATXN1; (-) strand; PAM type: YTN; PAM sequence: TTA
aaaattaagaagctttatta

SEQ ID NO: 193105 - DNA, 20 bp, Artificial Sequence
  Description of Artificial Sequence: Synthetic oligonucleotide
  Target: ATXN1; (-) strand; PAM type: YTN; PAM sequence: TTG
ttaaaaattaagaagcttta

SEQ ID NO: 193106 - DNA, 20 bp, Artificial Sequence
  Description of Artificial Sequence: Synthetic oligonucleotide
  Target: ATXN1; (-) strand; PAM type: YTN; PAM sequence: CTT
gttaaaaattaagaagcttt

SEQ ID NO: 193107 - DNA, 20 bp, Artificial Sequence
  Description of Artificial Sequence: Synthetic oligonucleotide
  Target: ATXN1; (-) strand; PAM type: YTN; PAM sequence: TTA
ggcttgttaaaaattaagaa

SEQ ID NO: 193108 - DNA, 20 bp, Artificial Sequence
  Description of Artificial Sequence: Synthetic oligonucleotide
  Target: ATXN1; (-) strand; PAM type: YTN; PAM sequence: CTG
aatgagatggagatcattag

SEQ ID NO: 193109 - DNA, 20 bp, Artificial Sequence
  Description of Artificial Sequence: Synthetic oligonucleotide
  Target: ATXN1; (-) strand; PAM type: YTN; PAM sequence: CTC
ctgaatgagatggagatcat

SEQ ID NO: 193110 - DNA, 20 bp, Artificial Sequence
  Description of Artificial Sequence: Synthetic oligonucleotide
  Target: ATXN1; (-) strand; PAM type: YTN; PAM sequence: TTC
ctcctgaatgagatggagat

SEQ ID NO: 193111 - DNA, 20 bp, Artificial Sequence
  Description of Artificial Sequence: Synthetic oligonucleotide
  Target: ATXN1; (-) strand; PAM type: YTN; PAM sequence: TTG
ttcctcctgaatgagatgga

SEQ ID NO: 193112 - DNA, 20 bp, Artificial Sequence
  Description of Artificial Sequence: Synthetic oligonucleotide
  Target: ATXN1; (-) strand; PAM type: YTN; PAM sequence: CTT
gttcctcctgaatgagatgg

SEQ ID NO: 193113 - DNA, 20 bp, Artificial Sequence
  Description of Artificial Sequence: Synthetic oligonucleotide
  Target: ATXN1; (-) strand; PAM type: YTN; PAM sequence: CTG
accttgttcctcctgaatga

SEQ ID NO: 193114 - DNA, 20 bp, Artificial Sequence
  Description of Artificial Sequence: Synthetic oligonucleotide
  Target: ATXN1; (-) strand; PAM type: YTN; PAM sequence: TTC
tgaccttgttcctcctgaat

SEQ ID NO: 193115 - DNA, 20 bp, Artificial Sequence
  Description of Artificial Sequence: Synthetic oligonucleotide
  Target: ATXN1; (-) strand; PAM type: YTN; PAM sequence: TTT
ctgaccttgttcctcctgaa

SEQ ID NO: 193116 - DNA, 20 bp, Artificial Sequence
  Description of Artificial Sequence: Synthetic oligonucleotide
  Target: ATXN1; (-) strand; PAM type: YTN; PAM sequence: CTT
tctgaccttgttcctcctga

SEQ ID NO: 193117 - DNA, 20 bp, Artificial Sequence
  Description of Artificial Sequence: Synthetic oligonucleotide
  Target: ATXN1; (-) strand; PAM type: YTN; PAM sequence: TTG
tctttctgaccttgttcctc

SEQ ID NO: 193118 - DNA, 20 bp, Artificial Sequence
  Description of Artificial Sequence: Synthetic oligonucleotide
  Target: ATXN1; (-) strand; PAM type: YTN; PAM sequence: CTT
gtctttctgaccttgttcct

SEQ ID NO: 193119 - DNA, 20 bp, Artificial Sequence
  Description of Artificial Sequence: Synthetic oligonucleotide
  Target: ATXN1; (-) strand; PAM type: YTN; PAM sequence: CTG
gtcccatcttgtctttctga

SEQ ID NO: 193120 - DNA, 20 bp, Artificial Sequence
  Description of Artificial Sequence: Synthetic oligonucleotide
  Target: ATXN1; (-) strand; PAM type: YTN; PAM sequence: TTC
acaagtcatctggtcccatc

SEQ ID NO: 193121 - DNA, 20 bp, Artificial Sequence
  Description of Artificial Sequence: Synthetic oligonucleotide
  Target: ATXN1; (-) strand; PAM type: YTN; PAM sequence: CTC
acagttcacaagtcatctgg

SEQ ID NO: 193122 - DNA, 20 bp, Artificial Sequence
  Description of Artificial Sequence: Synthetic oligonucleotide
  Target: ATXN1; (-) strand; PAM type: YTN; PAM sequence: CTC
aactcacagttcacaagtca

SEQ ID NO: 193123 - DNA, 20 bp, Artificial Sequence
  Description of Artificial Sequence: Synthetic oligonucleotide
  Target: ATXN1; (-) strand; PAM type: YTN; PAM sequence: CTA
acagtccagagctcaactca

SEQ ID NO: 193124 - DNA, 20 bp, Artificial Sequence
  Description of Artificial Sequence: Synthetic oligonucleotide
  Target: ATXN1; (-) strand; PAM type: YTN; PAM sequence: CTG
tctaacagtccagagctcaa

SEQ ID NO: 193125 - DNA, 20 bp, Artificial Sequence
  Description of Artificial Sequence: Synthetic oligonucleotide
  Target: ATXN1; (-) strand; PAM type: YTN; PAM sequence: TTA
gacacatcactgtctaacag

SEQ ID NO: 193126 - DNA, 20 bp, Artificial Sequence
  Description of Artificial Sequence: Synthetic oligonucleotide
  Target: ATXN1; (-) strand; PAM type: YTN; PAM sequence: CTT
agacacatcactgtctaaca

SEQ ID NO: 193127 - DNA, 20 bp, Artificial Sequence
  Description of Artificial Sequence: Synthetic oligonucleotide
  Target: ATXN1; (-) strand; PAM type: YTN; PAM sequence: TTG
tcttagacacatcactgtct

SEQ ID NO: 193128 - DNA, 20 bp, Artificial Sequence
  Description of Artificial Sequence: Synthetic oligonucleotide
  Target: ATXN1; (-) strand; PAM type: YTN; PAM sequence: CTT
gtcttagacacatcactgtc

SEQ ID NO: 193129 - DNA, 20 bp, Artificial Sequence
  Description of Artificial Sequence: Synthetic oligonucleotide
  Target: ATXN1; (-) strand; PAM type: YTN; PAM sequence: TTG
gccttgtcttagacacatca

SEQ ID NO: 193130 - DNA, 20 bp, Artificial Sequence
  Description of Artificial Sequence: Synthetic oligonucleotide
  Target: ATXN1; (-) strand; PAM type: YTN; PAM sequence: CTG
ccagacattggccttgtctt

SEQ ID NO: 193131 - DNA, 20 bp, Artificial Sequence
  Description of Artificial Sequence: Synthetic oligonucleotide
  Target: ATXN1; (-) strand; PAM type: YTN; PAM sequence: CTA
aagccccggcctgccagaca

SEQ ID NO: 193132 - DNA, 20 bp, Artificial Sequence
  Description of Artificial Sequence: Synthetic oligonucleotide
  Target: ATXN1; (-) strand; PAM type: YTN; PAM sequence: TTA
cgctaaagccccggcctgcc

SEQ ID NO: 193133 - DNA, 20 bp, Artificial Sequence
  Description of Artificial Sequence: Synthetic oligonucleotide
  Target: ATXN1; (-) strand; PAM type: YTN; PAM sequence: CTT
acgctaaagccccggcctgc

SEQ ID NO: 193134 - DNA, 20 bp, Artificial Sequence
  Description of Artificial Sequence: Synthetic oligonucleotide
  Target: ATXN1; (-) strand; PAM type: YTN; PAM sequence: CTA
aacttacgctaaagccccgg

SEQ ID NO: 193135 - DNA, 20 bp, Artificial Sequence
  Description of Artificial Sequence: Synthetic oligonucleotide
  Target: ATXN1; (-) strand; PAM type: YTN; PAM sequence: TTA
gcaggtggctaaacttacgc

SEQ ID NO: 193136 - DNA, 20 bp, Artificial Sequence
  Description of Artificial Sequence: Synthetic oligonucleotide
  Target: ATXN1; (-) strand; PAM type: YTN; PAM sequence: TTT
agcaggtggctaaacttacg

SEQ ID NO: 193137 - DNA, 20 bp, Artificial Sequence
  Description of Artificial Sequence: Synthetic oligonucleotide
  Target: ATXN1; (-) strand; PAM type: YTN; PAM sequence: CTC
aatttagcaggtggctaaac

SEQ ID NO: 193138 - DNA, 20 bp, Artificial Sequence
  Description of Artificial Sequence: Synthetic oligonucleotide
  Target: ATXN1; (-) strand; PAM type: YTN; PAM sequence: TTA
aactcaatttagcaggtggc

SEQ ID NO: 193139 - DNA, 20 bp, Artificial Sequence
  Description of Artificial Sequence: Synthetic oligonucleotide
  Target: ATXN1; (-) strand; PAM type: YTN; PAM sequence: CTA
tggtgatgggacaatcataa

SEQ ID NO: 193140 - DNA, 20 bp, Artificial Sequence
  Description of Artificial Sequence: Synthetic oligonucleotide
  Target: ATXN1; (-) strand; PAM type: YTN; PAM sequence: TTA
gctatggtgatgggacaatc

SEQ ID NO: 193141 - DNA, 20 bp, Artificial Sequence
  Description of Artificial Sequence: Synthetic oligonucleotide
  Target: ATXN1; (-) strand; PAM type: YTN; PAM sequence: TTA
attagctatggtgatgggac

SEQ ID NO: 193142 - DNA, 20 bp, Artificial Sequence
  Description of Artificial Sequence: Synthetic oligonucleotide
  Target: ATXN1; (-) strand; PAM type: YTN; PAM sequence: TTA
acattaattagctatggtga

SEQ ID NO: 193143 - DNA, 20 bp, Artificial Sequence
  Description of Artificial Sequence: Synthetic oligonucleotide
  Target: ATXN1; (-) strand; PAM type: YTN; PAM sequence: TTA
ataaaaataacaacatagtt

SEQ ID NO: 193144 - DNA, 20 bp, Artificial Sequence
  Description of Artificial Sequence: Synthetic oligonucleotide
  Target: ATXN1; (-) strand; PAM type: YTN; PAM sequence: TTA
aaagagcattaataaaaata

SEQ ID NO: 193145 - DNA, 20 bp, Artificial Sequence
  Description of Artificial Sequence: Synthetic oligonucleotide
  Target: ATXN1; (-) strand; PAM type: YTN; PAM sequence: CTA
aaattaaaagagcattaata

SEQ ID NO: 193146 - DNA, 20 bp, Artificial Sequence
  Description of Artificial Sequence: Synthetic oligonucleotide
  Target: ATXN1; (-) strand; PAM type: YTN; PAM sequence: TTA
ctaaaattaaaagagcatta

SEQ ID NO: 193147 - DNA, 20 bp, Artificial Sequence
  Description of Artificial Sequence: Synthetic oligonucleotide
  Target: ATXN1; (-) strand; PAM type: YTN; PAM sequence: TTT
actaaaattaaaagagcatt

SEQ ID NO: 193148 - DNA, 20 bp, Artificial Sequence
  Description of Artificial Sequence: Synthetic oligonucleotide
  Target: ATXN1; (-) strand; PAM type: YTN; PAM sequence: CTC
aaaaatatttactaaaatta

SEQ ID NO: 193149 - DNA, 20 bp, Artificial Sequence
  Description of Artificial Sequence: Synthetic oligonucleotide
  Target: ATXN1; (-) strand; PAM type: YTN; PAM sequence: CTG
gctcaaaaatatttactaaa

SEQ ID NO: 193150 - DNA, 20 bp, Artificial Sequence
  Description of Artificial Sequence: Synthetic oligonucleotide
  Target: ATXN1; (-) strand; PAM type: YTN; PAM sequence: TTG
gaacagtcagatctggctca

SEQ ID NO: 193151 - DNA, 20 bp, Artificial Sequence
  Description of Artificial Sequence: Synthetic oligonucleotide
  Target: ATXN1; (-) strand; PAM type: YTN; PAM sequence: CTT
ggaacagtcagatctggctc

SEQ ID NO: 193152 - DNA, 20 bp, Artificial Sequence
  Description of Artificial Sequence: Synthetic oligonucleotide
  Target: ATXN1; (-) strand; PAM type: YTN; PAM sequence: CTG
gcagcccccaaagcccaggc

SEQ ID NO: 193153 - DNA, 20 bp, Artificial Sequence
  Description of Artificial Sequence: Synthetic oligonucleotide
  Target: ATXN1; (-) strand; PAM type: YTN; PAM sequence: TTG
tagcagtaatatacctggca

SEQ ID NO: 193154 - DNA, 20 bp, Artificial Sequence
  Description of Artificial Sequence: Synthetic oligonucleotide
  Target: ATXN1; (-) strand; PAM type: YTN; PAM sequence: CTG
atggtgttgtagcagtaata

SEQ ID NO: 193155 - DNA, 20 bp, Artificial Sequence
  Description of Artificial Sequence: Synthetic oligonucleotide
  Target: ATXN1; (-) strand; PAM type: YTN; PAM sequence: CTC
ctgatggtgttgtagcagta

SEQ ID NO: 193156 - DNA, 20 bp, Artificial Sequence
  Description of Artificial Sequence: Synthetic oligonucleotide
  Target: ATXN1; (-) strand; PAM type: YTN; PAM sequence: TTG
ctcctgatggtgttgtagca

SEQ ID NO: 193157 - DNA, 20 bp, Artificial Sequence
  Description of Artificial Sequence: Synthetic oligonucleotide
  Target: ATXN1; (-) strand; PAM type: YTN; PAM sequence: CTT
gctcctgatggtgttgtagc

SEQ ID NO: 193158 - DNA, 20 bp, Artificial Sequence
  Description of Artificial Sequence: Synthetic oligonucleotide
  Target: ATXN1; (-) strand; PAM type: YTN; PAM sequence: TTG
tgacttgctcctgatggtgt

SEQ ID NO: 193159 - DNA, 20 bp, Artificial Sequence
  Description of Artificial Sequence: Synthetic oligonucleotide
  Target: ATXN1; (-) strand; PAM type: YTN; PAM sequence: TTA
agaatgcattgtgacttgct

SEQ ID NO: 193160 - DNA, 20 bp, Artificial Sequence
  Description of Artificial Sequence: Synthetic oligonucleotide
  Target: ATXN1; (-) strand; PAM type: YTN; PAM sequence: CTT
aagaatgcattgtgacttgc

SEQ ID NO: 193161 - DNA, 20 bp, Artificial Sequence
  Description of Artificial Sequence: Synthetic oligonucleotide
  Target: ATXN1; (-) strand; PAM type: YTN; PAM sequence: CTC
gataacgtgtagggtaaaag

SEQ ID NO: 193162 - DNA, 20 bp, Artificial Sequence
  Description of Artificial Sequence: Synthetic oligonucleotide
  Target: ATXN1; (-) strand; PAM type: YTN; PAM sequence: CTC
acacagcacacagtaggtgc

SEQ ID NO: 193163 - DNA, 20 bp, Artificial Sequence
  Description of Artificial Sequence: Synthetic oligonucleotide
  Target: ATXN1; (-) strand; PAM type: YTN; PAM sequence: CTC
tcacacagcacacagtaggt

SEQ ID NO: 193164 - DNA, 20 bp, Artificial Sequence
  Description of Artificial Sequence: Synthetic oligonucleotide
  Target: ATXN1; (-) strand; PAM type: YTN; PAM sequence: CTC
ccaacgtcccagtcctctca

SEQ ID NO: 193165 - DNA, 20 bp, Artificial Sequence
  Description of Artificial Sequence: Synthetic oligonucleotide
  Target: ATXN1; (-) strand; PAM type: YTN; PAM sequence: TTG
tataactcccaacgtcccag

SEQ ID NO: 193166 - DNA, 20 bp, Artificial Sequence
  Description of Artificial Sequence: Synthetic oligonucleotide
  Target: ATXN1; (-) strand; PAM type: YTN; PAM sequence: TTT
gtataactcccaacgtccca

SEQ ID NO: 193167 - DNA, 20 bp, Artificial Sequence
  Description of Artificial Sequence: Synthetic oligonucleotide
  Target: ATXN1; (-) strand; PAM type: YTN; PAM sequence: TTT
tgtataactcccaacgtccc

SEQ ID NO: 193168 - DNA, 20 bp, Artificial Sequence
  Description of Artificial Sequence: Synthetic oligonucleotide
  Target: ATXN1; (-) strand; PAM type: YTN; PAM sequence: TTT
ttgtataactcccaacgtcc

SEQ ID NO: 193169 - DNA, 20 bp, Artificial Sequence
  Description of Artificial Sequence: Synthetic oligonucleotide
  Target: ATXN1; (-) strand; PAM type: YTN; PAM sequence: CTT
tttgtataactcccaacgtc

SEQ ID NO: 193170 - DNA, 20 bp, Artificial Sequence
  Description of Artificial Sequence: Synthetic oligonucleotide
  Target: ATXN1; (-) strand; PAM type: YTN; PAM sequence: TTA
gctttttgtataactcccaa

SEQ ID NO: 193171 - DNA, 20 bp, Artificial Sequence
  Description of Artificial Sequence: Synthetic oligonucleotide
  Target: ATXN1; (-) strand; PAM type: YTN; PAM sequence: TTT
agctttttgtataactccca

SEQ ID NO: 193172 - DNA, 20 bp, Artificial Sequence
  Description of Artificial Sequence: Synthetic oligonucleotide
  Target: ATXN1; (-) strand; PAM type: YTN; PAM sequence: TTT
tagctttttgtataactccc

SEQ ID NO: 193173 - DNA, 20 bp, Artificial Sequence
  Description of Artificial Sequence: Synthetic oligonucleotide
  Target: ATXN1; (-) strand; PAM type: YTN; PAM sequence: CTT
ttagctttttgtataactcc

SEQ ID NO: 193174 - DNA, 20 bp, Artificial Sequence
  Description of Artificial Sequence: Synthetic oligonucleotide
  Target: ATXN1; (-) strand; PAM type: YTN; PAM sequence: CTA
agcatggcttttagcttttt

SEQ ID NO: 193175 - DNA, 20 bp, Artificial Sequence
  Description of Artificial Sequence: Synthetic oligonucleotide
  Target: ATXN1; (-) strand; PAM type: YTN; PAM sequence: CTA
tgtcctaagcatggctttta

SEQ ID NO: 193176 - DNA, 20 bp, Artificial Sequence
  Description of Artificial Sequence: Synthetic oligonucleotide
  Target: ATXN1; (-) strand; PAM type: YTN; PAM sequence: CTG
ctatgtcctaagcatggctt

SEQ ID NO: 193177 - DNA, 20 bp, Artificial Sequence
  Description of Artificial Sequence: Synthetic oligonucleotide
  Target: ATXN1; (-) strand; PAM type: YTN; PAM sequence: TTG
tcacctgctatgtcctaagc

SEQ ID NO: 193178 - DNA, 20 bp, Artificial Sequence
  Description of Artificial Sequence: Synthetic oligonucleotide
  Target: ATXN1; (-) strand; PAM type: YTN; PAM sequence: CTT
gtcacctgctatgtcctaag

SEQ ID NO: 193179 - DNA, 20 bp, Artificial Sequence
  Description of Artificial Sequence: Synthetic oligonucleotide
  Target: ATXN1; (-) strand; PAM type: YTN; PAM sequence: CTA
gaagggacacttgtcacctg

SEQ ID NO: 193180 - DNA, 20 bp, Artificial Sequence
  Description of Artificial Sequence: Synthetic oligonucleotide
  Target: ATXN1; (-) strand; PAM type: YTN; PAM sequence: TTG
gcctagaagggacacttgtc

SEQ ID NO: 193181 - DNA, 20 bp, Artificial Sequence
  Description of Artificial Sequence: Synthetic oligonucleotide
  Target: ATXN1; (-) strand; PAM type: YTN; PAM sequence: TTT
ggcctagaagggacacttgt

SEQ ID NO: 193182 - DNA, 20 bp, Artificial Sequence
  Description of Artificial Sequence: Synthetic oligonucleotide
  Target: ATXN1; (-) strand; PAM type: YTN; PAM sequence: CTT
tggcctagaagggacacttg

SEQ ID NO: 193183 - DNA, 20 bp, Artificial Sequence
  Description of Artificial Sequence: Synthetic oligonucleotide
  Target: ATXN1; (-) strand; PAM type: YTN; PAM sequence: TTC
aaagctttggcctagaaggg

SEQ ID NO: 193184 - DNA, 20 bp, Artificial Sequence
  Description of Artificial Sequence: Synthetic oligonucleotide
  Target: ATXN1; (-) strand; PAM type: YTN; PAM sequence: CTT
caaagctttggcctagaagg

SEQ ID NO: 193185 - DNA, 20 bp, Artificial Sequence
  Description of Artificial Sequence: Synthetic oligonucleotide
  Target: ATXN1; (-) strand; PAM type: YTN; PAM sequence: TTC
aatgcttcaaagctttggcc

SEQ ID NO: 193186 - DNA, 20 bp, Artificial Sequence
  Description of Artificial Sequence: Synthetic oligonucleotide
  Target: ATXN1; (-) strand; PAM type: YTN; PAM sequence: TTG
caccagcaattcaatgcttc

SEQ ID NO: 193187 - DNA, 20 bp, Artificial Sequence
  Description of Artificial Sequence: Synthetic oligonucleotide
  Target: ATXN1; (-) strand; PAM type: YTN; PAM sequence: TTG
gaaaattgcaccagcaattc

SEQ ID NO: 193188 - DNA, 20 bp, Artificial Sequence
  Description of Artificial Sequence: Synthetic oligonucleotide
  Target: ATXN1; (-) strand; PAM type: YTN; PAM sequence: CTG
gaagagagaaaaattggaaa

SEQ ID NO: 193189 - DNA, 20 bp, Artificial Sequence
  Description of Artificial Sequence: Synthetic oligonucleotide
  Target: ATXN1; (-) strand; PAM type: YTN; PAM sequence: TTC
atgatcactggaagagagaa

SEQ ID NO: 193190 - DNA, 20 bp, Artificial Sequence
  Description of Artificial Sequence: Synthetic oligonucleotide
  Target: ATXN1; (-) strand; PAM type: YTN; PAM sequence: TTT
catgatcactggaagagaga

SEQ ID NO: 193191 - DNA, 20 bp, Artificial Sequence
  Description of Artificial Sequence: Synthetic oligonucleotide
  Target: ATXN1; (-) strand; PAM type: YTN; PAM sequence: CTT
tcatgatcactggaagagag

SEQ ID NO: 193192 - DNA, 20 bp, Artificial Sequence
  Description of Artificial Sequence: Synthetic oligonucleotide
  Target: ATXN1; (-) strand; PAM type: YTN; PAM sequence: CTC
tttcatgatcactggaagag

SEQ ID NO: 193193 - DNA, 20 bp, Artificial Sequence
  Description of Artificial Sequence: Synthetic oligonucleotide
  Target: ATXN1; (-) strand; PAM type: YTN; PAM sequence: CTA
ggggcctctttcatgatcac

SEQ ID NO: 193194 - DNA, 20 bp, Artificial Sequence
  Description of Artificial Sequence: Synthetic oligonucleotide
  Target: ATXN1; (-) strand; PAM type: YTN; PAM sequence: TTA
tccagccatctaggggcctc

SEQ ID NO: 193195 - DNA, 20 bp, Artificial Sequence
  Description of Artificial Sequence: Synthetic oligonucleotide
  Target: ATXN1; (-) strand; PAM type: YTN; PAM sequence: TTT
atccagccatctaggggcct

SEQ ID NO: 193196 - DNA, 20 bp, Artificial Sequence
  Description of Artificial Sequence: Synthetic oligonucleotide
  Target: ATXN1; (-) strand; PAM type: YTN; PAM sequence: TTT
tatccagccatctaggggcc

SEQ ID NO: 193197 - DNA, 20 bp, Artificial Sequence
  Description of Artificial Sequence: Synthetic oligonucleotide
  Target: ATXN1; (-) strand; PAM type: YTN; PAM sequence: TTT
ttatccagccatctaggggc

SEQ ID NO: 193198 - DNA, 20 bp, Artificial Sequence
  Description of Artificial Sequence: Synthetic oligonucleotide
  Target: ATXN1; (-) strand; PAM type: YTN; PAM sequence: CTT
tttatccagccatctagggg

SEQ ID NO: 193199 - DNA, 20 bp, Artificial Sequence
  Description of Artificial Sequence: Synthetic oligonucleotide
  Target: ATXN1; (-) strand; PAM type: YTN; PAM sequence: TTG
atctttttatccagccatct

SEQ ID NO: 193200 - DNA, 20 bp, Artificial Sequence
  Description of Artificial Sequence: Synthetic oligonucleotide
  Target: ATXN1; (-) strand; PAM type: YTN; PAM sequence: TTT
gatctttttatccagccatc

SEQ ID NO: 193201 - DNA, 20 bp, Artificial Sequence
  Description of Artificial Sequence: Synthetic oligonucleotide
  Target: ATXN1; (-) strand; PAM type: YTN; PAM sequence: CTT
tgatctttttatccagccat

SEQ ID NO: 193202 - DNA, 20 bp, Artificial Sequence
  Description of Artificial Sequence: Synthetic oligonucleotide
  Target: ATXN1; (-) strand; PAM type: YTN; PAM sequence: CTG
ctttgatctttttatccagc

SEQ ID NO: 193203 - DNA, 20 bp, Artificial Sequence
  Description of Artificial Sequence: Synthetic oligonucleotide
  Target: ATXN1; (-) strand; PAM type: YTN; PAM sequence: CTC
catgatgcagtctgctttga

SEQ ID NO: 193204 - DNA, 20 bp, Artificial Sequence
  Description of Artificial Sequence: Synthetic oligonucleotide
  Target: ATXN1; (-) strand; PAM type: YTN; PAM sequence: CTC
catgcataactccatgatgc

SEQ ID NO: 193205 - DNA, 20 bp, Artificial Sequence
  Description of Artificial Sequence: Synthetic oligonucleotide
  Target: ATXN1; (-) strand; PAM type: YTN; PAM sequence: CTG
tcctccatgcataactccat

SEQ ID NO: 193206 - DNA, 20 bp, Artificial Sequence
  Description of Artificial Sequence: Synthetic oligonucleotide
  Target: ATXN1; (-) strand; PAM type: YTN; PAM sequence: CTC
caggacaactgtcctccatg

SEQ ID NO: 193207 - DNA, 20 bp, Artificial Sequence
  Description of Artificial Sequence: Synthetic oligonucleotide
  Target: ATXN1; (-) strand; PAM type: YTN; PAM sequence: CTC
tccaggacaactgtcctcca

SEQ ID NO: 193208 - DNA, 20 bp, Artificial Sequence
  Description of Artificial Sequence: Synthetic oligonucleotide
  Target: ATXN1; (-) strand; PAM type: YTN; PAM sequence: CTG
tggatgcagtatctctccag

SEQ ID NO: 193209 - DNA, 20 bp, Artificial Sequence
  Description of Artificial Sequence: Synthetic oligonucleotide
  Target: ATXN1; (-) strand; PAM type: YTN; PAM sequence: TTC
atacagtgaccgctgtggat

SEQ ID NO: 193210 - DNA, 20 bp, Artificial Sequence
  Description of Artificial Sequence: Synthetic oligonucleotide
  Target: ATXN1; (-) strand; PAM type: YTN; PAM sequence: CTC
attcatacagtgaccgctgt

SEQ ID NO: 193211 - DNA, 20 bp, Artificial Sequence
  Description of Artificial Sequence: Synthetic oligonucleotide
  Target: ATXN1; (-) strand; PAM type: YTN; PAM sequence: TTC
tcattcatacagtgaccgct

SEQ ID NO: 193212 - DNA, 20 bp, Artificial Sequence
  Description of Artificial Sequence: Synthetic oligonucleotide
  Target: ATXN1; (-) strand; PAM type: YTN; PAM sequence: TTT
ctcattcatacagtgaccgc

SEQ ID NO: 193213 - DNA, 20 bp, Artificial Sequence
  Description of Artificial Sequence: Synthetic oligonucleotide
  Target: ATXN1; (-) strand; PAM type: YTN; PAM sequence: TTA
tttctcattcatacagtgac

SEQ ID NO: 193214 - DNA, 20 bp, Artificial Sequence
  Description of Artificial Sequence: Synthetic oligonucleotide
  Target: ATXN1; (-) strand; PAM type: YTN; PAM sequence: TTT
atttctcattcatacagtga

SEQ ID NO: 193215 - DNA, 20 bp, Artificial Sequence
  Description of Artificial Sequence: Synthetic oligonucleotide
  Target: ATXN1; (-) strand; PAM type: YTN; PAM sequence: TTA
gcaaaataaaagtttatttc

SEQ ID NO: 193216 - DNA, 20 bp, Artificial Sequence
  Description of Artificial Sequence: Synthetic oligonucleotide
  Target: ATXN1; (-) strand; PAM type: YTN; PAM sequence: CTT
agcaaaataaaagtttattt

SEQ ID NO: 193217 - DNA, 20 bp, Artificial Sequence
  Description of Artificial Sequence: Synthetic oligonucleotide
  Target: ATXN1; (-) strand; PAM type: YTN; PAM sequence: TTC
agtagcttagcaaaataaaa

SEQ ID NO: 193218 - DNA, 20 bp, Artificial Sequence
  Description of Artificial Sequence: Synthetic oligonucleotide
  Target: ATXN1; (-) strand; PAM type: YTN; PAM sequence: TTT
cagtagcttagcaaaataaa

SEQ ID NO: 193219 - DNA, 20 bp, Artificial Sequence
  Description of Artificial Sequence: Synthetic oligonucleotide
  Target: ATXN1; (-) strand; PAM type: YTN; PAM sequence: CTT
tcagtagcttagcaaaataa

SEQ ID NO: 193220 - DNA, 20 bp, Artificial Sequence
  Description of Artificial Sequence: Synthetic oligonucleotide
  Target: ATXN1; (-) strand; PAM type: YTN; PAM sequence: CTA
aactttcagtagcttagcaa

SEQ ID NO: 193221 - DNA, 20 bp, Artificial Sequence
  Description of Artificial Sequence: Synthetic oligonucleotide
  Target: ATXN1; (-) strand; PAM type: YTN; PAM sequence: TTG
cagaaaggtcaaccctaaac

SEQ ID NO: 193222 - DNA, 20 bp, Artificial Sequence
  Description of Artificial Sequence: Synthetic oligonucleotide
  Target: ATXN1; (-) strand; PAM type: YTN; PAM sequence: TTG
ttgcagaaaggtcaacccta

SEQ ID NO: 193223 - DNA, 20 bp, Artificial Sequence
  Description of Artificial Sequence: Synthetic oligonucleotide
  Target: ATXN1; (-) strand; PAM type: YTN; PAM sequence: TTT
gttgcagaaaggtcaaccct

SEQ ID NO: 193224 - DNA, 20 bp, Artificial Sequence
  Description of Artificial Sequence: Synthetic oligonucleotide
  Target: ATXN1; (-) strand; PAM type: YTN; PAM sequence: TTT
tgttgcagaaaggtcaaccc

SEQ ID NO: 193225 - DNA, 20 bp, Artificial Sequence
  Description of Artificial Sequence: Synthetic oligonucleotide
  Target: ATXN1; (-) strand; PAM type: YTN; PAM sequence: CTT
ttgttgcagaaaggtcaacc

SEQ ID NO: 193226 - DNA, 20 bp, Artificial Sequence
  Description of Artificial Sequence: Synthetic oligonucleotide
  Target: ATXN1; (-) strand; PAM type: YTN; PAM sequence: TTA
gtcaggataggataagcttt

SEQ ID NO: 193227 - DNA, 20 bp, Artificial Sequence
  Description of Artificial Sequence: Synthetic oligonucleotide
  Target: ATXN1; (-) strand; PAM type: YTN; PAM sequence: TTG
tattagtcaggataggataa

SEQ ID NO: 193228 - DNA, 20 bp, Artificial Sequence
  Description of Artificial Sequence: Synthetic oligonucleotide
  Target: ATXN1; (-) strand; PAM type: YTN; PAM sequence: CTA
ttgtattagtcaggatagga

SEQ ID NO: 193229 - DNA, 20 bp, Artificial Sequence
  Description of Artificial Sequence: Synthetic oligonucleotide
  Target: ATXN1; (-) strand; PAM type: YTN; PAM sequence: TTA
ccaaatggtaataatagaga

SEQ ID NO: 193230 - DNA, 20 bp, Artificial Sequence
  Description of Artificial Sequence: Synthetic oligonucleotide
  Target: ATXN1; (-) strand; PAM type: YTN; PAM sequence: TTC
attaccaaatggtaataata

SEQ ID NO: 193231 - DNA, 20 bp, Artificial Sequence
  Description of Artificial Sequence: Synthetic oligonucleotide
  Target: ATXN1; (-) strand; PAM type: YTN; PAM sequence: TTA
gacatgattcattaccaaat

SEQ ID NO: 193232 - DNA, 20 bp, Artificial Sequence
  Description of Artificial Sequence: Synthetic oligonucleotide
  Target: ATXN1; (-) strand; PAM type: YTN; PAM sequence: TTG
ttagacatgattcattacca

SEQ ID NO: 193233 - DNA, 20 bp, Artificial Sequence
  Description of Artificial Sequence: Synthetic oligonucleotide
  Target: ATXN1; (-) strand; PAM type: YTN; PAM sequence: CTA
gcacaaggcattgttagaca

SEQ ID NO: 193234 - DNA, 20 bp, Artificial Sequence
  Description of Artificial Sequence: Synthetic oligonucleotide
  Target: ATXN1; (-) strand; PAM type: YTN; PAM sequence: CTG
agggcagtaaatataaagcc

SEQ ID NO: 193235 - DNA, 20 bp, Artificial Sequence
  Description of Artificial Sequence: Synthetic oligonucleotide
  Target: ATXN1; (-) strand; PAM type: YTN; PAM sequence: TTA
aaagatactgagggcagtaa

SEQ ID NO: 193236 - DNA, 20 bp, Artificial Sequence
  Description of Artificial Sequence: Synthetic oligonucleotide
  Target: ATXN1; (-) strand; PAM type: YTN; PAM sequence: TTA
aggcaattaaaagatactga

SEQ ID NO: 193237 - DNA, 20 bp, Artificial Sequence
  Description of Artificial Sequence: Synthetic oligonucleotide
  Target: ATXN1; (-) strand; PAM type: YTN; PAM sequence: TTA
agtggcaaggagtgagtaaa

SEQ ID NO: 193238 - DNA, 20 bp, Artificial Sequence
  Description of Artificial Sequence: Synthetic oligonucleotide
  Target: ATXN1; (-) strand; PAM type: YTN; PAM sequence: CTC
attaagtggcaaggagtgag

SEQ ID NO: 193239 - DNA, 20 bp, Artificial Sequence
  Description of Artificial Sequence: Synthetic oligonucleotide
  Target: ATXN1; (-) strand; PAM type: YTN; PAM sequence: TTG
tctcattaagtggcaaggag

SEQ ID NO: 193240 - DNA, 20 bp, Artificial Sequence
  Description of Artificial Sequence: Synthetic oligonucleotide
  Target: ATXN1; (-) strand; PAM type: YTN; PAM sequence: CTT
gtctcattaagtggcaagga

SEQ ID NO: 193241 - DNA, 20 bp, Artificial Sequence
  Description of Artificial Sequence: Synthetic oligonucleotide
  Target: ATXN1; (-) strand; PAM type: YTN; PAM sequence: CTC
ttgtctcattaagtggcaag

SEQ ID NO: 193242 - DNA, 20 bp, Artificial Sequence
  Description of Artificial Sequence: Synthetic oligonucleotide
  Target: ATXN1; (-) strand; PAM type: YTN; PAM sequence: TTC
aagaggctcttgtctcatta

SEQ ID NO: 193243 - DNA, 20 bp, Artificial Sequence
  Description of Artificial Sequence: Synthetic oligonucleotide
  Target: ATXN1; (-) strand; PAM type: YTN; PAM sequence: CTT
caagaggctcttgtctcatt

SEQ ID NO: 193244 - DNA, 20 bp, Artificial Sequence
  Description of Artificial Sequence: Synthetic oligonucleotide
  Target: ATXN1; (-) strand; PAM type: YTN; PAM sequence: CTG
tcttcaagaggctcttgtct

SEQ ID NO: 193245 - DNA, 20 bp, Artificial Sequence
  Description of Artificial Sequence: Synthetic oligonucleotide
  Target: ATXN1; (-) strand; PAM type: YTN; PAM sequence: CTG
aaagtacaagccaaggtcac

SEQ ID NO: 193246 - DNA, 20 bp, Artificial Sequence
  Description of Artificial Sequence: Synthetic oligonucleotide
  Target: ATXN1; (-) strand; PAM type: YTN; PAM sequence: TTG
gagggtgaaaaggtaagccc

SEQ ID NO: 193247 - DNA, 20 bp, Artificial Sequence
  Description of Artificial Sequence: Synthetic oligonucleotide
  Target: ATXN1; (-) strand; PAM type: YTN; PAM sequence: TTG
gggaaaatgatgagaggaag

SEQ ID NO: 193248 - DNA, 20 bp, Artificial Sequence
  Description of Artificial Sequence: Synthetic oligonucleotide
  Target: ATXN1; (-) strand; PAM type: YTN; PAM sequence: TTT
ggggaaaatgatgagaggaa

SEQ ID NO: 193249 - DNA, 20 bp, Artificial Sequence
  Description of Artificial Sequence: Synthetic oligonucleotide
  Target: ATXN1; (-) strand; PAM type: YTN; PAM sequence: TTT
tggggaaaatgatgagagga

SEQ ID NO: 193250 - DNA, 20 bp, Artificial Sequence
  Description of Artificial Sequence: Synthetic oligonucleotide
  Target: ATXN1; (-) strand; PAM type: YTN; PAM sequence: CTA
aattttggggaaaatgatga

SEQ ID NO: 193251 - DNA, 20 bp, Artificial Sequence
  Description of Artificial Sequence: Synthetic oligonucleotide
  Target: ATXN1; (-) strand; PAM type: YTN; PAM sequence: CTC
acaactaaattttggggaaa

SEQ ID NO: 193252 - DNA, 20 bp, Artificial Sequence
  Description of Artificial Sequence: Synthetic oligonucleotide
  Target: ATXN1; (-) strand; PAM type: YTN; PAM sequence: TTG
cgaggctcacaactaaattt

SEQ ID NO: 193253 - DNA, 20 bp, Artificial Sequence
  Description of Artificial Sequence: Synthetic oligonucleotide
  Target: ATXN1; (-) strand; PAM type: YTN; PAM sequence: CTT
gcgaggctcacaactaaatt

SEQ ID NO: 193254 - DNA, 20 bp, Artificial Sequence
  Description of Artificial Sequence: Synthetic oligonucleotide
  Target: ATXN1; (-) strand; PAM type: YTN; PAM sequence: CTG
cttgcgaggctcacaactaa

SEQ ID NO: 193255 - DNA, 20 bp, Artificial Sequence
  Description of Artificial Sequence: Synthetic oligonucleotide
  Target: ATXN1; (-) strand; PAM type: YTN; PAM sequence: CTA
ctgcttgcgaggctcacaac

SEQ ID NO: 193256 - DNA, 20 bp, Artificial Sequence
  Description of Artificial Sequence: Synthetic oligonucleotide
  Target: ATXN1; (-) strand; PAM type: YTN; PAM sequence: TTA
agcagctactgcttgcgagg

SEQ ID NO: 193257 - DNA, 20 bp, Artificial Sequence
  Description of Artificial Sequence: Synthetic oligonucleotide
  Target: ATXN1; (-) strand; PAM type: YTN; PAM sequence: TTA
tgagttaagcagctactgct

SEQ ID NO: 193258 - DNA, 20 bp, Artificial Sequence
  Description of Artificial Sequence: Synthetic oligonucleotide
  Target: ATXN1; (-) strand; PAM type: YTN; PAM sequence: CTA
gtgggaaaatatcaagtcat

SEQ ID NO: 193259 - DNA, 20 bp, Artificial Sequence
  Description of Artificial Sequence: Synthetic oligonucleotide
  Target: ATXN1; (-) strand; PAM type: YTN; PAM sequence: TTC
ctagtgggaaaatatcaagt

SEQ ID NO: 193260 - DNA, 20 bp, Artificial Sequence
  Description of Artificial Sequence: Synthetic oligonucleotide
  Target: ATXN1; (-) strand; PAM type: YTN; PAM sequence: TTT
cctagtgggaaaatatcaag

SEQ ID NO: 193261 - DNA, 20 bp, Artificial Sequence
  Description of Artificial Sequence: Synthetic oligonucleotide
  Target: ATXN1; (-) strand; PAM type: YTN; PAM sequence: TTA
tttcctagtgggaaaatatc

SEQ ID NO: 193262 - DNA, 20 bp, Artificial Sequence
  Description of Artificial Sequence: Synthetic oligonucleotide
  Target: ATXN1; (-) strand; PAM type: YTN; PAM sequence: TTG
ggaattatttcctagtggga

SEQ ID NO: 193263 - DNA, 20 bp, Artificial Sequence
  Description of Artificial Sequence: Synthetic oligonucleotide
  Target: ATXN1; (-) strand; PAM type: YTN; PAM sequence: TTA
cgtattgggaattatttcct

SEQ ID NO: 193264 - DNA, 20 bp, Artificial Sequence
  Description of Artificial Sequence: Synthetic oligonucleotide
  Target: ATXN1; (-) strand; PAM type: YTN; PAM sequence: TTA
ttacgtattgggaattattt

SEQ ID NO: 193265 - DNA, 20 bp, Artificial Sequence
  Description of Artificial Sequence: Synthetic oligonucleotide
  Target: ATXN1; (-) strand; PAM type: YTN; PAM sequence: TTG
ttattacgtattgggaatta

SEQ ID NO: 193266 - DNA, 20 bp, Artificial Sequence
  Description of Artificial Sequence: Synthetic oligonucleotide
  Target: ATXN1; (-) strand; PAM type: YTN; PAM sequence: TTA
atgcaaatgaataattgtta

SEQ ID NO: 193267 - DNA, 20 bp, Artificial Sequence
  Description of Artificial Sequence: Synthetic oligonucleotide
  Target: ATXN1; (-) strand; PAM type: YTN; PAM sequence: TTG
gttaatgcaaatgaataatt

SEQ ID NO: 193268 - DNA, 20 bp, Artificial Sequence
  Description of Artificial Sequence: Synthetic oligonucleotide
  Target: ATXN1; (-) strand; PAM type: YTN; PAM sequence: CTG
catggtggtattggttaatg

SEQ ID NO: 193269 - DNA, 20 bp, Artificial Sequence
  Description of Artificial Sequence: Synthetic oligonucleotide
  Target: ATXN1; (-) strand; PAM type: YTN; PAM sequence: CTG
atgatccatgcctgcatggt

SEQ ID NO: 193270 - DNA, 20 bp, Artificial Sequence
  Description of Artificial Sequence: Synthetic oligonucleotide
  Target: ATXN1; (-) strand; PAM type: YTN; PAM sequence: TTC
ctgatgatccatgcctgcat

SEQ ID NO: 193271 - DNA, 20 bp, Artificial Sequence
  Description of Artificial Sequence: Synthetic oligonucleotide
  Target: ATXN1; (-) strand; PAM type: YTN; PAM sequence: TTA
attcctgatgatccatgcct

SEQ ID NO: 193272 - DNA, 20 bp, Artificial Sequence
  Description of Artificial Sequence: Synthetic oligonucleotide
  Target: ATXN1; (-) strand; PAM type: YTN; PAM sequence: CTT
aattcctgatgatccatgcc

SEQ ID NO: 193273 - DNA, 20 bp, Artificial Sequence
  Description of Artificial Sequence: Synthetic oligonucleotide
  Target: ATXN1; (-) strand; PAM type: YTN; PAM sequence: TTG
cacttaattcctgatgatcc

SEQ ID NO: 193274 - DNA, 20 bp, Artificial Sequence
  Description of Artificial Sequence: Synthetic oligonucleotide
  Target: ATXN1; (-) strand; PAM type: YTN; PAM sequence: TTG
tagccattgcacttaattcc

SEQ ID NO: 193275 - DNA, 20 bp, Artificial Sequence
  Description of Artificial Sequence: Synthetic oligonucleotide
  Target: ATXN1; (-) strand; PAM type: YTN; PAM sequence: CTT
gtagccattgcacttaattc

SEQ ID NO: 193276 - DNA, 20 bp, Artificial Sequence
  Description of Artificial Sequence: Synthetic oligonucleotide
  Target: ATXN1; (-) strand; PAM type: YTN; PAM sequence: TTC
ttgtagccattgcacttaat

SEQ ID NO: 193277 - DNA, 20 bp, Artificial Sequence
  Description of Artificial Sequence: Synthetic oligonucleotide
  Target: ATXN1; (-) strand; PAM type: YTN; PAM sequence: CTT
cttgtagccattgcacttaa

SEQ ID NO: 193278 - DNA, 20 bp, Artificial Sequence
  Description of Artificial Sequence: Synthetic oligonucleotide
  Target: ATXN1; (-) strand; PAM type: YTN; PAM sequence: CTA
atgccttcttgtagccattg

SEQ ID NO: 193279 - DNA, 20 bp, Artificial Sequence
  Description of Artificial Sequence: Synthetic oligonucleotide
  Target: ATXN1; (-) strand; PAM type: YTN; PAM sequence: TTC
acagatgaatagctaatgcc

SEQ ID NO: 193280 - DNA, 20 bp, Artificial Sequence
  Description of Artificial Sequence: Synthetic oligonucleotide
  Target: ATXN1; (-) strand; PAM type: YTN; PAM sequence: CTA
agataaattcacagatgaat

SEQ ID NO: 193281 - DNA, 20 bp, Artificial Sequence
  Description of Artificial Sequence: Synthetic oligonucleotide
  Target: ATXN1; (-) strand; PAM type: YTN; PAM sequence: TTG
acacagaatcaaggccatgg

SEQ ID NO: 193282 - DNA, 20 bp, Artificial Sequence
  Description of Artificial Sequence: Synthetic oligonucleotide
  Target: ATXN1; (-) strand; PAM type: YTN; PAM sequence: TTA
gggtcaacacaaataagtaa

SEQ ID NO: 193283 - DNA, 20 bp, Artificial Sequence
  Description of Artificial Sequence: Synthetic oligonucleotide
  Target: ATXN1; (-) strand; PAM type: YTN; PAM sequence: CTA
aagacattagggtcaacaca

SEQ ID NO: 193284 - DNA, 20 bp, Artificial Sequence
  Description of Artificial Sequence: Synthetic oligonucleotide
  Target: ATXN1; (-) strand; PAM type: YTN; PAM sequence: TTA
aatagacctaaagacattag

SEQ ID NO: 193285 - DNA, 20 bp, Artificial Sequence
  Description of Artificial Sequence: Synthetic oligonucleotide
  Target: ATXN1; (-) strand; PAM type: YTN; PAM sequence: TTA
gaagcccagaccaaaatcat

SEQ ID NO: 193286 - DNA, 20 bp, Artificial Sequence
  Description of Artificial Sequence: Synthetic oligonucleotide
  Target: ATXN1; (-) strand; PAM type: YTN; PAM sequence: TTT
agaagcccagaccaaaatca

SEQ ID NO: 193287 - DNA, 20 bp, Artificial Sequence
  Description of Artificial Sequence: Synthetic oligonucleotide
  Target: ATXN1; (-) strand; PAM type: YTN; PAM sequence: TTT
tagaagcccagaccaaaatc

SEQ ID NO: 193288 - DNA, 20 bp, Artificial Sequence
  Description of Artificial Sequence: Synthetic oligonucleotide
  Target: ATXN1; (-) strand; PAM type: YTN; PAM sequence: CTG
aatgagaattttagaagccc

SEQ ID NO: 193289 - DNA, 20 bp, Artificial Sequence
  Description of Artificial Sequence: Synthetic oligonucleotide
  Target: ATXN1; (-) strand; PAM type: YTN; PAM sequence: TTG
tgtgaatgaacaaatgactg

SEQ ID NO: 193290 - DNA, 20 bp, Artificial Sequence
  Description of Artificial Sequence: Synthetic oligonucleotide
  Target: ATXN1; (-) strand; PAM type: YTN; PAM sequence: TTT
gtgtgaatgaacaaatgact

SEQ ID NO: 193291 - DNA, 20 bp, Artificial Sequence
  Description of Artificial Sequence: Synthetic oligonucleotide
  Target: ATXN1; (-) strand; PAM type: YTN; PAM sequence: CTG
tatttgtgtgaatgaacaaa

SEQ ID NO: 193292 - DNA, 20 bp, Artificial Sequence
  Description of Artificial Sequence: Synthetic oligonucleotide
  Target: ATXN1; (-) strand; PAM type: YTN; PAM sequence: CTA
ctgtatttgtgtgaatgaac

SEQ ID NO: 193293 - DNA, 20 bp, Artificial Sequence
  Description of Artificial Sequence: Synthetic oligonucleotide
  Target: ATXN1; (-) strand; PAM type: YTN; PAM sequence: CTG
actactgtatttgtgtgaat

SEQ ID NO: 193294 - DNA, 20 bp, Artificial Sequence
  Description of Artificial Sequence: Synthetic oligonucleotide
  Target: ATXN1; (-) strand; PAM type: YTN; PAM sequence: CTC
agaaactgactactgtattt

SEQ ID NO: 193295 - DNA, 20 bp, Artificial Sequence
  Description of Artificial Sequence: Synthetic oligonucleotide
  Target: ATXN1; (-) strand; PAM type: YTN; PAM sequence: CTC
tcagaaactgactactgtat

SEQ ID NO: 193296 - DNA, 20 bp, Artificial Sequence
  Description of Artificial Sequence: Synthetic oligonucleotide
  Target: ATXN1; (-) strand; PAM type: YTN; PAM sequence: CTA
cctctcagaaactgactact

SEQ ID NO: 193297 - DNA, 20 bp, Artificial Sequence
  Description of Artificial Sequence: Synthetic oligonucleotide
  Target: ATXN1; (-) strand; PAM type: YTN; PAM sequence: CTG
ctacctctcagaaactgact

SEQ ID NO: 193298 - DNA, 20 bp, Artificial Sequence
  Description of Artificial Sequence: Synthetic oligonucleotide
  Target: ATXN1; (-) strand; PAM type: YTN; PAM sequence: CTC
tgctacctctcagaaactga

SEQ ID NO: 193299 - DNA, 20 bp, Artificial Sequence
  Description of Artificial Sequence: Synthetic oligonucleotide
  Target: ATXN1; (-) strand; PAM type: YTN; PAM sequence: TTC
tctgctacctctcagaaact

SEQ ID NO: 193300 - DNA, 20 bp, Artificial Sequence
  Description of Artificial Sequence: Synthetic oligonucleotide
  Target: ATXN1; (-) strand; PAM type: YTN; PAM sequence: TTT
ctctgctacctctcagaaac

SEQ ID NO: 193301 - DNA, 20 bp, Artificial Sequence
  Description of Artificial Sequence: Synthetic oligonucleotide
  Target: ATXN1; (-) strand; PAM type: YTN; PAM sequence: TTT
tctctgctacctctcagaaa

SEQ ID NO: 193302 - DNA, 20 bp, Artificial Sequence
  Description of Artificial Sequence: Synthetic oligonucleotide
  Target: ATXN1; (-) strand; PAM type: YTN; PAM sequence: TTT
ttctctgctacctctcagaa

SEQ ID NO: 193303 - DNA, 20 bp, Artificial Sequence
  Description of Artificial Sequence: Synthetic oligonucleotide
  Target: ATXN1; (-) strand; PAM type: YTN; PAM sequence: TTT
tttctctgctacctctcaga

SEQ ID NO: 193304 - DNA, 20 bp, Artificial Sequence
  Description of Artificial Sequence: Synthetic oligonucleotide
  Target: ATXN1; (-) strand; PAM type: YTN; PAM sequence: TTT
ttttctctgctacctctcag

SEQ ID NO: 193305 - DNA, 20 bp, Artificial Sequence
  Description of Artificial Sequence: Synthetic oligonucleotide
  Target: ATXN1; (-) strand; PAM type: YTN; PAM sequence: CTT
tttttctctgctacctctca

SEQ ID NO: 193306 - DNA, 20 bp, Artificial Sequence
  Description of Artificial Sequence: Synthetic oligonucleotide
  Target: ATXN1; (-) strand; PAM type: YTN; PAM sequence: CTC
catagctttttttctctgct

SEQ ID NO: 193307 - DNA, 20 bp, Artificial Sequence
  Description of Artificial Sequence: Synthetic oligonucleotide
  Target: ATXN1; (-) strand; PAM type: YTN; PAM sequence: CTG
actccatagctttttttctc

SEQ ID NO: 193308 - DNA, 20 bp, Artificial Sequence
  Description of Artificial Sequence: Synthetic oligonucleotide
  Target: ATXN1; (-) strand; PAM type: YTN; PAM sequence: CTA
gcctgactccatagcttttt

SEQ ID NO: 193309 - DNA, 20 bp, Artificial Sequence
  Description of Artificial Sequence: Synthetic oligonucleotide
  Target: ATXN1; (-) strand; PAM type: YTN; PAM sequence: CTC
acagctagcctgactccata

SEQ ID NO: 193310 - DNA, 20 bp, Artificial Sequence
  Description of Artificial Sequence: Synthetic oligonucleotide
  Target: ATXN1; (-) strand; PAM type: YTN; PAM sequence: CTG
gcccacagtctcacagctag

SEQ ID NO: 193311 - DNA, 20 bp, Artificial Sequence
  Description of Artificial Sequence: Synthetic oligonucleotide
  Target: ATXN1; (-) strand; PAM type: YTN; PAM sequence: CTG
gggacatgaagaggtcaagt

SEQ ID NO: 193312 - DNA, 20 bp, Artificial Sequence
  Description of Artificial Sequence: Synthetic oligonucleotide
  Target: ATXN1; (-) strand; PAM type: YTN; PAM sequence: TTG
tgggaaaggaaactggggac

SEQ ID NO: 193313 - DNA, 20 bp, Artificial Sequence
  Description of Artificial Sequence: Synthetic oligonucleotide
  Target: ATXN1; (-) strand; PAM type: YTN; PAM sequence: TTT
gtgggaaaggaaactgggga

SEQ ID NO: 193314 - DNA, 20 bp, Artificial Sequence
  Description of Artificial Sequence: Synthetic oligonucleotide
  Target: ATXN1; (-) strand; PAM type: YTN; PAM sequence: TTT
tgtgggaaaggaaactgggg

SEQ ID NO: 193315 - DNA, 20 bp, Artificial Sequence
  Description of Artificial Sequence: Synthetic oligonucleotide
  Target: ATXN1; (-) strand; PAM type: YTN; PAM sequence: CTC
gttttgtgggaaaggaaact

SEQ ID NO: 193316 - DNA, 20 bp, Artificial Sequence
  Description of Artificial Sequence: Synthetic oligonucleotide
  Target: ATXN1; (-) strand; PAM type: YTN; PAM sequence: TTA
aactcgttttgtgggaaagg

SEQ ID NO: 193317 - DNA, 20 bp, Artificial Sequence
  Description of Artificial Sequence: Synthetic oligonucleotide
  Target: ATXN1; (-) strand; PAM type: YTN; PAM sequence: TTT
aaactcgttttgtgggaaag

SEQ ID NO: 193318 - DNA, 20 bp, Artificial Sequence
  Description of Artificial Sequence: Synthetic oligonucleotide
  Target: ATXN1; (-) strand; PAM type: YTN; PAM sequence: TTT
taaactcgttttgtgggaaa

SEQ ID NO: 193319 - DNA, 20 bp, Artificial Sequence
  Description of Artificial Sequence: Synthetic oligonucleotide
  Target: ATXN1; (-) strand; PAM type: YTN; PAM sequence: TTA
caagatacattttaaactcg

SEQ ID NO: 193320 - DNA, 20 bp, Artificial Sequence
  Description of Artificial Sequence: Synthetic oligonucleotide
  Target: ATXN1; (-) strand; PAM type: YTN; PAM sequence: CTT
acaagatacattttaaactc

SEQ ID NO: 193321 - DNA, 20 bp, Artificial Sequence
  Description of Artificial Sequence: Synthetic oligonucleotide
  Target: ATXN1; (-) strand; PAM type: YTN; PAM sequence: CTC
acaacaaccttacaagatac

SEQ ID NO: 193322 - DNA, 20 bp, Artificial Sequence
  Description of Artificial Sequence: Synthetic oligonucleotide
  Target: ATXN1; (-) strand; PAM type: YTN; PAM sequence: TTC
tcacaacaaccttacaagat

SEQ ID NO: 193323 - DNA, 20 bp, Artificial Sequence
  Description of Artificial Sequence: Synthetic oligonucleotide
  Target: ATXN1; (-) strand; PAM type: YTN; PAM sequence: TTG
tgtaattctcacaacaacct

SEQ ID NO: 193324 - DNA, 20 bp, Artificial Sequence
  Description of Artificial Sequence: Synthetic oligonucleotide
  Target: ATXN1; (-) strand; PAM type: YTN; PAM sequence: CTT
gtgtaattctcacaacaacc

SEQ ID NO: 193325 - DNA, 20 bp, Artificial Sequence
  Description of Artificial Sequence: Synthetic oligonucleotide
  Target: ATXN1; (-) strand; PAM type: YTN; PAM sequence: TTA
acttgtgtaattctcacaac

SEQ ID NO: 193326 - DNA, 20 bp, Artificial Sequence
  Description of Artificial Sequence: Synthetic oligonucleotide
  Target: ATXN1; (-) strand; PAM type: YTN; PAM sequence: TTG
catatattaacttgtgtaat

SEQ ID NO: 193327 - DNA, 20 bp, Artificial Sequence
  Description of Artificial Sequence: Synthetic oligonucleotide
  Target: ATXN1; (-) strand; PAM type: YTN; PAM sequence: CTT
gcatatattaacttgtgtaa

SEQ ID NO: 193328 - DNA, 20 bp, Artificial Sequence
  Description of Artificial Sequence: Synthetic oligonucleotide
  Target: ATXN1; (-) strand; PAM type: YTN; PAM sequence: TTA
tgtatcttgcatatattaac

SEQ ID NO: 193329 - DNA, 20 bp, Artificial Sequence
  Description of Artificial Sequence: Synthetic oligonucleotide
  Target: ATXN1; (-) strand; PAM type: YTN; PAM sequence: TTT
atgtatcttgcatatattaa

SEQ ID NO: 193330 - DNA, 20 bp, Artificial Sequence
  Description of Artificial Sequence: Synthetic oligonucleotide
  Target: ATXN1; (-) strand; PAM type: YTN; PAM sequence: TTT
tatgtatcttgcatatatta

SEQ ID NO: 193331 - DNA, 20 bp, Artificial Sequence
  Description of Artificial Sequence: Synthetic oligonucleotide
  Target: ATXN1; (-) strand; PAM type: YTN; PAM sequence: CTT
ttatgtatcttgcatatatt

SEQ ID NO: 193332 - DNA, 20 bp, Artificial Sequence
  Description of Artificial Sequence: Synthetic oligonucleotide
  Target: ATXN1; (-) strand; PAM type: YTN; PAM sequence: TTA
aaataacttttatgtatctt

SEQ ID NO: 193333 - DNA, 20 bp, Artificial Sequence
  Description of Artificial Sequence: Synthetic oligonucleotide
  Target: ATXN1; (-) strand; PAM type: YTN; PAM sequence: TTT
aaaataacttttatgtatct

SEQ ID NO: 193334 - DNA, 20 bp, Artificial Sequence
  Description of Artificial Sequence: Synthetic oligonucleotide
  Target: ATXN1; (-) strand; PAM type: YTN; PAM sequence: TTA
aaatttaaaataacttttat

SEQ ID NO: 193335 - DNA, 20 bp, Artificial Sequence
  Description of Artificial Sequence: Synthetic oligonucleotide
  Target: ATXN1; (-) strand; PAM type: YTN; PAM sequence: TTT
aaaatttaaaataactttta

SEQ ID NO: 193336 - DNA, 20 bp, Artificial Sequence
  Description of Artificial Sequence: Synthetic oligonucleotide
  Target: ATXN1; (-) strand; PAM type: YTN; PAM sequence: TTT
taaaatttaaaataactttt

SEQ ID NO: 193337 - DNA, 20 bp, Artificial Sequence
  Description of Artificial Sequence: Synthetic oligonucleotide
  Target: ATXN1; (-) strand; PAM type: YTN; PAM sequence: TTA
ttttaaaatttaaaataact

SEQ ID NO: 193338 - DNA, 20 bp, Artificial Sequence
  Description of Artificial Sequence: Synthetic oligonucleotide
  Target: ATXN1; (-) strand; PAM type: YTN; PAM sequence: TTT
attttaaaatttaaaataac

SEQ ID NO: 193339 - DNA, 20 bp, Artificial Sequence
  Description of Artificial Sequence: Synthetic oligonucleotide
  Target: ATXN1; (-) strand; PAM type: YTN; PAM sequence: CTT
tattttaaaatttaaaataa

SEQ ID NO: 193340 - DNA, 20 bp, Artificial Sequence
  Description of Artificial Sequence: Synthetic oligonucleotide
  Target: ATXN1; (-) strand; PAM type: YTN; PAM sequence: CTG
ctttattttaaaatttaaaa

SEQ ID NO: 193341 - DNA, 20 bp, Artificial Sequence
  Description of Artificial Sequence: Synthetic oligonucleotide
  Target: ATXN1; (-) strand; PAM type: YTN; PAM sequence: TTA
caacatgcccagtactgctt

SEQ ID NO: 193342 - DNA, 20 bp, Artificial Sequence
  Description of Artificial Sequence: Synthetic oligonucleotide
  Target: ATXN1; (-) strand; PAM type: YTN; PAM sequence: CTT
acaacatgcccagtactgct

SEQ ID NO: 193343 - DNA, 20 bp, Artificial Sequence
  Description of Artificial Sequence: Synthetic oligonucleotide
  Target: ATXN1; (-) strand; PAM type: YTN; PAM sequence: CTA
agcacttacaacatgcccag

SEQ ID NO: 193344 - DNA, 20 bp, Artificial Sequence
  Description of Artificial Sequence: Synthetic oligonucleotide
  Target: ATXN1; (-) strand; PAM type: YTN; PAM sequence: TTC
taagcacttacaacatgccc

SEQ ID NO: 193345 - DNA, 20 bp, Artificial Sequence
  Description of Artificial Sequence: Synthetic oligonucleotide
  Target: ATXN1; (-) strand; PAM type: YTN; PAM sequence: TTA
gcattctaagcacttacaac

SEQ ID NO: 193346 - DNA, 20 bp, Artificial Sequence
  Description of Artificial Sequence: Synthetic oligonucleotide
  Target: ATXN1; (-) strand; PAM type: YTN; PAM sequence: CTC
agtatatgataatattagca

SEQ ID NO: 193347 - DNA, 20 bp, Artificial Sequence
  Description of Artificial Sequence: Synthetic oligonucleotide
  Target: ATXN1; (-) strand; PAM type: YTN; PAM sequence: CTG
ccatgtagtaggtgctcagt

SEQ ID NO: 193348 - DNA, 20 bp, Artificial Sequence
  Description of Artificial Sequence: Synthetic oligonucleotide
  Target: ATXN1; (-) strand; PAM type: YTN; PAM sequence: CTA
atatctgccatgtagtaggt

SEQ ID NO: 193349 - DNA, 20 bp, Artificial Sequence
  Description of Artificial Sequence: Synthetic oligonucleotide
  Target: ATXN1; (-) strand; PAM type: YTN; PAM sequence: CTC
taatatctgccatgtagtag

SEQ ID NO: 193350 - DNA, 20 bp, Artificial Sequence
  Description of Artificial Sequence: Synthetic oligonucleotide
  Target: ATXN1; (-) strand; PAM type: YTN; PAM sequence: TTC
ctctaatatctgccatgtag

SEQ ID NO: 193351 - DNA, 20 bp, Artificial Sequence
  Description of Artificial Sequence: Synthetic oligonucleotide
  Target: ATXN1; (-) strand; PAM type: YTN; PAM sequence: TTG
ttcctctaatatctgccatg

SEQ ID NO: 193352 - DNA, 20 bp, Artificial Sequence
  Description of Artificial Sequence: Synthetic oligonucleotide
  Target: ATXN1; (-) strand; PAM type: YTN; PAM sequence: CTT
gttcctctaatatctgccat

SEQ ID NO: 193353 - DNA, 20 bp, Artificial Sequence
  Description of Artificial Sequence: Synthetic oligonucleotide
  Target: ATXN1; (-) strand; PAM type: YTN; PAM sequence: TTC
ttgttcctctaatatctgcc

SEQ ID NO: 193354 - DNA, 20 bp, Artificial Sequence
  Description of Artificial Sequence: Synthetic oligonucleotide
  Target: ATXN1; (-) strand; PAM type: YTN; PAM sequence: TTA
atcattcttgttcctctaat

SEQ ID NO: 193355 - DNA, 20 bp, Artificial Sequence
  Description of Artificial Sequence: Synthetic oligonucleotide
  Target: ATXN1; (-) strand; PAM type: YTN; PAM sequence: CTG
ttaatcattcttgttcctct

SEQ ID NO: 193356 - DNA, 20 bp, Artificial Sequence
  Description of Artificial Sequence: Synthetic oligonucleotide
  Target: ATXN1; (-) strand; PAM type: YTN; PAM sequence: CTG
gggaacctgttaatcattct

SEQ ID NO: 193357 - DNA, 20 bp, Artificial Sequence
  Description of Artificial Sequence: Synthetic oligonucleotide
  Target: ATXN1; (-) strand; PAM type: YTN; PAM sequence: TTG
aagaactggggaacctgtta

SEQ ID NO: 193358 - DNA, 20 bp, Artificial Sequence
  Description of Artificial Sequence: Synthetic oligonucleotide
  Target: ATXN1; (-) strand; PAM type: YTN; PAM sequence: CTT
gaagaactggggaacctgtt

SEQ ID NO: 193359 - DNA, 20 bp, Artificial Sequence
  Description of Artificial Sequence: Synthetic oligonucleotide
  Target: ATXN1; (-) strand; PAM type: YTN; PAM sequence: TTG
caaatgcttgaagaactggg

SEQ ID NO: 193360 - DNA, 20 bp, Artificial Sequence
  Description of Artificial Sequence: Synthetic oligonucleotide
  Target: ATXN1; (-) strand; PAM type: YTN; PAM sequence: CTA
gattgcaaatgcttgaagaa

SEQ ID NO: 193361 - DNA, 20 bp, Artificial Sequence
  Description of Artificial Sequence: Synthetic oligonucleotide
  Target: ATXN1; (-) strand; PAM type: YTN; PAM sequence: TTA
ctagattgcaaatgcttgaa

SEQ ID NO: 193362 - DNA, 20 bp, Artificial Sequence
  Description of Artificial Sequence: Synthetic oligonucleotide
  Target: ATXN1; (-) strand; PAM type: YTN; PAM sequence: CTT
actagattgcaaatgcttga

SEQ ID NO: 193363 - DNA, 20 bp, Artificial Sequence
  Description of Artificial Sequence: Synthetic oligonucleotide
  Target: ATXN1; (-) strand; PAM type: YTN; PAM sequence: TTA
cccttactagattgcaaatg

SEQ ID NO: 193364 - DNA, 20 bp, Artificial Sequence
  Description of Artificial Sequence: Synthetic oligonucleotide
  Target: ATXN1; (-) strand; PAM type: YTN; PAM sequence: TTT
acccttactagattgcaaat

SEQ ID NO: 193365 - DNA, 20 bp, Artificial Sequence
  Description of Artificial Sequence: Synthetic oligonucleotide
  Target: ATXN1; (-) strand; PAM type: YTN; PAM sequence: TTT
tacccttactagattgcaaa

SEQ ID NO: 193366 - DNA, 20 bp, Artificial Sequence
  Description of Artificial Sequence: Synthetic oligonucleotide
  Target: ATXN1; (-) strand; PAM type: YTN; PAM sequence: CTT
ttacccttactagattgcaa

SEQ ID NO: 193367 - DNA, 20 bp, Artificial Sequence
  Description of Artificial Sequence: Synthetic oligonucleotide
  Target: ATXN1; (-) strand; PAM type: YTN; PAM sequence: TTA
catatcttttacccttacta

SEQ ID NO: 193368 - DNA, 20 bp, Artificial Sequence
  Description of Artificial Sequence: Synthetic oligonucleotide
  Target: ATXN1; (-) strand; PAM type: YTN; PAM sequence: TTT
acatatcttttacccttact

SEQ ID NO: 193369 - DNA, 20 bp, Artificial Sequence
  Description of Artificial Sequence: Synthetic oligonucleotide
  Target: ATXN1; (-) strand; PAM type: YTN; PAM sequence: TTG
tttacatatcttttaccctt

SEQ ID NO: 193370 - DNA, 20 bp, Artificial Sequence
  Description of Artificial Sequence: Synthetic oligonucleotide
  Target: ATXN1; (-) strand; PAM type: YTN; PAM sequence: TTT
gtttacatatcttttaccct

SEQ ID NO: 193371 - DNA, 20 bp, Artificial Sequence
  Description of Artificial Sequence: Synthetic oligonucleotide
  Target: ATXN1; (-) strand; PAM type: YTN; PAM sequence: TTA
tttgtttacatatcttttac

SEQ ID NO: 193372 - DNA, 20 bp, Artificial Sequence
  Description of Artificial Sequence: Synthetic oligonucleotide
  Target: ATXN1; (-) strand; PAM type: YTN; PAM sequence: CTT
atttgtttacatatctttta

SEQ ID NO: 193373 - DNA, 20 bp, Artificial Sequence
  Description of Artificial Sequence: Synthetic oligonucleotide
  Target: ATXN1; (-) strand; PAM type: YTN; PAM sequence: TTC
acttatttgtttacatatct

SEQ ID NO: 193374 - DNA, 20 bp, Artificial Sequence
  Description of Artificial Sequence: Synthetic oligonucleotide
  Target: ATXN1; (-) strand; PAM type: YTN; PAM sequence: CTT
cacttatttgtttacatatc

SEQ ID NO: 193375 - DNA, 20 bp, Artificial Sequence
  Description of Artificial Sequence: Synthetic oligonucleotide
  Target: ATXN1; (-) strand; PAM type: YTN; PAM sequence: CTG
taatacttcacttatttgtt

SEQ ID NO: 193376 - DNA, 20 bp, Artificial Sequence
  Description of Artificial Sequence: Synthetic oligonucleotide
  Target: ATXN1; (-) strand; PAM type: YTN; PAM sequence: CTC
tgtaatacttcacttatttg

SEQ ID NO: 193377 - DNA, 20 bp, Artificial Sequence
  Description of Artificial Sequence: Synthetic oligonucleotide
  Target: ATXN1; (-) strand; PAM type: YTN; PAM sequence: CTG
gctctgtaatacttcactta

SEQ ID NO: 193378 - DNA, 20 bp, Artificial Sequence
  Description of Artificial Sequence: Synthetic oligonucleotide
  Target: ATXN1; (-) strand; PAM type: YTN; PAM sequence: CTC
tggctctgtaatacttcact

SEQ ID NO: 193379 - DNA, 20 bp, Artificial Sequence
  Description of Artificial Sequence: Synthetic oligonucleotide
  Target: ATXN1; (-) strand; PAM type: YTN; PAM sequence: CTC
tctggctctgtaatacttca

SEQ ID NO: 193380 - DNA, 20 bp, Artificial Sequence
  Description of Artificial Sequence: Synthetic oligonucleotide
  Target: ATXN1; (-) strand; PAM type: YTN; PAM sequence: CTC
tctctggctctgtaatactt

SEQ ID NO: 193381 - DNA, 20 bp, Artificial Sequence
  Description of Artificial Sequence: Synthetic oligonucleotide
  Target: ATXN1; (-) strand; PAM type: YTN; PAM sequence: CTC
tctctctggctctgtaatac

SEQ ID NO: 193382 - DNA, 20 bp, Artificial Sequence
  Description of Artificial Sequence: Synthetic oligonucleotide
  Target: ATXN1; (-) strand; PAM type: YTN; PAM sequence: CTC
tctctctctggctctgtaat

SEQ ID NO: 193383 - DNA, 20 bp, Artificial Sequence
  Description of Artificial Sequence: Synthetic oligonucleotide
  Target: ATXN1; (-) strand; PAM type: YTN; PAM sequence: TTC
tctctctctctggctctgta

SEQ ID NO: 193384 - DNA, 20 bp, Artificial Sequence
  Description of Artificial Sequence: Synthetic oligonucleotide
  Target: ATXN1; (-) strand; PAM type: YTN; PAM sequence: TTG
tgttctctctctctctggct

SEQ ID NO: 193385 - DNA, 20 bp, Artificial Sequence
  Description of Artificial Sequence: Synthetic oligonucleotide
  Target: ATXN1; (-) strand; PAM type: YTN; PAM sequence: CTT
gtgttctctctctctctggc

SEQ ID NO: 193386 - DNA, 20 bp, Artificial Sequence
  Description of Artificial Sequence: Synthetic oligonucleotide
  Target: ATXN1; (-) strand; PAM type: YTN; PAM sequence: TTG
tatgtacttgtgttctctct

SEQ ID NO: 193387 - DNA, 20 bp, Artificial Sequence
  Description of Artificial Sequence: Synthetic oligonucleotide
  Target: ATXN1; (-) strand; PAM type: YTN; PAM sequence: TTT
gtatgtacttgtgttctctc

SEQ ID NO: 193388 - DNA, 20 bp, Artificial Sequence
  Description of Artificial Sequence: Synthetic oligonucleotide
  Target: ATXN1; (-) strand; PAM type: YTN; PAM sequence: TTG
tgcatatgtatttgtatgta

SEQ ID NO: 193389 - DNA, 20 bp, Artificial Sequence
  Description of Artificial Sequence: Synthetic oligonucleotide
  Target: ATXN1; (-) strand; PAM type: YTN; PAM sequence: TTT
gtgcatatgtatttgtatgt

SEQ ID NO: 193390 - DNA, 20 bp, Artificial Sequence
  Description of Artificial Sequence: Synthetic oligonucleotide
  Target: ATXN1; (-) strand; PAM type: YTN; PAM sequence: TTT
tgtgcatatgtatttgtatg

SEQ ID NO: 193391 - DNA, 20 bp, Artificial Sequence
  Description of Artificial Sequence: Synthetic oligonucleotide
  Target: ATXN1; (-) strand; PAM type: YTN; PAM sequence: CTT
ttgtgcatatgtatttgtat

SEQ ID NO: 193392 - DNA, 20 bp, Artificial Sequence
  Description of Artificial Sequence: Synthetic oligonucleotide
  Target: ATXN1; (-) strand; PAM type: YTN; PAM sequence: CTG
tatccttttgtgcatatgta

SEQ ID NO: 193393 - DNA, 20 bp, Artificial Sequence
  Description of Artificial Sequence: Synthetic oligonucleotide
  Target: ATXN1; (-) strand; PAM type: YTN; PAM sequence: CTA
catacctgtatccttttgtg

SEQ ID NO: 193394 - DNA, 20 bp, Artificial Sequence
  Description of Artificial Sequence: Synthetic oligonucleotide
  Target: ATXN1; (-) strand; PAM type: YTN; PAM sequence: TTG
tatgcatgtgtgtgcaccta

SEQ ID NO: 193395 - DNA, 20 bp, Artificial Sequence
  Description of Artificial Sequence: Synthetic oligonucleotide
  Target: ATXN1; (-) strand; PAM type: YTN; PAM sequence: TTT
gtatgcatgtgtgtgcacct

SEQ ID NO: 193396 - DNA, 20 bp, Artificial Sequence
  Description of Artificial Sequence: Synthetic oligonucleotide
  Target: ATXN1; (-) strand; PAM type: YTN; PAM sequence: CTT
tgtatgcatgtgtgtgcacc

SEQ ID NO: 193397 - DNA, 20 bp, Artificial Sequence
  Description of Artificial Sequence: Synthetic oligonucleotide
  Target: ATXN1; (-) strand; PAM type: YTN; PAM sequence: CTC
atgtaggtgagtgtgcatgt

SEQ ID NO: 193398 - DNA, 20 bp, Artificial Sequence
  Description of Artificial Sequence: Synthetic oligonucleotide
  Target: ATXN1; (-) strand; PAM type: YTN; PAM sequence: CTC
tcatgtaggtgagtgtgcat

SEQ ID NO: 193399 - DNA, 20 bp, Artificial Sequence
  Description of Artificial Sequence: Synthetic oligonucleotide
  Target: ATXN1; (-) strand; PAM type: YTN; PAM sequence: TTG
gcatgtgtgcatgtgtgtgc

SEQ ID NO: 193400 - DNA, 20 bp, Artificial Sequence
  Description of Artificial Sequence: Synthetic oligonucleotide
  Target: ATXN1; (-) strand; PAM type: YTN; PAM sequence: TTG
gcagtagttggcatgtgtgc

SEQ ID NO: 193401 - DNA, 20 bp, Artificial Sequence
  Description of Artificial Sequence: Synthetic oligonucleotide
  Target: ATXN1; (-) strand; PAM type: YTN; PAM sequence: CTC
atcagttggcagtagttggc

SEQ ID NO: 193402 - DNA, 20 bp, Artificial Sequence
  Description of Artificial Sequence: Synthetic oligonucleotide
  Target: ATXN1; (-) strand; PAM type: YTN; PAM sequence: CTG
tatgtagctcatcagttggc

SEQ ID NO: 193403 - DNA, 20 bp, Artificial Sequence
  Description of Artificial Sequence: Synthetic oligonucleotide
  Target: ATXN1; (-) strand; PAM type: YTN; PAM sequence: CTC
tgtatgtagctcatcagttg

SEQ ID NO: 193404 - DNA, 20 bp, Artificial Sequence
  Description of Artificial Sequence: Synthetic oligonucleotide
  Target: ATXN1; (-) strand; PAM type: YTN; PAM sequence: TTG
ctctgtatgtagctcatcag

SEQ ID NO: 193405 - DNA, 20 bp, Artificial Sequence
  Description of Artificial Sequence: Synthetic oligonucleotide
  Target: ATXN1; (-) strand; PAM type: YTN; PAM sequence: CTT
gctctgtatgtagctcatca

SEQ ID NO: 193406 - DNA, 20 bp, Artificial Sequence
  Description of Artificial Sequence: Synthetic oligonucleotide
  Target: ATXN1; (-) strand; PAM type: YTN; PAM sequence: TTC
ttgctctgtatgtagctcat

SEQ ID NO: 193407 - DNA, 20 bp, Artificial Sequence
  Description of Artificial Sequence: Synthetic oligonucleotide
  Target: ATXN1; (-) strand; PAM type: YTN; PAM sequence: CTT
cttgctctgtatgtagctca

SEQ ID NO: 193408 - DNA, 20 bp, Artificial Sequence
  Description of Artificial Sequence: Synthetic oligonucleotide
  Target: ATXN1; (-) strand; PAM type: YTN; PAM sequence: CTC
ttcttgctctgtatgtagct

SEQ ID NO: 193409 - DNA, 20 bp, Artificial Sequence
  Description of Artificial Sequence: Synthetic oligonucleotide
  Target: ATXN1; (-) strand; PAM type: YTN; PAM sequence: TTC
agcaatcgtggtctcttctt

SEQ ID NO: 193410 - DNA, 20 bp, Artificial Sequence
  Description of Artificial Sequence: Synthetic oligonucleotide
  Target: ATXN1; (-) strand; PAM type: YTN; PAM sequence: CTA
gttcagcaatcgtggtctct

SEQ ID NO: 193411 - DNA, 20 bp, Artificial Sequence
  Description of Artificial Sequence: Synthetic oligonucleotide
  Target: ATXN1; (-) strand; PAM type: YTN; PAM sequence: CTG
taggagctagttcagcaatc

SEQ ID NO: 193412 - DNA, 20 bp, Artificial Sequence
  Description of Artificial Sequence: Synthetic oligonucleotide
  Target: ATXN1; (-) strand; PAM type: YTN; PAM sequence: CTG
gcaagtctgtaggagctagt

SEQ ID NO: 193413 - DNA, 20 bp, Artificial Sequence
  Description of Artificial Sequence: Synthetic oligonucleotide
  Target: ATXN1; (-) strand; PAM type: YTN; PAM sequence: TTG
tctggcaagtctgtaggagc

SEQ ID NO: 193414 - DNA, 20 bp, Artificial Sequence
  Description of Artificial Sequence: Synthetic oligonucleotide
  Target: ATXN1; (-) strand; PAM type: YTN; PAM sequence: CTT
gtctggcaagtctgtaggag

SEQ ID NO: 193415 - DNA, 20 bp, Artificial Sequence
  Description of Artificial Sequence: Synthetic oligonucleotide
  Target: ATXN1; (-) strand; PAM type: YTN; PAM sequence: CTG
tcttgtctggcaagtctgta

SEQ ID NO: 193416 - DNA, 20 bp, Artificial Sequence
  Description of Artificial Sequence: Synthetic oligonucleotide
  Target: ATXN1; (-) strand; PAM type: YTN; PAM sequence: CTG
gtgccctgtcttgtctggca

SEQ ID NO: 193417 - DNA, 20 bp, Artificial Sequence
  Description of Artificial Sequence: Synthetic oligonucleotide
  Target: ATXN1; (-) strand; PAM type: YTN; PAM sequence: CTG
gacatccctggtgccctgtc

SEQ ID NO: 193418 - DNA, 20 bp, Artificial Sequence
  Description of Artificial Sequence: Synthetic oligonucleotide
  Target: ATXN1; (-) strand; PAM type: YTN; PAM sequence: TTA
cctggacatccctggtgccc

SEQ ID NO: 193419 - DNA, 20 bp, Artificial Sequence
  Description of Artificial Sequence: Synthetic oligonucleotide
  Target: ATXN1; (-) strand; PAM type: YTN; PAM sequence: TTA
attacctggacatccctggt

SEQ ID NO: 193420 - DNA, 20 bp, Artificial Sequence
  Description of Artificial Sequence: Synthetic oligonucleotide
  Target: ATXN1; (-) strand; PAM type: YTN; PAM sequence: TTT
aattacctggacatccctgg

SEQ ID NO: 193421 - DNA, 20 bp, Artificial Sequence
  Description of Artificial Sequence: Synthetic oligonucleotide
  Target: ATXN1; (-) strand; PAM type: YTN; PAM sequence: CTT
taattacctggacatccctg

SEQ ID NO: 193422 - DNA, 20 bp, Artificial Sequence
  Description of Artificial Sequence: Synthetic oligonucleotide
  Target: ATXN1; (-) strand; PAM type: YTN; PAM sequence: CTC
tttaattacctggacatccc

SEQ ID NO: 193423 - DNA, 20 bp, Artificial Sequence
  Description of Artificial Sequence: Synthetic oligonucleotide
  Target: ATXN1; (-) strand; PAM type: YTN; PAM sequence: CTC
acactctttaattacctgga

SEQ ID NO: 193424 - DNA, 20 bp, Artificial Sequence
  Description of Artificial Sequence: Synthetic oligonucleotide
  Target: ATXN1; (-) strand; PAM type: YTN; PAM sequence: CTG
ctcacactctttaattacct

SEQ ID NO: 193425 - DNA, 20 bp, Artificial Sequence
  Description of Artificial Sequence: Synthetic oligonucleotide
  Target: ATXN1; (-) strand; PAM type: YTN; PAM sequence: CTC
tgctcacactctttaattac

SEQ ID NO: 193426 - DNA, 20 bp, Artificial Sequence
  Description of Artificial Sequence: Synthetic oligonucleotide
  Target: ATXN1; (-) strand; PAM type: YTN; PAM sequence: TTG
atgcctctgctcacactctt

SEQ ID NO: 193427 - DNA, 20 bp, Artificial Sequence
  Description of Artificial Sequence: Synthetic oligonucleotide
  Target: ATXN1; (-) strand; PAM type: YTN; PAM sequence: TTT
gatgcctctgctcacactct

SEQ ID NO: 193428 - DNA, 20 bp, Artificial Sequence
  Description of Artificial Sequence: Synthetic oligonucleotide
  Target: ATXN1; (-) strand; PAM type: YTN; PAM sequence: TTG
tttgatgcctctgctcacac

SEQ ID NO: 193429 - DNA, 20 bp, Artificial Sequence
  Description of Artificial Sequence: Synthetic oligonucleotide
  Target: ATXN1; (-) strand; PAM type: YTN; PAM sequence: TTG
aatgaataaacacatagatg

SEQ ID NO: 193430 - DNA, 20 bp, Artificial Sequence
  Description of Artificial Sequence: Synthetic oligonucleotide
  Target: ATXN1; (-) strand; PAM type: YTN; PAM sequence: TTG
ttgaatgaataaacacatag

SEQ ID NO: 193431 - DNA, 20 bp, Artificial Sequence
  Description of Artificial Sequence: Synthetic oligonucleotide
  Target: ATXN1; (-) strand; PAM type: YTN; PAM sequence: TTT
gttgaatgaataaacacata

SEQ ID NO: 193432 - DNA, 20 bp, Artificial Sequence
  Description of Artificial Sequence: Synthetic oligonucleotide
  Target: ATXN1; (-) strand; PAM type: YTN; PAM sequence: TTG
atcaatatttgttgaatgaa

SEQ ID NO: 193433 - DNA, 20 bp, Artificial Sequence
  Description of Artificial Sequence: Synthetic oligonucleotide
  Target: ATXN1; (-) strand; PAM type: YTN; PAM sequence: TTT
gatcaatatttgttgaatga

SEQ ID NO: 193434 - DNA, 20 bp, Artificial Sequence
  Description of Artificial Sequence: Synthetic oligonucleotide
  Target: ATXN1; (-) strand; PAM type: YTN; PAM sequence: CTG
tgccaagcacataggaggca

SEQ ID NO: 193435 - DNA, 20 bp, Artificial Sequence
  Description of Artificial Sequence: Synthetic oligonucleotide
  Target: ATXN1; (-) strand; PAM type: YTN; PAM sequence: TTA
aaactgtgccaagcacatag

SEQ ID NO: 193436 - DNA, 20 bp, Artificial Sequence
  Description of Artificial Sequence: Synthetic oligonucleotide
  Target: ATXN1; (-) strand; PAM type: YTN; PAM sequence: TTT
aaaactgtgccaagcacata

SEQ ID NO: 193437 - DNA, 20 bp, Artificial Sequence
  Description of Artificial Sequence: Synthetic oligonucleotide
  Target: ATXN1; (-) strand; PAM type: YTN; PAM sequence: CTG
catgtatcccagtatttaaa

SEQ ID NO: 193438 - DNA, 20 bp, Artificial Sequence
  Description of Artificial Sequence: Synthetic oligonucleotide
  Target: ATXN1; (-) strand; PAM type: YTN; PAM sequence: CTC
atggactgcatgtatcccag

SEQ ID NO: 193439 - DNA, 20 bp, Artificial Sequence
  Description of Artificial Sequence: Synthetic oligonucleotide
  Target: ATXN1; (-) strand; PAM type: YTN; PAM sequence: TTG
tcggtctcatggactgcatg

SEQ ID NO: 193440 - DNA, 20 bp, Artificial Sequence
  Description of Artificial Sequence: Synthetic oligonucleotide
  Target: ATXN1; (-) strand; PAM type: YTN; PAM sequence: CTT
gtcggtctcatggactgcat

SEQ ID NO: 193441 - DNA, 20 bp, Artificial Sequence
  Description of Artificial Sequence: Synthetic oligonucleotide
  Target: ATXN1; (-) strand; PAM type: YTN; PAM sequence: CTC
agtggaagcaaaagccttgt

SEQ ID NO: 193442 - DNA, 20 bp, Artificial Sequence
  Description of Artificial Sequence: Synthetic oligonucleotide
  Target: ATXN1; (-) strand; PAM type: YTN; PAM sequence: TTA
gctcagtggaagcaaaagcc

SEQ ID NO: 193443 - DNA, 20 bp, Artificial Sequence
  Description of Artificial Sequence: Synthetic oligonucleotide
  Target: ATXN1; (-) strand; PAM type: YTN; PAM sequence: TTA
gaattagctcagtggaagca

SEQ ID NO: 193444 - DNA, 20 bp, Artificial Sequence
  Description of Artificial Sequence: Synthetic oligonucleotide
  Target: ATXN1; (-) strand; PAM type: YTN; PAM sequence: CTA
ttagaattagctcagtggaa

SEQ ID NO: 193445 - DNA, 20 bp, Artificial Sequence
  Description of Artificial Sequence: Synthetic oligonucleotide
  Target: ATXN1; (-) strand; PAM type: YTN; PAM sequence: CTC
tattagaattagctcagtgg

SEQ ID NO: 193446 - DNA, 20 bp, Artificial Sequence
  Description of Artificial Sequence: Synthetic oligonucleotide
  Target: ATXN1; (-) strand; PAM type: YTN; PAM sequence: CTC
ctctattagaattagctcag

SEQ ID NO: 193447 - DNA, 20 bp, Artificial Sequence
  Description of Artificial Sequence: Synthetic oligonucleotide
  Target: ATXN1; (-) strand; PAM type: YTN; PAM sequence: TTA
gtctcctctattagaattag

SEQ ID NO: 193448 - DNA, 20 bp, Artificial Sequence
  Description of Artificial Sequence: Synthetic oligonucleotide
  Target: ATXN1; (-) strand; PAM type: YTN; PAM sequence: TTG
ttagtctcctctattagaat

SEQ ID NO: 193449 - DNA, 20 bp, Artificial Sequence
  Description of Artificial Sequence: Synthetic oligonucleotide
  Target: ATXN1; (-) strand; PAM type: YTN; PAM sequence: TTA
ttgttagtctcctctattag

SEQ ID NO: 193450 - DNA, 20 bp, Artificial Sequence
  Description of Artificial Sequence: Synthetic oligonucleotide
  Target: ATXN1; (-) strand; PAM type: YTN; PAM sequence: TTT
attgttagtctcctctatta

SEQ ID NO: 193451 - DNA, 20 bp, Artificial Sequence
  Description of Artificial Sequence: Synthetic oligonucleotide
  Target: ATXN1; (-) strand; PAM type: YTN; PAM sequence: CTG
gtttattgttagtctcctct

SEQ ID NO: 193452 - DNA, 20 bp, Artificial Sequence
  Description of Artificial Sequence: Synthetic oligonucleotide
  Target: ATXN1; (-) strand; PAM type: YTN; PAM sequence: CTG
ctggtttattgttagtctcc

SEQ ID NO: 193453 - DNA, 20 bp, Artificial Sequence
  Description of Artificial Sequence: Synthetic oligonucleotide
  Target: ATXN1; (-) strand; PAM type: YTN; PAM sequence: CTG
catccgactgctggtttatt

SEQ ID NO: 193454 - DNA, 20 bp, Artificial Sequence
  Description of Artificial Sequence: Synthetic oligonucleotide
  Target: ATXN1; (-) strand; PAM type: YTN; PAM sequence: TTC
tgcatccgactgctggttta

SEQ ID NO: 193455 - DNA, 20 bp, Artificial Sequence
  Description of Artificial Sequence: Synthetic oligonucleotide
  Target: ATXN1; (-) strand; PAM type: YTN; PAM sequence: CTT
ctgcatccgactgctggttt

SEQ ID NO: 193456 - DNA, 20 bp, Artificial Sequence
  Description of Artificial Sequence: Synthetic oligonucleotide
  Target: ATXN1; (-) strand; PAM type: YTN; PAM sequence: TTG
ggcttctgcatccgactgct

SEQ ID NO: 193457 - DNA, 20 bp, Artificial Sequence
  Description of Artificial Sequence: Synthetic oligonucleotide
  Target: ATXN1; (-) strand; PAM type: YTN; PAM sequence: CTT
gggcttctgcatccgactgc

SEQ ID NO: 193458 - DNA, 20 bp, Artificial Sequence
  Description of Artificial Sequence: Synthetic oligonucleotide
  Target: ATXN1; (-) strand; PAM type: YTN; PAM sequence: TTC
gtggcgcttgggcttctgca

SEQ ID NO: 193459 - DNA, 20 bp, Artificial Sequence
  Description of Artificial Sequence: Synthetic oligonucleotide
  Target: ATXN1; (-) strand; PAM type: YTN; PAM sequence: CTT
cgtggcgcttgggcttctgc

SEQ ID NO: 193460 - DNA, 20 bp, Artificial Sequence
  Description of Artificial Sequence: Synthetic oligonucleotide
  Target: ATXN1; (-) strand; PAM type: YTN; PAM sequence: TTC
ttcgtggcgcttgggcttct

SEQ ID NO: 193461 - DNA, 20 bp, Artificial Sequence
  Description of Artificial Sequence: Synthetic oligonucleotide
  Target: ATXN1; (-) strand; PAM type: YTN; PAM sequence: TTT
cttcgtggcgcttgggcttc

SEQ ID NO: 193462 - DNA, 20 bp, Artificial Sequence
  Description of Artificial Sequence: Synthetic oligonucleotide
  Target: ATXN1; (-) strand; PAM type: YTN; PAM sequence: TTT
tcttcgtggcgcttgggctt

SEQ ID NO: 193463 - DNA, 20 bp, Artificial Sequence
  Description of Artificial Sequence: Synthetic oligonucleotide
  Target: ATXN1; (-) strand; PAM type: YTN; PAM sequence: TTG
ttttcttcgtggcgcttggg

SEQ ID NO: 193464 - DNA, 20 bp, Artificial Sequence
  Description of Artificial Sequence: Synthetic oligonucleotide
  Target: ATXN1; (-) strand; PAM type: YTN; PAM sequence: CTG
ttgttttcttcgtggcgctt

SEQ ID NO: 193465 - DNA, 20 bp, Artificial Sequence
  Description of Artificial Sequence: Synthetic oligonucleotide
  Target: ATXN1; (-) strand; PAM type: YTN; PAM sequence: TTA
cctgttgttttcttcgtggc

SEQ ID NO: 193466 - DNA, 20 bp, Artificial Sequence
  Description of Artificial Sequence: Synthetic oligonucleotide
  Target: ATXN1; (-) strand; PAM type: YTN; PAM sequence: CTT
acctgttgttttcttcgtgg

SEQ ID NO: 193467 - DNA, 20 bp, Artificial Sequence
  Description of Artificial Sequence: Synthetic oligonucleotide
  Target: ATXN1; (-) strand; PAM type: YTN; PAM sequence: TTC
ttacctgttgttttcttcgt

SEQ ID NO: 193468 - DNA, 20 bp, Artificial Sequence
  Description of Artificial Sequence: Synthetic oligonucleotide
  Target: ATXN1; (-) strand; PAM type: YTN; PAM sequence: CTT
cttacctgttgttttcttcg

SEQ ID NO: 193469 - DNA, 20 bp, Artificial Sequence
  Description of Artificial Sequence: Synthetic oligonucleotide
  Target: ATXN1; (-) strand; PAM type: YTN; PAM sequence: CTC
aagccttcttacctgttgtt

SEQ ID NO: 193470 - DNA, 20 bp, Artificial Sequence
  Description of Artificial Sequence: Synthetic oligonucleotide
  Target: ATXN1; (-) strand; PAM type: YTN; PAM sequence: CTC
actcaagccttcttacctgt

SEQ ID NO: 193471 - DNA, 20 bp, Artificial Sequence
  Description of Artificial Sequence: Synthetic oligonucleotide
  Target: ATXN1; (-) strand; PAM type: YTN; PAM sequence: CTA
cccgcccccagctcactcaa

SEQ ID NO: 193472 - DNA, 20 bp, Artificial Sequence
  Description of Artificial Sequence: Synthetic oligonucleotide
  Target: ATXN1; (-) strand; PAM type: YTN; PAM sequence: CTG
caccccatcaggcctacccg

SEQ ID NO: 193473 - DNA, 20 bp, Artificial Sequence
  Description of Artificial Sequence: Synthetic oligonucleotide
  Target: ATXN1; (-) strand; PAM type: YTN; PAM sequence: CTC
cctgcaccccatcaggccta

SEQ ID NO: 193474 - DNA, 20 bp, Artificial Sequence
  Description of Artificial Sequence: Synthetic oligonucleotide
  Target: ATXN1; (-) strand; PAM type: YTN; PAM sequence: CTG
ctccctgcaccccatcaggc

SEQ ID NO: 193475 - DNA, 20 bp, Artificial Sequence
  Description of Artificial Sequence: Synthetic oligonucleotide
  Target: ATXN1; (-) strand; PAM type: YTN; PAM sequence: TTC
tgctccctgcaccccatcag

SEQ ID NO: 193476 - DNA, 20 bp, Artificial Sequence
  Description of Artificial Sequence: Synthetic oligonucleotide
  Target: ATXN1; (-) strand; PAM type: YTN; PAM sequence: TTT
ctgctccctgcaccccatca

SEQ ID NO: 193477 - DNA, 20 bp, Artificial Sequence
  Description of Artificial Sequence: Synthetic oligonucleotide
  Target: ATXN1; (-) strand; PAM type: YTN; PAM sequence: CTG
gccatatttctgctccctgc

SEQ ID NO: 193478 - DNA, 20 bp, Artificial Sequence
  Description of Artificial Sequence: Synthetic oligonucleotide
  Target: ATXN1; (-) strand; PAM type: YTN; PAM sequence: CTC
tggccatatttctgctccct

SEQ ID NO: 193479 - DNA, 20 bp, Artificial Sequence
  Description of Artificial Sequence: Synthetic oligonucleotide
  Target: ATXN1; (-) strand; PAM type: YTN; PAM sequence: CTG
ctctggccatatttctgctc

SEQ ID NO: 193480 - DNA, 20 bp, Artificial Sequence
  Description of Artificial Sequence: Synthetic oligonucleotide
  Target: ATXN1; (-) strand; PAM type: YTN; PAM sequence: TTC
ctgctctggccatatttctg

SEQ ID NO: 193481 - DNA, 20 bp, Artificial Sequence
  Description of Artificial Sequence: Synthetic oligonucleotide
  Target: ATXN1; (-) strand; PAM type: YTN; PAM sequence: CTT
cctgctctggccatatttct

SEQ ID NO: 193482 - DNA, 20 bp, Artificial Sequence
  Description of Artificial Sequence: Synthetic oligonucleotide
  Target: ATXN1; (-) strand; PAM type: YTN; PAM sequence: TTC
cttcctgctctggccatatt

SEQ ID NO: 193483 - DNA, 20 bp, Artificial Sequence
  Description of Artificial Sequence: Synthetic oligonucleotide
  Target: ATXN1; (-) strand; PAM type: YTN; PAM sequence: TTT
ccttcctgctctggccatat

SEQ ID NO: 193484 - DNA, 20 bp, Artificial Sequence
  Description of Artificial Sequence: Synthetic oligonucleotide
  Target: ATXN1; (-) strand; PAM type: YTN; PAM sequence: CTG
gggtggggcgtggcgtttcc

SEQ ID NO: 193485 - DNA, 20 bp, Artificial Sequence
  Description of Artificial Sequence: Synthetic oligonucleotide
  Target: ATXN1; (-) strand; PAM type: YTN; PAM sequence: CTC
ccccatagaaagctggggtg

SEQ ID NO: 193486 - DNA, 20 bp, Artificial Sequence
  Description of Artificial Sequence: Synthetic oligonucleotide
  Target: ATXN1; (-) strand; PAM type: YTN; PAM sequence: TTG
gagcaagaggtcagagggca

SEQ ID NO: 193487 - DNA, 20 bp, Artificial Sequence
  Description of Artificial Sequence: Synthetic oligonucleotide
  Target: ATXN1; (-) strand; PAM type: YTN; PAM sequence: TTG
gggaagaaaaggttggagca

SEQ ID NO: 193488 - DNA, 20 bp, Artificial Sequence
  Description of Artificial Sequence: Synthetic oligonucleotide
  Target: ATXN1; (-) strand; PAM type: YTN; PAM sequence: CTT
ggggaagaaaaggttggagc

SEQ ID NO: 193489 - DNA, 20 bp, Artificial Sequence
  Description of Artificial Sequence: Synthetic oligonucleotide
  Target: ATXN1; (-) strand; PAM type: YTN; PAM sequence: TTC
cacacccttggggaagaaaa

SEQ ID NO: 193490 - DNA, 20 bp, Artificial Sequence
  Description of Artificial Sequence: Synthetic oligonucleotide
  Target: ATXN1; (-) strand; PAM type: YTN; PAM sequence: CTC
attccacacccttggggaag

SEQ ID NO: 193491 - DNA, 20 bp, Artificial Sequence
  Description of Artificial Sequence: Synthetic oligonucleotide
  Target: ATXN1; (-) strand; PAM type: YTN; PAM sequence: TTA
ctcattccacacccttgggg

SEQ ID NO: 193492 - DNA, 20 bp, Artificial Sequence
  Description of Artificial Sequence: Synthetic oligonucleotide
  Target: ATXN1; (-) strand; PAM type: YTN; PAM sequence: TTA
gccccagccgggttactcat

SEQ ID NO: 193493 - DNA, 20 bp, Artificial Sequence
  Description of Artificial Sequence: Synthetic oligonucleotide
  Target: ATXN1; (-) strand; PAM type: YTN; PAM sequence: TTT
agccccagccgggttactca

SEQ ID NO: 193494 - DNA, 20 bp, Artificial Sequence
  Description of Artificial Sequence: Synthetic oligonucleotide
  Target: ATXN1; (-) strand; PAM type: YTN; PAM sequence: CTT
tagccccagccgggttactc

SEQ ID NO: 193495 - DNA, 20 bp, Artificial Sequence
  Description of Artificial Sequence: Synthetic oligonucleotide
  Target: ATXN1; (-) strand; PAM type: YTN; PAM sequence: TTG
gctttagccccagccgggtt

SEQ ID NO: 193496 - DNA, 20 bp, Artificial Sequence
  Description of Artificial Sequence: Synthetic oligonucleotide
  Target: ATXN1; (-) strand; PAM type: YTN; PAM sequence: CTA
tccaaggagggggcataggc

SEQ ID NO: 193497 - DNA, 20 bp, Artificial Sequence
  Description of Artificial Sequence: Synthetic oligonucleotide
  Target: ATXN1; (-) strand; PAM type: YTN; PAM sequence: TTC
accctatccaaggagggggc

SEQ ID NO: 193498 - DNA, 20 bp, Artificial Sequence
  Description of Artificial Sequence: Synthetic oligonucleotide
  Target: ATXN1; (-) strand; PAM type: YTN; PAM sequence: TTA
tatagattcaccctatccaa

SEQ ID NO: 193499 - DNA, 20 bp, Artificial Sequence
  Description of Artificial Sequence: Synthetic oligonucleotide
  Target: ATXN1; (-) strand; PAM type: YTN; PAM sequence: CTC
aaaattatatagattcaccc

SEQ ID NO: 193500 - DNA, 20 bp, Artificial Sequence
  Description of Artificial Sequence: Synthetic oligonucleotide
  Target: ATXN1; (-) strand; PAM type: YTN; PAM sequence: CTG
ctcaaaattatatagattca

SEQ ID NO: 193501 - DNA, 20 bp, Artificial Sequence
  Description of Artificial Sequence: Synthetic oligonucleotide
  Target: ATXN1; (-) strand; PAM type: YTN; PAM sequence: CTA
accctgctcaaaattatata

SEQ ID NO: 193502 - DNA, 20 bp, Artificial Sequence
  Description of Artificial Sequence: Synthetic oligonucleotide
  Target: ATXN1; (-) strand; PAM type: YTN; PAM sequence: CTG
ctaaccctgctcaaaattat

SEQ ID NO: 193503 - DNA, 20 bp, Artificial Sequence
  Description of Artificial Sequence: Synthetic oligonucleotide
  Target: ATXN1; (-) strand; PAM type: YTN; PAM sequence: CTG
tgtgaagagggaaggagaaa

SEQ ID NO: 193504 - DNA, 20 bp, Artificial Sequence
  Description of Artificial Sequence: Synthetic oligonucleotide
  Target: ATXN1; (-) strand; PAM type: YTN; PAM sequence: CTG
tctgtgtgaagagggaagga

SEQ ID NO: 193505 - DNA, 20 bp, Artificial Sequence
  Description of Artificial Sequence: Synthetic oligonucleotide
  Target: ATXN1; (-) strand; PAM type: YTN; PAM sequence: CTA
caggcacctgtctgtgtgaa

SEQ ID NO: 193506 - DNA, 20 bp, Artificial Sequence
  Description of Artificial Sequence: Synthetic oligonucleotide
  Target: ATXN1; (-) strand; PAM type: YTN; PAM sequence: TTG
agtctacaggcacctgtctg

SEQ ID NO: 193507 - DNA, 20 bp, Artificial Sequence
  Description of Artificial Sequence: Synthetic oligonucleotide
  Target: ATXN1; (-) strand; PAM type: YTN; PAM sequence: TTT
gagtctacaggcacctgtct

SEQ ID NO: 193508 - DNA, 20 bp, Artificial Sequence
  Description of Artificial Sequence: Synthetic oligonucleotide
  Target: ATXN1; (-) strand; PAM type: YTN; PAM sequence: TTT
tgagtctacaggcacctgtc

SEQ ID NO: 193509 - DNA, 20 bp, Artificial Sequence
  Description of Artificial Sequence: Synthetic oligonucleotide
  Target: ATXN1; (-) strand; PAM type: YTN; PAM sequence: CTG
caggaaagttttgagtctac

SEQ ID NO: 193510 - DNA, 20 bp, Artificial Sequence
  Description of Artificial Sequence: Synthetic oligonucleotide
  Target: ATXN1; (-) strand; PAM type: YTN; PAM sequence: CTG
gtcgcaggccacctgcagga

SEQ ID NO: 193511 - DNA, 20 bp, Artificial Sequence
  Description of Artificial Sequence: Synthetic oligonucleotide
  Target: ATXN1; (-) strand; PAM type: YTN; PAM sequence: CTA
gcctggtcgcaggccacctg

SEQ ID NO: 193512 - DNA, 20 bp, Artificial Sequence
  Description of Artificial Sequence: Synthetic oligonucleotide
  Target: ATXN1; (-) strand; PAM type: YTN; PAM sequence: TTC
cccagtctagcctggtcgca

SEQ ID NO: 193513 - DNA, 20 bp, Artificial Sequence
  Description of Artificial Sequence: Synthetic oligonucleotide
  Target: ATXN1; (-) strand; PAM type: YTN; PAM sequence: CTG
ttccccagtctagcctggtc

SEQ ID NO: 193514 - DNA, 20 bp, Artificial Sequence
  Description of Artificial Sequence: Synthetic oligonucleotide
  Target: ATXN1; (-) strand; PAM type: YTN; PAM sequence: CTG
cctgttccccagtctagcct

SEQ ID NO: 193515 - DNA, 20 bp, Artificial Sequence
  Description of Artificial Sequence: Synthetic oligonucleotide
  Target: ATXN1; (-) strand; PAM type: YTN; PAM sequence: TTG
acacctgcctgttccccagt

SEQ ID NO: 193516 - DNA, 20 bp, Artificial Sequence
  Description of Artificial Sequence: Synthetic oligonucleotide
  Target: ATXN1; (-) strand; PAM type: YTN; PAM sequence: CTT
gacacctgcctgttccccag

SEQ ID NO: 193517 - DNA, 20 bp, Artificial Sequence
  Description of Artificial Sequence: Synthetic oligonucleotide
  Target: ATXN1; (-) strand; PAM type: YTN; PAM sequence: CTA
acttgacacctgcctgttcc

SEQ ID NO: 193518 - DNA, 20 bp, Artificial Sequence
  Description of Artificial Sequence: Synthetic oligonucleotide
  Target: ATXN1; (-) strand; PAM type: YTN; PAM sequence: CTG
agggcaatgagctaacttga

SEQ ID NO: 193519 - DNA, 20 bp, Artificial Sequence
  Description of Artificial Sequence: Synthetic oligonucleotide
  Target: ATXN1; (-) strand; PAM type: YTN; PAM sequence: CTA
tgtgactgagggcaatgagc

SEQ ID NO: 193520 - DNA, 20 bp, Artificial Sequence
  Description of Artificial Sequence: Synthetic oligonucleotide
  Target: ATXN1; (-) strand; PAM type: YTN; PAM sequence: TTG
aggcagacgggggccagaat

SEQ ID NO: 193521 - DNA, 20 bp, Artificial Sequence
  Description of Artificial Sequence: Synthetic oligonucleotide
  Target: ATXN1; (-) strand; PAM type: YTN; PAM sequence: CTG
agaaataagacaagagtatt

SEQ ID NO: 193522 - DNA, 20 bp, Artificial Sequence
  Description of Artificial Sequence: Synthetic oligonucleotide
  Target: ATXN1; (-) strand; PAM type: YTN; PAM sequence: CTG
agcccactgagaaataagac

SEQ ID NO: 193523 - DNA, 20 bp, Artificial Sequence
  Description of Artificial Sequence: Synthetic oligonucleotide
  Target: ATXN1; (-) strand; PAM type: YTN; PAM sequence: TTC
tgagcccactgagaaataag

SEQ ID NO: 193524 - DNA, 20 bp, Artificial Sequence
  Description of Artificial Sequence: Synthetic oligonucleotide
  Target: ATXN1; (-) strand; PAM type: YTN; PAM sequence: TTC
ccgtcccaagttctgagccc

SEQ ID NO: 193525 - DNA, 20 bp, Artificial Sequence
  Description of Artificial Sequence: Synthetic oligonucleotide
  Target: ATXN1; (-) strand; PAM type: YTN; PAM sequence: CTT
cccgtcccaagttctgagcc

SEQ ID NO: 193526 - DNA, 20 bp, Artificial Sequence
  Description of Artificial Sequence: Synthetic oligonucleotide
  Target: ATXN1; (-) strand; PAM type: YTN; PAM sequence: CTC
ttcccgtcccaagttctgag

SEQ ID NO: 193527 - DNA, 20 bp, Artificial Sequence
  Description of Artificial Sequence: Synthetic oligonucleotide
  Target: ATXN1; (-) strand; PAM type: YTN; PAM sequence: TTC
tcttcccgtcccaagttctg

SEQ ID NO: 193528 - DNA, 20 bp, Artificial Sequence
  Description of Artificial Sequence: Synthetic oligonucleotide
  Target: ATXN1; (-) strand; PAM type: YTN; PAM sequence: TTA
caagagttctcttcccgtcc

SEQ ID NO: 193529 - DNA, 20 bp, Artificial Sequence
  Description of Artificial Sequence: Synthetic oligonucleotide
  Target: ATXN1; (-) strand; PAM type: YTN; PAM sequence: CTT
acaagagttctcttcccgtc

SEQ ID NO: 193530 - DNA, 20 bp, Artificial Sequence
  Description of Artificial Sequence: Synthetic oligonucleotide
  Target: ATXN1; (-) strand; PAM type: YTN; PAM sequence: TTA
tcttacaagagttctcttcc

SEQ ID NO: 193531 - DNA, 20 bp, Artificial Sequence
  Description of Artificial Sequence: Synthetic oligonucleotide
  Target: ATXN1; (-) strand; PAM type: YTN; PAM sequence: TTT
atcttacaagagttctcttc

SEQ ID NO: 193532 - DNA, 20 bp, Artificial Sequence
  Description of Artificial Sequence: Synthetic oligonucleotide
  Target: ATXN1; (-) strand; PAM type: YTN; PAM sequence: TTT
tatcttacaagagttctctt

SEQ ID NO: 193533 - DNA, 20 bp, Artificial Sequence
  Description of Artificial Sequence: Synthetic oligonucleotide
  Target: ATXN1; (-) strand; PAM type: YTN; PAM sequence: CTT
ttatcttacaagagttctct

SEQ ID NO: 193534 - DNA, 20 bp, Artificial Sequence
  Description of Artificial Sequence: Synthetic oligonucleotide
  Target: ATXN1; (-) strand; PAM type: YTN; PAM sequence: TTA
tggaaacttttatcttacaa

SEQ ID NO: 193535 - DNA, 20 bp, Artificial Sequence
  Description of Artificial Sequence: Synthetic oligonucleotide
  Target: ATXN1; (-) strand; PAM type: YTN; PAM sequence: CTT
atggaaacttttatcttaca

SEQ ID NO: 193536 - DNA, 20 bp, Artificial Sequence
  Description of Artificial Sequence: Synthetic oligonucleotide
  Target: ATXN1; (-) strand; PAM type: YTN; PAM sequence: TTA
tcttatggaaacttttatct

SEQ ID NO: 193537 - DNA, 20 bp, Artificial Sequence
  Description of Artificial Sequence: Synthetic oligonucleotide
  Target: ATXN1; (-) strand; PAM type: YTN; PAM sequence: TTT
atcttatggaaacttttatc

SEQ ID NO: 193538 - DNA, 20 bp, Artificial Sequence
  Description of Artificial Sequence: Synthetic oligonucleotide
  Target: ATXN1; (-) strand; PAM type: YTN; PAM sequence: TTT
tatcttatggaaacttttat

SEQ ID NO: 193539 - DNA, 20 bp, Artificial Sequence
  Description of Artificial Sequence: Synthetic oligonucleotide
  Target: ATXN1; (-) strand; PAM type: YTN; PAM sequence: TTT
ttatcttatggaaactttta

SEQ ID NO: 193540 - DNA, 20 bp, Artificial Sequence
  Description of Artificial Sequence: Synthetic oligonucleotide
  Target: ATXN1; (-) strand; PAM type: YTN; PAM sequence: TTA
ggggagggaaggtttttatc

SEQ ID NO: 193541 - DNA, 20 bp, Artificial Sequence
  Description of Artificial Sequence: Synthetic oligonucleotide
  Target: ATXN1; (-) strand; PAM type: YTN; PAM sequence: TTT
aggggagggaaggtttttat

SEQ ID NO: 193542 - DNA, 20 bp, Artificial Sequence
  Description of Artificial Sequence: Synthetic oligonucleotide
  Target: ATXN1; (-) strand; PAM type: YTN; PAM sequence: CTG
tttaggggagggaaggtttt

SEQ ID NO: 193543 - DNA, 20 bp, Artificial Sequence
  Description of Artificial Sequence: Synthetic oligonucleotide
  Target: ATXN1; (-) strand; PAM type: YTN; PAM sequence: TTG
aggtctgtttaggggaggga

SEQ ID NO: 193544 - DNA, 20 bp, Artificial Sequence
  Description of Artificial Sequence: Synthetic oligonucleotide
  Target: ATXN1; (-) strand; PAM type: YTN; PAM sequence: TTT
gaggtctgtttaggggaggg

SEQ ID NO: 193545 - DNA, 20 bp, Artificial Sequence
  Description of Artificial Sequence: Synthetic oligonucleotide
  Target: ATXN1; (-) strand; PAM type: YTN; PAM sequence: TTT
tgaggtctgtttaggggagg

SEQ ID NO: 193546 - DNA, 20 bp, Artificial Sequence
  Description of Artificial Sequence: Synthetic oligonucleotide
  Target: ATXN1; (-) strand; PAM type: YTN; PAM sequence: TTG
gttttgaggtctgtttaggg

SEQ ID NO: 193547 - DNA, 20 bp, Artificial Sequence
  Description of Artificial Sequence: Synthetic oligonucleotide
  Target: ATXN1; (-) strand; PAM type: YTN; PAM sequence: TTT
ggttttgaggtctgtttagg

SEQ ID NO: 193548 - DNA, 20 bp, Artificial Sequence
  Description of Artificial Sequence: Synthetic oligonucleotide
  Target: ATXN1; (-) strand; PAM type: YTN; PAM sequence: CTA
atttggttttgaggtctgtt

SEQ ID NO: 193549 - DNA, 20 bp, Artificial Sequence
  Description of Artificial Sequence: Synthetic oligonucleotide
  Target: ATXN1; (-) strand; PAM type: YTN; PAM sequence: TTC
ctaatttggttttgaggtct

SEQ ID NO: 193550 - DNA, 20 bp, Artificial Sequence
  Description of Artificial Sequence: Synthetic oligonucleotide
  Target: ATXN1; (-) strand; PAM type: YTN; PAM sequence: TTA
ggatagtgattcctaatttg

SEQ ID NO: 193551 - DNA, 20 bp, Artificial Sequence
  Description of Artificial Sequence: Synthetic oligonucleotide
  Target: ATXN1; (-) strand; PAM type: YTN; PAM sequence: TTG
atagattaggatagtgattc

SEQ ID NO: 193552 - DNA, 20 bp, Artificial Sequence
  Description of Artificial Sequence: Synthetic oligonucleotide
  Target: ATXN1; (-) strand; PAM type: YTN; PAM sequence: TTT
gatagattaggatagtgatt

SEQ ID NO: 193553 - DNA, 20 bp, Artificial Sequence
  Description of Artificial Sequence: Synthetic oligonucleotide
  Target: ATXN1; (-) strand; PAM type: YTN; PAM sequence: TTA
ggtttgatagattaggatag

SEQ ID NO: 193554 - DNA, 20 bp, Artificial Sequence
  Description of Artificial Sequence: Synthetic oligonucleotide
  Target: ATXN1; (-) strand; PAM type: YTN; PAM sequence: TTA
agatgacagatagattaggt

SEQ ID NO: 193555 - DNA, 20 bp, Artificial Sequence
  Description of Artificial Sequence: Synthetic oligonucleotide
  Target: ATXN1; (-) strand; PAM type: YTN; PAM sequence: TTC
cattaagatgacagatagat

SEQ ID NO: 193556 - DNA, 20 bp, Artificial Sequence
  Description of Artificial Sequence: Synthetic oligonucleotide
  Target: ATXN1; (-) strand; PAM type: YTN; PAM sequence: TTT
ccattaagatgacagataga

SEQ ID NO: 193557 - DNA, 20 bp, Artificial Sequence
  Description of Artificial Sequence: Synthetic oligonucleotide
  Target: ATXN1; (-) strand; PAM type: YTN; PAM sequence: TTT
tccattaagatgacagatag

SEQ ID NO: 193558 - DNA, 20 bp, Artificial Sequence
  Description of Artificial Sequence: Synthetic oligonucleotide
  Target: ATXN1; (-) strand; PAM type: YTN; PAM sequence: TTT
ttccattaagatgacagata

SEQ ID NO: 193559 - DNA, 20 bp, Artificial Sequence
  Description of Artificial Sequence: Synthetic oligonucleotide
  Target: ATXN1; (-) strand; PAM type: YTN; PAM sequence: TTG
agggatttttccattaagat

SEQ ID NO: 193560 - DNA, 20 bp, Artificial Sequence
  Description of Artificial Sequence: Synthetic oligonucleotide
  Target: ATXN1; (-) strand; PAM type: YTN; PAM sequence: TTT
gagggatttttccattaaga

SEQ ID NO: 193561 - DNA, 20 bp, Artificial Sequence
  Description of Artificial Sequence: Synthetic oligonucleotide
  Target: ATXN1; (-) strand; PAM type: YTN; PAM sequence: TTA
agtaagagatttgagggatt

SEQ ID NO: 193562 - DNA, 20 bp, Artificial Sequence
  Description of Artificial Sequence: Synthetic oligonucleotide
  Target: ATXN1; (-) strand; PAM type: YTN; PAM sequence: CTA
ttaagtaagagatttgaggg

SEQ ID NO: 193563 - DNA, 20 bp, Artificial Sequence
  Description of Artificial Sequence: Synthetic oligonucleotide
  Target: ATXN1; (-) strand; PAM type: YTN; PAM sequence: TTG
gactattaagtaagagattt

SEQ ID NO: 193564 - DNA, 20 bp, Artificial Sequence
  Description of Artificial Sequence: Synthetic oligonucleotide
  Target: ATXN1; (-) strand; PAM type: YTN; PAM sequence: TTT
ggactattaagtaagagatt

SEQ ID NO: 193565 - DNA, 20 bp, Artificial Sequence
  Description of Artificial Sequence: Synthetic oligonucleotide
  Target: ATXN1; (-) strand; PAM type: YTN; PAM sequence: TTT
tggactattaagtaagagat

SEQ ID NO: 193566 - DNA, 20 bp, Artificial Sequence
  Description of Artificial Sequence: Synthetic oligonucleotide
  Target: ATXN1; (-) strand; PAM type: YTN; PAM sequence: CTA
gcgttttggactattaagta

SEQ ID NO: 193567 - DNA, 20 bp, Artificial Sequence
  Description of Artificial Sequence: Synthetic oligonucleotide
  Target: ATXN1; (-) strand; PAM type: YTN; PAM sequence: CTC
agtctagcgttttggactat

SEQ ID NO: 193568 - DNA, 20 bp, Artificial Sequence
  Description of Artificial Sequence: Synthetic oligonucleotide
  Target: ATXN1; (-) strand; PAM type: YTN; PAM sequence: TTC
tcagtctagcgttttggact

SEQ ID NO: 193569 - DNA, 20 bp, Artificial Sequence
  Description of Artificial Sequence: Synthetic oligonucleotide
  Target: ATXN1; (-) strand; PAM type: YTN; PAM sequence: CTT
ctcagtctagcgttttggac

SEQ ID NO: 193570 - DNA, 20 bp, Artificial Sequence
  Description of Artificial Sequence: Synthetic oligonucleotide
  Target: ATXN1; (-) strand; PAM type: YTN; PAM sequence: TTG
ggatcagacttctcagtcta

SEQ ID NO: 193571 - DNA, 20 bp, Artificial Sequence
  Description of Artificial Sequence: Synthetic oligonucleotide
  Target: ATXN1; (-) strand; PAM type: YTN; PAM sequence: TTT
gggatcagacttctcagtct

SEQ ID NO: 193572 - DNA, 20 bp, Artificial Sequence
  Description of Artificial Sequence: Synthetic oligonucleotide
  Target: ATXN1; (-) strand; PAM type: YTN; PAM sequence: CTT
tgggatcagacttctcagtc

SEQ ID NO: 193573 - DNA, 20 bp, Artificial Sequence
  Description of Artificial Sequence: Synthetic oligonucleotide
  Target: ATXN1; (-) strand; PAM type: YTN; PAM sequence: TTG
tctttgggatcagacttctc

SEQ ID NO: 193574 - DNA, 20 bp, Artificial Sequence
  Description of Artificial Sequence: Synthetic oligonucleotide
  Target: ATXN1; (-) strand; PAM type: YTN; PAM sequence: TTT
gtctttgggatcagacttct

SEQ ID NO: 193575 - DNA, 20 bp, Artificial Sequence
  Description of Artificial Sequence: Synthetic oligonucleotide
  Target: ATXN1; (-) strand; PAM type: YTN; PAM sequence: TTG
aatttgtctttgggatcaga

SEQ ID NO: 193576 - DNA, 20 bp, Artificial Sequence
  Description of Artificial Sequence: Synthetic oligonucleotide
  Target: ATXN1; (-) strand; PAM type: YTN; PAM sequence: CTG
tattgaatttgtctttggga

SEQ ID NO: 193577 - DNA, 20 bp, Artificial Sequence
  Description of Artificial Sequence: Synthetic oligonucleotide
  Target: ATXN1; (-) strand; PAM type: YTN; PAM sequence: TTC
actgtattgaatttgtcttt

SEQ ID NO: 193578 - DNA, 20 bp, Artificial Sequence
  Description of Artificial Sequence: Synthetic oligonucleotide
  Target: ATXN1; (-) strand; PAM type: YTN; PAM sequence: CTC
ccaatattcactgtattgaa

SEQ ID NO: 193579 - DNA, 20 bp, Artificial Sequence
  Description of Artificial Sequence: Synthetic oligonucleotide
  Target: ATXN1; (-) strand; PAM type: YTN; PAM sequence: CTC
actcccaatattcactgtat

SEQ ID NO: 193580 - DNA, 20 bp, Artificial Sequence
  Description of Artificial Sequence: Synthetic oligonucleotide
  Target: ATXN1; (-) strand; PAM type: YTN; PAM sequence: TTC
ccacctcactcccaatattc

SEQ ID NO: 193581 - DNA, 20 bp, Artificial Sequence
  Description of Artificial Sequence: Synthetic oligonucleotide
  Target: ATXN1; (-) strand; PAM type: YTN; PAM sequence: TTT
cccacctcactcccaatatt

SEQ ID NO: 193582 - DNA, 20 bp, Artificial Sequence
  Description of Artificial Sequence: Synthetic oligonucleotide
  Target: ATXN1; (-) strand; PAM type: YTN; PAM sequence: TTT
tcccacctcactcccaatat

SEQ ID NO: 193583 - DNA, 20 bp, Artificial Sequence
  Description of Artificial Sequence: Synthetic oligonucleotide
  Target: ATXN1; (-) strand; PAM type: YTN; PAM sequence: TTT
ttcccacctcactcccaata

SEQ ID NO: 193584 - DNA, 20 bp, Artificial Sequence
  Description of Artificial Sequence: Synthetic oligonucleotide
  Target: ATXN1; (-) strand; PAM type: YTN; PAM sequence: CTT
tttcccacctcactcccaat

SEQ ID NO: 193585 - DNA, 20 bp, Artificial Sequence
  Description of Artificial Sequence: Synthetic oligonucleotide
  Target: ATXN1; (-) strand; PAM type: YTN; PAM sequence: CTG
gcaccaaaatcatccttttt

SEQ ID NO: 193586 - DNA, 20 bp, Artificial Sequence
  Description of Artificial Sequence: Synthetic oligonucleotide
  Target: ATXN1; (-) strand; PAM type: YTN; PAM sequence: TTA
tactggcaccaaaatcatcc

SEQ ID NO: 193587 - DNA, 20 bp, Artificial Sequence
  Description of Artificial Sequence: Synthetic oligonucleotide
  Target: ATXN1; (-) strand; PAM type: YTN; PAM sequence: TTT
atactggcaccaaaatcatc

SEQ ID NO: 193588 - DNA, 20 bp, Artificial Sequence
  Description of Artificial Sequence: Synthetic oligonucleotide
  Target: ATXN1; (-) strand; PAM type: YTN; PAM sequence: TTT
tatactggcaccaaaatcat

SEQ ID NO: 193589 - DNA, 20 bp, Artificial Sequence
  Description of Artificial Sequence: Synthetic oligonucleotide
  Target: ATXN1; (-) strand; PAM type: YTN; PAM sequence: CTG
ggttttatactggcaccaaa

SEQ ID NO: 193590 - DNA, 20 bp, Artificial Sequence
  Description of Artificial Sequence: Synthetic oligonucleotide
  Target: ATXN1; (-) strand; PAM type: YTN; PAM sequence: CTG
accatagcatatacccctgg

SEQ ID NO: 193591 - DNA, 20 bp, Artificial Sequence
  Description of Artificial Sequence: Synthetic oligonucleotide
  Target: ATXN1; (-) strand; PAM type: YTN; PAM sequence: CTA
ctgaccatagcatatacccc

SEQ ID NO: 193592 - DNA, 20 bp, Artificial Sequence
  Description of Artificial Sequence: Synthetic oligonucleotide
  Target: ATXN1; (-) strand; PAM type: YTN; PAM sequence: CTG
gctactgaccatagcatata

SEQ ID NO: 193593 - DNA, 20 bp, Artificial Sequence
  Description of Artificial Sequence: Synthetic oligonucleotide
  Target: ATXN1; (-) strand; PAM type: YTN; PAM sequence: TTC
tggctactgaccatagcata

SEQ ID NO: 193594 - DNA, 20 bp, Artificial Sequence
  Description of Artificial Sequence: Synthetic oligonucleotide
  Target: ATXN1; (-) strand; PAM type: YTN; PAM sequence: TTT
ctggctactgaccatagcat

SEQ ID NO: 193595 - DNA, 20 bp, Artificial Sequence
  Description of Artificial Sequence: Synthetic oligonucleotide
  Target: ATXN1; (-) strand; PAM type: YTN; PAM sequence: CTT
tctggctactgaccatagca

SEQ ID NO: 193596 - DNA, 20 bp, Artificial Sequence
  Description of Artificial Sequence: Synthetic oligonucleotide
  Target: ATXN1; (-) strand; PAM type: YTN; PAM sequence: CTC
tttctggctactgaccatag

SEQ ID NO: 193597 - DNA, 20 bp, Artificial Sequence
  Description of Artificial Sequence: Synthetic oligonucleotide
  Target: ATXN1; (-) strand; PAM type: YTN; PAM sequence: TTC
ctctttctggctactgacca

SEQ ID NO: 193598 - DNA, 20 bp, Artificial Sequence
  Description of Artificial Sequence: Synthetic oligonucleotide
  Target: ATXN1; (-) strand; PAM type: YTN; PAM sequence: CTT
cctctttctggctactgacc

SEQ ID NO: 193599 - DNA, 20 bp, Artificial Sequence
  Description of Artificial Sequence: Synthetic oligonucleotide
  Target: ATXN1; (-) strand; PAM type: YTN; PAM sequence: CTC
atcttcctctttctggctac

SEQ ID NO: 193600 - DNA, 20 bp, Artificial Sequence
  Description of Artificial Sequence: Synthetic oligonucleotide
  Target: ATXN1; (-) strand; PAM type: YTN; PAM sequence: TTC
ctcatcttcctctttctggc

SEQ ID NO: 193601 - DNA, 20 bp, Artificial Sequence
  Description of Artificial Sequence: Synthetic oligonucleotide
  Target: ATXN1; (-) strand; PAM type: YTN; PAM sequence: TTT
cctcatcttcctctttctgg

SEQ ID NO: 193602 - DNA, 20 bp, Artificial Sequence
  Description of Artificial Sequence: Synthetic oligonucleotide
  Target: ATXN1; (-) strand; PAM type: YTN; PAM sequence: TTC
atatttcctcatcttcctct

SEQ ID NO: 193603 - DNA, 20 bp, Artificial Sequence
  Description of Artificial Sequence: Synthetic oligonucleotide
  Target: ATXN1; (-) strand; PAM type: YTN; PAM sequence: CTT
catatttcctcatcttcctc

SEQ ID NO: 193604 - DNA, 20 bp, Artificial Sequence
  Description of Artificial Sequence: Synthetic oligonucleotide
  Target: ATXN1; (-) strand; PAM type: YTN; PAM sequence: CTA
aaggcttcatatttcctcat

SEQ ID NO: 193605 - DNA, 20 bp, Artificial Sequence
  Description of Artificial Sequence: Synthetic oligonucleotide
  Target: ATXN1; (-) strand; PAM type: YTN; PAM sequence: TTA
atgcagatataaagtcacaa

SEQ ID NO: 193606 - DNA, 20 bp, Artificial Sequence
  Description of Artificial Sequence: Synthetic oligonucleotide
  Target: ATXN1; (-) strand; PAM type: YTN; PAM sequence: TTT
aatgcagatataaagtcaca

SEQ ID NO: 193607 - DNA, 20 bp, Artificial Sequence
  Description of Artificial Sequence: Synthetic oligonucleotide
  Target: ATXN1; (-) strand; PAM type: YTN; PAM sequence: TTT
taatgcagatataaagtcac

SEQ ID NO: 193608 - DNA, 20 bp, Artificial Sequence
  Description of Artificial Sequence: Synthetic oligonucleotide
  Target: ATXN1; (-) strand; PAM type: YTN; PAM sequence: TTT
ttaatgcagatataaagtca

SEQ ID NO: 193609 - DNA, 20 bp, Artificial Sequence
  Description of Artificial Sequence: Synthetic oligonucleotide
  Target: ATXN1; (-) strand; PAM type: YTN; PAM sequence: TTT
tttaatgcagatataaagtc

SEQ ID NO: 193610 - DNA, 20 bp, Artificial Sequence
  Description of Artificial Sequence: Synthetic oligonucleotide
  Target: ATXN1; (-) strand; PAM type: YTN; PAM sequence: TTT
ttttaatgcagatataaagt

SEQ ID NO: 193611 - DNA, 20 bp, Artificial Sequence
  Description of Artificial Sequence: Synthetic oligonucleotide
  Target: ATXN1; (-) strand; PAM type: YTN; PAM sequence: CTA
atgtggtttttttaatgcag

SEQ ID NO: 193612 - DNA, 20 bp, Artificial Sequence
  Description of Artificial Sequence: Synthetic oligonucleotide
  Target: ATXN1; (-) strand; PAM type: YTN; PAM sequence: TTC
ctaatgtggtttttttaatg

SEQ ID NO: 193613 - DNA, 20 bp, Artificial Sequence
  Description of Artificial Sequence: Synthetic oligonucleotide
  Target: ATXN1; (-) strand; PAM type: YTN; PAM sequence: TTT
cctaatgtggtttttttaat

SEQ ID NO: 193614 - DNA, 20 bp, Artificial Sequence
  Description of Artificial Sequence: Synthetic oligonucleotide
  Target: ATXN1; (-) strand; PAM type: YTN; PAM sequence: TTT
tcctaatgtggtttttttaa

SEQ ID NO: 193615 - DNA, 20 bp, Artificial Sequence
  Description of Artificial Sequence: Synthetic oligonucleotide
  Target: ATXN1; (-) strand; PAM type: YTN; PAM sequence: TTA
ttttcctaatgtggtttttt

SEQ ID NO: 193616 - DNA, 20 bp, Artificial Sequence
  Description of Artificial Sequence: Synthetic oligonucleotide
  Target: ATXN1; (-) strand; PAM type: YTN; PAM sequence: CTC
aagaaattattttcctaatg

SEQ ID NO: 193617 - DNA, 20 bp, Artificial Sequence
  Description of Artificial Sequence: Synthetic oligonucleotide
  Target: ATXN1; (-) strand; PAM type: YTN; PAM sequence: TTC
aaagaaaagataaactcaag

SEQ ID NO: 193618 - DNA, 20 bp, Artificial Sequence
  Description of Artificial Sequence: Synthetic oligonucleotide
  Target: ATXN1; (-) strand; PAM type: YTN; PAM sequence: CTT
caaagaaaagataaactcaa

SEQ ID NO: 193619 - DNA, 20 bp, Artificial Sequence
  Description of Artificial Sequence: Synthetic oligonucleotide
  Target: ATXN1; (-) strand; PAM type: YTN; PAM sequence: TTC
ttcaaagaaaagataaactc

SEQ ID NO: 193620 - DNA, 20 bp, Artificial Sequence
  Description of Artificial Sequence: Synthetic oligonucleotide
  Target: ATXN1; (-) strand; PAM type: YTN; PAM sequence: TTC
agttcttcaaagaaaagata

SEQ ID NO: 193621 - DNA, 20 bp, Artificial Sequence
  Description of Artificial Sequence: Synthetic oligonucleotide
  Target: ATXN1; (-) strand; PAM type: YTN; PAM sequence: TTG
ttcagttcttcaaagaaaag

SEQ ID NO: 193622 - DNA, 20 bp, Artificial Sequence
  Description of Artificial Sequence: Synthetic oligonucleotide
  Target: ATXN1; (-) strand; PAM type: YTN; PAM sequence: TTG
aaaatgttgttcagttcttc

SEQ ID NO: 193623 - DNA, 20 bp, Artificial Sequence
  Description of Artificial Sequence: Synthetic oligonucleotide
  Target: ATXN1; (-) strand; PAM type: YTN; PAM sequence: TTG
tgaggcaagtgtgtaaatat

SEQ ID NO: 193624 - DNA, 20 bp, Artificial Sequence
  Description of Artificial Sequence: Synthetic oligonucleotide
  Target: ATXN1; (-) strand; PAM type: YTN; PAM sequence: CTC
ccaaggaaattgtgaggcaa

SEQ ID NO: 193625 - DNA, 20 bp, Artificial Sequence
  Description of Artificial Sequence: Synthetic oligonucleotide
  Target: ATXN1; (-) strand; PAM type: YTN; PAM sequence: CTC
catctcccaaggaaattgtg

SEQ ID NO: 193626 - DNA, 20 bp, Artificial Sequence
  Description of Artificial Sequence: Synthetic oligonucleotide
  Target: ATXN1; (-) strand; PAM type: YTN; PAM sequence: CTC
actccatctcccaaggaaat

SEQ ID NO: 193627 - DNA, 20 bp, Artificial Sequence
  Description of Artificial Sequence: Synthetic oligonucleotide
  Target: ATXN1; (-) strand; PAM type: YTN; PAM sequence: TTC
tcactccatctcccaaggaa

SEQ ID NO: 193628 - DNA, 20 bp, Artificial Sequence
  Description of Artificial Sequence: Synthetic oligonucleotide
  Target: ATXN1; (-) strand; PAM type: YTN; PAM sequence: TTA
tattctcactccatctccca

SEQ ID NO: 193629 - DNA, 20 bp, Artificial Sequence
  Description of Artificial Sequence: Synthetic oligonucleotide
  Target: ATXN1; (-) strand; PAM type: YTN; PAM sequence: TTC
acgacaacgttatattctca

SEQ ID NO: 193630 - DNA, 20 bp, Artificial Sequence
  Description of Artificial Sequence: Synthetic oligonucleotide
  Target: ATXN1; (-) strand; PAM type: YTN; PAM sequence: TTG
ttcacgacaacgttatattc

SEQ ID NO: 193631 - DNA, 20 bp, Artificial Sequence
  Description of Artificial Sequence: Synthetic oligonucleotide
  Target: ATXN1; (-) strand; PAM type: YTN; PAM sequence: TTT
gttcacgacaacgttatatt

SEQ ID NO: 193632 - DNA, 20 bp, Artificial Sequence
  Description of Artificial Sequence: Synthetic oligonucleotide
  Target: ATXN1; (-) strand; PAM type: YTN; PAM sequence: TTA
atatttgttcacgacaacgt

SEQ ID NO: 193633 - DNA, 20 bp, Artificial Sequence
  Description of Artificial Sequence: Synthetic oligonucleotide
  Target: ATXN1; (-) strand; PAM type: YTN; PAM sequence: CTG
cagatagtaaccatgacatt

SEQ ID NO: 193634 - DNA, 20 bp, Artificial Sequence
  Description of Artificial Sequence: Synthetic oligonucleotide
  Target: ATXN1; (-) strand; PAM type: YTN; PAM sequence: TTC
tgcagatagtaaccatgaca

SEQ ID NO: 193635 - DNA, 20 bp, Artificial Sequence
  Description of Artificial Sequence: Synthetic oligonucleotide
  Target: ATXN1; (-) strand; PAM type: YTN; PAM sequence: CTG
agttctgcagatagtaacca

SEQ ID NO: 193636 - DNA, 20 bp, Artificial Sequence
  Description of Artificial Sequence: Synthetic oligonucleotide
  Target: ATXN1; (-) strand; PAM type: YTN; PAM sequence: CTC
acaactgagttctgcagata

SEQ ID NO: 193637 - DNA, 20 bp, Artificial Sequence
  Description of Artificial Sequence: Synthetic oligonucleotide
  Target: ATXN1; (-) strand; PAM type: YTN; PAM sequence: CTA
atgctcacaactgagttctg

SEQ ID NO: 193638 - DNA, 20 bp, Artificial Sequence
  Description of Artificial Sequence: Synthetic oligonucleotide
  Target: ATXN1; (-) strand; PAM type: YTN; PAM sequence: CTC
taatgctcacaactgagttc

SEQ ID NO: 193639 - DNA, 20 bp, Artificial Sequence
  Description of Artificial Sequence: Synthetic oligonucleotide
  Target: ATXN1; (-) strand; PAM type: YTN; PAM sequence: TTC
tctaatgctcacaactgagt

SEQ ID NO: 193640 - DNA, 20 bp, Artificial Sequence
  Description of Artificial Sequence: Synthetic oligonucleotide
  Target: ATXN1; (-) strand; PAM type: YTN; PAM sequence: TTT
ctctaatgctcacaactgag

SEQ ID NO: 193641 - DNA, 20 bp, Artificial Sequence
  Description of Artificial Sequence: Synthetic oligonucleotide
  Target: ATXN1; (-) strand; PAM type: YTN; PAM sequence: TTA
aaaaaatttctctaatgctc

SEQ ID NO: 193642 - DNA, 20 bp, Artificial Sequence
  Description of Artificial Sequence: Synthetic oligonucleotide
  Target: ATXN1; (-) strand; PAM type: YTN; PAM sequence: CTT
aaaaaaatttctctaatgct

SEQ ID NO: 193643 - DNA, 20 bp, Artificial Sequence
  Description of Artificial Sequence: Synthetic oligonucleotide
  Target: ATXN1; (-) strand; PAM type: YTN; PAM sequence: CTC
ttaaaaaaatttctctaatg

SEQ ID NO: 193644 - DNA, 20 bp, Artificial Sequence
  Description of Artificial Sequence: Synthetic oligonucleotide
  Target: ATXN1; (-) strand; PAM type: YTN; PAM sequence: TTC
ctcttaaaaaaatttctcta

SEQ ID NO: 193645 - DNA, 20 bp, Artificial Sequence
  Description of Artificial Sequence: Synthetic oligonucleotide
  Target: ATXN1; (-) strand; PAM type: YTN; PAM sequence: CTT
cctcttaaaaaaatttctct

SEQ ID NO: 193646 - DNA, 20 bp, Artificial Sequence
  Description of Artificial Sequence: Synthetic oligonucleotide
  Target: ATXN1; (-) strand; PAM type: YTN; PAM sequence: TTC
ttcctcttaaaaaaatttct

SEQ ID NO: 193647 - DNA, 20 bp, Artificial Sequence
  Description of Artificial Sequence: Synthetic oligonucleotide
  Target: ATXN1; (-) strand; PAM type: YTN; PAM sequence: CTT
cttcctcttaaaaaaatttc

SEQ ID NO: 193648 - DNA, 20 bp, Artificial Sequence
  Description of Artificial Sequence: Synthetic oligonucleotide
  Target: ATXN1; (-) strand; PAM type: YTN; PAM sequence: TTC
ttcttcctcttaaaaaaatt

SEQ ID NO: 193649 - DNA, 20 bp, Artificial Sequence
  Description of Artificial Sequence: Synthetic oligonucleotide
  Target: ATXN1; (-) strand; PAM type: YTN; PAM sequence: CTT
cttcttcctcttaaaaaaat

SEQ ID NO: 193650 - DNA, 20 bp, Artificial Sequence
  Description of Artificial Sequence: Synthetic oligonucleotide
  Target: ATXN1; (-) strand; PAM type: YTN; PAM sequence: TTC
aaggatacgaaacatgtatc

SEQ ID NO: 193651 - DNA, 20 bp, Artificial Sequence
  Description of Artificial Sequence: Synthetic oligonucleotide
  Target: ATXN1; (-) strand; PAM type: YTN; PAM sequence: CTT
caaggatacgaaacatgtat

SEQ ID NO: 193652 - DNA, 20 bp, Artificial Sequence
  Description of Artificial Sequence: Synthetic oligonucleotide
  Target: ATXN1; (-) strand; PAM type: YTN; PAM sequence: CTA
agcccttcaaggatacgaaa

SEQ ID NO: 193653 - DNA, 20 bp, Artificial Sequence
  Description of Artificial Sequence: Synthetic oligonucleotide
  Target: ATXN1; (-) strand; PAM type: YTN; PAM sequence: CTA
ggtcgaggctaagcccttca

SEQ ID NO: 193654 - DNA, 20 bp, Artificial Sequence
  Description of Artificial Sequence: Synthetic oligonucleotide
  Target: ATXN1; (-) strand; PAM type: YTN; PAM sequence: TTC
taggtcgaggctaagccctt

SEQ ID NO: 193655 - DNA, 20 bp, Artificial Sequence
  Description of Artificial Sequence: Synthetic oligonucleotide
  Target: ATXN1; (-) strand; PAM type: YTN; PAM sequence: TTT
ctaggtcgaggctaagccct

SEQ ID NO: 193656 - DNA, 20 bp, Artificial Sequence
  Description of Artificial Sequence: Synthetic oligonucleotide
  Target: ATXN1; (-) strand; PAM type: YTN; PAM sequence: TTT
tctaggtcgaggctaagccc

SEQ ID NO: 193657 - DNA, 20 bp, Artificial Sequence
  Description of Artificial Sequence: Synthetic oligonucleotide
  Target: ATXN1; (-) strand; PAM type: YTN; PAM sequence: CTG
agtgttttctaggtcgaggc

SEQ ID NO: 193658 - DNA, 20 bp, Artificial Sequence
  Description of Artificial Sequence: Synthetic oligonucleotide
  Target: ATXN1; (-) strand; PAM type: YTN; PAM sequence: TTG
ggggcctgagtgttttctag

SEQ ID NO: 193659 - DNA, 20 bp, Artificial Sequence
  Description of Artificial Sequence: Synthetic oligonucleotide
  Target: ATXN1; (-) strand; PAM type: YTN; PAM sequence: TTT
gggggcctgagtgttttcta

SEQ ID NO: 193660 - DNA, 20 bp, Artificial Sequence
  Description of Artificial Sequence: Synthetic oligonucleotide
  Target: ATXN1; (-) strand; PAM type: YTN; PAM sequence: CTT
tgggggcctgagtgttttct

SEQ ID NO: 193661 - DNA, 20 bp, Artificial Sequence
  Description of Artificial Sequence: Synthetic oligonucleotide
  Target: ATXN1; (-) strand; PAM type: YTN; PAM sequence: TTG
ctttgggggcctgagtgttt

SEQ ID NO: 193662 - DNA, 20 bp, Artificial Sequence
  Description of Artificial Sequence: Synthetic oligonucleotide
  Target: ATXN1; (-) strand; PAM type: YTN; PAM sequence: TTC
atatatattgctttgggggc

SEQ ID NO: 193663 - DNA, 20 bp, Artificial Sequence
  Description of Artificial Sequence: Synthetic oligonucleotide
  Target: ATXN1; (-) strand; PAM type: YTN; PAM sequence: TTT
catatatattgctttggggg

SEQ ID NO: 193664 - DNA, 20 bp, Artificial Sequence
  Description of Artificial Sequence: Synthetic oligonucleotide
  Target: ATXN1; (-) strand; PAM type: YTN; PAM sequence: TTT
tcatatatattgctttgggg

SEQ ID NO: 193665 - DNA, 20 bp, Artificial Sequence
  Description of Artificial Sequence: Synthetic oligonucleotide
  Target: ATXN1; (-) strand; PAM type: YTN; PAM sequence: TTT
ttcatatatattgctttggg

SEQ ID NO: 193666 - DNA, 20 bp, Artificial Sequence
  Description of Artificial Sequence: Synthetic oligonucleotide
  Target: ATXN1; (-) strand; PAM type: YTN; PAM sequence: TTT
tttcatatatattgctttgg

SEQ ID NO: 193667 - DNA, 20 bp, Artificial Sequence
  Description of Artificial Sequence: Synthetic oligonucleotide
  Target: ATXN1; (-) strand; PAM type: YTN; PAM sequence: CTT
ttttcatatatattgctttg

SEQ ID NO: 193668 - DNA, 20 bp, Artificial Sequence
  Description of Artificial Sequence: Synthetic oligonucleotide
  Target: ATXN1; (-) strand; PAM type: YTN; PAM sequence: TTC
cttttttcatatatattgct

SEQ ID NO: 193669 - DNA, 20 bp, Artificial Sequence
  Description of Artificial Sequence: Synthetic oligonucleotide
  Target: ATXN1; (-) strand; PAM type: YTN; PAM sequence: TTT
ccttttttcatatatattgc

SEQ ID NO: 193670 - DNA, 20 bp, Artificial Sequence
  Description of Artificial Sequence: Synthetic oligonucleotide
  Target: ATXN1; (-) strand; PAM type: YTN; PAM sequence: TTG
tatttccttttttcatatat

SEQ ID NO: 193671 - DNA, 20 bp, Artificial Sequence
  Description of Artificial Sequence: Synthetic oligonucleotide
  Target: ATXN1; (-) strand; PAM type: YTN; PAM sequence: CTT
gtatttccttttttcatata

SEQ ID NO: 193672 - DNA, 20 bp, Artificial Sequence
  Description of Artificial Sequence: Synthetic oligonucleotide
  Target: ATXN1; (-) strand; PAM type: YTN; PAM sequence: CTC
ttgtatttccttttttcata

SEQ ID NO: 193673 - DNA, 20 bp, Artificial Sequence
  Description of Artificial Sequence: Synthetic oligonucleotide
  Target: ATXN1; (-) strand; PAM type: YTN; PAM sequence: TTG
ctcttgtatttccttttttc

SEQ ID NO: 193674 - DNA, 20 bp, Artificial Sequence
  Description of Artificial Sequence: Synthetic oligonucleotide
  Target: ATXN1; (-) strand; PAM type: YTN; PAM sequence: TTG
acattgctcttgtatttcct

SEQ ID NO: 193675 - DNA, 20 bp, Artificial Sequence
  Description of Artificial Sequence: Synthetic oligonucleotide
  Target: ATXN1; (-) strand; PAM type: YTN; PAM sequence: TTT
gacattgctcttgtatttcc

SEQ ID NO: 193676 - DNA, 20 bp, Artificial Sequence
  Description of Artificial Sequence: Synthetic oligonucleotide
  Target: ATXN1; (-) strand; PAM type: YTN; PAM sequence: TTA
ccatccatttgacattgctc

SEQ ID NO: 193677 - DNA, 20 bp, Artificial Sequence
  Description of Artificial Sequence: Synthetic oligonucleotide
  Target: ATXN1; (-) strand; PAM type: YTN; PAM sequence: TTT
accatccatttgacattgct

SEQ ID NO: 193678 - DNA, 20 bp, Artificial Sequence
  Description of Artificial Sequence: Synthetic oligonucleotide
  Target: ATXN1; (-) strand; PAM type: YTN; PAM sequence: CTT
taccatccatttgacattgc

SEQ ID NO: 193679 - DNA, 20 bp, Artificial Sequence
  Description of Artificial Sequence: Synthetic oligonucleotide
  Target: ATXN1; (-) strand; PAM type: YTN; PAM sequence: TTA
aaaatctttaccatccattt

SEQ ID NO: 193680 - DNA, 20 bp, Artificial Sequence
  Description of Artificial Sequence: Synthetic oligonucleotide
  Target: ATXN1; (-) strand; PAM type: YTN; PAM sequence: TTT
aaaaatctttaccatccatt

SEQ ID NO: 193681 - DNA, 20 bp, Artificial Sequence
  Description of Artificial Sequence: Synthetic oligonucleotide
  Target: ATXN1; (-) strand; PAM type: YTN; PAM sequence: TTT
taaaaatctttaccatccat

SEQ ID NO: 193682 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatctttaccatcca

SEQ ID NO: 193683 - DNA, 20 bp, Artificial Sequence
  Description of Artificial Sequence: Synthetic oligonucleotide
  Target: ATXN1; (-) strand; PAM type: YTN; PAM sequence: CTG
aagcatttttaaaaatcttt

SEQ ID NO: 193684 - DNA, 20 bp, Artificial Sequence
  Description of Artificial Sequence: Synthetic oligonucleotide
  Target: ATXN1; (-) strand; PAM type: YTN; PAM sequence: CTC
ctgaagcatttttaaaaatc

SEQ ID NO: 193685 - DNA, 20 bp, Artificial Sequence
  Description of Artificial Sequence: Synthetic oligonucleotide
  Target: ATXN1; (-) strand; PAM type: YTN; PAM sequence: CTG
aactcctgaagcatttttaa

SEQ ID NO: 193686 - DNA, 20 bp, Artificial Sequence
  Description of Artificial Sequence: Synthetic oligonucleotide
  Target: ATXN1; (-) strand; PAM type: YTN; PAM sequence: CTC
tgaactcctgaagcattttt

SEQ ID NO: 193687 - DNA, 20 bp, Artificial Sequence
  Description of Artificial Sequence: Synthetic oligonucleotide
  Target: ATXN1; (-) strand; PAM type: YTN; PAM sequence: TTC
ccctctgaactcctgaagca

SEQ ID NO: 193688 - DNA, 20 bp, Artificial Sequence
  Description of Artificial Sequence: Synthetic oligonucleotide
  Target: ATXN1; (-) strand; PAM type: YTN; PAM sequence: TTT
cccctctgaactcctgaagc

SEQ ID NO: 193689 - DNA, 20 bp, Artificial Sequence
  Description of Artificial Sequence: Synthetic oligonucleotide
  Target: ATXN1; (-) strand; PAM type: YTN; PAM sequence: TTT
tcccctctgaactcctgaag

SEQ ID NO: 193690 - DNA, 20 bp, Artificial Sequence
  Description of Artificial Sequence: Synthetic oligonucleotide
  Target: ATXN1; (-) strand; PAM type: YTN; PAM sequence: TTT
ttcccctctgaactcctgaa

SEQ ID NO: 193691 - DNA, 20 bp, Artificial Sequence
  Description of Artificial Sequence: Synthetic oligonucleotide
  Target: ATXN1; (-) strand; PAM type: YTN; PAM sequence: TTT
tttcccctctgaactcctga

SEQ ID NO: 193692 - DNA, 20 bp, Artificial Sequence
  Description of Artificial Sequence: Synthetic oligonucleotide
  Target: ATXN1; (-) strand; PAM type: YTN; PAM sequence: TTT
ttttcccctctgaactcctg

SEQ ID NO: 193693 - DNA, 20 bp, Artificial Sequence
  Description of Artificial Sequence: Synthetic oligonucleotide
  Target: ATXN1; (-) strand; PAM type: YTN; PAM sequence: CTT
tttttcccctctgaactcct

SEQ ID NO: 193694 - DNA, 20 bp, Artificial Sequence
  Description of Artificial Sequence: Synthetic oligonucleotide
  Target: ATXN1; (-) strand; PAM type: YTN; PAM sequence: TTC
caacggatactttttttccc

SEQ ID NO: 193695 - DNA, 20 bp, Artificial Sequence
  Description of Artificial Sequence: Synthetic oligonucleotide
  Target: ATXN1; (-) strand; PAM type: YTN; PAM sequence: TTA
gttccaacggatactttttt

SEQ ID NO: 193696 - DNA, 20 bp, Artificial Sequence
  Description of Artificial Sequence: Synthetic oligonucleotide
  Target: ATXN1; (-) strand; PAM type: YTN; PAM sequence: CTT
agttccaacggatacttttt

SEQ ID NO: 193697 - DNA, 20 bp, Artificial Sequence
  Description of Artificial Sequence: Synthetic oligonucleotide
  Target: ATXN1; (-) strand; PAM type: YTN; PAM sequence: CTC
ttagttccaacggatacttt

SEQ ID NO: 193698 - DNA, 20 bp, Artificial Sequence
  Description of Artificial Sequence: Synthetic oligonucleotide
  Target: ATXN1; (-) strand; PAM type: YTN; PAM sequence: TTG
taagaactcttagttccaac

SEQ ID NO: 193699 - DNA, 20 bp, Artificial Sequence
  Description of Artificial Sequence: Synthetic oligonucleotide
  Target: ATXN1; (-) strand; PAM type: YTN; PAM sequence: TTG
atgaaagaattgtaagaact

SEQ ID NO: 193700 - DNA, 20 bp, Artificial Sequence
  Description of Artificial Sequence: Synthetic oligonucleotide
  Target: ATXN1; (-) strand; PAM type: YTN; PAM sequence: CTT
gatgaaagaattgtaagaac

SEQ ID NO: 193701 - DNA, 20 bp, Artificial Sequence
  Description of Artificial Sequence: Synthetic oligonucleotide
  Target: ATXN1; (-) strand; PAM type: YTN; PAM sequence: CTA
tataatccttgatgaaagaa

SEQ ID NO: 193702 - DNA, 20 bp, Artificial Sequence
  Description of Artificial Sequence: Synthetic oligonucleotide
  Target: ATXN1; (-) strand; PAM type: YTN; PAM sequence: CTC
atctatataatccttgatga

SEQ ID NO: 193703 - DNA, 20 bp, Artificial Sequence
  Description of Artificial Sequence: Synthetic oligonucleotide
  Target: ATXN1; (-) strand; PAM type: YTN; PAM sequence: TTC
ctcatctatataatccttga

SEQ ID NO: 193704 - DNA, 20 bp, Artificial Sequence
  Description of Artificial Sequence: Synthetic oligonucleotide
  Target: ATXN1; (-) strand; PAM type: YTN; PAM sequence: TTT
cctcatctatataatccttg

SEQ ID NO: 193705 - DNA, 20 bp, Artificial Sequence
  Description of Artificial Sequence: Synthetic oligonucleotide
  Target: ATXN1; (-) strand; PAM type: YTN; PAM sequence: CTA
atgtttcctcatctatataa

SEQ ID NO: 193706 - DNA, 20 bp, Artificial Sequence
  Description of Artificial Sequence: Synthetic oligonucleotide
  Target: ATXN1; (-) strand; PAM type: YTN; PAM sequence: CTC
taatgtttcctcatctatat

SEQ ID NO: 193707 - DNA, 20 bp, Artificial Sequence
  Description of Artificial Sequence: Synthetic oligonucleotide
  Target: ATXN1; (-) strand; PAM type: YTN; PAM sequence: TTC
tctaatgtttcctcatctat

SEQ ID NO: 193708 - DNA, 20 bp, Artificial Sequence
  Description of Artificial Sequence: Synthetic oligonucleotide
  Target: ATXN1; (-) strand; PAM type: YTN; PAM sequence: TTT
ctctaatgtttcctcatcta

SEQ ID NO: 193709 - DNA, 20 bp, Artificial Sequence
  Description of Artificial Sequence: Synthetic oligonucleotide
  Target: ATXN1; (-) strand; PAM type: YTN; PAM sequence: TTC
acatttctctaatgtttcct

SEQ ID NO: 193710 - DNA, 20 bp, Artificial Sequence
  Description of Artificial Sequence: Synthetic oligonucleotide
  Target: ATXN1; (-) strand; PAM type: YTN; PAM sequence: TTT
cacatttctctaatgtttcc

SEQ ID NO: 193711 - DNA, 20 bp, Artificial Sequence
  Description of Artificial Sequence: Synthetic oligonucleotide
  Target: ATXN1; (-) strand; PAM type: YTN; PAM sequence: CTT
tcacatttctctaatgtttc

SEQ ID NO: 193712 - DNA, 20 bp, Artificial Sequence
  Description of Artificial Sequence: Synthetic oligonucleotide
  Target: ATXN1; (-) strand; PAM type: YTN; PAM sequence: TTG
gggctttcacatttctctaa

SEQ ID NO: 193713 - DNA, 20 bp, Artificial Sequence
  Description of Artificial Sequence: Synthetic oligonucleotide
  Target: ATXN1; (-) strand; PAM type: YTN; PAM sequence: CTG
atgtgtggttggggctttca

SEQ ID NO: 193714 - DNA, 20 bp, Artificial Sequence
  Description of Artificial Sequence: Synthetic oligonucleotide
  Target: ATXN1; (-) strand; PAM type: YTN; PAM sequence: CTA
ctgatgtgtggttggggctt

SEQ ID NO: 193715 - DNA, 20 bp, Artificial Sequence
  Description of Artificial Sequence: Synthetic oligonucleotide
  Target: ATXN1; (-) strand; PAM type: YTN; PAM sequence: CTC
tactgatgtgtggttggggc

SEQ ID NO: 193716 - DNA, 20 bp, Artificial Sequence
  Description of Artificial Sequence: Synthetic oligonucleotide
  Target: ATXN1; (-) strand; PAM type: YTN; PAM sequence: TTC
tctactgatgtgtggttggg

SEQ ID NO: 193717 - DNA, 20 bp, Artificial Sequence
  Description of Artificial Sequence: Synthetic oligonucleotide
  Target: ATXN1; (-) strand; PAM type: YTN; PAM sequence: TTT
ctctactgatgtgtggttgg

SEQ ID NO: 193718 - DNA, 20 bp, Artificial Sequence
  Description of Artificial Sequence: Synthetic oligonucleotide
  Target: ATXN1; (-) strand; PAM type: YTN; PAM sequence: TTG
cagtttctctactgatgtgt

SEQ ID NO: 193719 - DNA, 20 bp, Artificial Sequence
  Description of Artificial Sequence: Synthetic oligonucleotide
  Target: ATXN1; (-) strand; PAM type: YTN; PAM sequence: CTA
attgcagtttctctactgat

SEQ ID NO: 193720 - DNA, 20 bp, Artificial Sequence
  Description of Artificial Sequence: Synthetic oligonucleotide
  Target: ATXN1; (-) strand; PAM type: YTN; PAM sequence: TTC
taattgcagtttctctactg

SEQ ID NO: 193721 - DNA, 20 bp, Artificial Sequence
  Description of Artificial Sequence: Synthetic oligonucleotide
  Target: ATXN1; (-) strand; PAM type: YTN; PAM sequence: TTT
ctaattgcagtttctctact

SEQ ID NO: 193722 - DNA, 20 bp, Artificial Sequence
  Description of Artificial Sequence: Synthetic oligonucleotide
  Target: ATXN1; (-) strand; PAM type: YTN; PAM sequence: TTA
ccagagaggcagtttctaat

SEQ ID NO: 193723 - DNA, 20 bp, Artificial Sequence
  Description of Artificial Sequence: Synthetic oligonucleotide
  Target: ATXN1; (-) strand; PAM type: YTN; PAM sequence: CTT
accagagaggcagtttctaa

SEQ ID NO: 193724 - DNA, 20 bp, Artificial Sequence
  Description of Artificial Sequence: Synthetic oligonucleotide
  Target: ATXN1; (-) strand; PAM type: YTN; PAM sequence: CTC
ttaccagagaggcagtttct

SEQ ID NO: 193725 - DNA, 20 bp, Artificial Sequence
  Description of Artificial Sequence: Synthetic oligonucleotide
  Target: ATXN1; (-) strand; PAM type: YTN; PAM sequence: CTG
ggagctcttaccagagaggc

SEQ ID NO: 193726 - DNA, 20 bp, Artificial Sequence
  Description of Artificial Sequence: Synthetic oligonucleotide
  Target: ATXN1; (-) strand; PAM type: YTN; PAM sequence: TTC
tgggagctcttaccagagag

SEQ ID NO: 193727 - DNA, 20 bp, Artificial Sequence
  Description of Artificial Sequence: Synthetic oligonucleotide
  Target: ATXN1; (-) strand; PAM type: YTN; PAM sequence: CTT
ctgggagctcttaccagaga

SEQ ID NO: 193728 - DNA, 20 bp, Artificial Sequence
  Description of Artificial Sequence: Synthetic oligonucleotide
  Target: ATXN1; (-) strand; PAM type: YTN; PAM sequence: CTC
atcttctgggagctcttacc

SEQ ID NO: 193729 - DNA, 20 bp, Artificial Sequence
  Description of Artificial Sequence: Synthetic oligonucleotide
  Target: ATXN1; (-) strand; PAM type: YTN; PAM sequence: TTC
tcatcttctgggagctctta

SEQ ID NO: 193730 - DNA, 20 bp, Artificial Sequence
  Description of Artificial Sequence: Synthetic oligonucleotide
  Target: ATXN1; (-) strand; PAM type: YTN; PAM sequence: TTT
ctcatcttctgggagctctt

SEQ ID NO: 193731 - DNA, 20 bp, Artificial Sequence
  Description of Artificial Sequence: Synthetic oligonucleotide
  Target: ATXN1; (-) strand; PAM type: YTN; PAM sequence: CTG
cacagagaaatgcaataccc

SEQ ID NO: 193732 - DNA, 20 bp, Artificial Sequence
  Description of Artificial Sequence: Synthetic oligonucleotide
  Target: ATXN1; (-) strand; PAM type: YTN; PAM sequence: CTG
caatgccaggcccagtagga

SEQ ID NO: 193733 - DNA, 20 bp, Artificial Sequence
  Description of Artificial Sequence: Synthetic oligonucleotide
  Target: ATXN1; (-) strand; PAM type: YTN; PAM sequence: CTA
ccagtggagcctgcaatgcc

SEQ ID NO: 193734 - DNA, 20 bp, Artificial Sequence
  Description of Artificial Sequence: Synthetic oligonucleotide
  Target: ATXN1; (-) strand; PAM type: YTN; PAM sequence: TTG
aggagacacctaccagtgga

SEQ ID NO: 193735 - DNA, 20 bp, Artificial Sequence
  Description of Artificial Sequence: Synthetic oligonucleotide
  Target: ATXN1; (-) strand; PAM type: YTN; PAM sequence: CTG
cagattgaggagacacctac

SEQ ID NO: 193736 - DNA, 20 bp, Artificial Sequence
  Description of Artificial Sequence: Synthetic oligonucleotide
  Target: ATXN1; (-) strand; PAM type: YTN; PAM sequence: TTA
atatgctgcagattgaggag

SEQ ID NO: 193737 - DNA, 20 bp, Artificial Sequence
  Description of Artificial Sequence: Synthetic oligonucleotide
  Target: ATXN1; (-) strand; PAM type: YTN; PAM sequence: TTT
aatatgctgcagattgagga

SEQ ID NO: 193738 - DNA, 20 bp, Artificial Sequence
  Description of Artificial Sequence: Synthetic oligonucleotide
  Target: ATXN1; (-) strand; PAM type: YTN; PAM sequence: CTC
atttaatatgctgcagattg

SEQ ID NO: 193739 - DNA, 20 bp, Artificial Sequence
  Description of Artificial Sequence: Synthetic oligonucleotide
  Target: ATXN1; (-) strand; PAM type: YTN; PAM sequence: CTG
aaatgtgtgggtagtgacat

SEQ ID NO: 193740 - DNA, 20 bp, Artificial Sequence
  Description of Artificial Sequence: Synthetic oligonucleotide
  Target: ATXN1; (-) strand; PAM type: YTN; PAM sequence: CTG
gctgaaatgtgtgggtagtg

SEQ ID NO: 193741 - DNA, 20 bp, Artificial Sequence
  Description of Artificial Sequence: Synthetic oligonucleotide
  Target: ATXN1; (-) strand; PAM type: YTN; PAM sequence: CTC
ctggctgaaatgtgtgggta

SEQ ID NO: 193742 - DNA, 20 bp, Artificial Sequence
  Description of Artificial Sequence: Synthetic oligonucleotide
  Target: ATXN1; (-) strand; PAM type: YTN; PAM sequence: CTG
ctcctggctgaaatgtgtgg

SEQ ID NO: 193743 - DNA, 20 bp, Artificial Sequence
  Description of Artificial Sequence: Synthetic oligonucleotide
  Target: ATXN1; (-) strand; PAM type: YTN; PAM sequence: CTG
ggcatcgtggtcagctgctc

SEQ ID NO: 193744 - DNA, 20 bp, Artificial Sequence
  Description of Artificial Sequence: Synthetic oligonucleotide
  Target: ATXN1; (-) strand; PAM type: YTN; PAM sequence: TTC
ctgggcatcgtggtcagctg

SEQ ID NO: 193745 - DNA, 20 bp, Artificial Sequence
  Description of Artificial Sequence: Synthetic oligonucleotide
  Target: ATXN1; (-) strand; PAM type: YTN; PAM sequence: CTT
cctgggcatcgtggtcagct

SEQ ID NO: 193746 - DNA, 20 bp, Artificial Sequence
  Description of Artificial Sequence: Synthetic oligonucleotide
  Target: ATXN1; (-) strand; PAM type: YTN; PAM sequence: CTG
gtggggagggtacttcctgg

SEQ ID NO: 193747 - DNA, 20 bp, Artificial Sequence
  Description of Artificial Sequence: Synthetic oligonucleotide
  Target: ATXN1; (-) strand; PAM type: YTN; PAM sequence: CTG
tcagaatgacctggtgggga

SEQ ID NO: 193748 - DNA, 20 bp, Artificial Sequence
  Description of Artificial Sequence: Synthetic oligonucleotide
  Target: ATXN1; (-) strand; PAM type: YTN; PAM sequence: CTC
tgtcagaatgacctggtggg

SEQ ID NO: 193749 - DNA, 20 bp, Artificial Sequence
  Description of Artificial Sequence: Synthetic oligonucleotide
  Target: ATXN1; (-) strand; PAM type: YTN; PAM sequence: CTG
tgtgtggcacagcggctctg

SEQ ID NO: 193750 - DNA, 20 bp, Artificial Sequence
  Description of Artificial Sequence: Synthetic oligonucleotide
  Target: ATXN1; (-) strand; PAM type: YTN; PAM sequence: CTC
cctgtgtgtggcacagcggc

SEQ ID NO: 193751 - DNA, 20 bp, Artificial Sequence
  Description of Artificial Sequence: Synthetic oligonucleotide
  Target: ATXN1; (-) strand; PAM type: YTN; PAM sequence: TTC
atcctccctgtgtgtggcac

SEQ ID NO: 193752 - DNA, 20 bp, Artificial Sequence
  Description of Artificial Sequence: Synthetic oligonucleotide
  Target: ATXN1; (-) strand; PAM type: YTN; PAM sequence: TTT
catcctccctgtgtgtggca

SEQ ID NO: 193753 - DNA, 20 bp, Artificial Sequence
  Description of Artificial Sequence: Synthetic oligonucleotide
  Target: ATXN1; (-) strand; PAM type: YTN; PAM sequence: TTT
tcatcctccctgtgtgtggc

SEQ ID NO: 193754 - DNA, 20 bp, Artificial Sequence
  Description of Artificial Sequence: Synthetic oligonucleotide
  Target: ATXN1; (-) strand; PAM type: YTN; PAM sequence: CTT
ttcatcctccctgtgtgtgg

SEQ ID NO: 193755 - DNA, 20 bp, Artificial Sequence
  Description of Artificial Sequence: Synthetic oligonucleotide
  Target: ATXN1; (-) strand; PAM type: YTN; PAM sequence: CTG
tgcttttcatcctccctgtg

SEQ ID NO: 193756 - DNA, 20 bp, Artificial Sequence
  Description of Artificial Sequence: Synthetic oligonucleotide
  Target: ATXN1; (-) strand; PAM type: YTN; PAM sequence: TTG
aaaggaggtggagagtctgt

SEQ ID NO: 193757 - DNA, 20 bp, Artificial Sequence
  Description of Artificial Sequence: Synthetic oligonucleotide
  Target: ATXN1; (-) strand; PAM type: YTN; PAM sequence: TTA
gcaattgaaaggaggtggag

SEQ ID NO: 193758 - DNA, 20 bp, Artificial Sequence
  Description of Artificial Sequence: Synthetic oligonucleotide
  Target: ATXN1; (-) strand; PAM type: YTN; PAM sequence: CTT
agcaattgaaaggaggtgga

SEQ ID NO: 193759 - DNA, 20 bp, Artificial Sequence
  Description of Artificial Sequence: Synthetic oligonucleotide
  Target: ATXN1; (-) strand; PAM type: YTN; PAM sequence: CTG
tcttagcaattgaaaggagg

SEQ ID NO: 193760 - DNA, 20 bp, Artificial Sequence
  Description of Artificial Sequence: Synthetic oligonucleotide
  Target: ATXN1; (-) strand; PAM type: YTN; PAM sequence: CTG
cctgtcttagcaattgaaag

SEQ ID NO: 193761 - DNA, 20 bp, Artificial Sequence
  Description of Artificial Sequence: Synthetic oligonucleotide
  Target: ATXN1; (-) strand; PAM type: YTN; PAM sequence: TTG
gcagcacctgcctgtcttag

SEQ ID NO: 193762 - DNA, 20 bp, Artificial Sequence
  Description of Artificial Sequence: Synthetic oligonucleotide
  Target: ATXN1; (-) strand; PAM type: YTN; PAM sequence: CTG
aatgggtcagcagggttggc

SEQ ID NO: 193763 - DNA, 20 bp, Artificial Sequence
  Description of Artificial Sequence: Synthetic oligonucleotide
  Target: ATXN1; (-) strand; PAM type: YTN; PAM sequence: CTC
tgaatgggtcagcagggttg

SEQ ID NO: 193764 - DNA, 20 bp, Artificial Sequence
  Description of Artificial Sequence: Synthetic oligonucleotide
  Target: ATXN1; (-) strand; PAM type: YTN; PAM sequence: CTG
caggcctctgaatgggtcag

SEQ ID NO: 193765 - DNA, 20 bp, Artificial Sequence
  Description of Artificial Sequence: Synthetic oligonucleotide
  Target: ATXN1; (-) strand; PAM type: YTN; PAM sequence: TTC
tgcaggcctctgaatgggtc

SEQ ID NO: 193766 - DNA, 20 bp, Artificial Sequence
  Description of Artificial Sequence: Synthetic oligonucleotide
  Target: ATXN1; (-) strand; PAM type: YTN; PAM sequence: CTG
taggagtgttctgcaggcct

SEQ ID NO: 193767 - DNA, 20 bp, Artificial Sequence
  Description of Artificial Sequence: Synthetic oligonucleotide
  Target: ATXN1; (-) strand; PAM type: YTN; PAM sequence: TTG
atgagagacaaggcaatgcc

SEQ ID NO: 193768 - DNA, 20 bp, Artificial Sequence
  Description of Artificial Sequence: Synthetic oligonucleotide
  Target: ATXN1; (-) strand; PAM type: YTN; PAM sequence: CTT
gatgagagacaaggcaatgc

SEQ ID NO: 193769 - DNA, 20 bp, Artificial Sequence
  Description of Artificial Sequence: Synthetic oligonucleotide
  Target: ATXN1; (-) strand; PAM type: YTN; PAM sequence: TTG
gaacttgatgagagacaagg

SEQ ID NO: 193770 - DNA, 20 bp, Artificial Sequence
  Description of Artificial Sequence: Synthetic oligonucleotide
  Target: ATXN1; (-) strand; PAM type: YTN; PAM sequence: CTT
ggaacttgatgagagacaag

SEQ ID NO: 193771 - DNA, 20 bp, Artificial Sequence
  Description of Artificial Sequence: Synthetic oligonucleotide
  Target: ATXN1; (-) strand; PAM type: YTN; PAM sequence: CTC
ggtccatcttggaacttgat

SEQ ID NO: 193772 - DNA, 20 bp, Artificial Sequence
  Description of Artificial Sequence: Synthetic oligonucleotide
  Target: ATXN1; (-) strand; PAM type: YTN; PAM sequence: CTG
tctcggtccatcttggaact

SEQ ID NO: 193773 - DNA, 20 bp, Artificial Sequence
  Description of Artificial Sequence: Synthetic oligonucleotide
  Target: ATXN1; (-) strand; PAM type: YTN; PAM sequence: CTC
ctgtctcggtccatcttgga

SEQ ID NO: 193774 - DNA, 20 bp, Artificial Sequence
  Description of Artificial Sequence: Synthetic oligonucleotide
  Target: ATXN1; (-) strand; PAM type: YTN; PAM sequence: TTG
cctcctgtctcggtccatct

SEQ ID NO: 193775 - DNA, 20 bp, Artificial Sequence
  Description of Artificial Sequence: Synthetic oligonucleotide
  Target: ATXN1; (-) strand; PAM type: YTN; PAM sequence: CTT
gcctcctgtctcggtccatc

SEQ ID NO: 193776 - DNA, 20 bp, Artificial Sequence
  Description of Artificial Sequence: Synthetic oligonucleotide
  Target: ATXN1; (-) strand; PAM type: YTN; PAM sequence: TTA
acacttgcctcctgtctcgg

SEQ ID NO: 193777 - DNA, 20 bp, Artificial Sequence
  Description of Artificial Sequence: Synthetic oligonucleotide
  Target: ATXN1; (-) strand; PAM type: YTN; PAM sequence: CTA
ttaacacttgcctcctgtct

SEQ ID NO: 193778 - DNA, 20 bp, Artificial Sequence
  Description of Artificial Sequence: Synthetic oligonucleotide
  Target: ATXN1; (-) strand; PAM type: YTN; PAM sequence: TTG
ctattaacacttgcctcctg

SEQ ID NO: 193779 - DNA, 20 bp, Artificial Sequence
  Description of Artificial Sequence: Synthetic oligonucleotide
  Target: ATXN1; (-) strand; PAM type: YTN; PAM sequence: CTT
gctattaacacttgcctcct

SEQ ID NO: 193780 - DNA, 20 bp, Artificial Sequence
  Description of Artificial Sequence: Synthetic oligonucleotide
  Target: ATXN1; (-) strand; PAM type: YTN; PAM sequence: CTC
ttgctattaacacttgcctc

SEQ ID NO: 193781 - DNA, 20 bp, Artificial Sequence
  Description of Artificial Sequence: Synthetic oligonucleotide
  Target: ATXN1; (-) strand; PAM type: YTN; PAM sequence: CTA
ctcttgctattaacacttgc

SEQ ID NO: 193782 - DNA, 20 bp, Artificial Sequence
  Description of Artificial Sequence: Synthetic oligonucleotide
  Target: ATXN1; (-) strand; PAM type: YTN; PAM sequence: CTA
tctactcttgctattaacac

SEQ ID NO: 193783 - DNA, 20 bp, Artificial Sequence
  Description of Artificial Sequence: Synthetic oligonucleotide
  Target: ATXN1; (-) strand; PAM type: YTN; PAM sequence: TTA
ctatctactcttgctattaa

SEQ ID NO: 193784 - DNA, 20 bp, Artificial Sequence
  Description of Artificial Sequence: Synthetic oligonucleotide
  Target: ATXN1; (-) strand; PAM type: YTN; PAM sequence: TTC
gtaatggttactatctactc

SEQ ID NO: 193785 - DNA, 20 bp, Artificial Sequence
  Description of Artificial Sequence: Synthetic oligonucleotide
  Target: ATXN1; (-) strand; PAM type: YTN; PAM sequence: TTT
cgtaatggttactatctact

SEQ ID NO: 193786 - DNA, 20 bp, Artificial Sequence
  Description of Artificial Sequence: Synthetic oligonucleotide
  Target: ATXN1; (-) strand; PAM type: YTN; PAM sequence: TTT
tcgtaatggttactatctac

SEQ ID NO: 193787 - DNA, 20 bp, Artificial Sequence
  Description of Artificial Sequence: Synthetic oligonucleotide
  Target: ATXN1; (-) strand; PAM type: YTN; PAM sequence: CTG
tgatatgcggagaatgtggt

SEQ ID NO: 193788 - DNA, 20 bp, Artificial Sequence
  Description of Artificial Sequence: Synthetic oligonucleotide
  Target: ATXN1; (-) strand; PAM type: YTN; PAM sequence: CTG
gggcctgtgatatgcggaga

SEQ ID NO: 193789 - DNA, 20 bp, Artificial Sequence
  Description of Artificial Sequence: Synthetic oligonucleotide
  Target: ATXN1; (-) strand; PAM type: YTN; PAM sequence: CTC
ctggggcctgtgatatgcgg

SEQ ID NO: 193790 - DNA, 20 bp, Artificial Sequence
  Description of Artificial Sequence: Synthetic oligonucleotide
  Target: ATXN1; (-) strand; PAM type: YTN; PAM sequence: TTC
ccctcctggggcctgtgata

SEQ ID NO: 193791 - DNA, 20 bp, Artificial Sequence
  Description of Artificial Sequence: Synthetic oligonucleotide
  Target: ATXN1; (-) strand; PAM type: YTN; PAM sequence: TTT
cccctcctggggcctgtgat

SEQ ID NO: 193792 - DNA, 20 bp, Artificial Sequence
  Description of Artificial Sequence: Synthetic oligonucleotide
  Target: ATXN1; (-) strand; PAM type: YTN; PAM sequence: CTT
tcccctcctggggcctgtga

SEQ ID NO: 193793 - DNA, 20 bp, Artificial Sequence
  Description of Artificial Sequence: Synthetic oligonucleotide
  Target: ATXN1; (-) strand; PAM type: YTN; PAM sequence: TTG
cctttcccctcctggggcct

SEQ ID NO: 193794 - DNA, 20 bp, Artificial Sequence
  Description of Artificial Sequence: Synthetic oligonucleotide
  Target: ATXN1; (-) strand; PAM type: YTN; PAM sequence: CTT
gcctttcccctcctggggcc

SEQ ID NO: 193795 - DNA, 20 bp, Artificial Sequence
  Description of Artificial Sequence: Synthetic oligonucleotide
  Target: ATXN1; (-) strand; PAM type: YTN; PAM sequence: CTC
ttgcctttcccctcctgggg

SEQ ID NO: 193796 - DNA, 20 bp, Artificial Sequence
  Description of Artificial Sequence: Synthetic oligonucleotide
  Target: ATXN1; (-) strand; PAM type: YTN; PAM sequence: CTC
tcttgcctttcccctcctgg

SEQ ID NO: 193797 - DNA, 20 bp, Artificial Sequence
  Description of Artificial Sequence: Synthetic oligonucleotide
  Target: ATXN1; (-) strand; PAM type: YTN; PAM sequence: TTA
tcctctcttgcctttcccct

SEQ ID NO: 193798 - DNA, 20 bp, Artificial Sequence
  Description of Artificial Sequence: Synthetic oligonucleotide
  Target: ATXN1; (-) strand; PAM type: YTN; PAM sequence: CTT
atcctctcttgcctttcccc

SEQ ID NO: 193799 - DNA, 20 bp, Artificial Sequence
  Description of Artificial Sequence: Synthetic oligonucleotide
  Target: ATXN1; (-) strand; PAM type: YTN; PAM sequence: TTC
ccaccttatcctctcttgcc

SEQ ID NO: 193800 - DNA, 20 bp, Artificial Sequence
  Description of Artificial Sequence: Synthetic oligonucleotide
  Target: ATXN1; (-) strand; PAM type: YTN; PAM sequence: TTT
cccaccttatcctctcttgc

SEQ ID NO: 193801 - DNA, 20 bp, Artificial Sequence
  Description of Artificial Sequence: Synthetic oligonucleotide
  Target: ATXN1; (-) strand; PAM type: YTN; PAM sequence: TTA
tttcccaccttatcctctct

SEQ ID NO: 193802 - DNA, 20 bp, Artificial Sequence
  Description of Artificial Sequence: Synthetic oligonucleotide
  Target: ATXN1; (-) strand; PAM type: YTN; PAM sequence: TTT
atttcccaccttatcctctc

SEQ ID NO: 193803 - DNA, 20 bp, Artificial Sequence
  Description of Artificial Sequence: Synthetic oligonucleotide
  Target: ATXN1; (-) strand; PAM type: YTN; PAM sequence: TTT
tatttcccaccttatcctct

SEQ ID NO: 193804 - DNA, 20 bp, Artificial Sequence
  Description of Artificial Sequence: Synthetic oligonucleotide
  Target: ATXN1; (-) strand; PAM type: YTN; PAM sequence: CTT
ttatttcccaccttatcctc

SEQ ID NO: 193805 - DNA, 20 bp, Artificial Sequence
  Description of Artificial Sequence: Synthetic oligonucleotide
  Target: ATXN1; (-) strand; PAM type: YTN; PAM sequence: CTC
ttttatttcccaccttatcc

SEQ ID NO: 193806 - DNA, 20 bp, Artificial Sequence
  Description of Artificial Sequence: Synthetic oligonucleotide
  Target: ATXN1; (-) strand; PAM type: YTN; PAM sequence: CTG
ataccctcttttatttccca

SEQ ID NO: 193807 - DNA, 20 bp, Artificial Sequence
  Description of Artificial Sequence: Synthetic oligonucleotide
  Target: ATXN1; (-) strand; PAM type: YTN; PAM sequence: CTG
ggcaggatgagggcagccct

SEQ ID NO: 193808 - DNA, 20 bp, Artificial Sequence
  Description of Artificial Sequence: Synthetic oligonucleotide
  Target: ATXN1; (-) strand; PAM type: YTN; PAM sequence: CTG
tgacagccagtgtatcctgg

SEQ ID NO: 193809 - DNA, 20 bp, Artificial Sequence
  Description of Artificial Sequence: Synthetic oligonucleotide
  Target: ATXN1; (-) strand; PAM type: YTN; PAM sequence: CTG
ccagaaaacatataatgact

SEQ ID NO: 193810 - DNA, 20 bp, Artificial Sequence
  Description of Artificial Sequence: Synthetic oligonucleotide
  Target: ATXN1; (-) strand; PAM type: YTN; PAM sequence: CTG
tgctgccagaaaacatataa

SEQ ID NO: 193811 - DNA, 20 bp, Artificial Sequence
  Description of Artificial Sequence: Synthetic oligonucleotide
  Target: ATXN1; (-) strand; PAM type: YTN; PAM sequence: TTC
catagcaacgtgactgtgct

SEQ ID NO: 193812 - DNA, 20 bp, Artificial Sequence
  Description of Artificial Sequence: Synthetic oligonucleotide
  Target: ATXN1; (-) strand; PAM type: YTN; PAM sequence: TTG
gttccatagcaacgtgactg

SEQ ID NO: 193813 - DNA, 20 bp, Artificial Sequence
  Description of Artificial Sequence: Synthetic oligonucleotide
  Target: ATXN1; (-) strand; PAM type: YTN; PAM sequence: CTA
gaggccaggtggcaatgaca

SEQ ID NO: 193814 - DNA, 20 bp, Artificial Sequence
  Description of Artificial Sequence: Synthetic oligonucleotide
  Target: ATXN1; (-) strand; PAM type: YTN; PAM sequence: TTG
ctagaggccaggtggcaatg

SEQ ID NO: 193815 - DNA, 20 bp, Artificial Sequence
  Description of Artificial Sequence: Synthetic oligonucleotide
  Target: ATXN1; (-) strand; PAM type: YTN; PAM sequence: TTT
gctagaggccaggtggcaat

SEQ ID NO: 193816 - DNA, 20 bp, Artificial Sequence
  Description of Artificial Sequence: Synthetic oligonucleotide
  Target: ATXN1; (-) strand; PAM type: YTN; PAM sequence: TTA
tttgctagaggccaggtggc

SEQ ID NO: 193817 - DNA, 20 bp, Artificial Sequence
  Description of Artificial Sequence: Synthetic oligonucleotide
  Target: ATXN1; (-) strand; PAM type: YTN; PAM sequence: TTT
atttgctagaggccaggtgg

SEQ ID NO: 193818 - DNA, 20 bp, Artificial Sequence
  Description of Artificial Sequence: Synthetic oligonucleotide
  Target: ATXN1; (-) strand; PAM type: YTN; PAM sequence: TTT
tatttgctagaggccaggtg

SEQ ID NO: 193819 - DNA, 20 bp, Artificial Sequence
  Description of Artificial Sequence: Synthetic oligonucleotide
  Target: ATXN1; (-) strand; PAM type: YTN; PAM sequence: CTG
tgattttatttgctagaggc

SEQ ID NO: 193820 - DNA, 20 bp, Artificial Sequence
  Description of Artificial Sequence: Synthetic oligonucleotide
  Target: ATXN1; (-) strand; PAM type: YTN; PAM sequence: TTG
ccagcgctgtgattttattt

SEQ ID NO: 193821 - DNA, 20 bp, Artificial Sequence
  Description of Artificial Sequence: Synthetic oligonucleotide
  Target: ATXN1; (-) strand; PAM type: YTN; PAM sequence: CTT
gccagcgctgtgattttatt

SEQ ID NO: 193822 - DNA, 20 bp, Artificial Sequence
  Description of Artificial Sequence: Synthetic oligonucleotide
  Target: ATXN1; (-) strand; PAM type: YTN; PAM sequence: CTC
ttgccagcgctgtgatttta

SEQ ID NO: 193823 - DNA, 20 bp, Artificial Sequence
  Description of Artificial Sequence: Synthetic oligonucleotide
  Target: ATXN1; (-) strand; PAM type: YTN; PAM sequence: TTA
agggaaatccagggaaatgc

SEQ ID NO: 193824 - DNA, 20 bp, Artificial Sequence
  Description of Artificial Sequence: Synthetic oligonucleotide
  Target: ATXN1; (-) strand; PAM type: YTN; PAM sequence: TTT
aagggaaatccagggaaatg

SEQ ID NO: 193825 - DNA, 20 bp, Artificial Sequence
  Description of Artificial Sequence: Synthetic oligonucleotide
  Target: ATXN1; (-) strand; PAM type: YTN; PAM sequence: CTT
taagggaaatccagggaaat

SEQ ID NO: 193826 - DNA, 20 bp, Artificial Sequence
  Description of Artificial Sequence: Synthetic oligonucleotide
  Target: ATXN1; (-) strand; PAM type: YTN; PAM sequence: CTC
tttaagggaaatccagggaa

SEQ ID NO: 193827 - DNA, 20 bp, Artificial Sequence
  Description of Artificial Sequence: Synthetic oligonucleotide
  Target: ATXN1; (-) strand; PAM type: YTN; PAM sequence: CTC
accatcaatggtatctcttt

SEQ ID NO: 193828 - DNA, 20 bp, Artificial Sequence
  Description of Artificial Sequence: Synthetic oligonucleotide
  Target: ATXN1; (-) strand; PAM type: YTN; PAM sequence: CTC
aaacagcactcaccatcaat

SEQ ID NO: 193829 - DNA, 20 bp, Artificial Sequence
  Description of Artificial Sequence: Synthetic oligonucleotide
  Target: ATXN1; (-) strand; PAM type: YTN; PAM sequence: CTA
agctcaaacagcactcacca

SEQ ID NO: 193830 - DNA, 20 bp, Artificial Sequence
  Description of Artificial Sequence: Synthetic oligonucleotide
  Target: ATXN1; (-) strand; PAM type: YTN; PAM sequence: TTC
taagctcaaacagcactcac

SEQ ID NO: 193831 - DNA, 20 bp, Artificial Sequence
  Description of Artificial Sequence: Synthetic oligonucleotide
  Target: ATXN1; (-) strand; PAM type: YTN; PAM sequence: TTT
ctaagctcaaacagcactca

SEQ ID NO: 193832 - DNA, 20 bp, Artificial Sequence
  Description of Artificial Sequence: Synthetic oligonucleotide
  Target: ATXN1; (-) strand; PAM type: YTN; PAM sequence: TTG
tttctaagctcaaacagcac

SEQ ID NO: 193833 - DNA, 20 bp, Artificial Sequence
  Description of Artificial Sequence: Synthetic oligonucleotide
  Target: ATXN1; (-) strand; PAM type: YTN; PAM sequence: CTG
ttgtttctaagctcaaacag

SEQ ID NO: 193834 - DNA, 20 bp, Artificial Sequence
  Description of Artificial Sequence: Synthetic oligonucleotide
  Target: ATXN1; (-) strand; PAM type: YTN; PAM sequence: CTG
ctgttgtttctaagctcaaa

SEQ ID NO: 193835 - DNA, 20 bp, Artificial Sequence
  Description of Artificial Sequence: Synthetic oligonucleotide
  Target: ATXN1; (-) strand; PAM type: YTN; PAM sequence: TTG
ggaacaatgctgctgttgtt

SEQ ID NO: 193836 - DNA, 20 bp, Artificial Sequence
  Description of Artificial Sequence: Synthetic oligonucleotide
  Target: ATXN1; (-) strand; PAM type: YTN; PAM sequence: CTT
gggaacaatgctgctgttgt

SEQ ID NO: 193837 - DNA, 20 bp, Artificial Sequence
  Description of Artificial Sequence: Synthetic oligonucleotide
  Target: ATXN1; (-) strand; PAM type: YTN; PAM sequence: CTG
ggtcttgggaacaatgctgc

SEQ ID NO: 193838 - DNA, 20 bp, Artificial Sequence
  Description of Artificial Sequence: Synthetic oligonucleotide
  Target: ATXN1; (-) strand; PAM type: YTN; PAM sequence: TTC
atggtatgcaatggggctgg

SEQ ID NO: 193839 - DNA, 20 bp, Artificial Sequence
  Description of Artificial Sequence: Synthetic oligonucleotide
  Target: ATXN1; (-) strand; PAM type: YTN; PAM sequence: TTT
catggtatgcaatggggctg

SEQ ID NO: 193840 - DNA, 20 bp, Artificial Sequence
  Description of Artificial Sequence: Synthetic oligonucleotide
  Target: ATXN1; (-) strand; PAM type: YTN; PAM sequence: CTC
agtttcatggtatgcaatgg

SEQ ID NO: 193841 - DNA, 20 bp, Artificial Sequence
  Description of Artificial Sequence: Synthetic oligonucleotide
  Target: ATXN1; (-) strand; PAM type: YTN; PAM sequence: CTG
ggctcagtttcatggtatgc

SEQ ID NO: 193842 - DNA, 20 bp, Artificial Sequence
  Description of Artificial Sequence: Synthetic oligonucleotide
  Target: ATXN1; (-) strand; PAM type: YTN; PAM sequence: TTG
taaaacgtgagtccctgggc

SEQ ID NO: 193843 - DNA, 20 bp, Artificial Sequence
  Description of Artificial Sequence: Synthetic oligonucleotide
  Target: ATXN1; (-) strand; PAM type: YTN; PAM sequence: CTT
gtaaaacgtgagtccctggg

SEQ ID NO: 193844 - DNA, 20 bp, Artificial Sequence
  Description of Artificial Sequence: Synthetic oligonucleotide
  Target: ATXN1; (-) strand; PAM type: YTN; PAM sequence: CTG
gcccccacatgcatatatac

SEQ ID NO: 193845 - DNA, 20 bp, Artificial Sequence
  Description of Artificial Sequence: Synthetic oligonucleotide
  Target: ATXN1; (-) strand; PAM type: YTN; PAM sequence: CTC
agaagctggcccccacatgc

SEQ ID NO: 193846 - DNA, 20 bp, Artificial Sequence
  Description of Artificial Sequence: Synthetic oligonucleotide
  Target: ATXN1; (-) strand; PAM type: YTN; PAM sequence: CTA
aaaagaagctcagaagctgg

SEQ ID NO: 193847 - DNA, 20 bp, Artificial Sequence
  Description of Artificial Sequence: Synthetic oligonucleotide
  Target: ATXN1; (-) strand; PAM type: YTN; PAM sequence: CTC
cctaaaaagaagctcagaag

SEQ ID NO: 193848 - DNA, 20 bp, Artificial Sequence
  Description of Artificial Sequence: Synthetic oligonucleotide
  Target: ATXN1; (-) strand; PAM type: YTN; PAM sequence: TTC
tccctaaaaagaagctcaga

SEQ ID NO: 193849 - DNA, 20 bp, Artificial Sequence
  Description of Artificial Sequence: Synthetic oligonucleotide
  Target: ATXN1; (-) strand; PAM type: YTN; PAM sequence: TTT
ctccctaaaaagaagctcag

SEQ ID NO: 193850 - DNA, 20 bp, Artificial Sequence
  Description of Artificial Sequence: Synthetic oligonucleotide
  Target: ATXN1; (-) strand; PAM type: YTN; PAM sequence: TTT
tctccctaaaaagaagctca

SEQ ID NO: 193851 - DNA, 20 bp, Artificial Sequence
  Description of Artificial Sequence: Synthetic oligonucleotide
  Target: ATXN1; (-) strand; PAM type: YTN; PAM sequence: TTT
ttctccctaaaaagaagctc

SEQ ID NO: 193852 - DNA, 20 bp, Artificial Sequence
  Description of Artificial Sequence: Synthetic oligonucleotide
  Target: ATXN1; (-) strand; PAM type: YTN; PAM sequence: CTA
aacacagatagaagccatga

SEQ ID NO: 193853 - DNA, 20 bp, Artificial Sequence
  Description of Artificial Sequence: Synthetic oligonucleotide
  Target: ATXN1; (-) strand; PAM type: YTN; PAM sequence: TTA
ccaaatgagaaaaaactaaa

SEQ ID NO: 193854 - DNA, 20 bp, Artificial Sequence
  Description of Artificial Sequence: Synthetic oligonucleotide
  Target: ATXN1; (-) strand; PAM type: YTN; PAM sequence: TTT
accaaatgagaaaaaactaa

SEQ ID NO: 193855 - DNA, 20 bp, Artificial Sequence
  Description of Artificial Sequence: Synthetic oligonucleotide
  Target: ATXN1; (-) strand; PAM type: YTN; PAM sequence: TTT
taccaaatgagaaaaaacta

SEQ ID NO: 193856 - DNA, 20 bp, Artificial Sequence
  Description of Artificial Sequence: Synthetic oligonucleotide
  Target: ATXN1; (-) strand; PAM type: YTN; PAM sequence: TTA
ttttaccaaatgagaaaaaa

SEQ ID NO: 193857 - DNA, 20 bp, Artificial Sequence
  Description of Artificial Sequence: Synthetic oligonucleotide
  Target: ATXN1; (-) strand; PAM type: YTN; PAM sequence: TTT
attttaccaaatgagaaaaa

SEQ ID NO: 193858 - DNA, 20 bp, Artificial Sequence
  Description of Artificial Sequence: Synthetic oligonucleotide
  Target: ATXN1; (-) strand; PAM type: YTN; PAM sequence: TTT
tattttaccaaatgagaaaa

SEQ ID NO: 193859 - DNA, 20 bp, Artificial Sequence
  Description of Artificial Sequence: Synthetic oligonucleotide
  Target: ATXN1; (-) strand; PAM type: YTN; PAM sequence: TTT
ttattttaccaaatgagaaa

SEQ ID NO: 193860 - DNA, 20 bp, Artificial Sequence
  Description of Artificial Sequence: Synthetic oligonucleotide
  Target: ATXN1; (-) strand; PAM type: YTN; PAM sequence: TTT
tttattttaccaaatgagaa

SEQ ID NO: 193861 - DNA, 20 bp, Artificial Sequence
  Description of Artificial Sequence: Synthetic oligonucleotide
  Target: ATXN1; (-) strand; PAM type: YTN; PAM sequence: TTT
ttttattttaccaaatgaga

SEQ ID NO: 193862 - DNA, 20 bp, Artificial Sequence
  Description of Artificial Sequence: Synthetic oligonucleotide
  Target: ATXN1; (-) strand; PAM type: YTN; PAM sequence: TTA
caagccgtaatttttttatt

SEQ ID NO: 193863 - DNA, 20 bp, Artificial Sequence
  Description of Artificial Sequence: Synthetic oligonucleotide
  Target: ATXN1; (-) strand; PAM type: YTN; PAM sequence: TTA
tccaaaatattacaagccgt

SEQ ID NO: 193864 - DNA, 20 bp, Artificial Sequence
  Description of Artificial Sequence: Synthetic oligonucleotide
  Target: ATXN1; (-) strand; PAM type: YTN; PAM sequence: TTA
ttatccaaaatattacaagc

SEQ ID NO: 193865 - DNA, 20 bp, Artificial Sequence
  Description of Artificial Sequence: Synthetic oligonucleotide
  Target: ATXN1; (-) strand; PAM type: YTN; PAM sequence: TTC
aagagggcatcaaattatta

SEQ ID NO: 193866 - DNA, 20 bp, Artificial Sequence
  Description of Artificial Sequence: Synthetic oligonucleotide
  Target: ATXN1; (-) strand; PAM type: YTN; PAM sequence: TTG
acattcaagagggcatcaaa

SEQ ID NO: 193867 - DNA, 20 bp, Artificial Sequence
  Description of Artificial Sequence: Synthetic oligonucleotide
  Target: ATXN1; (-) strand; PAM type: YTN; PAM sequence: TTG
atgttgacattcaagagggc

SEQ ID NO: 193868 - DNA, 20 bp, Artificial Sequence
  Description of Artificial Sequence: Synthetic oligonucleotide
  Target: ATXN1; (-) strand; PAM type: YTN; PAM sequence: TTT
gatgttgacattcaagaggg

SEQ ID NO: 193869 - DNA, 20 bp, Artificial Sequence
  Description of Artificial Sequence: Synthetic oligonucleotide
  Target: ATXN1; (-) strand; PAM type: YTN; PAM sequence: CTT
tgatgttgacattcaagagg

SEQ ID NO: 193870 - DNA, 20 bp, Artificial Sequence
  Description of Artificial Sequence: Synthetic oligonucleotide
  Target: ATXN1; (-) strand; PAM type: YTN; PAM sequence: CTG
gggtcatgagcactttgatg

SEQ ID NO: 193871 - DNA, 20 bp, Artificial Sequence
  Description of Artificial Sequence: Synthetic oligonucleotide
  Target: ATXN1; (-) strand; PAM type: YTN; PAM sequence: TTC
tggggtcatgagcactttga

SEQ ID NO: 193872 - DNA, 20 bp, Artificial Sequence
  Description of Artificial Sequence: Synthetic oligonucleotide
  Target: ATXN1; (-) strand; PAM type: YTN; PAM sequence: CTT
ctggggtcatgagcactttg

SEQ ID NO: 193873 - DNA, 20 bp, Artificial Sequence
  Description of Artificial Sequence: Synthetic oligonucleotide
  Target: ATXN1; (-) strand; PAM type: YTN; PAM sequence: TTC
cttctggggtcatgagcact

SEQ ID NO: 193874 - DNA, 20 bp, Artificial Sequence
  Description of Artificial Sequence: Synthetic oligonucleotide
  Target: ATXN1; (-) strand; PAM type: YTN; PAM sequence: TTT
ccttctggggtcatgagcac

SEQ ID NO: 193875 - DNA, 20 bp, Artificial Sequence
  Description of Artificial Sequence: Synthetic oligonucleotide
  Target: ATXN1; (-) strand; PAM type: YTN; PAM sequence: TTG
gtttccttctggggtcatga

SEQ ID NO: 193876 - DNA, 20 bp, Artificial Sequence
  Description of Artificial Sequence: Synthetic oligonucleotide
  Target: ATXN1; (-) strand; PAM type: YTN; PAM sequence: TTT
ggtttccttctggggtcatg

SEQ ID NO: 193877 - DNA, 20 bp, Artificial Sequence
  Description of Artificial Sequence: Synthetic oligonucleotide
  Target: ATXN1; (-) strand; PAM type: YTN; PAM sequence: CTT
tggtttccttctggggtcat

SEQ ID NO: 193878 - DNA, 20 bp, Artificial Sequence
  Description of Artificial Sequence: Synthetic oligonucleotide
  Target: ATXN1; (-) strand; PAM type: YTN; PAM sequence: CTA
ctttggtttccttctggggt

SEQ ID NO: 193879 - DNA, 20 bp, Artificial Sequence
  Description of Artificial Sequence: Synthetic oligonucleotide
  Target: ATXN1; (-) strand; PAM type: YTN; PAM sequence: TTG
tggctactttggtttccttc

SEQ ID NO: 193880 - DNA, 20 bp, Artificial Sequence
  Description of Artificial Sequence: Synthetic oligonucleotide
  Target: ATXN1; (-) strand; PAM type: YTN; PAM sequence: CTT
gtggctactttggtttcctt

SEQ ID NO: 193881 - DNA, 20 bp, Artificial Sequence
  Description of Artificial Sequence: Synthetic oligonucleotide
  Target: ATXN1; (-) strand; PAM type: YTN; PAM sequence: CTG
aacccatgtagaccacttgt

SEQ ID NO: 193882 - DNA, 20 bp, Artificial Sequence
  Description of Artificial Sequence: Synthetic oligonucleotide
  Target: ATXN1; (-) strand; PAM type: YTN; PAM sequence: CTG
cctgaacccatgtagaccac

SEQ ID NO: 193883 - DNA, 20 bp, Artificial Sequence
  Description of Artificial Sequence: Synthetic oligonucleotide
  Target: ATXN1; (-) strand; PAM type: YTN; PAM sequence: CTG
aggcaagaaatggtgaagga

SEQ ID NO: 193884 - DNA, 20 bp, Artificial Sequence
  Description of Artificial Sequence: Synthetic oligonucleotide
  Target: ATXN1; (-) strand; PAM type: YTN; PAM sequence: CTG
gtagagaagggtctgaggca

SEQ ID NO: 193885 - DNA, 20 bp, Artificial Sequence
  Description of Artificial Sequence: Synthetic oligonucleotide
  Target: ATXN1; (-) strand; PAM type: YTN; PAM sequence: TTG
ggtaaagaataaactggtag

SEQ ID NO: 193886 - DNA, 20 bp, Artificial Sequence
  Description of Artificial Sequence: Synthetic oligonucleotide
  Target: ATXN1; (-) strand; PAM type: YTN; PAM sequence: TTT
gggtaaagaataaactggta

SEQ ID NO: 193887 - DNA, 20 bp, Artificial Sequence
  Description of Artificial Sequence: Synthetic oligonucleotide
  Target: ATXN1; (-) strand; PAM type: YTN; PAM sequence: CTT
tgggtaaagaataaactggt

SEQ ID NO: 193888 - DNA, 20 bp, Artificial Sequence
  Description of Artificial Sequence: Synthetic oligonucleotide
  Target: ATXN1; (-) strand; PAM type: YTN; PAM sequence: TTC
tttgggtaaagaataaactg

SEQ ID NO: 193889 - DNA, 20 bp, Artificial Sequence
  Description of Artificial Sequence: Synthetic oligonucleotide
  Target: ATXN1; (-) strand; PAM type: YTN; PAM sequence: TTA
catcataggattctttgggt

SEQ ID NO: 193890 - DNA, 20 bp, Artificial Sequence
  Description of Artificial Sequence: Synthetic oligonucleotide
  Target: ATXN1; (-) strand; PAM type: YTN; PAM sequence: CTT
acatcataggattctttggg

SEQ ID NO: 193891 - DNA, 20 bp, Artificial Sequence
  Description of Artificial Sequence: Synthetic oligonucleotide
  Target: ATXN1; (-) strand; PAM type: YTN; PAM sequence: TTC
catgcttacatcataggatt

SEQ ID NO: 193892 - DNA, 20 bp, Artificial Sequence
  Description of Artificial Sequence: Synthetic oligonucleotide
  Target: ATXN1; (-) strand; PAM type: YTN; PAM sequence: TTT
ccatgcttacatcataggat

SEQ ID NO: 193893 - DNA, 20 bp, Artificial Sequence
  Description of Artificial Sequence: Synthetic oligonucleotide
  Target: ATXN1; (-) strand; PAM type: YTN; PAM sequence: TTG
agaaagtgaagaaatgtcca

SEQ ID NO: 193894 - DNA, 20 bp, Artificial Sequence
  Description of Artificial Sequence: Synthetic oligonucleotide
  Target: ATXN1; (-) strand; PAM type: YTN; PAM sequence: CTT
gagaaagtgaagaaatgtcc

SEQ ID NO: 193895 - DNA, 20 bp, Artificial Sequence
  Description of Artificial Sequence: Synthetic oligonucleotide
  Target: ATXN1; (-) strand; PAM type: YTN; PAM sequence: TTA
agggccttgagaaagtgaag

SEQ ID NO: 193896 - DNA, 20 bp, Artificial Sequence
  Description of Artificial Sequence: Synthetic oligonucleotide
  Target: ATXN1; (-) strand; PAM type: YTN; PAM sequence: CTA
aaagaagggggcaattaagg

SEQ ID NO: 193897 - DNA, 20 bp, Artificial Sequence
  Description of Artificial Sequence: Synthetic oligonucleotide
  Target: ATXN1; (-) strand; PAM type: YTN; PAM sequence: TTA
gactaaaagaagggggcaat

SEQ ID NO: 193898 - DNA, 20 bp, Artificial Sequence
  Description of Artificial Sequence: Synthetic oligonucleotide
  Target: ATXN1; (-) strand; PAM type: YTN; PAM sequence: TTA
attagactaaaagaaggggg

SEQ ID NO: 193899 - DNA, 20 bp, Artificial Sequence
  Description of Artificial Sequence: Synthetic oligonucleotide
  Target: ATXN1; (-) strand; PAM type: YTN; PAM sequence: TTA
gagtcaagagattaattaga

SEQ ID NO: 193900 - DNA, 20 bp, Artificial Sequence
  Description of Artificial Sequence: Synthetic oligonucleotide
  Target: ATXN1; (-) strand; PAM type: YTN; PAM sequence: TTT
agagtcaagagattaattag

SEQ ID NO: 193901 - DNA, 20 bp, Artificial Sequence
  Description of Artificial Sequence: Synthetic oligonucleotide
  Target: ATXN1; (-) strand; PAM type: YTN; PAM sequence: CTT
tagagtcaagagattaatta

SEQ ID NO: 193902 - DNA, 20 bp, Artificial Sequence
  Description of Artificial Sequence: Synthetic oligonucleotide
  Target: ATXN1; (-) strand; PAM type: YTN; PAM sequence: CTC
tttagagtcaagagattaat

SEQ ID NO: 193903 - DNA, 20 bp, Artificial Sequence
  Description of Artificial Sequence: Synthetic oligonucleotide
  Target: ATXN1; (-) strand; PAM type: YTN; PAM sequence: CTG
taaaggtctctttagagtca

SEQ ID NO: 193904 - DNA, 20 bp, Artificial Sequence
  Description of Artificial Sequence: Synthetic oligonucleotide
  Target: ATXN1; (-) strand; PAM type: YTN; PAM sequence: CTG
gggactgtaaaggtctcttt

SEQ ID NO: 193905 - DNA, 20 bp, Artificial Sequence
  Description of Artificial Sequence: Synthetic oligonucleotide
  Target: ATXN1; (-) strand; PAM type: YTN; PAM sequence: CTC
tggggactgtaaaggtctct

SEQ ID NO: 193906 - DNA, 20 bp, Artificial Sequence
  Description of Artificial Sequence: Synthetic oligonucleotide
  Target: ATXN1; (-) strand; PAM type: YTN; PAM sequence: CTC
tctggggactgtaaaggtct

SEQ ID NO: 193907 - DNA, 20 bp, Artificial Sequence
  Description of Artificial Sequence: Synthetic oligonucleotide
  Target: ATXN1; (-) strand; PAM type: YTN; PAM sequence: TTG
ctctctggggactgtaaagg

SEQ ID NO: 193908 - DNA, 20 bp, Artificial Sequence
  Description of Artificial Sequence: Synthetic oligonucleotide
  Target: ATXN1; (-) strand; PAM type: YTN; PAM sequence: CTG
ttgctctctggggactgtaa

SEQ ID NO: 193909 - DNA, 20 bp, Artificial Sequence
  Description of Artificial Sequence: Synthetic oligonucleotide
  Target: ATXN1; (-) strand; PAM type: YTN; PAM sequence: CTG
acacctgttgctctctgggg

SEQ ID NO: 193910 - DNA, 20 bp, Artificial Sequence
  Description of Artificial Sequence: Synthetic oligonucleotide
  Target: ATXN1; (-) strand; PAM type: YTN; PAM sequence: CTC
agagcacaccacagtacaat

SEQ ID NO: 193911 - DNA, 20 bp, Artificial Sequence
  Description of Artificial Sequence: Synthetic oligonucleotide
  Target: ATXN1; (-) strand; PAM type: YTN; PAM sequence: TTC
tcagagcacaccacagtaca

SEQ ID NO: 193912 - DNA, 20 bp, Artificial Sequence
  Description of Artificial Sequence: Synthetic oligonucleotide
  Target: ATXN1; (-) strand; PAM type: YTN; PAM sequence: TTA
ttctcagagcacaccacagt

SEQ ID NO: 193913 - DNA, 20 bp, Artificial Sequence
  Description of Artificial Sequence: Synthetic oligonucleotide
  Target: ATXN1; (-) strand; PAM type: YTN; PAM sequence: TTT
attctcagagcacaccacag

SEQ ID NO: 193914 - DNA, 20 bp, Artificial Sequence
  Description of Artificial Sequence: Synthetic oligonucleotide
  Target: ATXN1; (-) strand; PAM type: YTN; PAM sequence: CTG
agaaaagcccaaaaagttta

SEQ ID NO: 193915 - DNA, 20 bp, Artificial Sequence
  Description of Artificial Sequence: Synthetic oligonucleotide
  Target: ATXN1; (-) strand; PAM type: YTN; PAM sequence: TTA
tctgagaaaagcccaaaaag

SEQ ID NO: 193916 - DNA, 20 bp, Artificial Sequence
  Description of Artificial Sequence: Synthetic oligonucleotide
  Target: ATXN1; (-) strand; PAM type: YTN; PAM sequence: CTT
atctgagaaaagcccaaaaa

SEQ ID NO: 193917 - DNA, 20 bp, Artificial Sequence
  Description of Artificial Sequence: Synthetic oligonucleotide
  Target: ATXN1; (-) strand; PAM type: YTN; PAM sequence: CTG
tcttatctgagaaaagccca

SEQ ID NO: 193918 - DNA, 20 bp, Artificial Sequence
  Description of Artificial Sequence: Synthetic oligonucleotide
  Target: ATXN1; (-) strand; PAM type: YTN; PAM sequence: TTC
ctgtcttatctgagaaaagc

SEQ ID NO: 193919 - DNA, 20 bp, Artificial Sequence
  Description of Artificial Sequence: Synthetic oligonucleotide
  Target: ATXN1; (-) strand; PAM type: YTN; PAM sequence: TTT
cctgtcttatctgagaaaag

SEQ ID NO: 193920 - DNA, 20 bp, Artificial Sequence
  Description of Artificial Sequence: Synthetic oligonucleotide
  Target: ATXN1; (-) strand; PAM type: YTN; PAM sequence: TTT
tcctgtcttatctgagaaaa

SEQ ID NO: 193921 - DNA, 20 bp, Artificial Sequence
  Description of Artificial Sequence: Synthetic oligonucleotide
  Target: ATXN1; (-) strand; PAM type: YTN; PAM sequence: TTC
cattttcctgtcttatctga

SEQ ID NO: 193922 - DNA, 20 bp, Artificial Sequence
  Description of Artificial Sequence: Synthetic oligonucleotide
  Target: ATXN1; (-) strand; PAM type: YTN; PAM sequence: TTT
ccattttcctgtcttatctg

SEQ ID NO: 193923 - DNA, 20 bp, Artificial Sequence
  Description of Artificial Sequence: Synthetic oligonucleotide
  Target: ATXN1; (-) strand; PAM type: YTN; PAM sequence: CTG
tgaaggtttccattttcctg

SEQ ID NO: 193924 - DNA, 20 bp, Artificial Sequence
  Description of Artificial Sequence: Synthetic oligonucleotide
  Target: ATXN1; (-) strand; PAM type: YTN; PAM sequence: TTA
gaactgtgaaggtttccatt

SEQ ID NO: 193925 - DNA, 20 bp, Artificial Sequence
  Description of Artificial Sequence: Synthetic oligonucleotide
  Target: ATXN1; (-) strand; PAM type: YTN; PAM sequence: TTC
attagaactgtgaaggtttc

SEQ ID NO: 193926 - DNA, 20 bp, Artificial Sequence
  Description of Artificial Sequence: Synthetic oligonucleotide
  Target: ATXN1; (-) strand; PAM type: YTN; PAM sequence: TTA
gcattcattagaactgtgaa

SEQ ID NO: 193927 - DNA, 20 bp, Artificial Sequence
  Description of Artificial Sequence: Synthetic oligonucleotide
  Target: ATXN1; (-) strand; PAM type: YTN; PAM sequence: CTA
cacgagttagcattcattag

SEQ ID NO: 193928 - DNA, 20 bp, Artificial Sequence
  Description of Artificial Sequence: Synthetic oligonucleotide
  Target: ATXN1; (-) strand; PAM type: YTN; PAM sequence: CTG
ggtctacacgagttagcatt

SEQ ID NO: 193929 - DNA, 20 bp, Artificial Sequence
  Description of Artificial Sequence: Synthetic oligonucleotide
  Target: ATXN1; (-) strand; PAM type: YTN; PAM sequence: CTG
tccacagagctgggtctaca

SEQ ID NO: 193930 - DNA, 20 bp, Artificial Sequence
  Description of Artificial Sequence: Synthetic oligonucleotide
  Target: ATXN1; (-) strand; PAM type: YTN; PAM sequence: CTC
ctgtccacagagctgggtct

SEQ ID NO: 193931 - DNA, 20 bp, Artificial Sequence
  Description of Artificial Sequence: Synthetic oligonucleotide
  Target: ATXN1; (-) strand; PAM type: YTN; PAM sequence: TTG
atcgctcctgtccacagagc

SEQ ID NO: 193932 - DNA, 20 bp, Artificial Sequence
  Description of Artificial Sequence: Synthetic oligonucleotide
  Target: ATXN1; (-) strand; PAM type: YTN; PAM sequence: CTA
acattgatcgctcctgtcca

SEQ ID NO: 193933 - DNA, 20 bp, Artificial Sequence
  Description of Artificial Sequence: Synthetic oligonucleotide
  Target: ATXN1; (-) strand; PAM type: YTN; PAM sequence: TTA
ccctaacattgatcgctcct

SEQ ID NO: 193934 - DNA, 20 bp, Artificial Sequence
  Description of Artificial Sequence: Synthetic oligonucleotide
  Target: ATXN1; (-) strand; PAM type: YTN; PAM sequence: CTG
agttaccctaacattgatcg

SEQ ID NO: 193935 - DNA, 20 bp, Artificial Sequence
  Description of Artificial Sequence: Synthetic oligonucleotide
  Target: ATXN1; (-) strand; PAM type: YTN; PAM sequence: CTG
ctgagttaccctaacattga

SEQ ID NO: 193936 - DNA, 20 bp, Artificial Sequence
  Description of Artificial Sequence: Synthetic oligonucleotide
  Target: ATXN1; (-) strand; PAM type: YTN; PAM sequence: TTG
tgagggatcatctgctgagt

SEQ ID NO: 193937 - DNA, 20 bp, Artificial Sequence
  Description of Artificial Sequence: Synthetic oligonucleotide
  Target: ATXN1; (-) strand; PAM type: YTN; PAM sequence: TTT
gtgagggatcatctgctgag

SEQ ID NO: 193938 - DNA, 20 bp, Artificial Sequence
  Description of Artificial Sequence: Synthetic oligonucleotide
  Target: ATXN1; (-) strand; PAM type: YTN; PAM sequence: CTG
atttgtgagggatcatctgc

SEQ ID NO: 193939 - DNA, 20 bp, Artificial Sequence
  Description of Artificial Sequence: Synthetic oligonucleotide
  Target: ATXN1; (-) strand; PAM type: YTN; PAM sequence: TTG
ctgatttgtgagggatcatc

SEQ ID NO: 193940 - DNA, 20 bp, Artificial Sequence
  Description of Artificial Sequence: Synthetic oligonucleotide
  Target: ATXN1; (-) strand; PAM type: YTN; PAM sequence: CTG
aatggaatgtagaacataga

SEQ ID NO: 193941 - DNA, 20 bp, Artificial Sequence
  Description of Artificial Sequence: Synthetic oligonucleotide
  Target: ATXN1; (-) strand; PAM type: YTN; PAM sequence: CTA
ccaacatactgaatggaatg

SEQ ID NO: 193942 - DNA, 20 bp, Artificial Sequence
  Description of Artificial Sequence: Synthetic oligonucleotide
  Target: ATXN1; (-) strand; PAM type: YTN; PAM sequence: TTG
gtgtctaccaacatactgaa

SEQ ID NO: 193943 - DNA, 20 bp, Artificial Sequence
  Description of Artificial Sequence: Synthetic oligonucleotide
  Target: ATXN1; (-) strand; PAM type: YTN; PAM sequence: TTA
tgtacatacagacgtaattg

SEQ ID NO: 193944 - DNA, 20 bp, Artificial Sequence
  Description of Artificial Sequence: Synthetic oligonucleotide
  Target: ATXN1; (-) strand; PAM type: YTN; PAM sequence: CTT
atgtacatacagacgtaatt

SEQ ID NO: 193945 - DNA, 20 bp, Artificial Sequence
  Description of Artificial Sequence: Synthetic oligonucleotide
  Target: ATXN1; (-) strand; PAM type: YTN; PAM sequence: CTC
cttatgtacatacagacgta

SEQ ID NO: 193946 - DNA, 20 bp, Artificial Sequence
  Description of Artificial Sequence: Synthetic oligonucleotide
  Target: ATXN1; (-) strand; PAM type: YTN; PAM sequence: TTG
atcatctccttatgtacata

SEQ ID NO: 193947 - DNA, 20 bp, Artificial Sequence
  Description of Artificial Sequence: Synthetic oligonucleotide
  Target: ATXN1; (-) strand; PAM type: YTN; PAM sequence: CTT
gatcatctccttatgtacat

SEQ ID NO: 193948 - DNA, 20 bp, Artificial Sequence
  Description of Artificial Sequence: Synthetic oligonucleotide
  Target: ATXN1; (-) strand; PAM type: YTN; PAM sequence: TTG
cggaacttgatcatctcctt

SEQ ID NO: 193949 - DNA, 20 bp, Artificial Sequence
  Description of Artificial Sequence: Synthetic oligonucleotide
  Target: ATXN1; (-) strand; PAM type: YTN; PAM sequence: TTA
ttgcggaacttgatcatctc

SEQ ID NO: 193950 - DNA, 20 bp, Artificial Sequence
  Description of Artificial Sequence: Synthetic oligonucleotide
  Target: ATXN1; (-) strand; PAM type: YTN; PAM sequence: CTA
gagtcattattgcggaactt

SEQ ID NO: 193951 - DNA, 20 bp, Artificial Sequence
  Description of Artificial Sequence: Synthetic oligonucleotide
  Target: ATXN1; (-) strand; PAM type: YTN; PAM sequence: CTA
actagagtcattattgcgga

SEQ ID NO: 193952 - DNA, 20 bp, Artificial Sequence
  Description of Artificial Sequence: Synthetic oligonucleotide
  Target: ATXN1; (-) strand; PAM type: YTN; PAM sequence: TTC
cctaactagagtcattattg

SEQ ID NO: 193953 - DNA, 20 bp, Artificial Sequence
  Description of Artificial Sequence: Synthetic oligonucleotide
  Target: ATXN1; (-) strand; PAM type: YTN; PAM sequence: CTT
ccctaactagagtcattatt

SEQ ID NO: 193954 - DNA, 20 bp, Artificial Sequence
  Description of Artificial Sequence: Synthetic oligonucleotide
  Target: ATXN1; (-) strand; PAM type: YTN; PAM sequence: TTC
ttccctaactagagtcatta

SEQ ID NO: 193955 - DNA, 20 bp, Artificial Sequence
  Description of Artificial Sequence: Synthetic oligonucleotide
  Target: ATXN1; (-) strand; PAM type: YTN; PAM sequence: CTT
cttccctaactagagtcatt

SEQ ID NO: 193956 - DNA, 20 bp, Artificial Sequence
  Description of Artificial Sequence: Synthetic oligonucleotide
  Target: ATXN1; (-) strand; PAM type: YTN; PAM sequence: TTG
tcttcttccctaactagagt

SEQ ID NO: 193957 - DNA, 20 bp, Artificial Sequence
  Description of Artificial Sequence: Synthetic oligonucleotide
  Target: ATXN1; (-) strand; PAM type: YTN; PAM sequence: TTT
gtcttcttccctaactagag

SEQ ID NO: 193958 - DNA, 20 bp, Artificial Sequence
  Description of Artificial Sequence: Synthetic oligonucleotide
  Target: ATXN1; (-) strand; PAM type: YTN; PAM sequence: CTT
tgtcttcttccctaactaga

SEQ ID NO: 193959 - DNA, 20 bp, Artificial Sequence
  Description of Artificial Sequence: Synthetic oligonucleotide
  Target: ATXN1; (-) strand; PAM type: YTN; PAM sequence: TTA
atcactttgtcttcttccct

SEQ ID NO: 193960 - DNA, 20 bp, Artificial Sequence
  Description of Artificial Sequence: Synthetic oligonucleotide
  Target: ATXN1; (-) strand; PAM type: YTN; PAM sequence: CTT
aatcactttgtcttcttccc

SEQ ID NO: 193961 - DNA, 20 bp, Artificial Sequence
  Description of Artificial Sequence: Synthetic oligonucleotide
  Target: ATXN1; (-) strand; PAM type: YTN; PAM sequence: TTG
tcagcttaatcactttgtct

SEQ ID NO: 193962 - DNA, 20 bp, Artificial Sequence
  Description of Artificial Sequence: Synthetic oligonucleotide
  Target: ATXN1; (-) strand; PAM type: YTN; PAM sequence: CTT
gtcagcttaatcactttgtc

SEQ ID NO: 193963 - DNA, 20 bp, Artificial Sequence
  Description of Artificial Sequence: Synthetic oligonucleotide
  Target: ATXN1; (-) strand; PAM type: YTN; PAM sequence: TTA
tccaacttgtcagcttaatc

SEQ ID NO: 193964 - DNA, 20 bp, Artificial Sequence
  Description of Artificial Sequence: Synthetic oligonucleotide
  Target: ATXN1; (-) strand; PAM type: YTN; PAM sequence: TTT
atccaacttgtcagcttaat

SEQ ID NO: 193965 - DNA, 20 bp, Artificial Sequence
  Description of Artificial Sequence: Synthetic oligonucleotide
  Target: ATXN1; (-) strand; PAM type: YTN; PAM sequence: TTT
tatccaacttgtcagcttaa

SEQ ID NO: 193966 - DNA, 20 bp, Artificial Sequence
  Description of Artificial Sequence: Synthetic oligonucleotide
  Target: ATXN1; (-) strand; PAM type: YTN; PAM sequence: TTA
ttttatccaacttgtcagct

SEQ ID NO: 193967 - DNA, 20 bp, Artificial Sequence
  Description of Artificial Sequence: Synthetic oligonucleotide
  Target: ATXN1; (-) strand; PAM type: YTN; PAM sequence: TTA
ttattttatccaacttgtca

SEQ ID NO: 193968 - DNA, 20 bp, Artificial Sequence
  Description of Artificial Sequence: Synthetic oligonucleotide
  Target: ATXN1; (-) strand; PAM type: YTN; PAM sequence: TTT
attattttatccaacttgtc

SEQ ID NO: 193969 - DNA, 20 bp, Artificial Sequence
  Description of Artificial Sequence: Synthetic oligonucleotide
  Target: ATXN1; (-) strand; PAM type: YTN; PAM sequence: TTG
tgtttattattttatccaac

SEQ ID NO: 193970 - DNA, 20 bp, Artificial Sequence
  Description of Artificial Sequence: Synthetic oligonucleotide
  Target: ATXN1; (-) strand; PAM type: YTN; PAM sequence: CTT
gtgtttattattttatccaa

SEQ ID NO: 193971 - DNA, 20 bp, Artificial Sequence
  Description of Artificial Sequence: Synthetic oligonucleotide
  Target: ATXN1; (-) strand; PAM type: YTN; PAM sequence: TTA
agagcttgtgtttattattt

SEQ ID NO: 193972 - DNA, 20 bp, Artificial Sequence
  Description of Artificial Sequence: Synthetic oligonucleotide
  Target: ATXN1; (-) strand; PAM type: YTN; PAM sequence: CTA
gggagtggtcaaagggtagt

SEQ ID NO: 193973 - DNA, 20 bp, Artificial Sequence
  Description of Artificial Sequence: Synthetic oligonucleotide
  Target: ATXN1; (-) strand; PAM type: YTN; PAM sequence: CTC
acctagggagtggtcaaagg

SEQ ID NO: 193974 - DNA, 20 bp, Artificial Sequence
  Description of Artificial Sequence: Synthetic oligonucleotide
  Target: ATXN1; (-) strand; PAM type: YTN; PAM sequence: TTC
atctcacctagggagtggtc

SEQ ID NO: 193975 - DNA, 20 bp, Artificial Sequence
  Description of Artificial Sequence: Synthetic oligonucleotide
  Target: ATXN1; (-) strand; PAM type: YTN; PAM sequence: TTT
catctcacctagggagtggt

SEQ ID NO: 193976 - DNA, 20 bp, Artificial Sequence
  Description of Artificial Sequence: Synthetic oligonucleotide
  Target: ATXN1; (-) strand; PAM type: YTN; PAM sequence: TTC
caaaacatttcatctcacct

SEQ ID NO: 193977 - DNA, 20 bp, Artificial Sequence
  Description of Artificial Sequence: Synthetic oligonucleotide
  Target: ATXN1; (-) strand; PAM type: YTN; PAM sequence: TTT
ccaaaacatttcatctcacc

SEQ ID NO: 193978 - DNA, 20 bp, Artificial Sequence
  Description of Artificial Sequence: Synthetic oligonucleotide
  Target: ATXN1; (-) strand; PAM type: YTN; PAM sequence: TTA
tttccaaaacatttcatctc

SEQ ID NO: 193979 - DNA, 20 bp, Artificial Sequence
  Description of Artificial Sequence: Synthetic oligonucleotide
  Target: ATXN1; (-) strand; PAM type: YTN; PAM sequence: CTT
atttccaaaacatttcatct

SEQ ID NO: 193980 - DNA, 20 bp, Artificial Sequence
  Description of Artificial Sequence: Synthetic oligonucleotide
  Target: ATXN1; (-) strand; PAM type: YTN; PAM sequence: CTA
agtgcacttatttccaaaac

SEQ ID NO: 193981 - DNA, 20 bp, Artificial Sequence
  Description of Artificial Sequence: Synthetic oligonucleotide
  Target: ATXN1; (-) strand; PAM type: YTN; PAM sequence: TTG
gtgaactaagtgcacttatt

SEQ ID NO: 193982 - DNA, 20 bp, Artificial Sequence
  Description of Artificial Sequence: Synthetic oligonucleotide
  Target: ATXN1; (-) strand; PAM type: YTN; PAM sequence: TTA
ggttggtgaactaagtgcac

SEQ ID NO: 193983 - DNA, 20 bp, Artificial Sequence
  Description of Artificial Sequence: Synthetic oligonucleotide
  Target: ATXN1; (-) strand; PAM type: YTN; PAM sequence: TTT
aggttggtgaactaagtgca

SEQ ID NO: 193984 - DNA, 20 bp, Artificial Sequence
  Description of Artificial Sequence: Synthetic oligonucleotide
  Target: ATXN1; (-) strand; PAM type: YTN; PAM sequence: TTC
atttaggttggtgaactaag

SEQ ID NO: 193985 - DNA, 20 bp, Artificial Sequence
  Description of Artificial Sequence: Synthetic oligonucleotide
  Target: ATXN1; (-) strand; PAM type: YTN; PAM sequence: TTG
tgttcatttaggttggtgaa

SEQ ID NO: 193986 - DNA, 20 bp, Artificial Sequence
  Description of Artificial Sequence: Synthetic oligonucleotide
  Target: ATXN1; (-) strand; PAM type: YTN; PAM sequence: TTC
aaattgtgttcatttaggtt

SEQ ID NO: 193987 - DNA, 20 bp, Artificial Sequence
  Description of Artificial Sequence: Synthetic oligonucleotide
  Target: ATXN1; (-) strand; PAM type: YTN; PAM sequence: CTT
caaattgtgttcatttaggt

SEQ ID NO: 193988 - DNA, 20 bp, Artificial Sequence
  Description of Artificial Sequence: Synthetic oligonucleotide
  Target: ATXN1; (-) strand; PAM type: YTN; PAM sequence: CTG
gcttcaaattgtgttcattt

SEQ ID NO: 193989 - DNA, 20 bp, Artificial Sequence
  Description of Artificial Sequence: Synthetic oligonucleotide
  Target: ATXN1; (-) strand; PAM type: YTN; PAM sequence: TTA
aatctggcttcaaattgtgt

SEQ ID NO: 193990 - DNA, 20 bp, Artificial Sequence
  Description of Artificial Sequence: Synthetic oligonucleotide
  Target: ATXN1; (-) strand; PAM type: YTN; PAM sequence: CTA
ggttaaatctggcttcaaat

SEQ ID NO: 193991 - DNA, 20 bp, Artificial Sequence
  Description of Artificial Sequence: Synthetic oligonucleotide
  Target: ATXN1; (-) strand; PAM type: YTN; PAM sequence: TTA
gacatcctaggttaaatctg

SEQ ID NO: 193992 - DNA, 20 bp, Artificial Sequence
  Description of Artificial Sequence: Synthetic oligonucleotide
  Target: ATXN1; (-) strand; PAM type: YTN; PAM sequence: TTT
agacatcctaggttaaatct

SEQ ID NO: 193993 - DNA, 20 bp, Artificial Sequence
  Description of Artificial Sequence: Synthetic oligonucleotide
  Target: ATXN1; (-) strand; PAM type: YTN; PAM sequence: TTT
tagacatcctaggttaaatc

SEQ ID NO: 193994 - DNA, 20 bp, Artificial Sequence
  Description of Artificial Sequence: Synthetic oligonucleotide
  Target: ATXN1; (-) strand; PAM type: YTN; PAM sequence: TTT
ttagacatcctaggttaaat

SEQ ID NO: 193995 - DNA, 20 bp, Artificial Sequence
  Description of Artificial Sequence: Synthetic oligonucleotide
  Target: ATXN1; (-) strand; PAM type: YTN; PAM sequence: TTT
tttagacatcctaggttaaa

SEQ ID NO: 193996 - DNA, 20 bp, Artificial Sequence
  Description of Artificial Sequence: Synthetic oligonucleotide
  Target: ATXN1; (-) strand; PAM type: YTN; PAM sequence: TTT
ttttagacatcctaggttaa

SEQ ID NO: 193997 - DNA, 20 bp, Artificial Sequence
  Description of Artificial Sequence: Synthetic oligonucleotide
  Target: ATXN1; (-) strand; PAM type: YTN; PAM sequence: TTG
tttttttagacatcctaggt

SEQ ID NO: 193998 - DNA, 20 bp, Artificial Sequence
  Description of Artificial Sequence: Synthetic oligonucleotide
  Target: ATXN1; (-) strand; PAM type: YTN; PAM sequence: TTT
gtttttttagacatcctagg

SEQ ID NO: 193999 - DNA, 20 bp, Artificial Sequence
  Description of Artificial Sequence: Synthetic oligonucleotide
  Target: ATXN1; (-) strand; PAM type: YTN; PAM sequence: TTG
tttgtttttttagacatcct

SEQ ID NO: 194000 - DNA, 20 bp, Artificial Sequence
  Description of Artificial Sequence: Synthetic oligonucleotide
  Target: ATXN1; (-) strand; PAM type: YTN; PAM sequence: TTT
gtttgtttttttagacatcc

SEQ ID NO: 194001 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttttttagaca

SEQ ID NO: 194002 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttttttagac

SEQ ID NO: 194003 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgttttttta

SEQ ID NO: 194004 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgttttttt

SEQ ID NO: 194005 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgtttt

SEQ ID NO: 194006 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 194007 - DNA, 20 bp, Artificial Sequence
  Description of Artificial Sequence: Synthetic oligonucleotide
  Target: ATXN1; (-) strand; PAM type: YTN; PAM sequence: CTG
tgtgtgtggtttgtttgttt

SEQ ID NO: 194008 - DNA, 20 bp, Artificial Sequence
  Description of Artificial Sequence: Synthetic oligonucleotide
  Target: ATXN1; (-) strand; PAM type: YTN; PAM sequence: TTG
actgtgtgtgtggtttgttt

SEQ ID NO: 194009 - DNA, 20 bp, Artificial Sequence
  Description of Artificial Sequence: Synthetic oligonucleotide
  Target: ATXN1; (-) strand; PAM type: YTN; PAM sequence: CTT
gactgtgtgtgtggtttgtt

SEQ ID NO: 194010 - DNA, 20 bp, Artificial Sequence
  Description of Artificial Sequence: Synthetic oligonucleotide
  Target: ATXN1; (-) strand; PAM type: YTN; PAM sequence: TTA
gaatcccagaaggtaaactt

SEQ ID NO: 194011 - DNA, 20 bp, Artificial Sequence
  Description of Artificial Sequence: Synthetic oligonucleotide
  Target: ATXN1; (-) strand; PAM type: YTN; PAM sequence: CTC
agttagaatcccagaaggta

SEQ ID NO: 194012 - DNA, 20 bp, Artificial Sequence
  Description of Artificial Sequence: Synthetic oligonucleotide
  Target: ATXN1; (-) strand; PAM type: YTN; PAM sequence: TTC
tcagttagaatcccagaagg

SEQ ID NO: 194013 - DNA, 20 bp, Artificial Sequence
  Description of Artificial Sequence: Synthetic oligonucleotide
  Target: ATXN1; (-) strand; PAM type: YTN; PAM sequence: TTA
agaatatgattctcagttag

SEQ ID NO: 194014 - DNA, 20 bp, Artificial Sequence
  Description of Artificial Sequence: Synthetic oligonucleotide
  Target: ATXN1; (-) strand; PAM type: YTN; PAM sequence: TTG
tgcaataagatggagagaag

SEQ ID NO: 194015 - DNA, 20 bp, Artificial Sequence
  Description of Artificial Sequence: Synthetic oligonucleotide
  Target: ATXN1; (-) strand; PAM type: YTN; PAM sequence: TTA
cataagagtgcagttgtgca

SEQ ID NO: 194016 - DNA, 20 bp, Artificial Sequence
  Description of Artificial Sequence: Synthetic oligonucleotide
  Target: ATXN1; (-) strand; PAM type: YTN; PAM sequence: TTT
acataagagtgcagttgtgc

SEQ ID NO: 194017 - DNA, 20 bp, Artificial Sequence
  Description of Artificial Sequence: Synthetic oligonucleotide
  Target: ATXN1; (-) strand; PAM type: YTN; PAM sequence: TTT
tacataagagtgcagttgtg

SEQ ID NO: 194018 - DNA, 20 bp, Artificial Sequence
  Description of Artificial Sequence: Synthetic oligonucleotide
  Target: ATXN1; (-) strand; PAM type: YTN; PAM sequence: TTT
ttacataagagtgcagttgt

SEQ ID NO: 194019 - DNA, 20 bp, Artificial Sequence
  Description of Artificial Sequence: Synthetic oligonucleotide
  Target: ATXN1; (-) strand; PAM type: YTN; PAM sequence: TTG
gtttttacataagagtgcag

SEQ ID NO: 194020 - DNA, 20 bp, Artificial Sequence
  Description of Artificial Sequence: Synthetic oligonucleotide
  Target: ATXN1; (-) strand; PAM type: YTN; PAM sequence: TTA
tgttggtttttacataagag

SEQ ID NO: 194021 - DNA, 20 bp, Artificial Sequence
  Description of Artificial Sequence: Synthetic oligonucleotide
  Target: ATXN1; (-) strand; PAM type: YTN; PAM sequence: TTA
aagttatgttggtttttaca

SEQ ID NO: 194022 - DNA, 20 bp, Artificial Sequence
  Description of Artificial Sequence: Synthetic oligonucleotide
  Target: ATXN1; (-) strand; PAM type: YTN; PAM sequence: TTT
aaagttatgttggtttttac

SEQ ID NO: 194023 - DNA, 20 bp, Artificial Sequence
  Description of Artificial Sequence: Synthetic oligonucleotide
  Target: ATXN1; (-) strand; PAM type: YTN; PAM sequence: TTT
taaagttatgttggttttta

SEQ ID NO: 194024 - DNA, 20 bp, Artificial Sequence
  Description of Artificial Sequence: Synthetic oligonucleotide
  Target: ATXN1; (-) strand; PAM type: YTN; PAM sequence: TTT
ttaaagttatgttggttttt

SEQ ID NO: 194025 - DNA, 20 bp, Artificial Sequence
  Description of Artificial Sequence: Synthetic oligonucleotide
  Target: ATXN1; (-) strand; PAM type: YTN; PAM sequence: TTT
tttaaagttatgttggtttt

SEQ ID NO: 194026 - DNA, 20 bp, Artificial Sequence
  Description of Artificial Sequence: Synthetic oligonucleotide
  Target: ATXN1; (-) strand; PAM type: YTN; PAM sequence: TTT
ttttaaagttatgttggttt

SEQ ID NO: 194027 - DNA, 20 bp, Artificial Sequence
  Description of Artificial Sequence: Synthetic oligonucleotide
  Target: ATXN1; (-) strand; PAM type: YTN; PAM sequence: TTT
tttttaaagttatgttggtt

SEQ ID NO: 194028 - DNA, 20 bp, Artificial Sequence
  Description of Artificial Sequence: Synthetic oligonucleotide
  Target: ATXN1; (-) strand; PAM type: YTN; PAM sequence: TTC
gttttttttaaagttatgtt

SEQ ID NO: 194029 - DNA, 20 bp, Artificial Sequence
  Description of Artificial Sequence: Synthetic oligonucleotide
  Target: ATXN1; (-) strand; PAM type: YTN; PAM sequence: TTA
ttcgttttttttaaagttat

SEQ ID NO: 194030 - DNA, 20 bp, Artificial Sequence
  Description of Artificial Sequence: Synthetic oligonucleotide
  Target: ATXN1; (-) strand; PAM type: YTN; PAM sequence: TTT
attcgttttttttaaagtta

SEQ ID NO: 194031 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcgcc

SEQ ID NO: 194032 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 194033 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 194034 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 194035 - DNA, 20 bp, Artificial Sequence
  Description of Artificial Sequence: Synthetic oligonucleotide
  Target: ATXN1; (-) strand; PAM type: YTN; PAM sequence: CTC
gtgatccgcctcggcctccc

SEQ ID NO: 194036 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatccgcctcggc

SEQ ID NO: 194037 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatccgcctc

SEQ ID NO: 194038 - DNA, 20 bp, Artificial Sequence
  Description of Artificial Sequence: Synthetic oligonucleotide
  Target: ATXN1; (-) strand; PAM type: YTN; PAM sequence: CTC
catctcctgacctcgtgatc

SEQ ID NO: 194039 - DNA, 20 bp, Artificial Sequence
  Description of Artificial Sequence: Synthetic oligonucleotide
  Target: ATXN1; (-) strand; PAM type: YTN; PAM sequence: TTA
ccaaggatggtctccatctc

SEQ ID NO: 194040 - DNA, 20 bp, Artificial Sequence
  Description of Artificial Sequence: Synthetic oligonucleotide
  Target: ATXN1; (-) strand; PAM type: YTN; PAM sequence: CTG
tgttaccaaggatggtctcc

SEQ ID NO: 194041 - DNA, 20 bp, Artificial Sequence
  Description of Artificial Sequence: Synthetic oligonucleotide
  Target: ATXN1; (-) strand; PAM type: YTN; PAM sequence: TTC
actgtgttaccaaggatggt

SEQ ID NO: 194042 - DNA, 20 bp, Artificial Sequence
  Description of Artificial Sequence: Synthetic oligonucleotide
  Target: ATXN1; (-) strand; PAM type: YTN; PAM sequence: TTT
cactgtgttaccaaggatgg

SEQ ID NO: 194043 - DNA, 20 bp, Artificial Sequence
  Description of Artificial Sequence: Synthetic oligonucleotide
  Target: ATXN1; (-) strand; PAM type: YTN; PAM sequence: TTA
gtagagatgggtttcactgt

SEQ ID NO: 194044 - DNA, 20 bp, Artificial Sequence
  Description of Artificial Sequence: Synthetic oligonucleotide
  Target: ATXN1; (-) strand; PAM type: YTN; PAM sequence: TTT
agtagagatgggtttcactg

SEQ ID NO: 194045 - DNA, 20 bp, Artificial Sequence
  Description of Artificial Sequence: Synthetic oligonucleotide
  Target: ATXN1; (-) strand; PAM type: YTN; PAM sequence: TTT
tagtagagatgggtttcact

SEQ ID NO: 194046 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatgggtttcac

SEQ ID NO: 194047 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggt

SEQ ID NO: 194048 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 194049 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 194050 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 194051 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagat

SEQ ID NO: 194052 - DNA, 20 bp, Artificial Sequence
  Description of Artificial Sequence: Synthetic oligonucleotide
  Target: ATXN1; (-) strand; PAM type: YTN; PAM sequence: CTA
attttttgtatttttagtag

SEQ ID NO: 194053 - DNA, 20 bp, Artificial Sequence
  Description of Artificial Sequence: Synthetic oligonucleotide
  Target: ATXN1; (-) strand; PAM type: YTN; PAM sequence: CTG
gctaattttttgtattttta

SEQ ID NO: 194054 - DNA, 20 bp, Artificial Sequence
  Description of Artificial Sequence: Synthetic oligonucleotide
  Target: ATXN1; (-) strand; PAM type: YTN; PAM sequence: CTG
ccaccatgcctggctaattt

SEQ ID NO: 194055 - DNA, 20 bp, Artificial Sequence
  Description of Artificial Sequence: Synthetic oligonucleotide
  Target: ATXN1; (-) strand; PAM type: YTN; PAM sequence: CTA
caggtgcctgccaccatgcc

SEQ ID NO: 194056 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcctgccac

SEQ ID NO: 194057 - DNA, 20 bp, Artificial Sequence
  Description of Artificial Sequence: Synthetic oligonucleotide
  Target: ATXN1; (-) strand; PAM type: YTN; PAM sequence: CTG
agtagctgggactacaggtg

SEQ ID NO: 194058 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggactacag

SEQ ID NO: 194059 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 194060 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 194061 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 194062 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 194063 - DNA, 20 bp, Artificial Sequence
  Description of Artificial Sequence: Synthetic oligonucleotide
  Target: ATXN1; (-) strand; PAM type: YTN; PAM sequence: TTC
acgccattctcctgcctcag

SEQ ID NO: 194064 - DNA, 20 bp, Artificial Sequence
  Description of Artificial Sequence: Synthetic oligonucleotide
  Target: ATXN1; (-) strand; PAM type: YTN; PAM sequence: CTC
ccgggttcacgccattctcc

SEQ ID NO: 194065 - DNA, 20 bp, Artificial Sequence
  Description of Artificial Sequence: Synthetic oligonucleotide
  Target: ATXN1; (-) strand; PAM type: YTN; PAM sequence: CTC
cgcctcccgggttcacgcca

SEQ ID NO: 194066 - DNA, 20 bp, Artificial Sequence
  Description of Artificial Sequence: Synthetic oligonucleotide
  Target: ATXN1; (-) strand; PAM type: YTN; PAM sequence: CTG
caagctccgcctcccgggtt

SEQ ID NO: 194067 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccgcctcccg

SEQ ID NO: 194068 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaagctccgcc

SEQ ID NO: 194069 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacgatctc

SEQ ID NO: 194070 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgcag

SEQ ID NO: 194071 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagtgc

SEQ ID NO: 194072 - DNA, 20 bp, Artificial Sequence
  Description of Artificial Sequence: Synthetic oligonucleotide
  Target: ATXN1; (-) strand; PAM type: YTN; PAM sequence: CTC
cctctgtcgcccaggctgga

SEQ ID NO: 194073 - DNA, 20 bp, Artificial Sequence
  Description of Artificial Sequence: Synthetic oligonucleotide
  Target: ATXN1; (-) strand; PAM type: YTN; PAM sequence: TTG
agacggatctccctctgtcg

SEQ ID NO: 194074 - DNA, 20 bp, Artificial Sequence
  Description of Artificial Sequence: Synthetic oligonucleotide
  Target: ATXN1; (-) strand; PAM type: YTN; PAM sequence: TTT
gagacggatctccctctgtc

SEQ ID NO: 194075 - DNA, 20 bp, Artificial Sequence
  Description of Artificial Sequence: Synthetic oligonucleotide
  Target: ATXN1; (-) strand; PAM type: YTN; PAM sequence: CTT
tgagacggatctccctctgt

SEQ ID NO: 194076 - DNA, 20 bp, Artificial Sequence
  Description of Artificial Sequence: Synthetic oligonucleotide
  Target: ATXN1; (-) strand; PAM type: YTN; PAM sequence: TTA
ctttgagacggatctccctc

SEQ ID NO: 194077 - DNA, 20 bp, Artificial Sequence
  Description of Artificial Sequence: Synthetic oligonucleotide
  Target: ATXN1; (-) strand; PAM type: YTN; PAM sequence: TTT
actttgagacggatctccct

SEQ ID NO: 194078 - DNA, 20 bp, Artificial Sequence
  Description of Artificial Sequence: Synthetic oligonucleotide
  Target: ATXN1; (-) strand; PAM type: YTN; PAM sequence: TTA
tttactttgagacggatctc

SEQ ID NO: 194079 - DNA, 20 bp, Artificial Sequence
  Description of Artificial Sequence: Synthetic oligonucleotide
  Target: ATXN1; (-) strand; PAM type: YTN; PAM sequence: TTT
atttactttgagacggatct

SEQ ID NO: 194080 - DNA, 20 bp, Artificial Sequence
  Description of Artificial Sequence: Synthetic oligonucleotide
  Target: ATXN1; (-) strand; PAM type: YTN; PAM sequence: TTA
tttatttactttgagacgga

SEQ ID NO: 194081 - DNA, 20 bp, Artificial Sequence
  Description of Artificial Sequence: Synthetic oligonucleotide
  Target: ATXN1; (-) strand; PAM type: YTN; PAM sequence: TTT
atttatttactttgagacgg

SEQ ID NO: 194082 - DNA, 20 bp, Artificial Sequence
  Description of Artificial Sequence: Synthetic oligonucleotide
  Target: ATXN1; (-) strand; PAM type: YTN; PAM sequence: TTG
tttatttatttactttgaga

SEQ ID NO: 194083 - DNA, 20 bp, Artificial Sequence
  Description of Artificial Sequence: Synthetic oligonucleotide
  Target: ATXN1; (-) strand; PAM type: YTN; PAM sequence: TTT
gtttatttatttactttgag

SEQ ID NO: 194084 - DNA, 20 bp, Artificial Sequence
  Description of Artificial Sequence: Synthetic oligonucleotide
  Target: ATXN1; (-) strand; PAM type: YTN; PAM sequence: TTA
tttgtttatttatttacttt

SEQ ID NO: 194085 - DNA, 20 bp, Artificial Sequence
  Description of Artificial Sequence: Synthetic oligonucleotide
  Target: ATXN1; (-) strand; PAM type: YTN; PAM sequence: TTT
atttgtttatttatttactt

SEQ ID NO: 194086 - DNA, 20 bp, Artificial Sequence
  Description of Artificial Sequence: Synthetic oligonucleotide
  Target: ATXN1; (-) strand; PAM type: YTN; PAM sequence: TTT
tatttgtttatttatttact

SEQ ID NO: 194087 - DNA, 20 bp, Artificial Sequence
  Description of Artificial Sequence: Synthetic oligonucleotide
  Target: ATXN1; (-) strand; PAM type: YTN; PAM sequence: TTA
ttttatttgtttatttattt

SEQ ID NO: 194088 - DNA, 20 bp, Artificial Sequence
  Description of Artificial Sequence: Synthetic oligonucleotide
  Target: ATXN1; (-) strand; PAM type: YTN; PAM sequence: TTT
attttatttgtttatttatt

SEQ ID NO: 194089 - DNA, 20 bp, Artificial Sequence
  Description of Artificial Sequence: Synthetic oligonucleotide
  Target: ATXN1; (-) strand; PAM type: YTN; PAM sequence: TTT
tattttatttgtttatttat

SEQ ID NO: 194090 - DNA, 20 bp, Artificial Sequence
  Description of Artificial Sequence: Synthetic oligonucleotide
  Target: ATXN1; (-) strand; PAM type: YTN; PAM sequence: CTT
ttattttatttgtttattta

SEQ ID NO: 194091 - DNA, 20 bp, Artificial Sequence
  Description of Artificial Sequence: Synthetic oligonucleotide
  Target: ATXN1; (-) strand; PAM type: YTN; PAM sequence: TTC
ttttattttatttgtttatt

SEQ ID NO: 194092 - DNA, 20 bp, Artificial Sequence
  Description of Artificial Sequence: Synthetic oligonucleotide
  Target: ATXN1; (-) strand; PAM type: YTN; PAM sequence: TTA
ttcttttattttatttgttt

SEQ ID NO: 194093 - DNA, 20 bp, Artificial Sequence
  Description of Artificial Sequence: Synthetic oligonucleotide
  Target: ATXN1; (-) strand; PAM type: YTN; PAM sequence: TTT
attcttttattttatttgtt

SEQ ID NO: 194094 - DNA, 20 bp, Artificial Sequence
  Description of Artificial Sequence: Synthetic oligonucleotide
  Target: ATXN1; (-) strand; PAM type: YTN; PAM sequence: TTG
agaaacatttattcttttat

SEQ ID NO: 194095 - DNA, 20 bp, Artificial Sequence
  Description of Artificial Sequence: Synthetic oligonucleotide
  Target: ATXN1; (-) strand; PAM type: YTN; PAM sequence: TTT
gagaaacatttattctttta

SEQ ID NO: 194096 - DNA, 20 bp, Artificial Sequence
  Description of Artificial Sequence: Synthetic oligonucleotide
  Target: ATXN1; (-) strand; PAM type: YTN; PAM sequence: TTT
tgagaaacatttattctttt

SEQ ID NO: 194097 - DNA, 20 bp, Artificial Sequence
  Description of Artificial Sequence: Synthetic oligonucleotide
  Target: ATXN1; (-) strand; PAM type: YTN; PAM sequence: CTT
ttgagaaacatttattcttt

SEQ ID NO: 194098 - DNA, 20 bp, Artificial Sequence
  Description of Artificial Sequence: Synthetic oligonucleotide
  Target: ATXN1; (-) strand; PAM type: YTN; PAM sequence: TTC
atagagacttttgagaaaca

SEQ ID NO: 194099 - DNA, 20 bp, Artificial Sequence
  Description of Artificial Sequence: Synthetic oligonucleotide
  Target: ATXN1; (-) strand; PAM type: YTN; PAM sequence: CTT
catagagacttttgagaaac

SEQ ID NO: 194100 - DNA, 20 bp, Artificial Sequence
  Description of Artificial Sequence: Synthetic oligonucleotide
  Target: ATXN1; (-) strand; PAM type: YTN; PAM sequence: CTG
accttcatagagacttttga

SEQ ID NO: 194101 - DNA, 20 bp, Artificial Sequence
  Description of Artificial Sequence: Synthetic oligonucleotide
  Target: ATXN1; (-) strand; PAM type: YTN; PAM sequence: TTG
aagtacaaatctgaccttca

SEQ ID NO: 194102 - DNA, 20 bp, Artificial Sequence
  Description of Artificial Sequence: Synthetic oligonucleotide
  Target: ATXN1; (-) strand; PAM type: YTN; PAM sequence: CTA
tattgaagtacaaatctgac

SEQ ID NO: 194103 - DNA, 20 bp, Artificial Sequence
  Description of Artificial Sequence: Synthetic oligonucleotide
  Target: ATXN1; (-) strand; PAM type: YTN; PAM sequence: TTC
ctatattgaagtacaaatct

SEQ ID NO: 194104 - DNA, 20 bp, Artificial Sequence
  Description of Artificial Sequence: Synthetic oligonucleotide
  Target: ATXN1; (-) strand; PAM type: YTN; PAM sequence: CTA
acagggttcctatattgaag

SEQ ID NO: 194105 - DNA, 20 bp, Artificial Sequence
  Description of Artificial Sequence: Synthetic oligonucleotide
  Target: ATXN1; (-) strand; PAM type: YTN; PAM sequence: CTG
cagaagaatggctaacaggg

SEQ ID NO: 194106 - DNA, 20 bp, Artificial Sequence
  Description of Artificial Sequence: Synthetic oligonucleotide
  Target: ATXN1; (-) strand; PAM type: YTN; PAM sequence: CTG
cacctgcagaagaatggcta

SEQ ID NO: 194107 - DNA, 20 bp, Artificial Sequence
  Description of Artificial Sequence: Synthetic oligonucleotide
  Target: ATXN1; (-) strand; PAM type: YTN; PAM sequence: TTG
tctgcacctgcagaagaatg

SEQ ID NO: 194108 - DNA, 20 bp, Artificial Sequence
  Description of Artificial Sequence: Synthetic oligonucleotide
  Target: ATXN1; (-) strand; PAM type: YTN; PAM sequence: CTC
gcggttgtctgcacctgcag

SEQ ID NO: 194109 - DNA, 20 bp, Artificial Sequence
  Description of Artificial Sequence: Synthetic oligonucleotide
  Target: ATXN1; (-) strand; PAM type: YTN; PAM sequence: CTG
cagacccacacacccgactc

SEQ ID NO: 194110 - DNA, 20 bp, Artificial Sequence
  Description of Artificial Sequence: Synthetic oligonucleotide
  Target: ATXN1; (-) strand; PAM type: YTN; PAM sequence: CTG
caggtgtgtgcagtccagct

SEQ ID NO: 194111 - DNA, 20 bp, Artificial Sequence
  Description of Artificial Sequence: Synthetic oligonucleotide
  Target: ATXN1; (-) strand; PAM type: YTN; PAM sequence: CTA
gaagtcatggtacacctgca

SEQ ID NO: 194112 - DNA, 20 bp, Artificial Sequence
  Description of Artificial Sequence: Synthetic oligonucleotide
  Target: ATXN1; (-) strand; PAM type: YTN; PAM sequence: TTG
cagctagaagtcatggtaca

SEQ ID NO: 194113 - DNA, 20 bp, Artificial Sequence
  Description of Artificial Sequence: Synthetic oligonucleotide
  Target: ATXN1; (-) strand; PAM type: YTN; PAM sequence: TTT
gcagctagaagtcatggtac

SEQ ID NO: 194114 - DNA, 20 bp, Artificial Sequence
  Description of Artificial Sequence: Synthetic oligonucleotide
  Target: ATXN1; (-) strand; PAM type: YTN; PAM sequence: CTT
tgcagctagaagtcatggta

SEQ ID NO: 194115 - DNA, 20 bp, Artificial Sequence
  Description of Artificial Sequence: Synthetic oligonucleotide
  Target: ATXN1; (-) strand; PAM type: YTN; PAM sequence: CTG
ctttgcagctagaagtcatg

SEQ ID NO: 194116 - DNA, 20 bp, Artificial Sequence
  Description of Artificial Sequence: Synthetic oligonucleotide
  Target: ATXN1; (-) strand; PAM type: YTN; PAM sequence: TTG
gtggtacatctgctttgcag

SEQ ID NO: 194117 - DNA, 20 bp, Artificial Sequence
  Description of Artificial Sequence: Synthetic oligonucleotide
  Target: ATXN1; (-) strand; PAM type: YTN; PAM sequence: CTT
ggtggtacatctgctttgca

SEQ ID NO: 194118 - DNA, 20 bp, Artificial Sequence
  Description of Artificial Sequence: Synthetic oligonucleotide
  Target: ATXN1; (-) strand; PAM type: YTN; PAM sequence: CTG
agacttggtggtacatctgc

SEQ ID NO: 194119 - DNA, 20 bp, Artificial Sequence
  Description of Artificial Sequence: Synthetic oligonucleotide
  Target: ATXN1; (-) strand; PAM type: YTN; PAM sequence: TTG
tcatgtgctgagacttggtg

SEQ ID NO: 194120 - DNA, 20 bp, Artificial Sequence
  Description of Artificial Sequence: Synthetic oligonucleotide
  Target: ATXN1; (-) strand; PAM type: YTN; PAM sequence: CTG
caatgccacgttgtcatgtg

SEQ ID NO: 194121 - DNA, 20 bp, Artificial Sequence
  Description of Artificial Sequence: Synthetic oligonucleotide
  Target: ATXN1; (-) strand; PAM type: YTN; PAM sequence: CTG
catctgcaatgccacgttgt

SEQ ID NO: 194122 - DNA, 20 bp, Artificial Sequence
  Description of Artificial Sequence: Synthetic oligonucleotide
  Target: ATXN1; (-) strand; PAM type: YTN; PAM sequence: TTC
caaaccactgcatctgcaat

SEQ ID NO: 194123 - DNA, 20 bp, Artificial Sequence
  Description of Artificial Sequence: Synthetic oligonucleotide
  Target: ATXN1; (-) strand; PAM type: YTN; PAM sequence: TTT
ccaaaccactgcatctgcaa

SEQ ID NO: 194124 - DNA, 20 bp, Artificial Sequence
  Description of Artificial Sequence: Synthetic oligonucleotide
  Target: ATXN1; (-) strand; PAM type: YTN; PAM sequence: CTT
tccaaaccactgcatctgca

SEQ ID NO: 194125 - DNA, 20 bp, Artificial Sequence
  Description of Artificial Sequence: Synthetic oligonucleotide
  Target: ATXN1; (-) strand; PAM type: YTN; PAM sequence: CTG
cgccctttccaaaccactgc

SEQ ID NO: 194126 - DNA, 20 bp, Artificial Sequence
  Description of Artificial Sequence: Synthetic oligonucleotide
  Target: ATXN1; (-) strand; PAM type: YTN; PAM sequence: TTC
tgcgccctttccaaaccact

SEQ ID NO: 194127 - DNA, 20 bp, Artificial Sequence
  Description of Artificial Sequence: Synthetic oligonucleotide
  Target: ATXN1; (-) strand; PAM type: YTN; PAM sequence: CTT
ctgcgccctttccaaaccac

SEQ ID NO: 194128 - DNA, 20 bp, Artificial Sequence
  Description of Artificial Sequence: Synthetic oligonucleotide
  Target: ATXN1; (-) strand; PAM type: YTN; PAM sequence: TTC
ttctgcgccctttccaaacc

SEQ ID NO: 194129 - DNA, 20 bp, Artificial Sequence
  Description of Artificial Sequence: Synthetic oligonucleotide
  Target: ATXN1; (-) strand; PAM type: YTN; PAM sequence: TTT
cttctgcgccctttccaaac

SEQ ID NO: 194130 - DNA, 20 bp, Artificial Sequence
  Description of Artificial Sequence: Synthetic oligonucleotide
  Target: ATXN1; (-) strand; PAM type: YTN; PAM sequence: TTT
tcttctgcgccctttccaaa

SEQ ID NO: 194131 - DNA, 20 bp, Artificial Sequence
  Description of Artificial Sequence: Synthetic oligonucleotide
  Target: ATXN1; (-) strand; PAM type: YTN; PAM sequence: TTA
ttttcttctgcgccctttcc

SEQ ID NO: 194132 - DNA, 20 bp, Artificial Sequence
  Description of Artificial Sequence: Synthetic oligonucleotide
  Target: ATXN1; (-) strand; PAM type: YTN; PAM sequence: CTT
attttcttctgcgccctttc

SEQ ID NO: 194133 - DNA, 20 bp, Artificial Sequence
  Description of Artificial Sequence: Synthetic oligonucleotide
  Target: ATXN1; (-) strand; PAM type: YTN; PAM sequence: CTG
agaaagcttattttcttctg

SEQ ID NO: 194134 - DNA, 20 bp, Artificial Sequence
  Description of Artificial Sequence: Synthetic oligonucleotide
  Target: ATXN1; (-) strand; PAM type: YTN; PAM sequence: TTA
tggatgtcatctgagaaagc

SEQ ID NO: 194135 - DNA, 20 bp, Artificial Sequence
  Description of Artificial Sequence: Synthetic oligonucleotide
  Target: ATXN1; (-) strand; PAM type: YTN; PAM sequence: CTG
ttatggatgtcatctgagaa

SEQ ID NO: 194136 - DNA, 20 bp, Artificial Sequence
  Description of Artificial Sequence: Synthetic oligonucleotide
  Target: ATXN1; (-) strand; PAM type: YTN; PAM sequence: TTC
tgttatggatgtcatctgag

SEQ ID NO: 194137 - DNA, 20 bp, Artificial Sequence
  Description of Artificial Sequence: Synthetic oligonucleotide
  Target: ATXN1; (-) strand; PAM type: YTN; PAM sequence: CTT
ctgttatggatgtcatctga

SEQ ID NO: 194138 - DNA, 20 bp, Artificial Sequence
  Description of Artificial Sequence: Synthetic oligonucleotide
  Target: ATXN1; (-) strand; PAM type: YTN; PAM sequence: TTG
gcagagtgagtgcacccaga

SEQ ID NO: 194139 - DNA, 20 bp, Artificial Sequence
  Description of Artificial Sequence: Synthetic oligonucleotide
  Target: ATXN1; (-) strand; PAM type: YTN; PAM sequence: CTA
agtaaaggggttggcagagt

SEQ ID NO: 194140 - DNA, 20 bp, Artificial Sequence
  Description of Artificial Sequence: Synthetic oligonucleotide
  Target: ATXN1; (-) strand; PAM type: YTN; PAM sequence: CTA
ctaagtaaaggggttggcag

SEQ ID NO: 194141 - DNA, 20 bp, Artificial Sequence
  Description of Artificial Sequence: Synthetic oligonucleotide
  Target: ATXN1; (-) strand; PAM type: YTN; PAM sequence: TTG
gctactaagtaaaggggttg

SEQ ID NO: 194142 - DNA, 20 bp, Artificial Sequence
  Description of Artificial Sequence: Synthetic oligonucleotide
  Target: ATXN1; (-) strand; PAM type: YTN; PAM sequence: CTA
gttggctactaagtaaaggg

SEQ ID NO: 194143 - DNA, 20 bp, Artificial Sequence
  Description of Artificial Sequence: Synthetic oligonucleotide
  Target: ATXN1; (-) strand; PAM type: YTN; PAM sequence: CTC
ataatcctagttggctacta

SEQ ID NO: 194144 - DNA, 20 bp, Artificial Sequence
  Description of Artificial Sequence: Synthetic oligonucleotide
  Target: ATXN1; (-) strand; PAM type: YTN; PAM sequence: TTC
tcataatcctagttggctac

SEQ ID NO: 194145 - DNA, 20 bp, Artificial Sequence
  Description of Artificial Sequence: Synthetic oligonucleotide
  Target: ATXN1; (-) strand; PAM type: YTN; PAM sequence: TTT
ctcataatcctagttggcta

SEQ ID NO: 194146 - DNA, 20 bp, Artificial Sequence
  Description of Artificial Sequence: Synthetic oligonucleotide
  Target: ATXN1; (-) strand; PAM type: YTN; PAM sequence: CTT
tctcataatcctagttggct

SEQ ID NO: 194147 - DNA, 20 bp, Artificial Sequence
  Description of Artificial Sequence: Synthetic oligonucleotide
  Target: ATXN1; (-) strand; PAM type: YTN; PAM sequence: TTG
actttctcataatcctagtt

SEQ ID NO: 194148 - DNA, 20 bp, Artificial Sequence
  Description of Artificial Sequence: Synthetic oligonucleotide
  Target: ATXN1; (-) strand; PAM type: YTN; PAM sequence: TTT
gactttctcataatcctagt

SEQ ID NO: 194149 - DNA, 20 bp, Artificial Sequence
  Description of Artificial Sequence: Synthetic oligonucleotide
  Target: ATXN1; (-) strand; PAM type: YTN; PAM sequence: CTA
tttgactttctcataatcct

SEQ ID NO: 194150 - DNA, 20 bp, Artificial Sequence
  Description of Artificial Sequence: Synthetic oligonucleotide
  Target: ATXN1; (-) strand; PAM type: YTN; PAM sequence: CTG
atagactatttgactttctc

SEQ ID NO: 194151 - DNA, 20 bp, Artificial Sequence
  Description of Artificial Sequence: Synthetic oligonucleotide
  Target: ATXN1; (-) strand; PAM type: YTN; PAM sequence: CTG
atactgatagactatttgac

SEQ ID NO: 194152 - DNA, 20 bp, Artificial Sequence
  Description of Artificial Sequence: Synthetic oligonucleotide
  Target: ATXN1; (-) strand; PAM type: YTN; PAM sequence: CTA
aggcaagggtcaagactgat

SEQ ID NO: 194153 - DNA, 20 bp, Artificial Sequence
  Description of Artificial Sequence: Synthetic oligonucleotide
  Target: ATXN1; (-) strand; PAM type: YTN; PAM sequence: CTA
ataatgatcacccctaaggc

SEQ ID NO: 194154 - DNA, 20 bp, Artificial Sequence
  Description of Artificial Sequence: Synthetic oligonucleotide
  Target: ATXN1; (-) strand; PAM type: YTN; PAM sequence: TTG
gtaatctaataatgatcacc

SEQ ID NO: 194155 - DNA, 20 bp, Artificial Sequence
  Description of Artificial Sequence: Synthetic oligonucleotide
  Target: ATXN1; (-) strand; PAM type: YTN; PAM sequence: CTT
ggtaatctaataatgatcac

SEQ ID NO: 194156 - DNA, 20 bp, Artificial Sequence
  Description of Artificial Sequence: Synthetic oligonucleotide
  Target: ATXN1; (-) strand; PAM type: YTN; PAM sequence: TTA
atgtggtcttggtaatctaa

SEQ ID NO: 194157 - DNA, 20 bp, Artificial Sequence
  Description of Artificial Sequence: Synthetic oligonucleotide
  Target: ATXN1; (-) strand; PAM type: YTN; PAM sequence: CTT
aatgtggtcttggtaatcta

SEQ ID NO: 194158 - DNA, 20 bp, Artificial Sequence
  Description of Artificial Sequence: Synthetic oligonucleotide
  Target: ATXN1; (-) strand; PAM type: YTN; PAM sequence: TTA
acttaatgtggtcttggtaa

SEQ ID NO: 194159 - DNA, 20 bp, Artificial Sequence
  Description of Artificial Sequence: Synthetic oligonucleotide
  Target: ATXN1; (-) strand; PAM type: YTN; PAM sequence: TTT
aacttaatgtggtcttggta

SEQ ID NO: 194160 - DNA, 20 bp, Artificial Sequence
  Description of Artificial Sequence: Synthetic oligonucleotide
  Target: ATXN1; (-) strand; PAM type: YTN; PAM sequence: TTA
taggtagtttaacttaatgt

SEQ ID NO: 194161 - DNA, 20 bp, Artificial Sequence
  Description of Artificial Sequence: Synthetic oligonucleotide
  Target: ATXN1; (-) strand; PAM type: YTN; PAM sequence: CTG
tagagttataggtagtttaa

SEQ ID NO: 194162 - DNA, 20 bp, Artificial Sequence
  Description of Artificial Sequence: Synthetic oligonucleotide
  Target: ATXN1; (-) strand; PAM type: YTN; PAM sequence: TTG
aggctgtagagttataggta

SEQ ID NO: 194163 - DNA, 20 bp, Artificial Sequence
  Description of Artificial Sequence: Synthetic oligonucleotide
  Target: ATXN1; (-) strand; PAM type: YTN; PAM sequence: TTT
gaggctgtagagttataggt

SEQ ID NO: 194164 - DNA, 20 bp, Artificial Sequence
  Description of Artificial Sequence: Synthetic oligonucleotide
  Target: ATXN1; (-) strand; PAM type: YTN; PAM sequence: TTT
tgaggctgtagagttatagg

SEQ ID NO: 194165 - DNA, 20 bp, Artificial Sequence
  Description of Artificial Sequence: Synthetic oligonucleotide
  Target: ATXN1; (-) strand; PAM type: YTN; PAM sequence: TTT
ttgaggctgtagagttatag

SEQ ID NO: 194166 - DNA, 20 bp, Artificial Sequence
  Description of Artificial Sequence: Synthetic oligonucleotide
  Target: ATXN1; (-) strand; PAM type: YTN; PAM sequence: CTT
tttgaggctgtagagttata

SEQ ID NO: 194167 - DNA, 20 bp, Artificial Sequence
  Description of Artificial Sequence: Synthetic oligonucleotide
  Target: ATXN1; (-) strand; PAM type: YTN; PAM sequence: TTC
tttttgaggctgtagagtta

SEQ ID NO: 194168 - DNA, 20 bp, Artificial Sequence
  Description of Artificial Sequence: Synthetic oligonucleotide
  Target: ATXN1; (-) strand; PAM type: YTN; PAM sequence: CTG
cagattctttttgaggctgt

SEQ ID NO: 194169 - DNA, 20 bp, Artificial Sequence
  Description of Artificial Sequence: Synthetic oligonucleotide
  Target: ATXN1; (-) strand; PAM type: YTN; PAM sequence: TTG
gaatctgcagattctttttg

SEQ ID NO: 194170 - DNA, 20 bp, Artificial Sequence
  Description of Artificial Sequence: Synthetic oligonucleotide
  Target: ATXN1; (-) strand; PAM type: YTN; PAM sequence: TTT
ggaatctgcagattcttttt

SEQ ID NO: 194171 - DNA, 20 bp, Artificial Sequence
  Description of Artificial Sequence: Synthetic oligonucleotide
  Target: ATXN1; (-) strand; PAM type: YTN; PAM sequence: TTT
tggaatctgcagattctttt

SEQ ID NO: 194172 - DNA, 20 bp, Artificial Sequence
  Description of Artificial Sequence: Synthetic oligonucleotide
  Target: ATXN1; (-) strand; PAM type: YTN; PAM sequence: CTG
gttttggaatctgcagattc

SEQ ID NO: 194173 - DNA, 20 bp, Artificial Sequence
  Description of Artificial Sequence: Synthetic oligonucleotide
  Target: ATXN1; (-) strand; PAM type: YTN; PAM sequence: CTG
cacaagtctggttttggaat

SEQ ID NO: 194174 - DNA, 20 bp, Artificial Sequence
  Description of Artificial Sequence: Synthetic oligonucleotide
  Target: ATXN1; (-) strand; PAM type: YTN; PAM sequence: TTG
ccctgcacaagtctggtttt

SEQ ID NO: 194175 - DNA, 20 bp, Artificial Sequence
  Description of Artificial Sequence: Synthetic oligonucleotide
  Target: ATXN1; (-) strand; PAM type: YTN; PAM sequence: TTT
gccctgcacaagtctggttt

SEQ ID NO: 194176 - DNA, 20 bp, Artificial Sequence
  Description of Artificial Sequence: Synthetic oligonucleotide
  Target: ATXN1; (-) strand; PAM type: YTN; PAM sequence: CTG
catgatgtttgccctgcaca

SEQ ID NO: 194177 - DNA, 20 bp, Artificial Sequence
  Description of Artificial Sequence: Synthetic oligonucleotide
  Target: ATXN1; (-) strand; PAM type: YTN; PAM sequence: CTA
gctgcatgatgtttgccctg

SEQ ID NO: 194178 - DNA, 20 bp, Artificial Sequence
  Description of Artificial Sequence: Synthetic oligonucleotide
  Target: ATXN1; (-) strand; PAM type: YTN; PAM sequence: CTC
ctagctgcatgatgtttgcc

SEQ ID NO: 194179 - DNA, 20 bp, Artificial Sequence
  Description of Artificial Sequence: Synthetic oligonucleotide
  Target: ATXN1; (-) strand; PAM type: YTN; PAM sequence: TTG
gctcctagctgcatgatgtt

SEQ ID NO: 194180 - DNA, 20 bp, Artificial Sequence
  Description of Artificial Sequence: Synthetic oligonucleotide
  Target: ATXN1; (-) strand; PAM type: YTN; PAM sequence: TTT
ggctcctagctgcatgatgt

SEQ ID NO: 194181 - DNA, 20 bp, Artificial Sequence
  Description of Artificial Sequence: Synthetic oligonucleotide
  Target: ATXN1; (-) strand; PAM type: YTN; PAM sequence: CTG
gtgtgtttggctcctagctg

SEQ ID NO: 194182 - DNA, 20 bp, Artificial Sequence
  Description of Artificial Sequence: Synthetic oligonucleotide
  Target: ATXN1; (-) strand; PAM type: YTN; PAM sequence: TTG
atactggtgtgtttggctcc

SEQ ID NO: 194183 - DNA, 20 bp, Artificial Sequence
  Description of Artificial Sequence: Synthetic oligonucleotide
  Target: ATXN1; (-) strand; PAM type: YTN; PAM sequence: TTT
gatactggtgtgtttggctc

SEQ ID NO: 194184 - DNA, 20 bp, Artificial Sequence
  Description of Artificial Sequence: Synthetic oligonucleotide
  Target: ATXN1; (-) strand; PAM type: YTN; PAM sequence: TTT
tgatactggtgtgtttggct

SEQ ID NO: 194185 - DNA, 20 bp, Artificial Sequence
  Description of Artificial Sequence: Synthetic oligonucleotide
  Target: ATXN1; (-) strand; PAM type: YTN; PAM sequence: CTA
ggattttgatactggtgtgt

SEQ ID NO: 194186 - DNA, 20 bp, Artificial Sequence
  Description of Artificial Sequence: Synthetic oligonucleotide
  Target: ATXN1; (-) strand; PAM type: YTN; PAM sequence: TTC
atggagagtagcagagctag

SEQ ID NO: 194187 - DNA, 20 bp, Artificial Sequence
  Description of Artificial Sequence: Synthetic oligonucleotide
  Target: ATXN1; (-) strand; PAM type: YTN; PAM sequence: CTT
catggagagtagcagagcta

SEQ ID NO: 194188 - DNA, 20 bp, Artificial Sequence
  Description of Artificial Sequence: Synthetic oligonucleotide
  Target: ATXN1; (-) strand; PAM type: YTN; PAM sequence: TTA
tggggcttcatggagagtag

SEQ ID NO: 194189 - DNA, 20 bp, Artificial Sequence
  Description of Artificial Sequence: Synthetic oligonucleotide
  Target: ATXN1; (-) strand; PAM type: YTN; PAM sequence: TTT
atggggcttcatggagagta

SEQ ID NO: 194190 - DNA, 20 bp, Artificial Sequence
  Description of Artificial Sequence: Synthetic oligonucleotide
  Target: ATXN1; (-) strand; PAM type: YTN; PAM sequence: CTT
tatggggcttcatggagagt

SEQ ID NO: 194191 - DNA, 20 bp, Artificial Sequence
  Description of Artificial Sequence: Synthetic oligonucleotide
  Target: ATXN1; (-) strand; PAM type: YTN; PAM sequence: CTC
acatcacctttatggggctt

SEQ ID NO: 194192 - DNA, 20 bp, Artificial Sequence
  Description of Artificial Sequence: Synthetic oligonucleotide
  Target: ATXN1; (-) strand; PAM type: YTN; PAM sequence: CTG
aggcccagaggctcacatca

SEQ ID NO: 194193 - DNA, 20 bp, Artificial Sequence
  Description of Artificial Sequence: Synthetic oligonucleotide
  Target: ATXN1; (-) strand; PAM type: YTN; PAM sequence: CTA
tgtacagatggggcatctga

SEQ ID NO: 194194 - DNA, 20 bp, Artificial Sequence
  Description of Artificial Sequence: Synthetic oligonucleotide
  Target: ATXN1; (-) strand; PAM type: YTN; PAM sequence: CTG
gcaaaggccctatgtacaga

SEQ ID NO: 194195 - DNA, 20 bp, Artificial Sequence
  Description of Artificial Sequence: Synthetic oligonucleotide
  Target: ATXN1; (-) strand; PAM type: YTN; PAM sequence: TTG
tctggcaaaggccctatgta

SEQ ID NO: 194196 - DNA, 20 bp, Artificial Sequence
  Description of Artificial Sequence: Synthetic oligonucleotide
  Target: ATXN1; (-) strand; PAM type: YTN; PAM sequence: CTT
gtctggcaaaggccctatgt

SEQ ID NO: 194197 - DNA, 20 bp, Artificial Sequence
  Description of Artificial Sequence: Synthetic oligonucleotide
  Target: ATXN1; (-) strand; PAM type: YTN; PAM sequence: CTG
agagcttgtctggcaaaggc

SEQ ID NO: 194198 - DNA, 20 bp, Artificial Sequence
  Description of Artificial Sequence: Synthetic oligonucleotide
  Target: ATXN1; (-) strand; PAM type: YTN; PAM sequence: TTC
catgaccaagaataacagga

SEQ ID NO: 194199 - DNA, 20 bp, Artificial Sequence
  Description of Artificial Sequence: Synthetic oligonucleotide
  Target: ATXN1; (-) strand; PAM type: YTN; PAM sequence: TTG
aattccatgaccaagaataa

SEQ ID NO: 194200 - DNA, 20 bp, Artificial Sequence
  Description of Artificial Sequence: Synthetic oligonucleotide
  Target: ATXN1; (-) strand; PAM type: YTN; PAM sequence: TTT
gaattccatgaccaagaata

SEQ ID NO: 194201 - DNA, 20 bp, Artificial Sequence
  Description of Artificial Sequence: Synthetic oligonucleotide
  Target: ATXN1; (-) strand; PAM type: YTN; PAM sequence: TTT
tgaattccatgaccaagaat

SEQ ID NO: 194202 - DNA, 20 bp, Artificial Sequence
  Description of Artificial Sequence: Synthetic oligonucleotide
  Target: ATXN1; (-) strand; PAM type: YTN; PAM sequence: CTT
ttgaattccatgaccaagaa

SEQ ID NO: 194203 - DNA, 20 bp, Artificial Sequence
  Description of Artificial Sequence: Synthetic oligonucleotide
  Target: ATXN1; (-) strand; PAM type: YTN; PAM sequence: CTG
tgatgtcttttgaattccat

SEQ ID NO: 194204 - DNA, 20 bp, Artificial Sequence
  Description of Artificial Sequence: Synthetic oligonucleotide
  Target: ATXN1; (-) strand; PAM type: YTN; PAM sequence: TTC
aagtgactgtgatgtctttt

SEQ ID NO: 194205 - DNA, 20 bp, Artificial Sequence
  Description of Artificial Sequence: Synthetic oligonucleotide
  Target: ATXN1; (-) strand; PAM type: YTN; PAM sequence: TTT
caagtgactgtgatgtcttt

SEQ ID NO: 194206 - DNA, 20 bp, Artificial Sequence
  Description of Artificial Sequence: Synthetic oligonucleotide
  Target: ATXN1; (-) strand; PAM type: YTN; PAM sequence: CTG
taggcaagggggaaccatcc

SEQ ID NO: 194207 - DNA, 20 bp, Artificial Sequence
  Description of Artificial Sequence: Synthetic oligonucleotide
  Target: ATXN1; (-) strand; PAM type: YTN; PAM sequence: CTG
gtgcacagagatacagctgt

SEQ ID NO: 194208 - DNA, 20 bp, Artificial Sequence
  Description of Artificial Sequence: Synthetic oligonucleotide
  Target: ATXN1; (-) strand; PAM type: YTN; PAM sequence: CTC
agcaactggtgcacagagat

SEQ ID NO: 194209 - DNA, 20 bp, Artificial Sequence
  Description of Artificial Sequence: Synthetic oligonucleotide
  Target: ATXN1; (-) strand; PAM type: YTN; PAM sequence: TTC
cctcagcaactggtgcacag

SEQ ID NO: 194210 - DNA, 20 bp, Artificial Sequence
  Description of Artificial Sequence: Synthetic oligonucleotide
  Target: ATXN1; (-) strand; PAM type: YTN; PAM sequence: TTT
ccctcagcaactggtgcaca

SEQ ID NO: 194211 - DNA, 20 bp, Artificial Sequence
  Description of Artificial Sequence: Synthetic oligonucleotide
  Target: ATXN1; (-) strand; PAM type: YTN; PAM sequence: CTT
tccctcagcaactggtgcac

SEQ ID NO: 194212 - DNA, 20 bp, Artificial Sequence
  Description of Artificial Sequence: Synthetic oligonucleotide
  Target: ATXN1; (-) strand; PAM type: YTN; PAM sequence: TTC
tttccctcagcaactggtgc

SEQ ID NO: 194213 - DNA, 20 bp, Artificial Sequence
  Description of Artificial Sequence: Synthetic oligonucleotide
  Target: ATXN1; (-) strand; PAM type: YTN; PAM sequence: TTT
ctttccctcagcaactggtg

SEQ ID NO: 194214 - DNA, 20 bp, Artificial Sequence
  Description of Artificial Sequence: Synthetic oligonucleotide
  Target: ATXN1; (-) strand; PAM type: YTN; PAM sequence: CTC
acagaaaggaagtttctttc

SEQ ID NO: 194215 - DNA, 20 bp, Artificial Sequence
  Description of Artificial Sequence: Synthetic oligonucleotide
  Target: ATXN1; (-) strand; PAM type: YTN; PAM sequence: TTG
tccagctcacagaaaggaag

SEQ ID NO: 194216 - DNA, 20 bp, Artificial Sequence
  Description of Artificial Sequence: Synthetic oligonucleotide
  Target: ATXN1; (-) strand; PAM type: YTN; PAM sequence: CTT
gtccagctcacagaaaggaa

SEQ ID NO: 194217 - DNA, 20 bp, Artificial Sequence
  Description of Artificial Sequence: Synthetic oligonucleotide
  Target: ATXN1; (-) strand; PAM type: YTN; PAM sequence: TTA
ccttgtccagctcacagaaa

SEQ ID NO: 194218 - DNA, 20 bp, Artificial Sequence
  Description of Artificial Sequence: Synthetic oligonucleotide
  Target: ATXN1; (-) strand; PAM type: YTN; PAM sequence: CTA
ttaccttgtccagctcacag

SEQ ID NO: 194219 - DNA, 20 bp, Artificial Sequence
  Description of Artificial Sequence: Synthetic oligonucleotide
  Target: ATXN1; (-) strand; PAM type: YTN; PAM sequence: TTG
ctattaccttgtccagctca

SEQ ID NO: 194220 - DNA, 20 bp, Artificial Sequence
  Description of Artificial Sequence: Synthetic oligonucleotide
  Target: ATXN1; (-) strand; PAM type: YTN; PAM sequence: TTG
ttgctattaccttgtccagc

SEQ ID NO: 194221 - DNA, 20 bp, Artificial Sequence
  Description of Artificial Sequence: Synthetic oligonucleotide
  Target: ATXN1; (-) strand; PAM type: YTN; PAM sequence: CTC
gtgcgaggtcatcattgttg

SEQ ID NO: 194222 - DNA, 20 bp, Artificial Sequence
  Description of Artificial Sequence: Synthetic oligonucleotide
  Target: ATXN1; (-) strand; PAM type: YTN; PAM sequence: TTG
cctcgtgcgaggtcatcatt

SEQ ID NO: 194223 - DNA, 20 bp, Artificial Sequence
  Description of Artificial Sequence: Synthetic oligonucleotide
  Target: ATXN1; (-) strand; PAM type: YTN; PAM sequence: TTT
gcctcgtgcgaggtcatcat

SEQ ID NO: 194224 - DNA, 20 bp, Artificial Sequence
  Description of Artificial Sequence: Synthetic oligonucleotide
  Target: ATXN1; (-) strand; PAM type: YTN; PAM sequence: CTT
tgcctcgtgcgaggtcatca

SEQ ID NO: 194225 - DNA, 20 bp, Artificial Sequence
  Description of Artificial Sequence: Synthetic oligonucleotide
  Target: ATXN1; (-) strand; PAM type: YTN; PAM sequence: TTC
acatgctttgcctcgtgcga

SEQ ID NO: 194226 - DNA, 20 bp, Artificial Sequence
  Description of Artificial Sequence: Synthetic oligonucleotide
  Target: ATXN1; (-) strand; PAM type: YTN; PAM sequence: TTG
ccgttcacatgctttgcctc

SEQ ID NO: 194227 - DNA, 20 bp, Artificial Sequence
  Description of Artificial Sequence: Synthetic oligonucleotide
  Target: ATXN1; (-) strand; PAM type: YTN; PAM sequence: TTT
gccgttcacatgctttgcct

SEQ ID NO: 194228 - DNA, 20 bp, Artificial Sequence
  Description of Artificial Sequence: Synthetic oligonucleotide
  Target: ATXN1; (-) strand; PAM type: YTN; PAM sequence: TTT
tgccgttcacatgctttgcc

SEQ ID NO: 194229 - DNA, 20 bp, Artificial Sequence
  Description of Artificial Sequence: Synthetic oligonucleotide
  Target: ATXN1; (-) strand; PAM type: YTN; PAM sequence: TTT
ttgccgttcacatgctttgc

SEQ ID NO: 194230 - DNA, 20 bp, Artificial Sequence
  Description of Artificial Sequence: Synthetic oligonucleotide
  Target: ATXN1; (-) strand; PAM type: YTN; PAM sequence: TTT
tttgccgttcacatgctttg

SEQ ID NO: 194231 - DNA, 20 bp, Artificial Sequence
  Description of Artificial Sequence: Synthetic oligonucleotide
  Target: ATXN1; (-) strand; PAM type: YTN; PAM sequence: CTT
ttttgccgttcacatgcttt

SEQ ID NO: 194232 - DNA, 20 bp, Artificial Sequence
  Description of Artificial Sequence: Synthetic oligonucleotide
  Target: ATXN1; (-) strand; PAM type: YTN; PAM sequence: TTC
ttttttgccgttcacatgct

SEQ ID NO: 194233 - DNA, 20 bp, Artificial Sequence
  Description of Artificial Sequence: Synthetic oligonucleotide
  Target: ATXN1; (-) strand; PAM type: YTN; PAM sequence: TTT
cttttttgccgttcacatgc

SEQ ID NO: 194234 - DNA, 20 bp, Artificial Sequence
  Description of Artificial Sequence: Synthetic oligonucleotide
  Target: ATXN1; (-) strand; PAM type: YTN; PAM sequence: CTG
cgatttcttttttgccgttc

SEQ ID NO: 194235 - DNA, 20 bp, Artificial Sequence
  Description of Artificial Sequence: Synthetic oligonucleotide
  Target: ATXN1; (-) strand; PAM type: YTN; PAM sequence: TTC
tgcgatttcttttttgccgt

SEQ ID NO: 194236 - DNA, 20 bp, Artificial Sequence
  Description of Artificial Sequence: Synthetic oligonucleotide
  Target: ATXN1; (-) strand; PAM type: YTN; PAM sequence: TTT
ctgcgatttcttttttgccg

SEQ ID NO: 194237 - DNA, 20 bp, Artificial Sequence
  Description of Artificial Sequence: Synthetic oligonucleotide
  Target: ATXN1; (-) strand; PAM type: YTN; PAM sequence: TTT
tctgcgatttcttttttgcc

SEQ ID NO: 194238 - DNA, 20 bp, Artificial Sequence
  Description of Artificial Sequence: Synthetic oligonucleotide
  Target: ATXN1; (-) strand; PAM type: YTN; PAM sequence: TTT
ttctgcgatttcttttttgc

SEQ ID NO: 194239 - DNA, 20 bp, Artificial Sequence
  Description of Artificial Sequence: Synthetic oligonucleotide
  Target: ATXN1; (-) strand; PAM type: YTN; PAM sequence: TTG
tagatttttctgcgatttct

SEQ ID NO: 194240 - DNA, 20 bp, Artificial Sequence
  Description of Artificial Sequence: Synthetic oligonucleotide
  Target: ATXN1; (-) strand; PAM type: YTN; PAM sequence: CTT
gtagatttttctgcgatttc

SEQ ID NO: 194241 - DNA, 20 bp, Artificial Sequence
  Description of Artificial Sequence: Synthetic oligonucleotide
  Target: ATXN1; (-) strand; PAM type: YTN; PAM sequence: TTC
ccttgtagatttttctgcga

SEQ ID NO: 194242 - DNA, 20 bp, Artificial Sequence
  Description of Artificial Sequence: Synthetic oligonucleotide
  Target: ATXN1; (-) strand; PAM type: YTN; PAM sequence: TTT
cccttgtagatttttctgcg

SEQ ID NO: 194243 - DNA, 20 bp, Artificial Sequence
  Description of Artificial Sequence: Synthetic oligonucleotide
  Target: ATXN1; (-) strand; PAM type: YTN; PAM sequence: TTG
gagaggatggtttcccttgt

SEQ ID NO: 194244 - DNA, 20 bp, Artificial Sequence
  Description of Artificial Sequence: Synthetic oligonucleotide
  Target: ATXN1; (-) strand; PAM type: YTN; PAM sequence: TTT
ggagaggatggtttcccttg

SEQ ID NO: 194245 - DNA, 20 bp, Artificial Sequence
  Description of Artificial Sequence: Synthetic oligonucleotide
  Target: ATXN1; (-) strand; PAM type: YTN; PAM sequence: CTT
tggagaggatggtttccctt

SEQ ID NO: 194246 - DNA, 20 bp, Artificial Sequence
  Description of Artificial Sequence: Synthetic oligonucleotide
  Target: ATXN1; (-) strand; PAM type: YTN; PAM sequence: CTG
ggtcctttggagaggatggt

SEQ ID NO: 194247 - DNA, 20 bp, Artificial Sequence
  Description of Artificial Sequence: Synthetic oligonucleotide
  Target: ATXN1; (-) strand; PAM type: YTN; PAM sequence: CTC
atcactgggtcctttggaga

SEQ ID NO: 194248 - DNA, 20 bp, Artificial Sequence
  Description of Artificial Sequence: Synthetic oligonucleotide
  Target: ATXN1; (-) strand; PAM type: YTN; PAM sequence: CTC
ctcatcactgggtcctttgg

SEQ ID NO: 194249 - DNA, 20 bp, Artificial Sequence
  Description of Artificial Sequence: Synthetic oligonucleotide
  Target: ATXN1; (-) strand; PAM type: YTN; PAM sequence: CTC
tcctcatcactgggtccttt

SEQ ID NO: 194250 - DNA, 20 bp, Artificial Sequence
  Description of Artificial Sequence: Synthetic oligonucleotide
  Target: ATXN1; (-) strand; PAM type: YTN; PAM sequence: TTG
actctcctcatcactgggtc

SEQ ID NO: 194251 - DNA, 20 bp, Artificial Sequence
  Description of Artificial Sequence: Synthetic oligonucleotide
  Target: ATXN1; (-) strand; PAM type: YTN; PAM sequence: TTT
gactctcctcatcactgggt

SEQ ID NO: 194252 - DNA, 20 bp, Artificial Sequence
  Description of Artificial Sequence: Synthetic oligonucleotide
  Target: ATXN1; (-) strand; PAM type: YTN; PAM sequence: CTT
tgactctcctcatcactggg

SEQ ID NO: 194253 - DNA, 20 bp, Artificial Sequence
  Description of Artificial Sequence: Synthetic oligonucleotide
  Target: ATXN1; (-) strand; PAM type: YTN; PAM sequence: TTC
tttgactctcctcatcactg

SEQ ID NO: 194254 - DNA, 20 bp, Artificial Sequence
  Description of Artificial Sequence: Synthetic oligonucleotide
  Target: ATXN1; (-) strand; PAM type: YTN; PAM sequence: CTA
ttctttgactctcctcatca

SEQ ID NO: 194255 - DNA, 20 bp, Artificial Sequence
  Description of Artificial Sequence: Synthetic oligonucleotide
  Target: ATXN1; (-) strand; PAM type: YTN; PAM sequence: TTC
ctattctttgactctcctca

SEQ ID NO: 194256 - DNA, 20 bp, Artificial Sequence
  Description of Artificial Sequence: Synthetic oligonucleotide
  Target: ATXN1; (-) strand; PAM type: YTN; PAM sequence: TTT
cctattctttgactctcctc

SEQ ID NO: 194257 - DNA, 20 bp, Artificial Sequence
  Description of Artificial Sequence: Synthetic oligonucleotide
  Target: ATXN1; (-) strand; PAM type: YTN; PAM sequence: TTT
tcctattctttgactctcct

SEQ ID NO: 194258 - DNA, 20 bp, Artificial Sequence
  Description of Artificial Sequence: Synthetic oligonucleotide
  Target: ATXN1; (-) strand; PAM type: YTN; PAM sequence: TTT
ttcctattctttgactctcc

SEQ ID NO: 194259 - DNA, 20 bp, Artificial Sequence
  Description of Artificial Sequence: Synthetic oligonucleotide
  Target: ATXN1; (-) strand; PAM type: YTN; PAM sequence: TTG
gaaccaaggtatttttccta

SEQ ID NO: 194260 - DNA, 20 bp, Artificial Sequence
  Description of Artificial Sequence: Synthetic oligonucleotide
  Target: ATXN1; (-) strand; PAM type: YTN; PAM sequence: CTT
ggaaccaaggtatttttcct

SEQ ID NO: 194261 - DNA, 20 bp, Artificial Sequence
  Description of Artificial Sequence: Synthetic oligonucleotide
  Target: ATXN1; (-) strand; PAM type: YTN; PAM sequence: CTG
cttggaaccaaggtattttt

SEQ ID NO: 194262 - DNA, 20 bp, Artificial Sequence
  Description of Artificial Sequence: Synthetic oligonucleotide
  Target: ATXN1; (-) strand; PAM type: YTN; PAM sequence: CTC
ctgcttggaaccaaggtatt

SEQ ID NO: 194263 - DNA, 20 bp, Artificial Sequence
  Description of Artificial Sequence: Synthetic oligonucleotide
  Target: ATXN1; (-) strand; PAM type: YTN; PAM sequence: TTC
tcctgcttggaaccaaggta

SEQ ID NO: 194264 - DNA, 20 bp, Artificial Sequence
  Description of Artificial Sequence: Synthetic oligonucleotide
  Target: ATXN1; (-) strand; PAM type: YTN; PAM sequence: TTT
ctcctgcttggaaccaaggt

SEQ ID NO: 194265 - DNA, 20 bp, Artificial Sequence
  Description of Artificial Sequence: Synthetic oligonucleotide
  Target: ATXN1; (-) strand; PAM type: YTN; PAM sequence: TTT
tctcctgcttggaaccaagg

SEQ ID NO: 194266 - DNA, 20 bp, Artificial Sequence
  Description of Artificial Sequence: Synthetic oligonucleotide
  Target: ATXN1; (-) strand; PAM type: YTN; PAM sequence: CTA
gttttctcctgcttggaacc

SEQ ID NO: 194267 - DNA, 20 bp, Artificial Sequence
  Description of Artificial Sequence: Synthetic oligonucleotide
  Target: ATXN1; (-) strand; PAM type: YTN; PAM sequence: CTC
tagttttctcctgcttggaa

SEQ ID NO: 194268 - DNA, 20 bp, Artificial Sequence
  Description of Artificial Sequence: Synthetic oligonucleotide
  Target: ATXN1; (-) strand; PAM type: YTN; PAM sequence: CTC
tctagttttctcctgcttgg

SEQ ID NO: 194269 - DNA, 20 bp, Artificial Sequence
  Description of Artificial Sequence: Synthetic oligonucleotide
  Target: ATXN1; (-) strand; PAM type: YTN; PAM sequence: CTA
tgatgcaccaagaaaaagtg

SEQ ID NO: 194270 - DNA, 20 bp, Artificial Sequence
  Description of Artificial Sequence: Synthetic oligonucleotide
  Target: ATXN1; (-) strand; PAM type: YTN; PAM sequence: TTA
ctatgatgcaccaagaaaaa

SEQ ID NO: 194271 - DNA, 20 bp, Artificial Sequence
  Description of Artificial Sequence: Synthetic oligonucleotide
  Target: ATXN1; (-) strand; PAM type: YTN; PAM sequence: TTA
tccaattactatgatgcacc

SEQ ID NO: 194272 - DNA, 20 bp, Artificial Sequence
  Description of Artificial Sequence: Synthetic oligonucleotide
  Target: ATXN1; (-) strand; PAM type: YTN; PAM sequence: TTA
cccacatcaaaatattatcc

SEQ ID NO: 194273 - DNA, 20 bp, Artificial Sequence
  Description of Artificial Sequence: Synthetic oligonucleotide
  Target: ATXN1; (-) strand; PAM type: YTN; PAM sequence: TTT
acccacatcaaaatattatc

SEQ ID NO: 194274 - DNA, 20 bp, Artificial Sequence
  Description of Artificial Sequence: Synthetic oligonucleotide
  Target: ATXN1; (-) strand; PAM type: YTN; PAM sequence: TTT
tacccacatcaaaatattat

SEQ ID NO: 194275 - DNA, 20 bp, Artificial Sequence
  Description of Artificial Sequence: Synthetic oligonucleotide
  Target: ATXN1; (-) strand; PAM type: YTN; PAM sequence: TTT
ttacccacatcaaaatatta

SEQ ID NO: 194276 - DNA, 20 bp, Artificial Sequence
  Description of Artificial Sequence: Synthetic oligonucleotide
  Target: ATXN1; (-) strand; PAM type: YTN; PAM sequence: TTC
atgtatttttacccacatca

SEQ ID NO: 194277 - DNA, 20 bp, Artificial Sequence
  Description of Artificial Sequence: Synthetic oligonucleotide
  Target: ATXN1; (-) strand; PAM type: YTN; PAM sequence: TTT
catgtatttttacccacatc

SEQ ID NO: 194278 - DNA, 20 bp, Artificial Sequence
  Description of Artificial Sequence: Synthetic oligonucleotide
  Target: ATXN1; (-) strand; PAM type: YTN; PAM sequence: CTT
tcatgtatttttacccacat

SEQ ID NO: 194279 - DNA, 20 bp, Artificial Sequence
  Description of Artificial Sequence: Synthetic oligonucleotide
  Target: ATXN1; (-) strand; PAM type: YTN; PAM sequence: TTG
aatctttcatgtatttttac

SEQ ID NO: 194280 - DNA, 20 bp, Artificial Sequence
  Description of Artificial Sequence: Synthetic oligonucleotide
  Target: ATXN1; (-) strand; PAM type: YTN; PAM sequence: TTT
gaatctttcatgtattttta

SEQ ID NO: 194281 - DNA, 20 bp, Artificial Sequence
  Description of Artificial Sequence: Synthetic oligonucleotide
  Target: ATXN1; (-) strand; PAM type: YTN; PAM sequence: CTT
tgaatctttcatgtattttt

SEQ ID NO: 194282 - DNA, 20 bp, Artificial Sequence
  Description of Artificial Sequence: Synthetic oligonucleotide
  Target: ATXN1; (-) strand; PAM type: YTN; PAM sequence: TTC
atagggtgagtgatcctttg

SEQ ID NO: 194283 - DNA, 20 bp, Artificial Sequence
  Description of Artificial Sequence: Synthetic oligonucleotide
  Target: ATXN1; (-) strand; PAM type: YTN; PAM sequence: TTT
catagggtgagtgatccttt

SEQ ID NO: 194284 - DNA, 20 bp, Artificial Sequence
  Description of Artificial Sequence: Synthetic oligonucleotide
  Target: ATXN1; (-) strand; PAM type: YTN; PAM sequence: TTT
tcatagggtgagtgatcctt

SEQ ID NO: 194285 - DNA, 20 bp, Artificial Sequence
  Description of Artificial Sequence: Synthetic oligonucleotide
  Target: ATXN1; (-) strand; PAM type: YTN; PAM sequence: CTG
ttttcatagggtgagtgatc

SEQ ID NO: 194286 - DNA, 20 bp, Artificial Sequence
  Description of Artificial Sequence: Synthetic oligonucleotide
  Target: ATXN1; (-) strand; PAM type: YTN; PAM sequence: TTC
gtgagaaagaaatcgacgtg

SEQ ID NO: 194287 - DNA, 20 bp, Artificial Sequence
  Description of Artificial Sequence: Synthetic oligonucleotide
  Target: ATXN1; (-) strand; PAM type: YTN; PAM sequence: CTT
cgtgagaaagaaatcgacgt

SEQ ID NO: 194288 - DNA, 20 bp, Artificial Sequence
  Description of Artificial Sequence: Synthetic oligonucleotide
  Target: ATXN1; (-) strand; PAM type: YTN; PAM sequence: TTC
ttcgtgagaaagaaatcgac

SEQ ID NO: 194289 - DNA, 20 bp, Artificial Sequence
  Description of Artificial Sequence: Synthetic oligonucleotide
  Target: ATXN1; (-) strand; PAM type: YTN; PAM sequence: TTT
cttcgtgagaaagaaatcga

SEQ ID NO: 194290 - DNA, 20 bp, Artificial Sequence
  Description of Artificial Sequence: Synthetic oligonucleotide
  Target: ATXN1; (-) strand; PAM type: YTN; PAM sequence: TTT
tcttcgtgagaaagaaatcg

SEQ ID NO: 194291 - DNA, 20 bp, Artificial Sequence
  Description of Artificial Sequence: Synthetic oligonucleotide
  Target: ATXN1; (-) strand; PAM type: YTN; PAM sequence: TTA
gaccattttcttcgtgagaa

SEQ ID NO: 194292 - DNA, 20 bp, Artificial Sequence
  Description of Artificial Sequence: Synthetic oligonucleotide
  Target: ATXN1; (-) strand; PAM type: YTN; PAM sequence: TTC
caaagaaattagaccatttt

SEQ ID NO: 194293 - DNA, 20 bp, Artificial Sequence
  Description of Artificial Sequence: Synthetic oligonucleotide
  Target: ATXN1; (-) strand; PAM type: YTN; PAM sequence: TTT
ccaaagaaattagaccattt

SEQ ID NO: 194294 - DNA, 20 bp, Artificial Sequence
  Description of Artificial Sequence: Synthetic oligonucleotide
  Target: ATXN1; (-) strand; PAM type: YTN; PAM sequence: TTT
tccaaagaaattagaccatt

SEQ ID NO: 194295 - DNA, 20 bp, Artificial Sequence
  Description of Artificial Sequence: Synthetic oligonucleotide
  Target: ATXN1; (-) strand; PAM type: YTN; PAM sequence: TTC
cagttttccaaagaaattag

SEQ ID NO: 194296 - DNA, 20 bp, Artificial Sequence
  Description of Artificial Sequence: Synthetic oligonucleotide
  Target: ATXN1; (-) strand; PAM type: YTN; PAM sequence: CTA
ttccagttttccaaagaaat

SEQ ID NO: 194297 - DNA, 20 bp, Artificial Sequence
  Description of Artificial Sequence: Synthetic oligonucleotide
  Target: ATXN1; (-) strand; PAM type: YTN; PAM sequence: TTC
tattccagttttccaaagaa

SEQ ID NO: 194298 - DNA, 20 bp, Artificial Sequence
  Description of Artificial Sequence: Synthetic oligonucleotide
  Target: ATXN1; (-) strand; PAM type: YTN; PAM sequence: TTT
ctattccagttttccaaaga

SEQ ID NO: 194299 - DNA, 20 bp, Artificial Sequence
  Description of Artificial Sequence: Synthetic oligonucleotide
  Target: ATXN1; (-) strand; PAM type: YTN; PAM sequence: TTT
tctattccagttttccaaag

SEQ ID NO: 194300 - DNA, 20 bp, Artificial Sequence
  Description of Artificial Sequence: Synthetic oligonucleotide
  Target: ATXN1; (-) strand; PAM type: YTN; PAM sequence: TTT
ttctattccagttttccaaa

SEQ ID NO: 194301 - DNA, 20 bp, Artificial Sequence
  Description of Artificial Sequence: Synthetic oligonucleotide
  Target: ATXN1; (-) strand; PAM type: YTN; PAM sequence: TTT
tttctattccagttttccaa

SEQ ID NO: 194302 - DNA, 20 bp, Artificial Sequence
  Description of Artificial Sequence: Synthetic oligonucleotide
  Target: ATXN1; (-) strand; PAM type: YTN; PAM sequence: TTT
ttttctattccagttttcca

SEQ ID NO: 194303 - DNA, 20 bp, Artificial Sequence
  Description of Artificial Sequence: Synthetic oligonucleotide
  Target: ATXN1; (-) strand; PAM type: YTN; PAM sequence: CTT
tttttctattccagttttcc

SEQ ID NO: 194304 - DNA, 20 bp, Artificial Sequence
  Description of Artificial Sequence: Synthetic oligonucleotide
  Target: ATXN1; (-) strand; PAM type: YTN; PAM sequence: TTA
aaaaatctttttttctattc

SEQ ID NO: 194305 - DNA, 20 bp, Artificial Sequence
  Description of Artificial Sequence: Synthetic oligonucleotide
  Target: ATXN1; (-) strand; PAM type: YTN; PAM sequence: TTT
aaaaaatctttttttctatt

SEQ ID NO: 194306 - DNA, 20 bp, Artificial Sequence
  Description of Artificial Sequence: Synthetic oligonucleotide
  Target: ATXN1; (-) strand; PAM type: YTN; PAM sequence: TTT
taaaaaatctttttttctat

SEQ ID NO: 194307 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaatctttttttcta

SEQ ID NO: 194308 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaatctttttttct

SEQ ID NO: 194309 - DNA, 20 bp, Artificial Sequence
  Description of Artificial Sequence: Synthetic oligonucleotide
  Target: ATXN1; (-) strand; PAM type: YTN; PAM sequence: TTT
ttttaaaaaatctttttttc

SEQ ID NO: 194310 - DNA, 20 bp, Artificial Sequence
  Description of Artificial Sequence: Synthetic oligonucleotide
  Target: ATXN1; (-) strand; PAM type: YTN; PAM sequence: TTA
atttttttaaaaaatctttt

SEQ ID NO: 194311 - DNA, 20 bp, Artificial Sequence
  Description of Artificial Sequence: Synthetic oligonucleotide
  Target: ATXN1; (-) strand; PAM type: YTN; PAM sequence: TTA
ttaatttttttaaaaaatct

SEQ ID NO: 194312 - DNA, 20 bp, Artificial Sequence
  Description of Artificial Sequence: Synthetic oligonucleotide
  Target: ATXN1; (-) strand; PAM type: YTN; PAM sequence: TTA
gagaatggagttattaattt

SEQ ID NO: 194313 - DNA, 20 bp, Artificial Sequence
  Description of Artificial Sequence: Synthetic oligonucleotide
  Target: ATXN1; (-) strand; PAM type: YTN; PAM sequence: TTT
agagaatggagttattaatt

SEQ ID NO: 194314 - DNA, 20 bp, Artificial Sequence
  Description of Artificial Sequence: Synthetic oligonucleotide
  Target: ATXN1; (-) strand; PAM type: YTN; PAM sequence: CTG
atttagagaatggagttatt

SEQ ID NO: 194315 - DNA, 20 bp, Artificial Sequence
  Description of Artificial Sequence: Synthetic oligonucleotide
  Target: ATXN1; (-) strand; PAM type: YTN; PAM sequence: TTG
gactgatttagagaatggag

SEQ ID NO: 194316 - DNA, 20 bp, Artificial Sequence
  Description of Artificial Sequence: Synthetic oligonucleotide
  Target: ATXN1; (-) strand; PAM type: YTN; PAM sequence: TTT
ggactgatttagagaatgga

SEQ ID NO: 194317 - DNA, 20 bp, Artificial Sequence
  Description of Artificial Sequence: Synthetic oligonucleotide
  Target: ATXN1; (-) strand; PAM type: YTN; PAM sequence: CTC
atttggactgatttagagaa

SEQ ID NO: 194318 - DNA, 20 bp, Artificial Sequence
  Description of Artificial Sequence: Synthetic oligonucleotide
  Target: ATXN1; (-) strand; PAM type: YTN; PAM sequence: CTG
ctcatttggactgatttaga

SEQ ID NO: 194319 - DNA, 20 bp, Artificial Sequence
  Description of Artificial Sequence: Synthetic oligonucleotide
  Target: ATXN1; (-) strand; PAM type: YTN; PAM sequence: CTA
ggcctgctcatttggactga

SEQ ID NO: 194320 - DNA, 20 bp, Artificial Sequence
  Description of Artificial Sequence: Synthetic oligonucleotide
  Target: ATXN1; (-) strand; PAM type: YTN; PAM sequence: CTC
taggcctgctcatttggact

SEQ ID NO: 194321 - DNA, 20 bp, Artificial Sequence
  Description of Artificial Sequence: Synthetic oligonucleotide
  Target: ATXN1; (-) strand; PAM type: YTN; PAM sequence: TTA
tcacctctaggcctgctcat

SEQ ID NO: 194322 - DNA, 20 bp, Artificial Sequence
  Description of Artificial Sequence: Synthetic oligonucleotide
  Target: ATXN1; (-) strand; PAM type: YTN; PAM sequence: CTT
atcacctctaggcctgctca

SEQ ID NO: 194323 - DNA, 20 bp, Artificial Sequence
  Description of Artificial Sequence: Synthetic oligonucleotide
  Target: ATXN1; (-) strand; PAM type: YTN; PAM sequence: TTC
ttatcacctctaggcctgct

SEQ ID NO: 194324 - DNA, 20 bp, Artificial Sequence
  Description of Artificial Sequence: Synthetic oligonucleotide
  Target: ATXN1; (-) strand; PAM type: YTN; PAM sequence: TTT
cttatcacctctaggcctgc

SEQ ID NO: 194325 - DNA, 20 bp, Artificial Sequence
  Description of Artificial Sequence: Synthetic oligonucleotide
  Target: ATXN1; (-) strand; PAM type: YTN; PAM sequence: CTG
gaatttcttatcacctctag

SEQ ID NO: 194326 - DNA, 20 bp, Artificial Sequence
  Description of Artificial Sequence: Synthetic oligonucleotide
  Target: ATXN1; (-) strand; PAM type: YTN; PAM sequence: CTA
ggggctggaatttcttatca

SEQ ID NO: 194327 - DNA, 20 bp, Artificial Sequence
  Description of Artificial Sequence: Synthetic oligonucleotide
  Target: ATXN1; (-) strand; PAM type: YTN; PAM sequence: CTA
ataaaggccaaagtgctagg

SEQ ID NO: 194328 - DNA, 20 bp, Artificial Sequence
  Description of Artificial Sequence: Synthetic oligonucleotide
  Target: ATXN1; (-) strand; PAM type: YTN; PAM sequence: TTG
tgcacctaataaaggccaaa

SEQ ID NO: 194329 - DNA, 20 bp, Artificial Sequence
  Description of Artificial Sequence: Synthetic oligonucleotide
  Target: ATXN1; (-) strand; PAM type: YTN; PAM sequence: TTA
ttgtgcacctaataaaggcc

SEQ ID NO: 194330 - DNA, 20 bp, Artificial Sequence
  Description of Artificial Sequence: Synthetic oligonucleotide
  Target: ATXN1; (-) strand; PAM type: YTN; PAM sequence: TTT
attgtgcacctaataaaggc

SEQ ID NO: 194331 - DNA, 20 bp, Artificial Sequence
  Description of Artificial Sequence: Synthetic oligonucleotide
  Target: ATXN1; (-) strand; PAM type: YTN; PAM sequence: TTC
agacatttattgtgcaccta

SEQ ID NO: 194332 - DNA, 20 bp, Artificial Sequence
  Description of Artificial Sequence: Synthetic oligonucleotide
  Target: ATXN1; (-) strand; PAM type: YTN; PAM sequence: CTT
cagacatttattgtgcacct

SEQ ID NO: 194333 - DNA, 20 bp, Artificial Sequence
  Description of Artificial Sequence: Synthetic oligonucleotide
  Target: ATXN1; (-) strand; PAM type: YTN; PAM sequence: TTC
ttcagacatttattgtgcac

SEQ ID NO: 194334 - DNA, 20 bp, Artificial Sequence
  Description of Artificial Sequence: Synthetic oligonucleotide
  Target: ATXN1; (-) strand; PAM type: YTN; PAM sequence: TTG
ttcttcagacatttattgtg

SEQ ID NO: 194335 - DNA, 20 bp, Artificial Sequence
  Description of Artificial Sequence: Synthetic oligonucleotide
  Target: ATXN1; (-) strand; PAM type: YTN; PAM sequence: CTA
ttgttcttcagacatttatt

SEQ ID NO: 194336 - DNA, 20 bp, Artificial Sequence
  Description of Artificial Sequence: Synthetic oligonucleotide
  Target: ATXN1; (-) strand; PAM type: YTN; PAM sequence: TTC
atatagtcagccaaataatc

SEQ ID NO: 194337 - DNA, 20 bp, Artificial Sequence
  Description of Artificial Sequence: Synthetic oligonucleotide
  Target: ATXN1; (-) strand; PAM type: YTN; PAM sequence: TTA
aaattcatatagtcagccaa

SEQ ID NO: 194338 - DNA, 20 bp, Artificial Sequence
  Description of Artificial Sequence: Synthetic oligonucleotide
  Target: ATXN1; (-) strand; PAM type: YTN; PAM sequence: TTT
aaaattcatatagtcagcca

SEQ ID NO: 194339 - DNA, 20 bp, Artificial Sequence
  Description of Artificial Sequence: Synthetic oligonucleotide
  Target: ATXN1; (-) strand; PAM type: YTN; PAM sequence: TTT
taaaattcatatagtcagcc

SEQ ID NO: 194340 - DNA, 20 bp, Artificial Sequence
  Description of Artificial Sequence: Synthetic oligonucleotide
  Target: ATXN1; (-) strand; PAM type: YTN; PAM sequence: CTT
ttaaaattcatatagtcagc

SEQ ID NO: 194341 - DNA, 20 bp, Artificial Sequence
  Description of Artificial Sequence: Synthetic oligonucleotide
  Target: ATXN1; (-) strand; PAM type: YTN; PAM sequence: CTG
cttttaaaattcatatagtc

SEQ ID NO: 194342 - DNA, 20 bp, Artificial Sequence
  Description of Artificial Sequence: Synthetic oligonucleotide
  Target: ATXN1; (-) strand; PAM type: YTN; PAM sequence: CTC
tgcttttaaaattcatatag

SEQ ID NO: 194343 - DNA, 20 bp, Artificial Sequence
  Description of Artificial Sequence: Synthetic oligonucleotide
  Target: ATXN1; (-) strand; PAM type: YTN; PAM sequence: TTC
aaagctctgcttttaaaatt

SEQ ID NO: 194344 - DNA, 20 bp, Artificial Sequence
  Description of Artificial Sequence: Synthetic oligonucleotide
  Target: ATXN1; (-) strand; PAM type: YTN; PAM sequence: TTG
ttcaaagctctgcttttaaa

SEQ ID NO: 194345 - DNA, 20 bp, Artificial Sequence
  Description of Artificial Sequence: Synthetic oligonucleotide
  Target: ATXN1; (-) strand; PAM type: YTN; PAM sequence: TTG
attgttcaaagctctgcttt

SEQ ID NO: 194346 - DNA, 20 bp, Artificial Sequence
  Description of Artificial Sequence: Synthetic oligonucleotide
  Target: ATXN1; (-) strand; PAM type: YTN; PAM sequence: CTA
catattgattgttcaaagct

SEQ ID NO: 194347 - DNA, 20 bp, Artificial Sequence
  Description of Artificial Sequence: Synthetic oligonucleotide
  Target: ATXN1; (-) strand; PAM type: YTN; PAM sequence: CTC
tacatattgattgttcaaag

SEQ ID NO: 194348 - DNA, 20 bp, Artificial Sequence
  Description of Artificial Sequence: Synthetic oligonucleotide
  Target: ATXN1; (-) strand; PAM type: YTN; PAM sequence: TTC
tctacatattgattgttcaa

SEQ ID NO: 194349 - DNA, 20 bp, Artificial Sequence
  Description of Artificial Sequence: Synthetic oligonucleotide
  Target: ATXN1; (-) strand; PAM type: YTN; PAM sequence: TTG
ttctctacatattgattgtt

SEQ ID NO: 194350 - DNA, 20 bp, Artificial Sequence
  Description of Artificial Sequence: Synthetic oligonucleotide
  Target: ATXN1; (-) strand; PAM type: YTN; PAM sequence: CTG
tgattgttctctacatattg

SEQ ID NO: 194351 - DNA, 20 bp, Artificial Sequence
  Description of Artificial Sequence: Synthetic oligonucleotide
  Target: ATXN1; (-) strand; PAM type: YTN; PAM sequence: CTC
atgataaatgaatcatgcct

SEQ ID NO: 194352 - DNA, 20 bp, Artificial Sequence
  Description of Artificial Sequence: Synthetic oligonucleotide
  Target: ATXN1; (-) strand; PAM type: YTN; PAM sequence: TTG
tcacaaggaccatacatctc

SEQ ID NO: 194353 - DNA, 20 bp, Artificial Sequence
  Description of Artificial Sequence: Synthetic oligonucleotide
  Target: ATXN1; (-) strand; PAM type: YTN; PAM sequence: CTT
gtcacaaggaccatacatct

SEQ ID NO: 194354 - DNA, 20 bp, Artificial Sequence
  Description of Artificial Sequence: Synthetic oligonucleotide
  Target: ATXN1; (-) strand; PAM type: YTN; PAM sequence: CTC
cttgtcacaaggaccataca

SEQ ID NO: 194355 - DNA, 20 bp, Artificial Sequence
  Description of Artificial Sequence: Synthetic oligonucleotide
  Target: ATXN1; (-) strand; PAM type: YTN; PAM sequence: TTG
ggcaccacaatatggactcc

SEQ ID NO: 194356 - DNA, 20 bp, Artificial Sequence
  Description of Artificial Sequence: Synthetic oligonucleotide
  Target: ATXN1; (-) strand; PAM type: YTN; PAM sequence: CTT
gggcaccacaatatggactc

SEQ ID NO: 194357 - DNA, 20 bp, Artificial Sequence
  Description of Artificial Sequence: Synthetic oligonucleotide
  Target: ATXN1; (-) strand; PAM type: YTN; PAM sequence: TTC
ttgggcaccacaatatggac

SEQ ID NO: 194358 - DNA, 20 bp, Artificial Sequence
  Description of Artificial Sequence: Synthetic oligonucleotide
  Target: ATXN1; (-) strand; PAM type: YTN; PAM sequence: TTT
cttgggcaccacaatatgga

SEQ ID NO: 194359 - DNA, 20 bp, Artificial Sequence
  Description of Artificial Sequence: Synthetic oligonucleotide
  Target: ATXN1; (-) strand; PAM type: YTN; PAM sequence: TTG
atttcttgggcaccacaata

SEQ ID NO: 194360 - DNA, 20 bp, Artificial Sequence
  Description of Artificial Sequence: Synthetic oligonucleotide
  Target: ATXN1; (-) strand; PAM type: YTN; PAM sequence: CTA
aaaaattgatttcttgggca

SEQ ID NO: 194361 - DNA, 20 bp, Artificial Sequence
  Description of Artificial Sequence: Synthetic oligonucleotide
  Target: ATXN1; (-) strand; PAM type: YTN; PAM sequence: TTA
agaaaggcacctaaaaaatt

SEQ ID NO: 194362 - DNA, 20 bp, Artificial Sequence
  Description of Artificial Sequence: Synthetic oligonucleotide
  Target: ATXN1; (-) strand; PAM type: YTN; PAM sequence: TTT
aagaaaggcacctaaaaaat

SEQ ID NO: 194363 - DNA, 20 bp, Artificial Sequence
  Description of Artificial Sequence: Synthetic oligonucleotide
  Target: ATXN1; (-) strand; PAM type: YTN; PAM sequence: TTT
taagaaaggcacctaaaaaa

SEQ ID NO: 194364 - DNA, 20 bp, Artificial Sequence
  Description of Artificial Sequence: Synthetic oligonucleotide
  Target: ATXN1; (-) strand; PAM type: YTN; PAM sequence: TTC
aataagcatcatggtgggca

SEQ ID NO: 194365 - DNA, 20 bp, Artificial Sequence
  Description of Artificial Sequence: Synthetic oligonucleotide
  Target: ATXN1; (-) strand; PAM type: YTN; PAM sequence: CTT
caataagcatcatggtgggc

SEQ ID NO: 194366 - DNA, 20 bp, Artificial Sequence
  Description of Artificial Sequence: Synthetic oligonucleotide
  Target: ATXN1; (-) strand; PAM type: YTN; PAM sequence: TTC
ttcaataagcatcatggtgg

SEQ ID NO: 194367 - DNA, 20 bp, Artificial Sequence
  Description of Artificial Sequence: Synthetic oligonucleotide
  Target: ATXN1; (-) strand; PAM type: YTN; PAM sequence: CTT
cttcaataagcatcatggtg

SEQ ID NO: 194368 - DNA, 20 bp, Artificial Sequence
  Description of Artificial Sequence: Synthetic oligonucleotide
  Target: ATXN1; (-) strand; PAM type: YTN; PAM sequence: TTC
aaaaaaatacaaaaaaagac

SEQ ID NO: 194369 - DNA, 20 bp, Artificial Sequence
  Description of Artificial Sequence: Synthetic oligonucleotide
  Target: ATXN1; (-) strand; PAM type: YTN; PAM sequence: CTT
caaaaaaatacaaaaaaaga

SEQ ID NO: 194370 - DNA, 20 bp, Artificial Sequence
  Description of Artificial Sequence: Synthetic oligonucleotide
  Target: ATXN1; (-) strand; PAM type: YTN; PAM sequence: TTA
cttcaaaaaaatacaaaaaa

SEQ ID NO: 194371 - DNA, 20 bp, Artificial Sequence
  Description of Artificial Sequence: Synthetic oligonucleotide
  Target: ATXN1; (-) strand; PAM type: YTN; PAM sequence: CTA
cagaaacattacttcaaaaa

SEQ ID NO: 194372 - DNA, 20 bp, Artificial Sequence
  Description of Artificial Sequence: Synthetic oligonucleotide
  Target: ATXN1; (-) strand; PAM type: YTN; PAM sequence: CTC
tacagaaacattacttcaaa

SEQ ID NO: 194373 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagtgagacccca

SEQ ID NO: 194374 - DNA, 20 bp, Artificial Sequence
  Description of Artificial Sequence: Synthetic oligonucleotide
  Target: ATXN1; (-) strand; PAM type: YTN; PAM sequence: TTC
aagaccagcctgggcaacat

SEQ ID NO: 194375 - DNA, 20 bp, Artificial Sequence
  Description of Artificial Sequence: Synthetic oligonucleotide
  Target: ATXN1; (-) strand; PAM type: YTN; PAM sequence: TTG
aggccaggagttcaagacca

SEQ ID NO: 194376 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagttcaagacc

SEQ ID NO: 194377 - DNA, 20 bp, Artificial Sequence
  Description of Artificial Sequence: Synthetic oligonucleotide
  Target: ATXN1; (-) strand; PAM type: YTN; PAM sequence: CTG
aggtggaaggagcgcttgag

SEQ ID NO: 194378 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggtggaaggag

SEQ ID NO: 194379 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggtggaagga

SEQ ID NO: 194380 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggtggaagg

SEQ ID NO: 194381 - DNA, 20 bp, Artificial Sequence
  Description of Artificial Sequence: Synthetic oligonucleotide
  Target: ATXN1; (-) strand; PAM type: YTN; PAM sequence: CTG
taatcccaacactttgggag

SEQ ID NO: 194382 - DNA, 20 bp, Artificial Sequence
  Description of Artificial Sequence: Synthetic oligonucleotide
  Target: ATXN1; (-) strand; PAM type: YTN; PAM sequence: CTC
aaacctgtaatcccaacact

SEQ ID NO: 194383 - DNA, 20 bp, Artificial Sequence
  Description of Artificial Sequence: Synthetic oligonucleotide
  Target: ATXN1; (-) strand; PAM type: YTN; PAM sequence: CTG
ggtacgatggctcaaacctg

SEQ ID NO: 194384 - DNA, 20 bp, Artificial Sequence
  Description of Artificial Sequence: Synthetic oligonucleotide
  Target: ATXN1; (-) strand; PAM type: YTN; PAM sequence: CTC
aaaaaaataaaacacggctg

SEQ ID NO: 194385 - DNA, 20 bp, Artificial Sequence
  Description of Artificial Sequence: Synthetic oligonucleotide
  Target: ATXN1; (-) strand; PAM type: YTN; PAM sequence: CTA
tctcaaaaaaataaaacacg

SEQ ID NO: 194386 - DNA, 20 bp, Artificial Sequence
  Description of Artificial Sequence: Synthetic oligonucleotide
  Target: ATXN1; (-) strand; PAM type: YTN; PAM sequence: CTA
tgacaaacccgggtaacaaa

SEQ ID NO: 194387 - DNA, 20 bp, Artificial Sequence
  Description of Artificial Sequence: Synthetic oligonucleotide
  Target: ATXN1; (-) strand; PAM type: YTN; PAM sequence: CTA
taaaatgggcacggatctat

SEQ ID NO: 194388 - DNA, 20 bp, Artificial Sequence
  Description of Artificial Sequence: Synthetic oligonucleotide
  Target: ATXN1; (-) strand; PAM type: YTN; PAM sequence: TTC
cagctataaaatgggcacgg

SEQ ID NO: 194389 - DNA, 20 bp, Artificial Sequence
  Description of Artificial Sequence: Synthetic oligonucleotide
  Target: ATXN1; (-) strand; PAM type: YTN; PAM sequence: TTT
ccagctataaaatgggcacg

SEQ ID NO: 194390 - DNA, 20 bp, Artificial Sequence
  Description of Artificial Sequence: Synthetic oligonucleotide
  Target: ATXN1; (-) strand; PAM type: YTN; PAM sequence: CTC
agggtttccagctataaaat

SEQ ID NO: 194391 - DNA, 20 bp, Artificial Sequence
  Description of Artificial Sequence: Synthetic oligonucleotide
  Target: ATXN1; (-) strand; PAM type: YTN; PAM sequence: CTG
ggcctcagggtttccagcta

SEQ ID NO: 194392 - DNA, 20 bp, Artificial Sequence
  Description of Artificial Sequence: Synthetic oligonucleotide
  Target: ATXN1; (-) strand; PAM type: YTN; PAM sequence: CTC
agtcccctgggcctcagggt

SEQ ID NO: 194393 - DNA, 20 bp, Artificial Sequence
  Description of Artificial Sequence: Synthetic oligonucleotide
  Target: ATXN1; (-) strand; PAM type: YTN; PAM sequence: CTC
acagccatgtgcacgtgagc

SEQ ID NO: 194394 - DNA, 20 bp, Artificial Sequence
  Description of Artificial Sequence: Synthetic oligonucleotide
  Target: ATXN1; (-) strand; PAM type: YTN; PAM sequence: CTG
ccactcacagccatgtgcac

SEQ ID NO: 194395 - DNA, 20 bp, Artificial Sequence
  Description of Artificial Sequence: Synthetic oligonucleotide
  Target: ATXN1; (-) strand; PAM type: YTN; PAM sequence: CTC
tgccactcacagccatgtgc

SEQ ID NO: 194396 - DNA, 20 bp, Artificial Sequence
  Description of Artificial Sequence: Synthetic oligonucleotide
  Target: ATXN1; (-) strand; PAM type: YTN; PAM sequence: CTC
agctctgccactcacagcca

SEQ ID NO: 194397 - DNA, 20 bp, Artificial Sequence
  Description of Artificial Sequence: Synthetic oligonucleotide
  Target: ATXN1; (-) strand; PAM type: YTN; PAM sequence: CTG
agctcagctctgccactcac

SEQ ID NO: 194398 - DNA, 20 bp, Artificial Sequence
  Description of Artificial Sequence: Synthetic oligonucleotide
  Target: ATXN1; (-) strand; PAM type: YTN; PAM sequence: TTG
gagggaggatcccagggtct

SEQ ID NO: 194399 - DNA, 20 bp, Artificial Sequence
  Description of Artificial Sequence: Synthetic oligonucleotide
  Target: ATXN1; (-) strand; PAM type: YTN; PAM sequence: TTT
ggagggaggatcccagggtc

SEQ ID NO: 194400 - DNA, 20 bp, Artificial Sequence
  Description of Artificial Sequence: Synthetic oligonucleotide
  Target: ATXN1; (-) strand; PAM type: YTN; PAM sequence: CTT
tggagggaggatcccagggt

SEQ ID NO: 194401 - DNA, 20 bp, Artificial Sequence
  Description of Artificial Sequence: Synthetic oligonucleotide
  Target: ATXN1; (-) strand; PAM type: YTN; PAM sequence: TTC
ccccatgagagggactttgg

SEQ ID NO: 194402 - DNA, 20 bp, Artificial Sequence
  Description of Artificial Sequence: Synthetic oligonucleotide
  Target: ATXN1; (-) strand; PAM type: YTN; PAM sequence: CTG
aattcccccatgagagggac

SEQ ID NO: 194403 - DNA, 20 bp, Artificial Sequence
  Description of Artificial Sequence: Synthetic oligonucleotide
  Target: ATXN1; (-) strand; PAM type: YTN; PAM sequence: CTA
tgatggcatccccatccacg

SEQ ID NO: 194404 - DNA, 20 bp, Artificial Sequence
  Description of Artificial Sequence: Synthetic oligonucleotide
  Target: ATXN1; (-) strand; PAM type: YTN; PAM sequence: CTG
cagtgagctatgatggcatc

SEQ ID NO: 194405 - DNA, 20 bp, Artificial Sequence
  Description of Artificial Sequence: Synthetic oligonucleotide
  Target: ATXN1; (-) strand; PAM type: YTN; PAM sequence: TTG
gaggctgcagtgagctatga

SEQ ID NO: 194406 - DNA, 20 bp, Artificial Sequence
  Description of Artificial Sequence: Synthetic oligonucleotide
  Target: ATXN1; (-) strand; PAM type: YTN; PAM sequence: CTA
ggagttggaggctgcagtga

SEQ ID NO: 194407 - DNA, 20 bp, Artificial Sequence
  Description of Artificial Sequence: Synthetic oligonucleotide
  Target: ATXN1; (-) strand; PAM type: YTN; PAM sequence: TTG
agtctaggagttggaggctg

SEQ ID NO: 194408 - DNA, 20 bp, Artificial Sequence
  Description of Artificial Sequence: Synthetic oligonucleotide
  Target: ATXN1; (-) strand; PAM type: YTN; PAM sequence: TTT
gagtctaggagttggaggct

SEQ ID NO: 194409 - DNA, 20 bp, Artificial Sequence
  Description of Artificial Sequence: Synthetic oligonucleotide
  Target: ATXN1; (-) strand; PAM type: YTN; PAM sequence: CTA
aggcaggagtttgagtctag

SEQ ID NO: 194410 - DNA, 20 bp, Artificial Sequence
  Description of Artificial Sequence: Synthetic oligonucleotide
  Target: ATXN1; (-) strand; PAM type: YTN; PAM sequence: TTG
gcggctaaggcaggagtttg

SEQ ID NO: 194411 - DNA, 20 bp, Artificial Sequence
  Description of Artificial Sequence: Synthetic oligonucleotide
  Target: ATXN1; (-) strand; PAM type: YTN; PAM sequence: CTT
ggcggctaaggcaggagttt

SEQ ID NO: 194412 - DNA, 20 bp, Artificial Sequence
  Description of Artificial Sequence: Synthetic oligonucleotide
  Target: ATXN1; (-) strand; PAM type: YTN; PAM sequence: CTA
cttggcggctaaggcaggag

SEQ ID NO: 194413 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttggcgg

SEQ ID NO: 194414 - DNA, 20 bp, Artificial Sequence
  Description of Artificial Sequence: Synthetic oligonucleotide
  Target: ATXN1; (-) strand; PAM type: YTN; PAM sequence: TTA
atccaggtgtggtggcacat

SEQ ID NO: 194415 - DNA, 20 bp, Artificial Sequence
  Description of Artificial Sequence: Synthetic oligonucleotide
  Target: ATXN1; (-) strand; PAM type: YTN; PAM sequence: TTT
aatccaggtgtggtggcaca

SEQ ID NO: 194416 - DNA, 20 bp, Artificial Sequence
  Description of Artificial Sequence: Synthetic oligonucleotide
  Target: ATXN1; (-) strand; PAM type: YTN; PAM sequence: TTT
taatccaggtgtggtggcac

SEQ ID NO: 194417 - DNA, 20 bp, Artificial Sequence
  Description of Artificial Sequence: Synthetic oligonucleotide
  Target: ATXN1; (-) strand; PAM type: YTN; PAM sequence: CTC
cgcaaataaagaaaaaacac

SEQ ID NO: 194418 - DNA, 20 bp, Artificial Sequence
  Description of Artificial Sequence: Synthetic oligonucleotide
  Target: ATXN1; (-) strand; PAM type: YTN; PAM sequence: CTC
catctccgcaaataaagaaa

SEQ ID NO: 194419 - DNA, 20 bp, Artificial Sequence
  Description of Artificial Sequence: Synthetic oligonucleotide
  Target: ATXN1; (-) strand; PAM type: YTN; PAM sequence: CTG
gcaatgtagcaaaactccat

SEQ ID NO: 194420 - DNA, 20 bp, Artificial Sequence
  Description of Artificial Sequence: Synthetic oligonucleotide
  Target: ATXN1; (-) strand; PAM type: YTN; PAM sequence: TTC
acagcctggcaatgtagcaa

SEQ ID NO: 194421 - DNA, 20 bp, Artificial Sequence
  Description of Artificial Sequence: Synthetic oligonucleotide
  Target: ATXN1; (-) strand; PAM type: YTN; PAM sequence: CTT
cacagcctggcaatgtagca

SEQ ID NO: 194422 - DNA, 20 bp, Artificial Sequence
  Description of Artificial Sequence: Synthetic oligonucleotide
  Target: ATXN1; (-) strand; PAM type: YTN; PAM sequence: TTC
ttcacagcctggcaatgtag

SEQ ID NO: 194423 - DNA, 20 bp, Artificial Sequence
  Description of Artificial Sequence: Synthetic oligonucleotide
  Target: ATXN1; (-) strand; PAM type: YTN; PAM sequence: CTT
cttcacagcctggcaatgta

SEQ ID NO: 194424 - DNA, 20 bp, Artificial Sequence
  Description of Artificial Sequence: Synthetic oligonucleotide
  Target: ATXN1; (-) strand; PAM type: YTN; PAM sequence: TTA
agacttcttcacagcctggc

SEQ ID NO: 194425 - DNA, 20 bp, Artificial Sequence
  Description of Artificial Sequence: Synthetic oligonucleotide
  Target: ATXN1; (-) strand; PAM type: YTN; PAM sequence: TTA
ttaagacttcttcacagcct

SEQ ID NO: 194426 - DNA, 20 bp, Artificial Sequence
  Description of Artificial Sequence: Synthetic oligonucleotide
  Target: ATXN1; (-) strand; PAM type: YTN; PAM sequence: TTT
attaagacttcttcacagcc

SEQ ID NO: 194427 - DNA, 20 bp, Artificial Sequence
  Description of Artificial Sequence: Synthetic oligonucleotide
  Target: ATXN1; (-) strand; PAM type: YTN; PAM sequence: TTA
tttattaagacttcttcaca

SEQ ID NO: 194428 - DNA, 20 bp, Artificial Sequence
  Description of Artificial Sequence: Synthetic oligonucleotide
  Target: ATXN1; (-) strand; PAM type: YTN; PAM sequence: TTG
gttatttattaagacttctt

SEQ ID NO: 194429 - DNA, 20 bp, Artificial Sequence
  Description of Artificial Sequence: Synthetic oligonucleotide
  Target: ATXN1; (-) strand; PAM type: YTN; PAM sequence: TTT
ggttatttattaagacttct

SEQ ID NO: 194430 - DNA, 20 bp, Artificial Sequence
  Description of Artificial Sequence: Synthetic oligonucleotide
  Target: ATXN1; (-) strand; PAM type: YTN; PAM sequence: CTT
tggttatttattaagacttc

SEQ ID NO: 194431 - DNA, 20 bp, Artificial Sequence
  Description of Artificial Sequence: Synthetic oligonucleotide
  Target: ATXN1; (-) strand; PAM type: YTN; PAM sequence: TTG
ggaaagagcaaagtgcagga

SEQ ID NO: 194432 - DNA, 20 bp, Artificial Sequence
  Description of Artificial Sequence: Synthetic oligonucleotide
  Target: ATXN1; (-) strand; PAM type: YTN; PAM sequence: TTT
gggaaagagcaaagtgcagg

SEQ ID NO: 194433 - DNA, 20 bp, Artificial Sequence
  Description of Artificial Sequence: Synthetic oligonucleotide
  Target: ATXN1; (-) strand; PAM type: YTN; PAM sequence: TTT
tgggaaagagcaaagtgcag

SEQ ID NO: 194434 - DNA, 20 bp, Artificial Sequence
  Description of Artificial Sequence: Synthetic oligonucleotide
  Target: ATXN1; (-) strand; PAM type: YTN; PAM sequence: CTG
tgggtataccattttgggaa

SEQ ID NO: 194435 - DNA, 20 bp, Artificial Sequence
  Description of Artificial Sequence: Synthetic oligonucleotide
  Target: ATXN1; (-) strand; PAM type: YTN; PAM sequence: CTG
cagggagtgaagctgtgggt

SEQ ID NO: 194436 - DNA, 20 bp, Artificial Sequence
  Description of Artificial Sequence: Synthetic oligonucleotide
  Target: ATXN1; (-) strand; PAM type: YTN; PAM sequence: TTA
catacagatcactgcaggga

SEQ ID NO: 194437 - DNA, 20 bp, Artificial Sequence
  Description of Artificial Sequence: Synthetic oligonucleotide
  Target: ATXN1; (-) strand; PAM type: YTN; PAM sequence: CTA
attacatacagatcactgca

SEQ ID NO: 194438 - DNA, 20 bp, Artificial Sequence
  Description of Artificial Sequence: Synthetic oligonucleotide
  Target: ATXN1; (-) strand; PAM type: YTN; PAM sequence: TTC
ccatatgagcctaattacat

SEQ ID NO: 194439 - DNA, 20 bp, Artificial Sequence
  Description of Artificial Sequence: Synthetic oligonucleotide
  Target: ATXN1; (-) strand; PAM type: YTN; PAM sequence: CTG
ccaagtccacattcccatat

SEQ ID NO: 194440 - DNA, 20 bp, Artificial Sequence
  Description of Artificial Sequence: Synthetic oligonucleotide
  Target: ATXN1; (-) strand; PAM type: YTN; PAM sequence: CTC
tgccaagtccacattcccat

SEQ ID NO: 194441 - DNA, 20 bp, Artificial Sequence
  Description of Artificial Sequence: Synthetic oligonucleotide
  Target: ATXN1; (-) strand; PAM type: YTN; PAM sequence: CTC
cagcgcccctctgccaagtc

SEQ ID NO: 194442 - DNA, 20 bp, Artificial Sequence
  Description of Artificial Sequence: Synthetic oligonucleotide
  Target: ATXN1; (-) strand; PAM type: YTN; PAM sequence: CTG
atatgtggcctccagcgccc

SEQ ID NO: 194443 - DNA, 20 bp, Artificial Sequence
  Description of Artificial Sequence: Synthetic oligonucleotide
  Target: ATXN1; (-) strand; PAM type: YTN; PAM sequence: CTC
agtcagcctgatatgtggcc

SEQ ID NO: 194444 - DNA, 20 bp, Artificial Sequence
  Description of Artificial Sequence: Synthetic oligonucleotide
  Target: ATXN1; (-) strand; PAM type: YTN; PAM sequence: TTA
ctcagtcagcctgatatgtg

SEQ ID NO: 194445 - DNA, 20 bp, Artificial Sequence
  Description of Artificial Sequence: Synthetic oligonucleotide
  Target: ATXN1; (-) strand; PAM type: YTN; PAM sequence: CTC
acgggattactcagtcagcc

SEQ ID NO: 194446 - DNA, 20 bp, Artificial Sequence
  Description of Artificial Sequence: Synthetic oligonucleotide
  Target: ATXN1; (-) strand; PAM type: YTN; PAM sequence: TTC
ctcacgggattactcagtca

SEQ ID NO: 194447 - DNA, 20 bp, Artificial Sequence
  Description of Artificial Sequence: Synthetic oligonucleotide
  Target: ATXN1; (-) strand; PAM type: YTN; PAM sequence: CTT
cctcacgggattactcagtc

SEQ ID NO: 194448 - DNA, 20 bp, Artificial Sequence
  Description of Artificial Sequence: Synthetic oligonucleotide
  Target: ATXN1; (-) strand; PAM type: YTN; PAM sequence: CTG
tggcttcctcacgggattac

SEQ ID NO: 194449 - DNA, 20 bp, Artificial Sequence
  Description of Artificial Sequence: Synthetic oligonucleotide
  Target: ATXN1; (-) strand; PAM type: YTN; PAM sequence: CTC
agacactgtggcttcctcac

SEQ ID NO: 194450 - DNA, 20 bp, Artificial Sequence
  Description of Artificial Sequence: Synthetic oligonucleotide
  Target: ATXN1; (-) strand; PAM type: YTN; PAM sequence: TTG
gcccgtcagtatctcagaca

SEQ ID NO: 194451 - DNA, 20 bp, Artificial Sequence
  Description of Artificial Sequence: Synthetic oligonucleotide
  Target: ATXN1; (-) strand; PAM type: YTN; PAM sequence: TTT
ggcccgtcagtatctcagac

SEQ ID NO: 194452 - DNA, 20 bp, Artificial Sequence
  Description of Artificial Sequence: Synthetic oligonucleotide
  Target: ATXN1; (-) strand; PAM type: YTN; PAM sequence: TTG
tttggcccgtcagtatctca

SEQ ID NO: 194453 - DNA, 20 bp, Artificial Sequence
  Description of Artificial Sequence: Synthetic oligonucleotide
  Target: ATXN1; (-) strand; PAM type: YTN; PAM sequence: TTT
gtttggcccgtcagtatctc

SEQ ID NO: 194454 - DNA, 20 bp, Artificial Sequence
  Description of Artificial Sequence: Synthetic oligonucleotide
  Target: ATXN1; (-) strand; PAM type: YTN; PAM sequence: CTT
tgtttggcccgtcagtatct

SEQ ID NO: 194455 - DNA, 20 bp, Artificial Sequence
  Description of Artificial Sequence: Synthetic oligonucleotide
  Target: ATXN1; (-) strand; PAM type: YTN; PAM sequence: TTC
ccacactttgtttggcccgt

SEQ ID NO: 194456 - DNA, 20 bp, Artificial Sequence
  Description of Artificial Sequence: Synthetic oligonucleotide
  Target: ATXN1; (-) strand; PAM type: YTN; PAM sequence: TTT
cccacactttgtttggcccg

SEQ ID NO: 194457 - DNA, 20 bp, Artificial Sequence
  Description of Artificial Sequence: Synthetic oligonucleotide
  Target: ATXN1; (-) strand; PAM type: YTN; PAM sequence: CTT
tcccacactttgtttggccc

SEQ ID NO: 194458 - DNA, 20 bp, Artificial Sequence
  Description of Artificial Sequence: Synthetic oligonucleotide
  Target: ATXN1; (-) strand; PAM type: YTN; PAM sequence: TTC
tttcccacactttgtttggc

SEQ ID NO: 194459 - DNA, 20 bp, Artificial Sequence
  Description of Artificial Sequence: Synthetic oligonucleotide
  Target: ATXN1; (-) strand; PAM type: YTN; PAM sequence: CTG
ttctttcccacactttgttt

SEQ ID NO: 194460 - DNA, 20 bp, Artificial Sequence
  Description of Artificial Sequence: Synthetic oligonucleotide
  Target: ATXN1; (-) strand; PAM type: YTN; PAM sequence: CTC
tgttctttcccacactttgt

SEQ ID NO: 194461 - DNA, 20 bp, Artificial Sequence
  Description of Artificial Sequence: Synthetic oligonucleotide
  Target: ATXN1; (-) strand; PAM type: YTN; PAM sequence: TTC
acatcatctctgttctttcc

SEQ ID NO: 194462 - DNA, 20 bp, Artificial Sequence
  Description of Artificial Sequence: Synthetic oligonucleotide
  Target: ATXN1; (-) strand; PAM type: YTN; PAM sequence: CTG
tccaacattcacatcatctc

SEQ ID NO: 194463 - DNA, 20 bp, Artificial Sequence
  Description of Artificial Sequence: Synthetic oligonucleotide
  Target: ATXN1; (-) strand; PAM type: YTN; PAM sequence: CTC
tgtccaacattcacatcatc

SEQ ID NO: 194464 - DNA, 20 bp, Artificial Sequence
  Description of Artificial Sequence: Synthetic oligonucleotide
  Target: ATXN1; (-) strand; PAM type: YTN; PAM sequence: TTC
ctctgtccaacattcacatc

SEQ ID NO: 194465 - DNA, 20 bp, Artificial Sequence
  Description of Artificial Sequence: Synthetic oligonucleotide
  Target: ATXN1; (-) strand; PAM type: YTN; PAM sequence: CTT
cctctgtccaacattcacat

SEQ ID NO: 194466 - DNA, 20 bp, Artificial Sequence
  Description of Artificial Sequence: Synthetic oligonucleotide
  Target: ATXN1; (-) strand; PAM type: YTN; PAM sequence: TTC
aggcttcctctgtccaacat

SEQ ID NO: 194467 - DNA, 20 bp, Artificial Sequence
  Description of Artificial Sequence: Synthetic oligonucleotide
  Target: ATXN1; (-) strand; PAM type: YTN; PAM sequence: TTT
caggcttcctctgtccaaca

SEQ ID NO: 194468 - DNA, 20 bp, Artificial Sequence
  Description of Artificial Sequence: Synthetic oligonucleotide
  Target: ATXN1; (-) strand; PAM type: YTN; PAM sequence: CTT
tcaggcttcctctgtccaac

SEQ ID NO: 194469 - DNA, 20 bp, Artificial Sequence
  Description of Artificial Sequence: Synthetic oligonucleotide
  Target: ATXN1; (-) strand; PAM type: YTN; PAM sequence: TTC
tttcaggcttcctctgtcca

SEQ ID NO: 194470 - DNA, 20 bp, Artificial Sequence
  Description of Artificial Sequence: Synthetic oligonucleotide
  Target: ATXN1; (-) strand; PAM type: YTN; PAM sequence: TTT
ctttcaggcttcctctgtcc

SEQ ID NO: 194471 - DNA, 20 bp, Artificial Sequence
  Description of Artificial Sequence: Synthetic oligonucleotide
  Target: ATXN1; (-) strand; PAM type: YTN; PAM sequence: CTT
tctttcaggcttcctctgtc

SEQ ID NO: 194472 - DNA, 20 bp, Artificial Sequence
  Description of Artificial Sequence: Synthetic oligonucleotide
  Target: ATXN1; (-) strand; PAM type: YTN; PAM sequence: CTC
cctttctttcaggcttcctc

SEQ ID NO: 194473 - DNA, 20 bp, Artificial Sequence
  Description of Artificial Sequence: Synthetic oligonucleotide
  Target: ATXN1; (-) strand; PAM type: YTN; PAM sequence: TTA
tctccctttctttcaggctt

SEQ ID NO: 194474 - DNA, 20 bp, Artificial Sequence
  Description of Artificial Sequence: Synthetic oligonucleotide
  Target: ATXN1; (-) strand; PAM type: YTN; PAM sequence: CTT
atctccctttctttcaggct

SEQ ID NO: 194475 - DNA, 20 bp, Artificial Sequence
  Description of Artificial Sequence: Synthetic oligonucleotide
  Target: ATXN1; (-) strand; PAM type: YTN; PAM sequence: CTC
ccttatctccctttctttca

SEQ ID NO: 194476 - DNA, 20 bp, Artificial Sequence
  Description of Artificial Sequence: Synthetic oligonucleotide
  Target: ATXN1; (-) strand; PAM type: YTN; PAM sequence: TTG
ccgtcgctcccttatctccc

SEQ ID NO: 194477 - DNA, 20 bp, Artificial Sequence
  Description of Artificial Sequence: Synthetic oligonucleotide
  Target: ATXN1; (-) strand; PAM type: YTN; PAM sequence: CTG
ttgccgtcgctcccttatct

SEQ ID NO: 194478 - DNA, 20 bp, Artificial Sequence
  Description of Artificial Sequence: Synthetic oligonucleotide
  Target: ATXN1; (-) strand; PAM type: YTN; PAM sequence: TTA
aatagtctgttgccgtcgct

SEQ ID NO: 194479 - DNA, 20 bp, Artificial Sequence
  Description of Artificial Sequence: Synthetic oligonucleotide
  Target: ATXN1; (-) strand; PAM type: YTN; PAM sequence: TTG
tgtggtgtagattaaatagt

SEQ ID NO: 194480 - DNA, 20 bp, Artificial Sequence
  Description of Artificial Sequence: Synthetic oligonucleotide
  Target: ATXN1; (-) strand; PAM type: YTN; PAM sequence: CTT
gtgtggtgtagattaaatag

SEQ ID NO: 194481 - DNA, 20 bp, Artificial Sequence
  Description of Artificial Sequence: Synthetic oligonucleotide
  Target: ATXN1; (-) strand; PAM type: YTN; PAM sequence: TTC
cttgtgtggtgtagattaaa

SEQ ID NO: 194482 - DNA, 20 bp, Artificial Sequence
  Description of Artificial Sequence: Synthetic oligonucleotide
  Target: ATXN1; (-) strand; PAM type: YTN; PAM sequence: TTA
gttccttgtgtggtgtagat

SEQ ID NO: 194483 - DNA, 20 bp, Artificial Sequence
  Description of Artificial Sequence: Synthetic oligonucleotide
  Target: ATXN1; (-) strand; PAM type: YTN; PAM sequence: CTT
agttccttgtgtggtgtaga

SEQ ID NO: 194484 - DNA, 20 bp, Artificial Sequence
  Description of Artificial Sequence: Synthetic oligonucleotide
  Target: ATXN1; (-) strand; PAM type: YTN; PAM sequence: TTG
aacttagttccttgtgtggt

SEQ ID NO: 194485 - DNA, 20 bp, Artificial Sequence
  Description of Artificial Sequence: Synthetic oligonucleotide
  Target: ATXN1; (-) strand; PAM type: YTN; PAM sequence: CTT
gaacttagttccttgtgtgg

SEQ ID NO: 194486 - DNA, 20 bp, Artificial Sequence
  Description of Artificial Sequence: Synthetic oligonucleotide
  Target: ATXN1; (-) strand; PAM type: YTN; PAM sequence: TTG
gatcttgaacttagttcctt

SEQ ID NO: 194487 - DNA, 20 bp, Artificial Sequence
  Description of Artificial Sequence: Synthetic oligonucleotide
  Target: ATXN1; (-) strand; PAM type: YTN; PAM sequence: TTG
agttggatcttgaacttagt

SEQ ID NO: 194488 - DNA, 20 bp, Artificial Sequence
  Description of Artificial Sequence: Synthetic oligonucleotide
  Target: ATXN1; (-) strand; PAM type: YTN; PAM sequence: TTG
ttgagttggatcttgaactt

SEQ ID NO: 194489 - DNA, 20 bp, Artificial Sequence
  Description of Artificial Sequence: Synthetic oligonucleotide
  Target: ATXN1; (-) strand; PAM type: YTN; PAM sequence: TTA
ttgttgagttggatcttgaa

SEQ ID NO: 194490 - DNA, 20 bp, Artificial Sequence
  Description of Artificial Sequence: Synthetic oligonucleotide
  Target: ATXN1; (-) strand; PAM type: YTN; PAM sequence: CTG
gagattattgttgagttgga

SEQ ID NO: 194491 - DNA, 20 bp, Artificial Sequence
  Description of Artificial Sequence: Synthetic oligonucleotide
  Target: ATXN1; (-) strand; PAM type: YTN; PAM sequence: CTC
tggagattattgttgagttg

SEQ ID NO: 194492 - DNA, 20 bp, Artificial Sequence
  Description of Artificial Sequence: Synthetic oligonucleotide
  Target: ATXN1; (-) strand; PAM type: YTN; PAM sequence: TTA
aaatagtctctggagattat

SEQ ID NO: 194493 - DNA, 20 bp, Artificial Sequence
  Description of Artificial Sequence: Synthetic oligonucleotide
  Target: ATXN1; (-) strand; PAM type: YTN; PAM sequence: TTT
aaaatagtctctggagatta

SEQ ID NO: 194494 - DNA, 20 bp, Artificial Sequence
  Description of Artificial Sequence: Synthetic oligonucleotide
  Target: ATXN1; (-) strand; PAM type: YTN; PAM sequence: CTT
taaaatagtctctggagatt

SEQ ID NO: 194495 - DNA, 20 bp, Artificial Sequence
  Description of Artificial Sequence: Synthetic oligonucleotide
  Target: ATXN1; (-) strand; PAM type: YTN; PAM sequence: CTG
caaaggcgtctttaaaatag

SEQ ID NO: 194496 - DNA, 20 bp, Artificial Sequence
  Description of Artificial Sequence: Synthetic oligonucleotide
  Target: ATXN1; (-) strand; PAM type: YTN; PAM sequence: TTA
aacctgcaaaggcgtcttta

SEQ ID NO: 194497 - DNA, 20 bp, Artificial Sequence
  Description of Artificial Sequence: Synthetic oligonucleotide
  Target: ATXN1; (-) strand; PAM type: YTN; PAM sequence: CTT
aaacctgcaaaggcgtcttt

SEQ ID NO: 194498 - DNA, 20 bp, Artificial Sequence
  Description of Artificial Sequence: Synthetic oligonucleotide
  Target: ATXN1; (-) strand; PAM type: YTN; PAM sequence: CTC
ttaaacctgcaaaggcgtct

SEQ ID NO: 194499 - DNA, 20 bp, Artificial Sequence
  Description of Artificial Sequence: Synthetic oligonucleotide
  Target: ATXN1; (-) strand; PAM type: YTN; PAM sequence: CTC
tcttaaacctgcaaaggcgt

SEQ ID NO: 194500 - DNA, 20 bp, Artificial Sequence
  Description of Artificial Sequence: Synthetic oligonucleotide
  Target: ATXN1; (-) strand; PAM type: YTN; PAM sequence: CTC
acagcctctcttaaacctgc

SEQ ID NO: 194501 - DNA, 20 bp, Artificial Sequence
  Description of Artificial Sequence: Synthetic oligonucleotide
  Target: ATXN1; (-) strand; PAM type: YTN; PAM sequence: TTG
cctcacagcctctcttaaac

SEQ ID NO: 194502 - DNA, 20 bp, Artificial Sequence
  Description of Artificial Sequence: Synthetic oligonucleotide
  Target: ATXN1; (-) strand; PAM type: YTN; PAM sequence: TTT
gcctcacagcctctcttaaa

SEQ ID NO: 194503 - DNA, 20 bp, Artificial Sequence
  Description of Artificial Sequence: Synthetic oligonucleotide
  Target: ATXN1; (-) strand; PAM type: YTN; PAM sequence: CTT
tgcctcacagcctctcttaa

SEQ ID NO: 194504 - DNA, 20 bp, Artificial Sequence
  Description of Artificial Sequence: Synthetic oligonucleotide
  Target: ATXN1; (-) strand; PAM type: YTN; PAM sequence: CTG
gaatagctttgcctcacagc

SEQ ID NO: 194505 - DNA, 20 bp, Artificial Sequence
  Description of Artificial Sequence: Synthetic oligonucleotide
  Target: ATXN1; (-) strand; PAM type: YTN; PAM sequence: TTG
cccacagaacatcaggagct

SEQ ID NO: 194506 - DNA, 20 bp, Artificial Sequence
  Description of Artificial Sequence: Synthetic oligonucleotide
  Target: ATXN1; (-) strand; PAM type: YTN; PAM sequence: CTT
gcccacagaacatcaggagc

SEQ ID NO: 194507 - DNA, 20 bp, Artificial Sequence
  Description of Artificial Sequence: Synthetic oligonucleotide
  Target: ATXN1; (-) strand; PAM type: YTN; PAM sequence: CTG
ggaaacttgcccacagaaca

SEQ ID NO: 194508 - DNA, 20 bp, Artificial Sequence
  Description of Artificial Sequence: Synthetic oligonucleotide
  Target: ATXN1; (-) strand; PAM type: YTN; PAM sequence: CTG
gaatcctgggaaacttgccc

SEQ ID NO: 194509 - DNA, 20 bp, Artificial Sequence
  Description of Artificial Sequence: Synthetic oligonucleotide
  Target: ATXN1; (-) strand; PAM type: YTN; PAM sequence: CTC
atagaatgaatcccaaagat

SEQ ID NO: 194510 - DNA, 20 bp, Artificial Sequence
  Description of Artificial Sequence: Synthetic oligonucleotide
  Target: ATXN1; (-) strand; PAM type: YTN; PAM sequence: TTC
cacagctcatagaatgaatc

SEQ ID NO: 194511 - DNA, 20 bp, Artificial Sequence
  Description of Artificial Sequence: Synthetic oligonucleotide
  Target: ATXN1; (-) strand; PAM type: YTN; PAM sequence: CTT
ccacagctcatagaatgaat

SEQ ID NO: 194512 - DNA, 20 bp, Artificial Sequence
  Description of Artificial Sequence: Synthetic oligonucleotide
  Target: ATXN1; (-) strand; PAM type: YTN; PAM sequence: CTG
tggccttccacagctcatag

SEQ ID NO: 194513 - DNA, 20 bp, Artificial Sequence
  Description of Artificial Sequence: Synthetic oligonucleotide
  Target: ATXN1; (-) strand; PAM type: YTN; PAM sequence: CTG
atgaaaagggcgggaaagct

SEQ ID NO: 194514 - DNA, 20 bp, Artificial Sequence
  Description of Artificial Sequence: Synthetic oligonucleotide
  Target: ATXN1; (-) strand; PAM type: YTN; PAM sequence: CTC
tgatgaaaagggcgggaaag

SEQ ID NO: 194515 - DNA, 20 bp, Artificial Sequence
  Description of Artificial Sequence: Synthetic oligonucleotide
  Target: ATXN1; (-) strand; PAM type: YTN; PAM sequence: CTG
gtggccggccacatgccgtc

SEQ ID NO: 194516 - DNA, 20 bp, Artificial Sequence
  Description of Artificial Sequence: Synthetic oligonucleotide
  Target: ATXN1; (-) strand; PAM type: YTN; PAM sequence: CTG
ccctggtggccggccacatg

SEQ ID NO: 194517 - DNA, 20 bp, Artificial Sequence
  Description of Artificial Sequence: Synthetic oligonucleotide
  Target: ATXN1; (-) strand; PAM type: YTN; PAM sequence: CTA
tcctgccctggtggccggcc

SEQ ID NO: 194518 - DNA, 20 bp, Artificial Sequence
  Description of Artificial Sequence: Synthetic oligonucleotide
  Target: ATXN1; (-) strand; PAM type: YTN; PAM sequence: CTC
tatcctgccctggtggccgg

SEQ ID NO: 194519 - DNA, 20 bp, Artificial Sequence
  Description of Artificial Sequence: Synthetic oligonucleotide
  Target: ATXN1; (-) strand; PAM type: YTN; PAM sequence: CTG
aaaaagctctatcctgccct

SEQ ID NO: 194520 - DNA, 20 bp, Artificial Sequence
  Description of Artificial Sequence: Synthetic oligonucleotide
  Target: ATXN1; (-) strand; PAM type: YTN; PAM sequence: CTG
gtgggccatcctgaaaaagc

SEQ ID NO: 194521 - DNA, 20 bp, Artificial Sequence
  Description of Artificial Sequence: Synthetic oligonucleotide
  Target: ATXN1; (-) strand; PAM type: YTN; PAM sequence: CTG
caggctggtgggccatcctg

SEQ ID NO: 194522 - DNA, 20 bp, Artificial Sequence
  Description of Artificial Sequence: Synthetic oligonucleotide
  Target: ATXN1; (-) strand; PAM type: YTN; PAM sequence: TTC
ctgcaggctggtgggccatc

SEQ ID NO: 194523 - DNA, 20 bp, Artificial Sequence
  Description of Artificial Sequence: Synthetic oligonucleotide
  Target: ATXN1; (-) strand; PAM type: YTN; PAM sequence: CTT
cctgcaggctggtgggccat

SEQ ID NO: 194524 - DNA, 20 bp, Artificial Sequence
  Description of Artificial Sequence: Synthetic oligonucleotide
  Target: ATXN1; (-) strand; PAM type: YTN; PAM sequence: CTG
ggaatcttcctgcaggctgg

SEQ ID NO: 194525 - DNA, 20 bp, Artificial Sequence
  Description of Artificial Sequence: Synthetic oligonucleotide
  Target: ATXN1; (-) strand; PAM type: YTN; PAM sequence: CTG
agtctgggaatcttcctgca

SEQ ID NO: 194526 - DNA, 20 bp, Artificial Sequence
  Description of Artificial Sequence: Synthetic oligonucleotide
  Target: ATXN1; (-) strand; PAM type: YTN; PAM sequence: CTG
aggaactgagtctgggaatc

SEQ ID NO: 194527 - DNA, 20 bp, Artificial Sequence
  Description of Artificial Sequence: Synthetic oligonucleotide
  Target: ATXN1; (-) strand; PAM type: YTN; PAM sequence: TTC
tgaggaactgagtctgggaa

SEQ ID NO: 194528 - DNA, 20 bp, Artificial Sequence
  Description of Artificial Sequence: Synthetic oligonucleotide
  Target: ATXN1; (-) strand; PAM type: YTN; PAM sequence: TTC
agattctgaggaactgagtc

SEQ ID NO: 194529 - DNA, 20 bp, Artificial Sequence
  Description of Artificial Sequence: Synthetic oligonucleotide
  Target: ATXN1; (-) strand; PAM type: YTN; PAM sequence: CTT
cagattctgaggaactgagt

SEQ ID NO: 194530 - DNA, 20 bp, Artificial Sequence
  Description of Artificial Sequence: Synthetic oligonucleotide
  Target: ATXN1; (-) strand; PAM type: YTN; PAM sequence: TTG
gaggagtgcccttcagattc

SEQ ID NO: 194531 - DNA, 20 bp, Artificial Sequence
  Description of Artificial Sequence: Synthetic oligonucleotide
  Target: ATXN1; (-) strand; PAM type: YTN; PAM sequence: CTT
ggaggagtgcccttcagatt

SEQ ID NO: 194532 - DNA, 20 bp, Artificial Sequence
  Description of Artificial Sequence: Synthetic oligonucleotide
  Target: ATXN1; (-) strand; PAM type: YTN; PAM sequence: CTG
tgggacttggaggagtgccc

SEQ ID NO: 194533 - DNA, 20 bp, Artificial Sequence
  Description of Artificial Sequence: Synthetic oligonucleotide
  Target: ATXN1; (-) strand; PAM type: YTN; PAM sequence: CTC
tgtgggacttggaggagtgc

SEQ ID NO: 194534 - DNA, 20 bp, Artificial Sequence
  Description of Artificial Sequence: Synthetic oligonucleotide
  Target: ATXN1; (-) strand; PAM type: YTN; PAM sequence: CTG
ctctgtgggacttggaggag

SEQ ID NO: 194535 - DNA, 20 bp, Artificial Sequence
  Description of Artificial Sequence: Synthetic oligonucleotide
  Target: ATXN1; (-) strand; PAM type: YTN; PAM sequence: TTG
tgggctgctctgtgggactt

SEQ ID NO: 194536 - DNA, 20 bp, Artificial Sequence
  Description of Artificial Sequence: Synthetic oligonucleotide
  Target: ATXN1; (-) strand; PAM type: YTN; PAM sequence: CTT
gtgggctgctctgtgggact

SEQ ID NO: 194537 - DNA, 20 bp, Artificial Sequence
  Description of Artificial Sequence: Synthetic oligonucleotide
  Target: ATXN1; (-) strand; PAM type: YTN; PAM sequence: TTA
aacacttgtgggctgctctg

SEQ ID NO: 194538 - DNA, 20 bp, Artificial Sequence
  Description of Artificial Sequence: Synthetic oligonucleotide
  Target: ATXN1; (-) strand; PAM type: YTN; PAM sequence: CTG
catagtaagtgtcatgttaa

SEQ ID NO: 194539 - DNA, 20 bp, Artificial Sequence
  Description of Artificial Sequence: Synthetic oligonucleotide
  Target: ATXN1; (-) strand; PAM type: YTN; PAM sequence: CTG
actgcatagtaagtgtcatg

SEQ ID NO: 194540 - DNA, 20 bp, Artificial Sequence
  Description of Artificial Sequence: Synthetic oligonucleotide
  Target: ATXN1; (-) strand; PAM type: YTN; PAM sequence: CTA
ggatagtctgactgcatagt

SEQ ID NO: 194541 - DNA, 20 bp, Artificial Sequence
  Description of Artificial Sequence: Synthetic oligonucleotide
  Target: ATXN1; (-) strand; PAM type: YTN; PAM sequence: CTA
gcctaggatagtctgactgc

SEQ ID NO: 194542 - DNA, 20 bp, Artificial Sequence
  Description of Artificial Sequence: Synthetic oligonucleotide
  Target: ATXN1; (-) strand; PAM type: YTN; PAM sequence: TTG
cagccccacctagcctagga

SEQ ID NO: 194543 - DNA, 20 bp, Artificial Sequence
  Description of Artificial Sequence: Synthetic oligonucleotide
  Target: ATXN1; (-) strand; PAM type: YTN; PAM sequence: TTT
gcagccccacctagcctagg

SEQ ID NO: 194544 - DNA, 20 bp, Artificial Sequence
  Description of Artificial Sequence: Synthetic oligonucleotide
  Target: ATXN1; (-) strand; PAM type: YTN; PAM sequence: CTT
tgcagccccacctagcctag

SEQ ID NO: 194545 - DNA, 20 bp, Artificial Sequence
  Description of Artificial Sequence: Synthetic oligonucleotide
  Target: ATXN1; (-) strand; PAM type: YTN; PAM sequence: TTG
tctttgcagccccacctagc

SEQ ID NO: 194546 - DNA, 20 bp, Artificial Sequence
  Description of Artificial Sequence: Synthetic oligonucleotide
  Target: ATXN1; (-) strand; PAM type: YTN; PAM sequence: TTT
gtctttgcagccccacctag

SEQ ID NO: 194547 - DNA, 20 bp, Artificial Sequence
  Description of Artificial Sequence: Synthetic oligonucleotide
  Target: ATXN1; (-) strand; PAM type: YTN; PAM sequence: CTT
tgtctttgcagccccaccta

SEQ ID NO: 194548 - DNA, 20 bp, Artificial Sequence
  Description of Artificial Sequence: Synthetic oligonucleotide
  Target: ATXN1; (-) strand; PAM type: YTN; PAM sequence: TTG
gagcataacctttgtctttg

SEQ ID NO: 194549 - DNA, 20 bp, Artificial Sequence
  Description of Artificial Sequence: Synthetic oligonucleotide
  Target: ATXN1; (-) strand; PAM type: YTN; PAM sequence: TTC
aattggagcataacctttgt

SEQ ID NO: 194550 - DNA, 20 bp, Artificial Sequence
  Description of Artificial Sequence: Synthetic oligonucleotide
  Target: ATXN1; (-) strand; PAM type: YTN; PAM sequence: TTT
caattggagcataacctttg

SEQ ID NO: 194551 - DNA, 20 bp, Artificial Sequence
  Description of Artificial Sequence: Synthetic oligonucleotide
  Target: ATXN1; (-) strand; PAM type: YTN; PAM sequence: TTT
tcaattggagcataaccttt

SEQ ID NO: 194552 - DNA, 20 bp, Artificial Sequence
  Description of Artificial Sequence: Synthetic oligonucleotide
  Target: ATXN1; (-) strand; PAM type: YTN; PAM sequence: TTT
ttcaattggagcataacctt

SEQ ID NO: 194553 - DNA, 20 bp, Artificial Sequence
  Description of Artificial Sequence: Synthetic oligonucleotide
  Target: ATXN1; (-) strand; PAM type: YTN; PAM sequence: TTT
tttcaattggagcataacct

SEQ ID NO: 194554 - DNA, 20 bp, Artificial Sequence
  Description of Artificial Sequence: Synthetic oligonucleotide
  Target: ATXN1; (-) strand; PAM type: YTN; PAM sequence: TTT
ttttcaattggagcataacc

SEQ ID NO: 194555 - DNA, 20 bp, Artificial Sequence
  Description of Artificial Sequence: Synthetic oligonucleotide
  Target: ATXN1; (-) strand; PAM type: YTN; PAM sequence: CTG
gcagtttttttcaattggag

SEQ ID NO: 194556 - DNA, 20 bp, Artificial Sequence
  Description of Artificial Sequence: Synthetic oligonucleotide
  Target: ATXN1; (-) strand; PAM type: YTN; PAM sequence: TTC
tggcagtttttttcaattgg

SEQ ID NO: 194557 - DNA, 20 bp, Artificial Sequence
  Description of Artificial Sequence: Synthetic oligonucleotide
  Target: ATXN1; (-) strand; PAM type: YTN; PAM sequence: TTT
ctggcagtttttttcaattg

SEQ ID NO: 194558 - DNA, 20 bp, Artificial Sequence
  Description of Artificial Sequence: Synthetic oligonucleotide
  Target: ATXN1; (-) strand; PAM type: YTN; PAM sequence: CTT
tctggcagtttttttcaatt

SEQ ID NO: 194559 - DNA, 20 bp, Artificial Sequence
  Description of Artificial Sequence: Synthetic oligonucleotide
  Target: ATXN1; (-) strand; PAM type: YTN; PAM sequence: TTG
catggctttctggcagtttt

SEQ ID NO: 194560 - DNA, 20 bp, Artificial Sequence
  Description of Artificial Sequence: Synthetic oligonucleotide
  Target: ATXN1; (-) strand; PAM type: YTN; PAM sequence: TTT
gcatggctttctggcagttt

SEQ ID NO: 194561 - DNA, 20 bp, Artificial Sequence
  Description of Artificial Sequence: Synthetic oligonucleotide
  Target: ATXN1; (-) strand; PAM type: YTN; PAM sequence: TTC
aatgtttgcatggctttctg

SEQ ID NO: 194562 - DNA, 20 bp, Artificial Sequence
  Description of Artificial Sequence: Synthetic oligonucleotide
  Target: ATXN1; (-) strand; PAM type: YTN; PAM sequence: TTT
caatgtttgcatggctttct

SEQ ID NO: 194563 - DNA, 20 bp, Artificial Sequence
  Description of Artificial Sequence: Synthetic oligonucleotide
  Target: ATXN1; (-) strand; PAM type: YTN; PAM sequence: TTT
tcaatgtttgcatggctttc

SEQ ID NO: 194564 - DNA, 20 bp, Artificial Sequence
  Description of Artificial Sequence: Synthetic oligonucleotide
  Target: ATXN1; (-) strand; PAM type: YTN; PAM sequence: TTT
ttcaatgtttgcatggcttt

SEQ ID NO: 194565 - DNA, 20 bp, Artificial Sequence
  Description of Artificial Sequence: Synthetic oligonucleotide
  Target: ATXN1; (-) strand; PAM type: YTN; PAM sequence: CTA
ccatttttcaatgtttgcat

SEQ ID NO: 194566 - DNA, 20 bp, Artificial Sequence
  Description of Artificial Sequence: Synthetic oligonucleotide
  Target: ATXN1; (-) strand; PAM type: YTN; PAM sequence: TTG
ccagtatctaccatttttca

SEQ ID NO: 194567 - DNA, 20 bp, Artificial Sequence
  Description of Artificial Sequence: Synthetic oligonucleotide
  Target: ATXN1; (-) strand; PAM type: YTN; PAM sequence: TTT
gccagtatctaccatttttc

SEQ ID NO: 194568 - DNA, 20 bp, Artificial Sequence
  Description of Artificial Sequence: Synthetic oligonucleotide
  Target: ATXN1; (-) strand; PAM type: YTN; PAM sequence: TTT
tgccagtatctaccattttt

SEQ ID NO: 194569 - DNA, 20 bp, Artificial Sequence
  Description of Artificial Sequence: Synthetic oligonucleotide
  Target: ATXN1; (-) strand; PAM type: YTN; PAM sequence: CTC
agagattttgccagtatcta

SEQ ID NO: 194570 - DNA, 20 bp, Artificial Sequence
  Description of Artificial Sequence: Synthetic oligonucleotide
  Target: ATXN1; (-) strand; PAM type: YTN; PAM sequence: TTA
aaacgaagaagatactcaga

SEQ ID NO: 194571 - DNA, 20 bp, Artificial Sequence
  Description of Artificial Sequence: Synthetic oligonucleotide
  Target: ATXN1; (-) strand; PAM type: YTN; PAM sequence: TTT
aaaacgaagaagatactcag

SEQ ID NO: 194572 - DNA, 20 bp, Artificial Sequence
  Description of Artificial Sequence: Synthetic oligonucleotide
  Target: ATXN1; (-) strand; PAM type: YTN; PAM sequence: CTT
taaaacgaagaagatactca

SEQ ID NO: 194573 - DNA, 20 bp, Artificial Sequence
  Description of Artificial Sequence: Synthetic oligonucleotide
  Target: ATXN1; (-) strand; PAM type: YTN; PAM sequence: TTG
ctttaaaacgaagaagatac

SEQ ID NO: 194574 - DNA, 20 bp, Artificial Sequence
  Description of Artificial Sequence: Synthetic oligonucleotide
  Target: ATXN1; (-) strand; PAM type: YTN; PAM sequence: TTA
taaagtgttgctttaaaacg

SEQ ID NO: 194575 - DNA, 20 bp, Artificial Sequence
  Description of Artificial Sequence: Synthetic oligonucleotide
  Target: ATXN1; (-) strand; PAM type: YTN; PAM sequence: TTA
ggatgaaaaggtcaatgcgt

SEQ ID NO: 194576 - DNA, 20 bp, Artificial Sequence
  Description of Artificial Sequence: Synthetic oligonucleotide
  Target: ATXN1; (-) strand; PAM type: YTN; PAM sequence: TTG
ttaggatgaaaaggtcaatg

SEQ ID NO: 194577 - DNA, 20 bp, Artificial Sequence
  Description of Artificial Sequence: Synthetic oligonucleotide
  Target: ATXN1; (-) strand; PAM type: YTN; PAM sequence: CTG
ttgttaggatgaaaaggtca

SEQ ID NO: 194578 - DNA, 20 bp, Artificial Sequence
  Description of Artificial Sequence: Synthetic oligonucleotide
  Target: ATXN1; (-) strand; PAM type: YTN; PAM sequence: CTC
gtctgttgttaggatgaaaa

SEQ ID NO: 194579 - DNA, 20 bp, Artificial Sequence
  Description of Artificial Sequence: Synthetic oligonucleotide
  Target: ATXN1; (-) strand; PAM type: YTN; PAM sequence: CTG
tagacgtctcgtctgttgtt

SEQ ID NO: 194580 - DNA, 20 bp, Artificial Sequence
  Description of Artificial Sequence: Synthetic oligonucleotide
  Target: ATXN1; (-) strand; PAM type: YTN; PAM sequence: TTC
gtactgtagacgtctcgtct

SEQ ID NO: 194581 - DNA, 20 bp, Artificial Sequence
  Description of Artificial Sequence: Synthetic oligonucleotide
  Target: ATXN1; (-) strand; PAM type: YTN; PAM sequence: CTC
aagaattcgtactgtagacg

SEQ ID NO: 194582 - DNA, 20 bp, Artificial Sequence
  Description of Artificial Sequence: Synthetic oligonucleotide
  Target: ATXN1; (-) strand; PAM type: YTN; PAM sequence: TTC
gtggtctcaagaattcgtac

SEQ ID NO: 194583 - DNA, 20 bp, Artificial Sequence
  Description of Artificial Sequence: Synthetic oligonucleotide
  Target: ATXN1; (-) strand; PAM type: YTN; PAM sequence: TTT
cgtggtctcaagaattcgta

SEQ ID NO: 194584 - DNA, 20 bp, Artificial Sequence
  Description of Artificial Sequence: Synthetic oligonucleotide
  Target: ATXN1; (-) strand; PAM type: YTN; PAM sequence: TTT
tcgtggtctcaagaattcgt

SEQ ID NO: 194585 - DNA, 20 bp, Artificial Sequence
  Description of Artificial Sequence: Synthetic oligonucleotide
  Target: ATXN1; (-) strand; PAM type: YTN; PAM sequence: TTG
aaatcagttttcgtggtctc

SEQ ID NO: 194586 - DNA, 20 bp, Artificial Sequence
  Description of Artificial Sequence: Synthetic oligonucleotide
  Target: ATXN1; (-) strand; PAM type: YTN; PAM sequence: TTT
gaaatcagttttcgtggtct

SEQ ID NO: 194587 - DNA, 20 bp, Artificial Sequence
  Description of Artificial Sequence: Synthetic oligonucleotide
  Target: ATXN1; (-) strand; PAM type: YTN; PAM sequence: CTT
tgaaatcagttttcgtggtc

SEQ ID NO: 194588 - DNA, 20 bp, Artificial Sequence
  Description of Artificial Sequence: Synthetic oligonucleotide
  Target: ATXN1; (-) strand; PAM type: YTN; PAM sequence: CTG
actttgaaatcagttttcgt

SEQ ID NO: 194589 - DNA, 20 bp, Artificial Sequence
  Description of Artificial Sequence: Synthetic oligonucleotide
  Target: ATXN1; (-) strand; PAM type: YTN; PAM sequence: CTG
aggtctgactttgaaatcag

SEQ ID NO: 194590 - DNA, 20 bp, Artificial Sequence
  Description of Artificial Sequence: Synthetic oligonucleotide
  Target: ATXN1; (-) strand; PAM type: YTN; PAM sequence: CTC
agactgaggtctgactttga

SEQ ID NO: 194591 - DNA, 20 bp, Artificial Sequence
  Description of Artificial Sequence: Synthetic oligonucleotide
  Target: ATXN1; (-) strand; PAM type: YTN; PAM sequence: CTG
aggctcagactgaggtctga

SEQ ID NO: 194592 - DNA, 20 bp, Artificial Sequence
  Description of Artificial Sequence: Synthetic oligonucleotide
  Target: ATXN1; (-) strand; PAM type: YTN; PAM sequence: CTC
agctgaggctcagactgagg

SEQ ID NO: 194593 - DNA, 20 bp, Artificial Sequence
  Description of Artificial Sequence: Synthetic oligonucleotide
  Target: ATXN1; (-) strand; PAM type: YTN; PAM sequence: CTG
tgactcagctgaggctcaga

SEQ ID NO: 194594 - DNA, 20 bp, Artificial Sequence
  Description of Artificial Sequence: Synthetic oligonucleotide
  Target: ATXN1; (-) strand; PAM type: YTN; PAM sequence: CTC
tgtgactcagctgaggctca

SEQ ID NO: 194595 - DNA, 20 bp, Artificial Sequence
  Description of Artificial Sequence: Synthetic oligonucleotide
  Target: ATXN1; (-) strand; PAM type: YTN; PAM sequence: CTC
ctctgtgactcagctgaggc

SEQ ID NO: 194596 - DNA, 20 bp, Artificial Sequence
  Description of Artificial Sequence: Synthetic oligonucleotide
  Target: ATXN1; (-) strand; PAM type: YTN; PAM sequence: CTG
gaaccacacagctcctctgt

SEQ ID NO: 194597 - DNA, 20 bp, Artificial Sequence
  Description of Artificial Sequence: Synthetic oligonucleotide
  Target: ATXN1; (-) strand; PAM type: YTN; PAM sequence: TTA
agtaactggaaccacacagc

SEQ ID NO: 194598 - DNA, 20 bp, Artificial Sequence
  Description of Artificial Sequence: Synthetic oligonucleotide
  Target: ATXN1; (-) strand; PAM type: YTN; PAM sequence: TTT
aagtaactggaaccacacag

SEQ ID NO: 194599 - DNA, 20 bp, Artificial Sequence
  Description of Artificial Sequence: Synthetic oligonucleotide
  Target: ATXN1; (-) strand; PAM type: YTN; PAM sequence: TTC
agagagtttaagtaactgga

SEQ ID NO: 194600 - DNA, 20 bp, Artificial Sequence
  Description of Artificial Sequence: Synthetic oligonucleotide
  Target: ATXN1; (-) strand; PAM type: YTN; PAM sequence: TTA
tacaaatgaggaaagggttc

SEQ ID NO: 194601 - DNA, 20 bp, Artificial Sequence
  Description of Artificial Sequence: Synthetic oligonucleotide
  Target: ATXN1; (-) strand; PAM type: YTN; PAM sequence: TTG
ccattatacaaatgaggaaa

SEQ ID NO: 194602 - DNA, 20 bp, Artificial Sequence
  Description of Artificial Sequence: Synthetic oligonucleotide
  Target: ATXN1; (-) strand; PAM type: YTN; PAM sequence: TTA
ttgccattatacaaatgagg

SEQ ID NO: 194603 - DNA, 20 bp, Artificial Sequence
  Description of Artificial Sequence: Synthetic oligonucleotide
  Target: ATXN1; (-) strand; PAM type: YTN; PAM sequence: TTG
ttattgccattatacaaatg

SEQ ID NO: 194604 - DNA, 20 bp, Artificial Sequence
  Description of Artificial Sequence: Synthetic oligonucleotide
  Target: ATXN1; (-) strand; PAM type: YTN; PAM sequence: CTA
tgaagtcgatattgttattg

SEQ ID NO: 194605 - DNA, 20 bp, Artificial Sequence
  Description of Artificial Sequence: Synthetic oligonucleotide
  Target: ATXN1; (-) strand; PAM type: YTN; PAM sequence: TTC
tatgaagtcgatattgttat

SEQ ID NO: 194606 - DNA, 20 bp, Artificial Sequence
  Description of Artificial Sequence: Synthetic oligonucleotide
  Target: ATXN1; (-) strand; PAM type: YTN; PAM sequence: CTA
gaaacattctatgaagtcga

SEQ ID NO: 194607 - DNA, 20 bp, Artificial Sequence
  Description of Artificial Sequence: Synthetic oligonucleotide
  Target: ATXN1; (-) strand; PAM type: YTN; PAM sequence: CTA
aaaactagaaacattctatg

SEQ ID NO: 194608 - DNA, 20 bp, Artificial Sequence
  Description of Artificial Sequence: Synthetic oligonucleotide
  Target: ATXN1; (-) strand; PAM type: YTN; PAM sequence: CTG
tgtaccaagcgccacactaa

SEQ ID NO: 194609 - DNA, 20 bp, Artificial Sequence
  Description of Artificial Sequence: Synthetic oligonucleotide
  Target: ATXN1; (-) strand; PAM type: YTN; PAM sequence: TTC
tgtgtaccaagcgccacact

SEQ ID NO: 194610 - DNA, 20 bp, Artificial Sequence
  Description of Artificial Sequence: Synthetic oligonucleotide
  Target: ATXN1; (-) strand; PAM type: YTN; PAM sequence: CTT
ctgtgtaccaagcgccacac

SEQ ID NO: 194611 - DNA, 20 bp, Artificial Sequence
  Description of Artificial Sequence: Synthetic oligonucleotide
  Target: ATXN1; (-) strand; PAM type: YTN; PAM sequence: CTC
ttctgtgtaccaagcgccac

SEQ ID NO: 194612 - DNA, 20 bp, Artificial Sequence
  Description of Artificial Sequence: Synthetic oligonucleotide
  Target: ATXN1; (-) strand; PAM type: YTN; PAM sequence: TTC
agtctcttctgtgtaccaag

SEQ ID NO: 194613 - DNA, 20 bp, Artificial Sequence
  Description of Artificial Sequence: Synthetic oligonucleotide
  Target: ATXN1; (-) strand; PAM type: YTN; PAM sequence: TTA
ttcagtctcttctgtgtacc

SEQ ID NO: 194614 - DNA, 20 bp, Artificial Sequence
  Description of Artificial Sequence: Synthetic oligonucleotide
  Target: ATXN1; (-) strand; PAM type: YTN; PAM sequence: TTT
attcagtctcttctgtgtac

SEQ ID NO: 194615 - DNA, 20 bp, Artificial Sequence
  Description of Artificial Sequence: Synthetic oligonucleotide
  Target: ATXN1; (-) strand; PAM type: YTN; PAM sequence: TTT
tattcagtctcttctgtgta

SEQ ID NO: 194616 - DNA, 20 bp, Artificial Sequence
  Description of Artificial Sequence: Synthetic oligonucleotide
  Target: ATXN1; (-) strand; PAM type: YTN; PAM sequence: TTG
ttttattcagtctcttctgt

SEQ ID NO: 194617 - DNA, 20 bp, Artificial Sequence
  Description of Artificial Sequence: Synthetic oligonucleotide
  Target: ATXN1; (-) strand; PAM type: YTN; PAM sequence: TTT
gttttattcagtctcttctg

SEQ ID NO: 194618 - DNA, 20 bp, Artificial Sequence
  Description of Artificial Sequence: Synthetic oligonucleotide
  Target: ATXN1; (-) strand; PAM type: YTN; PAM sequence: TTT
tgttttattcagtctcttct

SEQ ID NO: 194619 - DNA, 20 bp, Artificial Sequence
  Description of Artificial Sequence: Synthetic oligonucleotide
  Target: ATXN1; (-) strand; PAM type: YTN; PAM sequence: TTT
ttgttttattcagtctcttc

SEQ ID NO: 194620 - DNA, 20 bp, Artificial Sequence
  Description of Artificial Sequence: Synthetic oligonucleotide
  Target: ATXN1; (-) strand; PAM type: YTN; PAM sequence: CTT
tttgttttattcagtctctt

SEQ ID NO: 194621 - DNA, 20 bp, Artificial Sequence
  Description of Artificial Sequence: Synthetic oligonucleotide
  Target: ATXN1; (-) strand; PAM type: YTN; PAM sequence: TTG
tgtgccaaatggtgataatg

SEQ ID NO: 194622 - DNA, 20 bp, Artificial Sequence
  Description of Artificial Sequence: Synthetic oligonucleotide
  Target: ATXN1; (-) strand; PAM type: YTN; PAM sequence: TTA
cagatatatgaacatgttgt

SEQ ID NO: 194623 - DNA, 20 bp, Artificial Sequence
  Description of Artificial Sequence: Synthetic oligonucleotide
  Target: ATXN1; (-) strand; PAM type: YTN; PAM sequence: TTG
ttacagatatatgaacatgt

SEQ ID NO: 194624 - DNA, 20 bp, Artificial Sequence
  Description of Artificial Sequence: Synthetic oligonucleotide
  Target: ATXN1; (-) strand; PAM type: YTN; PAM sequence: CTC
cattgttacagatatatgaa

SEQ ID NO: 194625 - DNA, 20 bp, Artificial Sequence
  Description of Artificial Sequence: Synthetic oligonucleotide
  Target: ATXN1; (-) strand; PAM type: YTN; PAM sequence: TTC
ctccattgttacagatatat

SEQ ID NO: 194626 - DNA, 20 bp, Artificial Sequence
  Description of Artificial Sequence: Synthetic oligonucleotide
  Target: ATXN1; (-) strand; PAM type: YTN; PAM sequence: TTT
cctccattgttacagatata

SEQ ID NO: 194627 - DNA, 20 bp, Artificial Sequence
  Description of Artificial Sequence: Synthetic oligonucleotide
  Target: ATXN1; (-) strand; PAM type: YTN; PAM sequence: CTT
tcctccattgttacagatat

SEQ ID NO: 194628 - DNA, 20 bp, Artificial Sequence
  Description of Artificial Sequence: Synthetic oligonucleotide
  Target: ATXN1; (-) strand; PAM type: YTN; PAM sequence: CTG
tgtctttcctccattgttac

SEQ ID NO: 194629 - DNA, 20 bp, Artificial Sequence
  Description of Artificial Sequence: Synthetic oligonucleotide
  Target: ATXN1; (-) strand; PAM type: YTN; PAM sequence: CTC
ctgtgtctttcctccattgt

SEQ ID NO: 194630 - DNA, 20 bp, Artificial Sequence
  Description of Artificial Sequence: Synthetic oligonucleotide
  Target: ATXN1; (-) strand; PAM type: YTN; PAM sequence: CTC
tcctgtgtctttcctccatt

SEQ ID NO: 194631 - DNA, 20 bp, Artificial Sequence
  Description of Artificial Sequence: Synthetic oligonucleotide
  Target: ATXN1; (-) strand; PAM type: YTN; PAM sequence: TTA
agtcaccaaagtctctcctg

SEQ ID NO: 194632 - DNA, 20 bp, Artificial Sequence
  Description of Artificial Sequence: Synthetic oligonucleotide
  Target: ATXN1; (-) strand; PAM type: YTN; PAM sequence: TTA
ttaagtcaccaaagtctctc

SEQ ID NO: 194633 - DNA, 20 bp, Artificial Sequence
  Description of Artificial Sequence: Synthetic oligonucleotide
  Target: ATXN1; (-) strand; PAM type: YTN; PAM sequence: CTG
gcaaattattaagtcaccaa

SEQ ID NO: 194634 - DNA, 20 bp, Artificial Sequence
  Description of Artificial Sequence: Synthetic oligonucleotide
  Target: ATXN1; (-) strand; PAM type: YTN; PAM sequence: TTC
tggcaaattattaagtcacc

SEQ ID NO: 194635 - DNA, 20 bp, Artificial Sequence
  Description of Artificial Sequence: Synthetic oligonucleotide
  Target: ATXN1; (-) strand; PAM type: YTN; PAM sequence: TTA
taggagtgagccaccacgcc

SEQ ID NO: 194636 - DNA, 20 bp, Artificial Sequence
  Description of Artificial Sequence: Synthetic oligonucleotide
  Target: ATXN1; (-) strand; PAM type: YTN; PAM sequence: CTG
ggattataggagtgagccac

SEQ ID NO: 194637 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattatag

SEQ ID NO: 194638 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 194639 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 194640 - DNA, 20 bp, Artificial Sequence
  Description of Artificial Sequence: Synthetic oligonucleotide
  Target: ATXN1; (-) strand; PAM type: YTN; PAM sequence: CTG
gcttggcctcccaaagtgct

SEQ ID NO: 194641 - DNA, 20 bp, Artificial Sequence
  Description of Artificial Sequence: Synthetic oligonucleotide
  Target: ATXN1; (-) strand; PAM type: YTN; PAM sequence: TTC
aggtgatccacctggcttgg

SEQ ID NO: 194642 - DNA, 20 bp, Artificial Sequence
  Description of Artificial Sequence: Synthetic oligonucleotide
  Target: ATXN1; (-) strand; PAM type: YTN; PAM sequence: CTT
caggtgatccacctggcttg

SEQ ID NO: 194643 - DNA, 20 bp, Artificial Sequence
  Description of Artificial Sequence: Synthetic oligonucleotide
  Target: ATXN1; (-) strand; PAM type: YTN; PAM sequence: CTG
acttcaggtgatccacctgg

SEQ ID NO: 194644 - DNA, 20 bp, Artificial Sequence
  Description of Artificial Sequence: Synthetic oligonucleotide
  Target: ATXN1; (-) strand; PAM type: YTN; PAM sequence: CTC
ctgacttcaggtgatccacc

SEQ ID NO: 194645 - DNA, 20 bp, Artificial Sequence
  Description of Artificial Sequence: Synthetic oligonucleotide
  Target: ATXN1; (-) strand; PAM type: YTN; PAM sequence: TTG
aactcctgacttcaggtgat

SEQ ID NO: 194646 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacttcaggtga

SEQ ID NO: 194647 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgacttca

SEQ ID NO: 194648 - DNA, 20 bp, Artificial Sequence
  Description of Artificial Sequence: Synthetic oligonucleotide
  Target: ATXN1; (-) strand; PAM type: YTN; PAM sequence: TTA
ccatggtggccaggctggtc

SEQ ID NO: 194649 - DNA, 20 bp, Artificial Sequence
  Description of Artificial Sequence: Synthetic oligonucleotide
  Target: ATXN1; (-) strand; PAM type: YTN; PAM sequence: TTT
accatggtggccaggctggt

SEQ ID NO: 194650 - DNA, 20 bp, Artificial Sequence
  Description of Artificial Sequence: Synthetic oligonucleotide
  Target: ATXN1; (-) strand; PAM type: YTN; PAM sequence: TTT
taccatggtggccaggctgg

SEQ ID NO: 194651 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggttttacca

SEQ ID NO: 194652 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggttttacc

SEQ ID NO: 194653 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggttttac

SEQ ID NO: 194654 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttta

SEQ ID NO: 194655 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 194656 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 194657 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 194658 - DNA, 20 bp, Artificial Sequence
  Description of Artificial Sequence: Synthetic oligonucleotide
  Target: ATXN1; (-) strand; PAM type: YTN; PAM sequence: CTA
attttgtatttttagtagag

SEQ ID NO: 194659 - DNA, 20 bp, Artificial Sequence
  Description of Artificial Sequence: Synthetic oligonucleotide
  Target: ATXN1; (-) strand; PAM type: YTN; PAM sequence: TTA
caggtgcatgccaccatgcc

SEQ ID NO: 194660 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgcatgccac

SEQ ID NO: 194661 - DNA, 20 bp, Artificial Sequence
  Description of Artificial Sequence: Synthetic oligonucleotide
  Target: ATXN1; (-) strand; PAM type: YTN; PAM sequence: TTC
ccaaatagctgggattacag

SEQ ID NO: 194662 - DNA, 20 bp, Artificial Sequence
  Description of Artificial Sequence: Synthetic oligonucleotide
  Target: ATXN1; (-) strand; PAM type: YTN; PAM sequence: CTT
cccaaatagctgggattaca

SEQ ID NO: 194663 - DNA, 20 bp, Artificial Sequence
  Description of Artificial Sequence: Synthetic oligonucleotide
  Target: ATXN1; (-) strand; PAM type: YTN; PAM sequence: CTC
agcttcccaaatagctggga

SEQ ID NO: 194664 - DNA, 20 bp, Artificial Sequence
  Description of Artificial Sequence: Synthetic oligonucleotide
  Target: ATXN1; (-) strand; PAM type: YTN; PAM sequence: CTG
cctcagcttcccaaatagct

SEQ ID NO: 194665 - DNA, 20 bp, Artificial Sequence
  Description of Artificial Sequence: Synthetic oligonucleotide
  Target: ATXN1; (-) strand; PAM type: YTN; PAM sequence: TTC
ctgcctcagcttcccaaata

SEQ ID NO: 194666 - DNA, 20 bp, Artificial Sequence
  Description of Artificial Sequence: Synthetic oligonucleotide
  Target: ATXN1; (-) strand; PAM type: YTN; PAM sequence: TTT
cctgcctcagcttcccaaat

SEQ ID NO: 194667 - DNA, 20 bp, Artificial Sequence
  Description of Artificial Sequence: Synthetic oligonucleotide
  Target: ATXN1; (-) strand; PAM type: YTN; PAM sequence: TTT
tcctgcctcagcttcccaaa

SEQ ID NO: 194668 - DNA, 20 bp, Artificial Sequence
  Description of Artificial Sequence: Synthetic oligonucleotide
  Target: ATXN1; (-) strand; PAM type: YTN; PAM sequence: TTC
aagcaattttcctgcctcag

SEQ ID NO: 194669 - DNA, 20 bp, Artificial Sequence
  Description of Artificial Sequence: Synthetic oligonucleotide
  Target: ATXN1; (-) strand; PAM type: YTN; PAM sequence: CTC
ccgagttcaagcaattttcc

SEQ ID NO: 194670 - DNA, 20 bp, Artificial Sequence
  Description of Artificial Sequence: Synthetic oligonucleotide
  Target: ATXN1; (-) strand; PAM type: YTN; PAM sequence: CTG
cctcccgagttcaagcaatt

SEQ ID NO: 194671 - DNA, 20 bp, Artificial Sequence
  Description of Artificial Sequence: Synthetic oligonucleotide
  Target: ATXN1; (-) strand; PAM type: YTN; PAM sequence: TTC
tgcctcccgagttcaagcaa

SEQ ID NO: 194672 - DNA, 20 bp, Artificial Sequence
  Description of Artificial Sequence: Synthetic oligonucleotide
  Target: ATXN1; (-) strand; PAM type: YTN; PAM sequence: CTT
ctgcctcccgagttcaagca

SEQ ID NO: 194673 - DNA, 20 bp, Artificial Sequence
  Description of Artificial Sequence: Synthetic oligonucleotide
  Target: ATXN1; (-) strand; PAM type: YTN; PAM sequence: CTG
caacttctgcctcccgagtt

SEQ ID NO: 194674 - DNA, 20 bp, Artificial Sequence
  Description of Artificial Sequence: Synthetic oligonucleotide
  Target: ATXN1; (-) strand; PAM type: YTN; PAM sequence: CTC
actgcaacttctgcctcccg

SEQ ID NO: 194675 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacttctgcct

SEQ ID NO: 194676 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacttctgcc

SEQ ID NO: 194677 - DNA, 20 bp, Artificial Sequence
  Description of Artificial Sequence: Synthetic oligonucleotide
  Target: ATXN1; (-) strand; PAM type: YTN; PAM sequence: CTG
gagtacagtggcatgatctt

SEQ ID NO: 194678 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtacagtgg

SEQ ID NO: 194679 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggagtacag

SEQ ID NO: 194680 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctggagtaca

SEQ ID NO: 194681 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccaggctggagta

SEQ ID NO: 194682 - DNA, 20 bp, Artificial Sequence
  Description of Artificial Sequence: Synthetic oligonucleotide
  Target: ATXN1; (-) strand; PAM type: YTN; PAM sequence: TTG
ctcttgttgcccaggctgga

SEQ ID NO: 194683 - DNA, 20 bp, Artificial Sequence
  Description of Artificial Sequence: Synthetic oligonucleotide
  Target: ATXN1; (-) strand; PAM type: YTN; PAM sequence: TTT
gctcttgttgcccaggctgg

SEQ ID NO: 194684 - DNA, 20 bp, Artificial Sequence
  Description of Artificial Sequence: Synthetic oligonucleotide
  Target: ATXN1; (-) strand; PAM type: YTN; PAM sequence: TTT
tgctcttgttgcccaggctg

SEQ ID NO: 194685 - DNA, 20 bp, Artificial Sequence
  Description of Artificial Sequence: Synthetic oligonucleotide
  Target: ATXN1; (-) strand; PAM type: YTN; PAM sequence: TTG
ttttgctcttgttgcccagg

SEQ ID NO: 194686 - DNA, 20 bp, Artificial Sequence
  Description of Artificial Sequence: Synthetic oligonucleotide
  Target: ATXN1; (-) strand; PAM type: YTN; PAM sequence: TTT
gttttgctcttgttgcccag

SEQ ID NO: 194687 - DNA, 20 bp, Artificial Sequence
  Description of Artificial Sequence: Synthetic oligonucleotide
  Target: ATXN1; (-) strand; PAM type: YTN; PAM sequence: TTT
tgttttgctcttgttgccca

SEQ ID NO: 194688 - DNA, 20 bp, Artificial Sequence
  Description of Artificial Sequence: Synthetic oligonucleotide
  Target: ATXN1; (-) strand; PAM type: YTN; PAM sequence: TTT
ttgttttgctcttgttgccc

SEQ ID NO: 194689 - DNA, 20 bp, Artificial Sequence
  Description of Artificial Sequence: Synthetic oligonucleotide
  Target: ATXN1; (-) strand; PAM type: YTN; PAM sequence: TTG
tttttgttttgctcttgttg

SEQ ID NO: 194690 - DNA, 20 bp, Artificial Sequence
  Description of Artificial Sequence: Synthetic oligonucleotide
  Target: ATXN1; (-) strand; PAM type: YTN; PAM sequence: TTG
ttgtttttgttttgctcttg

SEQ ID NO: 194691 - DNA, 20 bp, Artificial Sequence
  Description of Artificial Sequence: Synthetic oligonucleotide
  Target: ATXN1; (-) strand; PAM type: YTN; PAM sequence: TTG
ttgttgtttttgttttgctc

SEQ ID NO: 194692 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgtttttgttttg

SEQ ID NO: 194693 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttgtttttgtt

SEQ ID NO: 194694 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttgttgttttt

SEQ ID NO: 194695 - DNA, 20 bp, Artificial Sequence
  Description of Artificial Sequence: Synthetic oligonucleotide
  Target: ATXN1; (-) strand; PAM type: YTN; PAM sequence: TTT
gttgttgttgttgttgtttt

SEQ ID NO: 194696 - DNA, 20 bp, Artificial Sequence
  Description of Artificial Sequence: Synthetic oligonucleotide
  Target: ATXN1; (-) strand; PAM type: YTN; PAM sequence: TTT
tgttgttgttgttgttgttt

SEQ ID NO: 194697 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgttgttgttgtt

SEQ ID NO: 194698 - DNA, 20 bp, Artificial Sequence
  Description of Artificial Sequence: Synthetic oligonucleotide
  Target: ATXN1; (-) strand; PAM type: YTN; PAM sequence: CTG
gtaatttttgttgttgttgt

SEQ ID NO: 194699 - DNA, 20 bp, Artificial Sequence
  Description of Artificial Sequence: Synthetic oligonucleotide
  Target: ATXN1; (-) strand; PAM type: YTN; PAM sequence: TTC
tggtaatttttgttgttgtt

SEQ ID NO: 194700 - DNA, 20 bp, Artificial Sequence
  Description of Artificial Sequence: Synthetic oligonucleotide
  Target: ATXN1; (-) strand; PAM type: YTN; PAM sequence: CTC
acattctggtaatttttgtt

SEQ ID NO: 194701 - DNA, 20 bp, Artificial Sequence
  Description of Artificial Sequence: Synthetic oligonucleotide
  Target: ATXN1; (-) strand; PAM type: YTN; PAM sequence: TTG
tgaggggtgaggaaaaaggg

SEQ ID NO: 194702 - DNA, 20 bp, Artificial Sequence
  Description of Artificial Sequence: Synthetic oligonucleotide
  Target: ATXN1; (-) strand; PAM type: YTN; PAM sequence: CTT
gtgaggggtgaggaaaaagg

SEQ ID NO: 194703 - DNA, 20 bp, Artificial Sequence
  Description of Artificial Sequence: Synthetic oligonucleotide
  Target: ATXN1; (-) strand; PAM type: YTN; PAM sequence: TTA
cttgtgaggggtgaggaaaa

SEQ ID NO: 194704 - DNA, 20 bp, Artificial Sequence
  Description of Artificial Sequence: Synthetic oligonucleotide
  Target: ATXN1; (-) strand; PAM type: YTN; PAM sequence: TTT
acttgtgaggggtgaggaaa

SEQ ID NO: 194705 - DNA, 20 bp, Artificial Sequence
  Description of Artificial Sequence: Synthetic oligonucleotide
  Target: ATXN1; (-) strand; PAM type: YTN; PAM sequence: CTC
atttacttgtgaggggtgag

SEQ ID NO: 194706 - DNA, 20 bp, Artificial Sequence
  Description of Artificial Sequence: Synthetic oligonucleotide
  Target: ATXN1; (-) strand; PAM type: YTN; PAM sequence: TTG
tctcatttacttgtgagggg

SEQ ID NO: 194707 - DNA, 20 bp, Artificial Sequence
  Description of Artificial Sequence: Synthetic oligonucleotide
  Target: ATXN1; (-) strand; PAM type: YTN; PAM sequence: CTT
gtctcatttacttgtgaggg

SEQ ID NO: 194708 - DNA, 20 bp, Artificial Sequence
  Description of Artificial Sequence: Synthetic oligonucleotide
  Target: ATXN1; (-) strand; PAM type: YTN; PAM sequence: CTG
gatcatatggcaacttgtct

SEQ ID NO: 194709 - DNA, 20 bp, Artificial Sequence
  Description of Artificial Sequence: Synthetic oligonucleotide
  Target: ATXN1; (-) strand; PAM type: YTN; PAM sequence: TTC
tggatcatatggcaacttgt

SEQ ID NO: 194710 - DNA, 20 bp, Artificial Sequence
  Description of Artificial Sequence: Synthetic oligonucleotide
  Target: ATXN1; (-) strand; PAM type: YTN; PAM sequence: TTT
ctggatcatatggcaacttg

SEQ ID NO: 194711 - DNA, 20 bp, Artificial Sequence
  Description of Artificial Sequence: Synthetic oligonucleotide
  Target: ATXN1; (-) strand; PAM type: YTN; PAM sequence: TTG
agtatatacccagtcgtggg

SEQ ID NO: 194712 - DNA, 20 bp, Artificial Sequence
  Description of Artificial Sequence: Synthetic oligonucleotide
  Target: ATXN1; (-) strand; PAM type: YTN; PAM sequence: TTT
gagtatatacccagtcgtgg

SEQ ID NO: 194713 - DNA, 20 bp, Artificial Sequence
  Description of Artificial Sequence: Synthetic oligonucleotide
  Target: ATXN1; (-) strand; PAM type: YTN; PAM sequence: TTT
tgagtatatacccagtcgtg

SEQ ID NO: 194714 - DNA, 20 bp, Artificial Sequence
  Description of Artificial Sequence: Synthetic oligonucleotide
  Target: ATXN1; (-) strand; PAM type: YTN; PAM sequence: CTT
ttgagtatatacccagtcgt

SEQ ID NO: 194715 - DNA, 20 bp, Artificial Sequence
  Description of Artificial Sequence: Synthetic oligonucleotide
  Target: ATXN1; (-) strand; PAM type: YTN; PAM sequence: TTC
ttttgagtatatacccagtc

SEQ ID NO: 194716 - DNA, 20 bp, Artificial Sequence
  Description of Artificial Sequence: Synthetic oligonucleotide
  Target: ATXN1; (-) strand; PAM type: YTN; PAM sequence: TTT
cttttgagtatatacccagt

SEQ ID NO: 194717 - DNA, 20 bp, Artificial Sequence
  Description of Artificial Sequence: Synthetic oligonucleotide
  Target: ATXN1; (-) strand; PAM type: YTN; PAM sequence: CTT
tcttttgagtatatacccag

SEQ ID NO: 194718 - DNA, 20 bp, Artificial Sequence
  Description of Artificial Sequence: Synthetic oligonucleotide
  Target: ATXN1; (-) strand; PAM type: YTN; PAM sequence: TTC
ctttcttttgagtatatacc

SEQ ID NO: 194719 - DNA, 20 bp, Artificial Sequence
  Description of Artificial Sequence: Synthetic oligonucleotide
  Target: ATXN1; (-) strand; PAM type: YTN; PAM sequence: TTT
cctttcttttgagtatatac

SEQ ID NO: 194720 - DNA, 20 bp, Artificial Sequence
  Description of Artificial Sequence: Synthetic oligonucleotide
  Target: ATXN1; (-) strand; PAM type: YTN; PAM sequence: CTG
atttcctttcttttgagtat

SEQ ID NO: 194721 - DNA, 20 bp, Artificial Sequence
  Description of Artificial Sequence: Synthetic oligonucleotide
  Target: ATXN1; (-) strand; PAM type: YTN; PAM sequence: CTC
aatatactgatttcctttct

SEQ ID NO: 194722 - DNA, 20 bp, Artificial Sequence
  Description of Artificial Sequence: Synthetic oligonucleotide
  Target: ATXN1; (-) strand; PAM type: YTN; PAM sequence: TTC
ctcaatatactgatttcctt

SEQ ID NO: 194723 - DNA, 20 bp, Artificial Sequence
  Description of Artificial Sequence: Synthetic oligonucleotide
  Target: ATXN1; (-) strand; PAM type: YTN; PAM sequence: TTT
cctcaatatactgatttcct

SEQ ID NO: 194724 - DNA, 20 bp, Artificial Sequence
  Description of Artificial Sequence: Synthetic oligonucleotide
  Target: ATXN1; (-) strand; PAM type: YTN; PAM sequence: TTT
tcctcaatatactgatttcc

SEQ ID NO: 194725 - DNA, 20 bp, Artificial Sequence
  Description of Artificial Sequence: Synthetic oligonucleotide
  Target: ATXN1; (-) strand; PAM type: YTN; PAM sequence: TTT
ttcctcaatatactgatttc

SEQ ID NO: 194726 - DNA, 20 bp, Artificial Sequence
  Description of Artificial Sequence: Synthetic oligonucleotide
  Target: ATXN1; (-) strand; PAM type: YTN; PAM sequence: CTG
taacaaacagaggaagtgca

SEQ ID NO: 194727 - DNA, 20 bp, Artificial Sequence
  Description of Artificial Sequence: Synthetic oligonucleotide
  Target: ATXN1; (-) strand; PAM type: YTN; PAM sequence: TTG
taaacagtgctgtaacaaac

SEQ ID NO: 194728 - DNA, 20 bp, Artificial Sequence
  Description of Artificial Sequence: Synthetic oligonucleotide
  Target: ATXN1; (-) strand; PAM type: YTN; PAM sequence: CTA
ttgtaaacagtgctgtaaca

SEQ ID NO: 194729 - DNA, 20 bp, Artificial Sequence
  Description of Artificial Sequence: Synthetic oligonucleotide
  Target: ATXN1; (-) strand; PAM type: YTN; PAM sequence: TTA
gctattgtaaacagtgctgt

SEQ ID NO: 194730 - DNA, 20 bp, Artificial Sequence
  Description of Artificial Sequence: Synthetic oligonucleotide
  Target: ATXN1; (-) strand; PAM type: YTN; PAM sequence: CTT
agctattgtaaacagtgctg

SEQ ID NO: 194731 - DNA, 20 bp, Artificial Sequence
  Description of Artificial Sequence: Synthetic oligonucleotide
  Target: ATXN1; (-) strand; PAM type: YTN; PAM sequence: TTC
caaatcttagctattgtaaa

SEQ ID NO: 194732 - DNA, 20 bp, Artificial Sequence
  Description of Artificial Sequence: Synthetic oligonucleotide
  Target: ATXN1; (-) strand; PAM type: YTN; PAM sequence: CTT
ccaaatcttagctattgtaa

SEQ ID NO: 194733 - DNA, 20 bp, Artificial Sequence
  Description of Artificial Sequence: Synthetic oligonucleotide
  Target: ATXN1; (-) strand; PAM type: YTN; PAM sequence: TTG
cttccaaatcttagctattg

SEQ ID NO: 194734 - DNA, 20 bp, Artificial Sequence
  Description of Artificial Sequence: Synthetic oligonucleotide
  Target: ATXN1; (-) strand; PAM type: YTN; PAM sequence: TTA
gattgcttccaaatcttagc

SEQ ID NO: 194735 - DNA, 20 bp, Artificial Sequence
  Description of Artificial Sequence: Synthetic oligonucleotide
  Target: ATXN1; (-) strand; PAM type: YTN; PAM sequence: TTT
agattgcttccaaatcttag

SEQ ID NO: 194736 - DNA, 20 bp, Artificial Sequence
  Description of Artificial Sequence: Synthetic oligonucleotide
  Target: ATXN1; (-) strand; PAM type: YTN; PAM sequence: TTG
gtagacatttagattgcttc

SEQ ID NO: 194737 - DNA, 20 bp, Artificial Sequence
  Description of Artificial Sequence: Synthetic oligonucleotide
  Target: ATXN1; (-) strand; PAM type: YTN; PAM sequence: CTG
ttggtagacatttagattgc

SEQ ID NO: 194738 - DNA, 20 bp, Artificial Sequence
  Description of Artificial Sequence: Synthetic oligonucleotide
  Target: ATXN1; (-) strand; PAM type: YTN; PAM sequence: TTC
atctgttggtagacatttag

SEQ ID NO: 194739 - DNA, 20 bp, Artificial Sequence
  Description of Artificial Sequence: Synthetic oligonucleotide
  Target: ATXN1; (-) strand; PAM type: YTN; PAM sequence: TTA
tccattcatctgttggtaga

SEQ ID NO: 194740 - DNA, 20 bp, Artificial Sequence
  Description of Artificial Sequence: Synthetic oligonucleotide
  Target: ATXN1; (-) strand; PAM type: YTN; PAM sequence: TTT
atccattcatctgttggtag

SEQ ID NO: 194741 - DNA, 20 bp, Artificial Sequence
  Description of Artificial Sequence: Synthetic oligonucleotide
  Target: ATXN1; (-) strand; PAM type: YTN; PAM sequence: CTT
tatccattcatctgttggta

SEQ ID NO: 194742 - DNA, 20 bp, Artificial Sequence
  Description of Artificial Sequence: Synthetic oligonucleotide
  Target: ATXN1; (-) strand; PAM type: YTN; PAM sequence: TTC
tttatccattcatctgttgg

SEQ ID NO: 194743 - DNA, 20 bp, Artificial Sequence
  Description of Artificial Sequence: Synthetic oligonucleotide
  Target: ATXN1; (-) strand; PAM type: YTN; PAM sequence: TTT
ctttatccattcatctgttg

SEQ ID NO: 194744 - DNA, 20 bp, Artificial Sequence
  Description of Artificial Sequence: Synthetic oligonucleotide
  Target: ATXN1; (-) strand; PAM type: YTN; PAM sequence: CTT
tctttatccattcatctgtt

SEQ ID NO: 194745 - DNA, 20 bp, Artificial Sequence
  Description of Artificial Sequence: Synthetic oligonucleotide
  Target: ATXN1; (-) strand; PAM type: YTN; PAM sequence: CTA
tactttctttatccattcat

SEQ ID NO: 194746 - DNA, 20 bp, Artificial Sequence
  Description of Artificial Sequence: Synthetic oligonucleotide
  Target: ATXN1; (-) strand; PAM type: YTN; PAM sequence: TTG
tgtgtatatactatactttc

SEQ ID NO: 194747 - DNA, 20 bp, Artificial Sequence
  Description of Artificial Sequence: Synthetic oligonucleotide
  Target: ATXN1; (-) strand; PAM type: YTN; PAM sequence: TTC
cattgtgtgtatatactata

SEQ ID NO: 194748 - DNA, 20 bp, Artificial Sequence
  Description of Artificial Sequence: Synthetic oligonucleotide
  Target: ATXN1; (-) strand; PAM type: YTN; PAM sequence: CTG
aataatattccattgtgtgt

SEQ ID NO: 194749 - DNA, 20 bp, Artificial Sequence
  Description of Artificial Sequence: Synthetic oligonucleotide
  Target: ATXN1; (-) strand; PAM type: YTN; PAM sequence: TTA
tggctgaataatattccatt

SEQ ID NO: 194750 - DNA, 20 bp, Artificial Sequence
  Description of Artificial Sequence: Synthetic oligonucleotide
  Target: ATXN1; (-) strand; PAM type: YTN; PAM sequence: TTT
atggctgaataatattccat

SEQ ID NO: 194751 - DNA, 20 bp, Artificial Sequence
  Description of Artificial Sequence: Synthetic oligonucleotide
  Target: ATXN1; (-) strand; PAM type: YTN; PAM sequence: TTT
tatggctgaataatattcca

SEQ ID NO: 194752 - DNA, 20 bp, Artificial Sequence
  Description of Artificial Sequence: Synthetic oligonucleotide
  Target: ATXN1; (-) strand; PAM type: YTN; PAM sequence: TTT
ttatggctgaataatattcc

SEQ ID NO: 194753 - DNA, 20 bp, Artificial Sequence
  Description of Artificial Sequence: Synthetic oligonucleotide
  Target: ATXN1; (-) strand; PAM type: YTN; PAM sequence: TTT
tttatggctgaataatattc

SEQ ID NO: 194754 - DNA, 20 bp, Artificial Sequence
  Description of Artificial Sequence: Synthetic oligonucleotide
  Target: ATXN1; (-) strand; PAM type: YTN; PAM sequence: CTT
ttttatggctgaataatatt

SEQ ID NO: 194755 - DNA, 20 bp, Artificial Sequence
  Description of Artificial Sequence: Synthetic oligonucleotide
  Target: ATXN1; (-) strand; PAM type: YTN; PAM sequence: TTC
ttttttatggctgaataata

SEQ ID NO: 194756 - DNA, 20 bp, Artificial Sequence
  Description of Artificial Sequence: Synthetic oligonucleotide
  Target: ATXN1; (-) strand; PAM type: YTN; PAM sequence: CTC
attcttttttatggctgaat

SEQ ID NO: 194757 - DNA, 20 bp, Artificial Sequence
  Description of Artificial Sequence: Synthetic oligonucleotide
  Target: ATXN1; (-) strand; PAM type: YTN; PAM sequence: CTG
gatctcattcttttttatgg

SEQ ID NO: 194758 - DNA, 20 bp, Artificial Sequence
  Description of Artificial Sequence: Synthetic oligonucleotide
  Target: ATXN1; (-) strand; PAM type: YTN; PAM sequence: TTG
caaatgactggatctcattc

SEQ ID NO: 194759 - DNA, 20 bp, Artificial Sequence
  Description of Artificial Sequence: Synthetic oligonucleotide
  Target: ATXN1; (-) strand; PAM type: YTN; PAM sequence: TTG
ttgcaaatgactggatctca

SEQ ID NO: 194760 - DNA, 20 bp, Artificial Sequence
  Description of Artificial Sequence: Synthetic oligonucleotide
  Target: ATXN1; (-) strand; PAM type: YTN; PAM sequence: TTC
catccatgttgttgcaaatg

SEQ ID NO: 194761 - DNA, 20 bp, Artificial Sequence
  Description of Artificial Sequence: Synthetic oligonucleotide
  Target: ATXN1; (-) strand; PAM type: YTN; PAM sequence: CTC
gttccatccatgttgttgca

SEQ ID NO: 194762 - DNA, 20 bp, Artificial Sequence
  Description of Artificial Sequence: Synthetic oligonucleotide
  Target: ATXN1; (-) strand; PAM type: YTN; PAM sequence: CTC
tcgttccatccatgttgttg

SEQ ID NO: 194763 - DNA, 20 bp, Artificial Sequence
  Description of Artificial Sequence: Synthetic oligonucleotide
  Target: ATXN1; (-) strand; PAM type: YTN; PAM sequence: TTA
acataatgatctctcgttcc

SEQ ID NO: 194764 - DNA, 20 bp, Artificial Sequence
  Description of Artificial Sequence: Synthetic oligonucleotide
  Target: ATXN1; (-) strand; PAM type: YTN; PAM sequence: CTT
aacataatgatctctcgttc

SEQ ID NO: 194765 - DNA, 20 bp, Artificial Sequence
  Description of Artificial Sequence: Synthetic oligonucleotide
  Target: ATXN1; (-) strand; PAM type: YTN; PAM sequence: TTC
acttaacataatgatctctc

SEQ ID NO: 194766 - DNA, 20 bp, Artificial Sequence
  Description of Artificial Sequence: Synthetic oligonucleotide
  Target: ATXN1; (-) strand; PAM type: YTN; PAM sequence: TTT
cacttaacataatgatctct

SEQ ID NO: 194767 - DNA, 20 bp, Artificial Sequence
  Description of Artificial Sequence: Synthetic oligonucleotide
  Target: ATXN1; (-) strand; PAM type: YTN; PAM sequence: TTT
tcacttaacataatgatctc

SEQ ID NO: 194768 - DNA, 20 bp, Artificial Sequence
  Description of Artificial Sequence: Synthetic oligonucleotide
  Target: ATXN1; (-) strand; PAM type: YTN; PAM sequence: TTT
ttcacttaacataatgatct

SEQ ID NO: 194769 - DNA, 20 bp, Artificial Sequence
  Description of Artificial Sequence: Synthetic oligonucleotide
  Target: ATXN1; (-) strand; PAM type: YTN; PAM sequence: TTT
tttcacttaacataatgatc

SEQ ID NO: 194770 - DNA, 20 bp, Artificial Sequence
  Description of Artificial Sequence: Synthetic oligonucleotide
  Target: ATXN1; (-) strand; PAM type: YTN; PAM sequence: CTT
ttttcacttaacataatgat

SEQ ID NO: 194771 - DNA, 20 bp, Artificial Sequence
  Description of Artificial Sequence: Synthetic oligonucleotide
  Target: ATXN1; (-) strand; PAM type: YTN; PAM sequence: CTG
gcttttttcacttaacataa

SEQ ID NO: 194772 - DNA, 20 bp, Artificial Sequence
  Description of Artificial Sequence: Synthetic oligonucleotide
  Target: ATXN1; (-) strand; PAM type: YTN; PAM sequence: CTG
tgcctggcttttttcactta

SEQ ID NO: 194773 - DNA, 20 bp, Artificial Sequence
  Description of Artificial Sequence: Synthetic oligonucleotide
  Target: ATXN1; (-) strand; PAM type: YTN; PAM sequence: TTC
tgtgcctggcttttttcact

SEQ ID NO: 194774 - DNA, 20 bp, Artificial Sequence
  Description of Artificial Sequence: Synthetic oligonucleotide
  Target: ATXN1; (-) strand; PAM type: YTN; PAM sequence: TTT
ctgtgcctggcttttttcac

SEQ ID NO: 194775 - DNA, 20 bp, Artificial Sequence
  Description of Artificial Sequence: Synthetic oligonucleotide
  Target: ATXN1; (-) strand; PAM type: YTN; PAM sequence: CTT
tctgtgcctggcttttttca

SEQ ID NO: 194776 - DNA, 20 bp, Artificial Sequence
  Description of Artificial Sequence: Synthetic oligonucleotide
  Target: ATXN1; (-) strand; PAM type: YTN; PAM sequence: TTG
tctttctgtgcctggctttt

SEQ ID NO: 194777 - DNA, 20 bp, Artificial Sequence
  Description of Artificial Sequence: Synthetic oligonucleotide
  Target: ATXN1; (-) strand; PAM type: YTN; PAM sequence: TTT
gtctttctgtgcctggcttt

SEQ ID NO: 194778 - DNA, 20 bp, Artificial Sequence
  Description of Artificial Sequence: Synthetic oligonucleotide
  Target: ATXN1; (-) strand; PAM type: YTN; PAM sequence: CTA
agtttgtctttctgtgcctg

SEQ ID NO: 194779 - DNA, 20 bp, Artificial Sequence
  Description of Artificial Sequence: Synthetic oligonucleotide
  Target: ATXN1; (-) strand; PAM type: YTN; PAM sequence: TTG
aatcccacagataagtgaga

SEQ ID NO: 194780 - DNA, 20 bp, Artificial Sequence
  Description of Artificial Sequence: Synthetic oligonucleotide
  Target: ATXN1; (-) strand; PAM type: YTN; PAM sequence: TTT
gaatcccacagataagtgag

SEQ ID NO: 194781 - DNA, 20 bp, Artificial Sequence
  Description of Artificial Sequence: Synthetic oligonucleotide
  Target: ATXN1; (-) strand; PAM type: YTN; PAM sequence: TTT
tgaatcccacagataagtga

SEQ ID NO: 194782 - DNA, 20 bp, Artificial Sequence
  Description of Artificial Sequence: Synthetic oligonucleotide
  Target: ATXN1; (-) strand; PAM type: YTN; PAM sequence: TTT
ttgaatcccacagataagtg

SEQ ID NO: 194783 - DNA, 20 bp, Artificial Sequence
  Description of Artificial Sequence: Synthetic oligonucleotide
  Target: ATXN1; (-) strand; PAM type: YTN; PAM sequence: TTG
atttttgaatcccacagata

SEQ ID NO: 194784 - DNA, 20 bp, Artificial Sequence
  Description of Artificial Sequence: Synthetic oligonucleotide
  Target: ATXN1; (-) strand; PAM type: YTN; PAM sequence: TTT
gatttttgaatcccacagat

SEQ ID NO: 194785 - DNA, 20 bp, Artificial Sequence
  Description of Artificial Sequence: Synthetic oligonucleotide
  Target: ATXN1; (-) strand; PAM type: YTN; PAM sequence: TTC
agtaggtttgatttttgaat

SEQ ID NO: 194786 - DNA, 20 bp, Artificial Sequence
  Description of Artificial Sequence: Synthetic oligonucleotide
  Target: ATXN1; (-) strand; PAM type: YTN; PAM sequence: CTG
tgtccatgagttcagtaggt

SEQ ID NO: 194787 - DNA, 20 bp, Artificial Sequence
  Description of Artificial Sequence: Synthetic oligonucleotide
  Target: ATXN1; (-) strand; PAM type: YTN; PAM sequence: CTC
tgtgtccatgagttcagtag

SEQ ID NO: 194788 - DNA, 20 bp, Artificial Sequence
  Description of Artificial Sequence: Synthetic oligonucleotide
  Target: ATXN1; (-) strand; PAM type: YTN; PAM sequence: CTC
tctgtgtccatgagttcagt

SEQ ID NO: 194789 - DNA, 20 bp, Artificial Sequence
  Description of Artificial Sequence: Synthetic oligonucleotide
  Target: ATXN1; (-) strand; PAM type: YTN; PAM sequence: CTA
ctctctgtgtccatgagttc

SEQ ID NO: 194790 - DNA, 20 bp, Artificial Sequence
  Description of Artificial Sequence: Synthetic oligonucleotide
  Target: ATXN1; (-) strand; PAM type: YTN; PAM sequence: CTC
ctactctctgtgtccatgag

SEQ ID NO: 194791 - DNA, 20 bp, Artificial Sequence
  Description of Artificial Sequence: Synthetic oligonucleotide
  Target: ATXN1; (-) strand; PAM type: YTN; PAM sequence: TTG
gtagccatcctcctactctc

SEQ ID NO: 194792 - DNA, 20 bp, Artificial Sequence
  Description of Artificial Sequence: Synthetic oligonucleotide
  Target: ATXN1; (-) strand; PAM type: YTN; PAM sequence: TTT
ggtagccatcctcctactct

SEQ ID NO: 194793 - DNA, 20 bp, Artificial Sequence
  Description of Artificial Sequence: Synthetic oligonucleotide
  Target: ATXN1; (-) strand; PAM type: YTN; PAM sequence: CTT
tggtagccatcctcctactc

SEQ ID NO: 194794 - DNA, 20 bp, Artificial Sequence
  Description of Artificial Sequence: Synthetic oligonucleotide
  Target: ATXN1; (-) strand; PAM type: YTN; PAM sequence: TTC
ccagcctttggtagccatcc

SEQ ID NO: 194795 - DNA, 20 bp, Artificial Sequence
  Description of Artificial Sequence: Synthetic oligonucleotide
  Target: ATXN1; (-) strand; PAM type: YTN; PAM sequence: CTT
cccagcctttggtagccatc

SEQ ID NO: 194796 - DNA, 20 bp, Artificial Sequence
  Description of Artificial Sequence: Synthetic oligonucleotide
  Target: ATXN1; (-) strand; PAM type: YTN; PAM sequence: CTA
cccttcccagcctttggtag

SEQ ID NO: 194797 - DNA, 20 bp, Artificial Sequence
  Description of Artificial Sequence: Synthetic oligonucleotide
  Target: ATXN1; (-) strand; PAM type: YTN; PAM sequence: CTA
ctacccttcccagcctttgg

SEQ ID NO: 194798 - DNA, 20 bp, Artificial Sequence
  Description of Artificial Sequence: Synthetic oligonucleotide
  Target: ATXN1; (-) strand; PAM type: YTN; PAM sequence: CTC
cagccccctactacccttcc

SEQ ID NO: 194799 - DNA, 20 bp, Artificial Sequence
  Description of Artificial Sequence: Synthetic oligonucleotide
  Target: ATXN1; (-) strand; PAM type: YTN; PAM sequence: CTC
ccctccagccccctactacc

SEQ ID NO: 194800 - DNA, 20 bp, Artificial Sequence
  Description of Artificial Sequence: Synthetic oligonucleotide
  Target: ATXN1; (-) strand; PAM type: YTN; PAM sequence: TTA
accatccccacctcccctcc

SEQ ID NO: 194801 - DNA, 20 bp, Artificial Sequence
  Description of Artificial Sequence: Synthetic oligonucleotide
  Target: ATXN1; (-) strand; PAM type: YTN; PAM sequence: TTG
tacccattaaccatccccac

SEQ ID NO: 194802 - DNA, 20 bp, Artificial Sequence
  Description of Artificial Sequence: Synthetic oligonucleotide
  Target: ATXN1; (-) strand; PAM type: YTN; PAM sequence: TTT
gtacccattaaccatcccca

SEQ ID NO: 194803 - DNA, 20 bp, Artificial Sequence
  Description of Artificial Sequence: Synthetic oligonucleotide
  Target: ATXN1; (-) strand; PAM type: YTN; PAM sequence: TTT
tgtacccattaaccatcccc

SEQ ID NO: 194804 - DNA, 20 bp, Artificial Sequence
  Description of Artificial Sequence: Synthetic oligonucleotide
  Target: ATXN1; (-) strand; PAM type: YTN; PAM sequence: TTT
ttgtacccattaaccatccc

SEQ ID NO: 194805 - DNA, 20 bp, Artificial Sequence
  Description of Artificial Sequence: Synthetic oligonucleotide
  Target: ATXN1; (-) strand; PAM type: YTN; PAM sequence: TTT
tttgtacccattaaccatcc

SEQ ID NO: 194806 - DNA, 20 bp, Artificial Sequence
  Description of Artificial Sequence: Synthetic oligonucleotide
  Target: ATXN1; (-) strand; PAM type: YTN; PAM sequence: TTT
ttttgtacccattaaccatc

SEQ ID NO: 194807 - DNA, 20 bp, Artificial Sequence
  Description of Artificial Sequence: Synthetic oligonucleotide
  Target: ATXN1; (-) strand; PAM type: YTN; PAM sequence: CTT
tttttgtacccattaaccat

SEQ ID NO: 194808 - DNA, 20 bp, Artificial Sequence
  Description of Artificial Sequence: Synthetic oligonucleotide
  Target: ATXN1; (-) strand; PAM type: YTN; PAM sequence: CTA
ctttttttgtacccattaac

SEQ ID NO: 194809 - DNA, 20 bp, Artificial Sequence
  Description of Artificial Sequence: Synthetic oligonucleotide
  Target: ATXN1; (-) strand; PAM type: YTN; PAM sequence: CTA
actactttttttgtacccat

SEQ ID NO: 194810 - DNA, 20 bp, Artificial Sequence
  Description of Artificial Sequence: Synthetic oligonucleotide
  Target: ATXN1; (-) strand; PAM type: YTN; PAM sequence: TTC
taactactttttttgtaccc

SEQ ID NO: 194811 - DNA, 20 bp, Artificial Sequence
  Description of Artificial Sequence: Synthetic oligonucleotide
  Target: ATXN1; (-) strand; PAM type: YTN; PAM sequence: TTA
ttctaactactttttttgta

SEQ ID NO: 194812 - DNA, 20 bp, Artificial Sequence
  Description of Artificial Sequence: Synthetic oligonucleotide
  Target: ATXN1; (-) strand; PAM type: YTN; PAM sequence: TTT
attctaactactttttttgt

SEQ ID NO: 194813 - DNA, 20 bp, Artificial Sequence
  Description of Artificial Sequence: Synthetic oligonucleotide
  Target: ATXN1; (-) strand; PAM type: YTN; PAM sequence: TTA
tttattctaactactttttt

SEQ ID NO: 194814 - DNA, 20 bp, Artificial Sequence
  Description of Artificial Sequence: Synthetic oligonucleotide
  Target: ATXN1; (-) strand; PAM type: YTN; PAM sequence: CTT
atttattctaactacttttt

SEQ ID NO: 194815 - DNA, 20 bp, Artificial Sequence
  Description of Artificial Sequence: Synthetic oligonucleotide
  Target: ATXN1; (-) strand; PAM type: YTN; PAM sequence: CTA
tcaaatagtagatcttattt

SEQ ID NO: 194816 - DNA, 20 bp, Artificial Sequence
  Description of Artificial Sequence: Synthetic oligonucleotide
  Target: ATXN1; (-) strand; PAM type: YTN; PAM sequence: TTG
tgctatcaaatagtagatct

SEQ ID NO: 194817 - DNA, 20 bp, Artificial Sequence
  Description of Artificial Sequence: Synthetic oligonucleotide
  Target: ATXN1; (-) strand; PAM type: YTN; PAM sequence: CTG
ttgtgctatcaaatagtaga

SEQ ID NO: 194818 - DNA, 20 bp, Artificial Sequence
  Description of Artificial Sequence: Synthetic oligonucleotide
  Target: ATXN1; (-) strand; PAM type: YTN; PAM sequence: CTC
tgttgtgctatcaaatagta

SEQ ID NO: 194819 - DNA, 20 bp, Artificial Sequence
  Description of Artificial Sequence: Synthetic oligonucleotide
  Target: ATXN1; (-) strand; PAM type: YTN; PAM sequence: CTA
tagtcactctgttgtgctat

SEQ ID NO: 194820 - DNA, 20 bp, Artificial Sequence
  Description of Artificial Sequence: Synthetic oligonucleotide
  Target: ATXN1; (-) strand; PAM type: YTN; PAM sequence: TTG
actatagtcactctgttgtg

SEQ ID NO: 194821 - DNA, 20 bp, Artificial Sequence
  Description of Artificial Sequence: Synthetic oligonucleotide
  Target: ATXN1; (-) strand; PAM type: YTN; PAM sequence: TTA
ttgactatagtcactctgtt

SEQ ID NO: 194822 - DNA, 20 bp, Artificial Sequence
  Description of Artificial Sequence: Synthetic oligonucleotide
  Target: ATXN1; (-) strand; PAM type: YTN; PAM sequence: TTA
ttattgactatagtcactct

SEQ ID NO: 194823 - DNA, 20 bp, Artificial Sequence
  Description of Artificial Sequence: Synthetic oligonucleotide
  Target: ATXN1; (-) strand; PAM type: YTN; PAM sequence: TTA
aaatgtacagttattattga

SEQ ID NO: 194824 - DNA, 20 bp, Artificial Sequence
  Description of Artificial Sequence: Synthetic oligonucleotide
  Target: ATXN1; (-) strand; PAM type: YTN; PAM sequence: TTT
aaaatgtacagttattattg

SEQ ID NO: 194825 - DNA, 20 bp, Artificial Sequence
  Description of Artificial Sequence: Synthetic oligonucleotide
  Target: ATXN1; (-) strand; PAM type: YTN; PAM sequence: TTT
taaaatgtacagttattatt

SEQ ID NO: 194826 - DNA, 20 bp, Artificial Sequence
  Description of Artificial Sequence: Synthetic oligonucleotide
  Target: ATXN1; (-) strand; PAM type: YTN; PAM sequence: TTA
ttttaaaatgtacagttatt

SEQ ID NO: 194827 - DNA, 20 bp, Artificial Sequence
  Description of Artificial Sequence: Synthetic oligonucleotide
  Target: ATXN1; (-) strand; PAM type: YTN; PAM sequence: TTT
attttaaaatgtacagttat

SEQ ID NO: 194828 - DNA, 20 bp, Artificial Sequence
  Description of Artificial Sequence: Synthetic oligonucleotide
  Target: ATXN1; (-) strand; PAM type: YTN; PAM sequence: CTT
tattttaaaatgtacagtta

SEQ ID NO: 194829 - DNA, 20 bp, Artificial Sequence
  Description of Artificial Sequence: Synthetic oligonucleotide
  Target: ATXN1; (-) strand; PAM type: YTN; PAM sequence: CTC
tttattttaaaatgtacagt

SEQ ID NO: 194830 - DNA, 20 bp, Artificial Sequence
  Description of Artificial Sequence: Synthetic oligonucleotide
  Target: ATXN1; (-) strand; PAM type: YTN; PAM sequence: TTA
tactctttattttaaaatgt

SEQ ID NO: 194831 - DNA, 20 bp, Artificial Sequence
  Description of Artificial Sequence: Synthetic oligonucleotide
  Target: ATXN1; (-) strand; PAM type: YTN; PAM sequence: CTC
cagttatactctttatttta

SEQ ID NO: 194832 - DNA, 20 bp, Artificial Sequence
  Description of Artificial Sequence: Synthetic oligonucleotide
  Target: ATXN1; (-) strand; PAM type: YTN; PAM sequence: TTA
caacaaacactccagttata

SEQ ID NO: 194833 - DNA, 20 bp, Artificial Sequence
  Description of Artificial Sequence: Synthetic oligonucleotide
  Target: ATXN1; (-) strand; PAM type: YTN; PAM sequence: TTA
tccattacaacaaacactcc

SEQ ID NO: 194834 - DNA, 20 bp, Artificial Sequence
  Description of Artificial Sequence: Synthetic oligonucleotide
  Target: ATXN1; (-) strand; PAM type: YTN; PAM sequence: TTT
atccattacaacaaacactc

SEQ ID NO: 194835 - DNA, 20 bp, Artificial Sequence
  Description of Artificial Sequence: Synthetic oligonucleotide
  Target: ATXN1; (-) strand; PAM type: YTN; PAM sequence: CTC
aagcatttatccattacaac

SEQ ID NO: 194836 - DNA, 20 bp, Artificial Sequence
  Description of Artificial Sequence: Synthetic oligonucleotide
  Target: ATXN1; (-) strand; PAM type: YTN; PAM sequence: TTG
atacagacatgtaaaataaa

SEQ ID NO: 194837 - DNA, 20 bp, Artificial Sequence
  Description of Artificial Sequence: Synthetic oligonucleotide
  Target: ATXN1; (-) strand; PAM type: YTN; PAM sequence: TTT
gatacagacatgtaaaataa

SEQ ID NO: 194838 - DNA, 20 bp, Artificial Sequence
  Description of Artificial Sequence: Synthetic oligonucleotide
  Target: ATXN1; (-) strand; PAM type: YTN; PAM sequence: TTT
tgatacagacatgtaaaata

SEQ ID NO: 194839 - DNA, 20 bp, Artificial Sequence
  Description of Artificial Sequence: Synthetic oligonucleotide
  Target: ATXN1; (-) strand; PAM type: YTN; PAM sequence: TTG
tgggtacataggtgtgtata

SEQ ID NO: 194840 - DNA, 20 bp, Artificial Sequence
  Description of Artificial Sequence: Synthetic oligonucleotide
  Target: ATXN1; (-) strand; PAM type: YTN; PAM sequence: TTT
gtgggtacataggtgtgtat

SEQ ID NO: 194841 - DNA, 20 bp, Artificial Sequence
  Description of Artificial Sequence: Synthetic oligonucleotide
  Target: ATXN1; (-) strand; PAM type: YTN; PAM sequence: TTT
tgtgggtacataggtgtgta

SEQ ID NO: 194842 - DNA, 20 bp, Artificial Sequence
  Description of Artificial Sequence: Synthetic oligonucleotide
  Target: ATXN1; (-) strand; PAM type: YTN; PAM sequence: TTT
ttgtgggtacataggtgtgt

SEQ ID NO: 194843 - DNA, 20 bp, Artificial Sequence
  Description of Artificial Sequence: Synthetic oligonucleotide
  Target: ATXN1; (-) strand; PAM type: YTN; PAM sequence: TTT
tttgtgggtacataggtgtg

SEQ ID NO: 194844 - DNA, 20 bp, Artificial Sequence
  Description of Artificial Sequence: Synthetic oligonucleotide
  Target: ATXN1; (-) strand; PAM type: YTN; PAM sequence: TTT
ttttgtgggtacataggtgt

SEQ ID NO: 194845 - DNA, 20 bp, Artificial Sequence
  Description of Artificial Sequence: Synthetic oligonucleotide
  Target: ATXN1; (-) strand; PAM type: YTN; PAM sequence: TTA
atttttttgtgggtacatag

SEQ ID NO: 194846 - DNA, 20 bp, Artificial Sequence
  Description of Artificial Sequence: Synthetic oligonucleotide
  Target: ATXN1; (-) strand; PAM type: YTN; PAM sequence: TTT
aatttttttgtgggtacata

SEQ ID NO: 194847 - DNA, 20 bp, Artificial Sequence
  Description of Artificial Sequence: Synthetic oligonucleotide
  Target: ATXN1; (-) strand; PAM type: YTN; PAM sequence: TTT
taatttttttgtgggtacat

SEQ ID NO: 194848 - DNA, 20 bp, Artificial Sequence
  Description of Artificial Sequence: Synthetic oligonucleotide
  Target: ATXN1; (-) strand; PAM type: YTN; PAM sequence: TTT
ttaatttttttgtgggtaca

SEQ ID NO: 194849 - DNA, 20 bp, Artificial Sequence
  Description of Artificial Sequence: Synthetic oligonucleotide
  Target: ATXN1; (-) strand; PAM type: YTN; PAM sequence: TTA
atttttaatttttttgtggg

SEQ ID NO: 194850 - DNA, 20 bp, Artificial Sequence
  Description of Artificial Sequence: Synthetic oligonucleotide
  Target: ATXN1; (-) strand; PAM type: YTN; PAM sequence: TTT
aatttttaatttttttgtgg

SEQ ID NO: 194851 - DNA, 20 bp, Artificial Sequence
  Description of Artificial Sequence: Synthetic oligonucleotide
  Target: ATXN1; (-) strand; PAM type: YTN; PAM sequence: TTT
taatttttaatttttttgtg

SEQ ID NO: 194852 - DNA, 20 bp, Artificial Sequence
  Description of Artificial Sequence: Synthetic oligonucleotide
  Target: ATXN1; (-) strand; PAM type: YTN; PAM sequence: TTT
ttaatttttaatttttttgt

SEQ ID NO: 194853 - DNA, 20 bp, Artificial Sequence
  Description of Artificial Sequence: Synthetic oligonucleotide
  Target: ATXN1; (-) strand; PAM type: YTN; PAM sequence: TTT
tttaatttttaatttttttg

SEQ ID NO: 194854 - DNA, 20 bp, Artificial Sequence
  Description of Artificial Sequence: Synthetic oligonucleotide
  Target: ATXN1; (-) strand; PAM type: YTN; PAM sequence: TTT
ttttaatttttaattttttt

SEQ ID NO: 194855 - DNA, 20 bp, Artificial Sequence
  Description of Artificial Sequence: Synthetic oligonucleotide
  Target: ATXN1; (-) strand; PAM type: YTN; PAM sequence: TTT
tttttaatttttaatttttt

SEQ ID NO: 194856 - DNA, 20 bp, Artificial Sequence
  Description of Artificial Sequence: Synthetic oligonucleotide
  Target: ATXN1; (-) strand; PAM type: YTN; PAM sequence: TTT
ttttttaatttttaattttt

SEQ ID NO: 194857 - DNA, 20 bp, Artificial Sequence
  Description of Artificial Sequence: Synthetic oligonucleotide
  Target: ATXN1; (-) strand; PAM type: YTN; PAM sequence: CTG
taatttttttttaattttta

SEQ ID NO: 194858 - DNA, 20 bp, Artificial Sequence
  Description of Artificial Sequence: Synthetic oligonucleotide
  Target: ATXN1; (-) strand; PAM type: YTN; PAM sequence: CTG
catagtcctgtaattttttt

SEQ ID NO: 194859 - DNA, 20 bp, Artificial Sequence
  Description of Artificial Sequence: Synthetic oligonucleotide
  Target: ATXN1; (-) strand; PAM type: YTN; PAM sequence: TTG
actgcatagtcctgtaattt

SEQ ID NO: 194860 - DNA, 20 bp, Artificial Sequence
  Description of Artificial Sequence: Synthetic oligonucleotide
  Target: ATXN1; (-) strand; PAM type: YTN; PAM sequence: TTT
gactgcatagtcctgtaatt

SEQ ID NO: 194861 - DNA, 20 bp, Artificial Sequence
  Description of Artificial Sequence: Synthetic oligonucleotide
  Target: ATXN1; (-) strand; PAM type: YTN; PAM sequence: TTT
tgactgcatagtcctgtaat

SEQ ID NO: 194862 - DNA, 20 bp, Artificial Sequence
  Description of Artificial Sequence: Synthetic oligonucleotide
  Target: ATXN1; (-) strand; PAM type: YTN; PAM sequence: TTT
ttgactgcatagtcctgtaa

SEQ ID NO: 194863 - DNA, 20 bp, Artificial Sequence
  Description of Artificial Sequence: Synthetic oligonucleotide
  Target: ATXN1; (-) strand; PAM type: YTN; PAM sequence: TTT
tttgactgcatagtcctgta

SEQ ID NO: 194864 - DNA, 20 bp, Artificial Sequence
  Description of Artificial Sequence: Synthetic oligonucleotide
  Target: ATXN1; (-) strand; PAM type: YTN; PAM sequence: TTT
ttttgactgcatagtcctgt

SEQ ID NO: 194865 - DNA, 20 bp, Artificial Sequence
  Description of Artificial Sequence: Synthetic oligonucleotide
  Target: ATXN1; (-) strand; PAM type: YTN; PAM sequence: CTT
tttttgactgcatagtcctg

SEQ ID NO: 194866 - DNA, 20 bp, Artificial Sequence
  Description of Artificial Sequence: Synthetic oligonucleotide
  Target: ATXN1; (-) strand; PAM type: YTN; PAM sequence: CTC
atccactttttttgactgca

SEQ ID NO: 194867 - DNA, 20 bp, Artificial Sequence
  Description of Artificial Sequence: Synthetic oligonucleotide
  Target: ATXN1; (-) strand; PAM type: YTN; PAM sequence: TTG
tctcatccactttttttgac

SEQ ID NO: 194868 - DNA, 20 bp, Artificial Sequence
  Description of Artificial Sequence: Synthetic oligonucleotide
  Target: ATXN1; (-) strand; PAM type: YTN; PAM sequence: TTT
gtctcatccactttttttga

SEQ ID NO: 194869 - DNA, 20 bp, Artificial Sequence
  Description of Artificial Sequence: Synthetic oligonucleotide
  Target: ATXN1; (-) strand; PAM type: YTN; PAM sequence: CTC
atttgtctcatccacttttt

SEQ ID NO: 194870 - DNA, 20 bp, Artificial Sequence
  Description of Artificial Sequence: Synthetic oligonucleotide
  Target: ATXN1; (-) strand; PAM type: YTN; PAM sequence: TTC
tcatttgtctcatccacttt

SEQ ID NO: 194871 - DNA, 20 bp, Artificial Sequence
  Description of Artificial Sequence: Synthetic oligonucleotide
  Target: ATXN1; (-) strand; PAM type: YTN; PAM sequence: TTG
ttctcatttgtctcatccac

SEQ ID NO: 194872 - DNA, 20 bp, Artificial Sequence
  Description of Artificial Sequence: Synthetic oligonucleotide
  Target: ATXN1; (-) strand; PAM type: YTN; PAM sequence: TTT
gttctcatttgtctcatcca

SEQ ID NO: 194873 - DNA, 20 bp, Artificial Sequence
  Description of Artificial Sequence: Synthetic oligonucleotide
  Target: ATXN1; (-) strand; PAM type: YTN; PAM sequence: TTT
tgttctcatttgtctcatcc

SEQ ID NO: 194874 - DNA, 20 bp, Artificial Sequence
  Description of Artificial Sequence: Synthetic oligonucleotide
  Target: ATXN1; (-) strand; PAM type: YTN; PAM sequence: TTA
ttttgttctcatttgtctca

SEQ ID NO: 194875 - DNA, 20 bp, Artificial Sequence
  Description of Artificial Sequence: Synthetic oligonucleotide
  Target: ATXN1; (-) strand; PAM type: YTN; PAM sequence: TTT
attttgttctcatttgtctc

SEQ ID NO: 194876 - DNA, 20 bp, Artificial Sequence
  Description of Artificial Sequence: Synthetic oligonucleotide
  Target: ATXN1; (-) strand; PAM type: YTN; PAM sequence: TTT
tattttgttctcatttgtct

SEQ ID NO: 194877 - DNA, 20 bp, Artificial Sequence
  Description of Artificial Sequence: Synthetic oligonucleotide
  Target: ATXN1; (-) strand; PAM type: YTN; PAM sequence: TTA
tacagtgaacagttttattt

SEQ ID NO: 194878 - DNA, 20 bp, Artificial Sequence
  Description of Artificial Sequence: Synthetic oligonucleotide
  Target: ATXN1; (-) strand; PAM type: YTN; PAM sequence: TTA
ttatacagtgaacagtttta

SEQ ID NO: 194879 - DNA, 20 bp, Artificial Sequence
  Description of Artificial Sequence: Synthetic oligonucleotide
  Target: ATXN1; (-) strand; PAM type: YTN; PAM sequence: CTA
attattatacagtgaacagt

SEQ ID NO: 194880 - DNA, 20 bp, Artificial Sequence
  Description of Artificial Sequence: Synthetic oligonucleotide
  Target: ATXN1; (-) strand; PAM type: YTN; PAM sequence: TTA
tctaattattatacagtgaa

SEQ ID NO: 194881 - DNA, 20 bp, Artificial Sequence
  Description of Artificial Sequence: Synthetic oligonucleotide
  Target: ATXN1; (-) strand; PAM type: YTN; PAM sequence: TTT
atctaattattatacagtga

SEQ ID NO: 194882 - DNA, 20 bp, Artificial Sequence
  Description of Artificial Sequence: Synthetic oligonucleotide
  Target: ATXN1; (-) strand; PAM type: YTN; PAM sequence: CTA
tttatctaattattatacag

SEQ ID NO: 194883 - DNA, 20 bp, Artificial Sequence
  Description of Artificial Sequence: Synthetic oligonucleotide
  Target: ATXN1; (-) strand; PAM type: YTN; PAM sequence: TTC
tatttatctaattattatac

SEQ ID NO: 194884 - DNA, 20 bp, Artificial Sequence
  Description of Artificial Sequence: Synthetic oligonucleotide
  Target: ATXN1; (-) strand; PAM type: YTN; PAM sequence: TTT
ctatttatctaattattata

SEQ ID NO: 194885 - DNA, 20 bp, Artificial Sequence
  Description of Artificial Sequence: Synthetic oligonucleotide
  Target: ATXN1; (-) strand; PAM type: YTN; PAM sequence: TTT
tctatttatctaattattat

SEQ ID NO: 194886 - DNA, 20 bp, Artificial Sequence
  Description of Artificial Sequence: Synthetic oligonucleotide
  Target: ATXN1; (-) strand; PAM type: YTN; PAM sequence: TTT
ttctatttatctaattatta

SEQ ID NO: 194887 - DNA, 20 bp, Artificial Sequence
  Description of Artificial Sequence: Synthetic oligonucleotide
  Target: ATXN1; (-) strand; PAM type: YTN; PAM sequence: TTG
ggtttttctatttatctaat

SEQ ID NO: 194888 - DNA, 20 bp, Artificial Sequence
  Description of Artificial Sequence: Synthetic oligonucleotide
  Target: ATXN1; (-) strand; PAM type: YTN; PAM sequence: CTT
gggtttttctatttatctaa

SEQ ID NO: 194889 - DNA, 20 bp, Artificial Sequence
  Description of Artificial Sequence: Synthetic oligonucleotide
  Target: ATXN1; (-) strand; PAM type: YTN; PAM sequence: TTA
cttgggtttttctatttatc

SEQ ID NO: 194890 - DNA, 20 bp, Artificial Sequence
  Description of Artificial Sequence: Synthetic oligonucleotide
  Target: ATXN1; (-) strand; PAM type: YTN; PAM sequence: TTG
tattacttgggtttttctat

SEQ ID NO: 194891 - DNA, 20 bp, Artificial Sequence
  Description of Artificial Sequence: Synthetic oligonucleotide
  Target: ATXN1; (-) strand; PAM type: YTN; PAM sequence: TTT
gtattacttgggtttttcta

SEQ ID NO: 194892 - DNA, 20 bp, Artificial Sequence
  Description of Artificial Sequence: Synthetic oligonucleotide
  Target: ATXN1; (-) strand; PAM type: YTN; PAM sequence: CTG
tggatttgtattacttgggt

SEQ ID NO: 194893 - DNA, 20 bp, Artificial Sequence
  Description of Artificial Sequence: Synthetic oligonucleotide
  Target: ATXN1; (-) strand; PAM type: YTN; PAM sequence: TTC
tgtggatttgtattacttgg

SEQ ID NO: 194894 - DNA, 20 bp, Artificial Sequence
  Description of Artificial Sequence: Synthetic oligonucleotide
  Target: ATXN1; (-) strand; PAM type: YTN; PAM sequence: CTT
ctgtggatttgtattacttg

SEQ ID NO: 194895 - DNA, 20 bp, Artificial Sequence
  Description of Artificial Sequence: Synthetic oligonucleotide
  Target: ATXN1; (-) strand; PAM type: YTN; PAM sequence: TTA
gtgggacttctgtggatttg

SEQ ID NO: 194896 - DNA, 20 bp, Artificial Sequence
  Description of Artificial Sequence: Synthetic oligonucleotide
  Target: ATXN1; (-) strand; PAM type: YTN; PAM sequence: TTA
ttagtgggacttctgtggat

SEQ ID NO: 194897 - DNA, 20 bp, Artificial Sequence
  Description of Artificial Sequence: Synthetic oligonucleotide
  Target: ATXN1; (-) strand; PAM type: YTN; PAM sequence: TTA
atagtgattattagtgggac

SEQ ID NO: 194898 - DNA, 20 bp, Artificial Sequence
  Description of Artificial Sequence: Synthetic oligonucleotide
  Target: ATXN1; (-) strand; PAM type: YTN; PAM sequence: CTG
ttaatagtgattattagtgg

SEQ ID NO: 194899 - DNA, 20 bp, Artificial Sequence
  Description of Artificial Sequence: Synthetic oligonucleotide
  Target: ATXN1; (-) strand; PAM type: YTN; PAM sequence: CTG
gggtcatataaccagactgt

SEQ ID NO: 194900 - DNA, 20 bp, Artificial Sequence
  Description of Artificial Sequence: Synthetic oligonucleotide
  Target: ATXN1; (-) strand; PAM type: YTN; PAM sequence: TTG
ggcataggagagagtctggg

SEQ ID NO: 194901 - DNA, 20 bp, Artificial Sequence
  Description of Artificial Sequence: Synthetic oligonucleotide
  Target: ATXN1; (-) strand; PAM type: YTN; PAM sequence: CTT
gggcataggagagagtctgg

SEQ ID NO: 194902 - DNA, 20 bp, Artificial Sequence
  Description of Artificial Sequence: Synthetic oligonucleotide
  Target: ATXN1; (-) strand; PAM type: YTN; PAM sequence: CTG
tatacttgggcataggagag

SEQ ID NO: 194903 - DNA, 20 bp, Artificial Sequence
  Description of Artificial Sequence: Synthetic oligonucleotide
  Target: ATXN1; (-) strand; PAM type: YTN; PAM sequence: CTC
tgtatacttgggcataggag

SEQ ID NO: 194904 - DNA, 20 bp, Artificial Sequence
  Description of Artificial Sequence: Synthetic oligonucleotide
  Target: ATXN1; (-) strand; PAM type: YTN; PAM sequence: CTA
tatgtatgtgtacaatatac

SEQ ID NO: 194905 - DNA, 20 bp, Artificial Sequence
  Description of Artificial Sequence: Synthetic oligonucleotide
  Target: ATXN1; (-) strand; PAM type: YTN; PAM sequence: TTC
tatatgtatgtgtacaatat

SEQ ID NO: 194906 - DNA, 20 bp, Artificial Sequence
  Description of Artificial Sequence: Synthetic oligonucleotide
  Target: ATXN1; (-) strand; PAM type: YTN; PAM sequence: TTT
ctatatgtatgtgtacaata

SEQ ID NO: 194907 - DNA, 20 bp, Artificial Sequence
  Description of Artificial Sequence: Synthetic oligonucleotide
  Target: ATXN1; (-) strand; PAM type: YTN; PAM sequence: TTA
tttctatatgtatgtgtaca

SEQ ID NO: 194908 - DNA, 20 bp, Artificial Sequence
  Description of Artificial Sequence: Synthetic oligonucleotide
  Target: ATXN1; (-) strand; PAM type: YTN; PAM sequence: TTT
atttctatatgtatgtgtac

SEQ ID NO: 194909 - DNA, 20 bp, Artificial Sequence
  Description of Artificial Sequence: Synthetic oligonucleotide
  Target: ATXN1; (-) strand; PAM type: YTN; PAM sequence: TTG
tatgtatgtatatatatata

SEQ ID NO: 194910 - DNA, 20 bp, Artificial Sequence
  Description of Artificial Sequence: Synthetic oligonucleotide
  Target: ATXN1; (-) strand; PAM type: YTN; PAM sequence: TTA
taaatagattgtatgtatgt

SEQ ID NO: 194911 - DNA, 20 bp, Artificial Sequence
  Description of Artificial Sequence: Synthetic oligonucleotide
  Target: ATXN1; (-) strand; PAM type: YTN; PAM sequence: CTA
tcatagtacattataaatag

SEQ ID NO: 194912 - DNA, 20 bp, Artificial Sequence
  Description of Artificial Sequence: Synthetic oligonucleotide
  Target: ATXN1; (-) strand; PAM type: YTN; PAM sequence: CTA
tgaatactatcatagtacat

SEQ ID NO: 194913 - DNA, 20 bp, Artificial Sequence
  Description of Artificial Sequence: Synthetic oligonucleotide
  Target: ATXN1; (-) strand; PAM type: YTN; PAM sequence: TTA
ataagtaaaaaaaatgagac

SEQ ID NO: 194914 - DNA, 20 bp, Artificial Sequence
  Description of Artificial Sequence: Synthetic oligonucleotide
  Target: ATXN1; (-) strand; PAM type: YTN; PAM sequence: TTC
aatataattaataagtaaaa

SEQ ID NO: 194915 - DNA, 20 bp, Artificial Sequence
  Description of Artificial Sequence: Synthetic oligonucleotide
  Target: ATXN1; (-) strand; PAM type: YTN; PAM sequence: TTT
caatataattaataagtaaa

SEQ ID NO: 194916 - DNA, 20 bp, Artificial Sequence
  Description of Artificial Sequence: Synthetic oligonucleotide
  Target: ATXN1; (-) strand; PAM type: YTN; PAM sequence: TTT
tcaatataattaataagtaa

SEQ ID NO: 194917 - DNA, 20 bp, Artificial Sequence
  Description of Artificial Sequence: Synthetic oligonucleotide
  Target: ATXN1; (-) strand; PAM type: YTN; PAM sequence: TTA
aaggaggttttcaatataat

SEQ ID NO: 194918 - DNA, 20 bp, Artificial Sequence
  Description of Artificial Sequence: Synthetic oligonucleotide
  Target: ATXN1; (-) strand; PAM type: YTN; PAM sequence: TTG
atgttaaaggaggttttcaa

SEQ ID NO: 194919 - DNA, 20 bp, Artificial Sequence
  Description of Artificial Sequence: Synthetic oligonucleotide
  Target: ATXN1; (-) strand; PAM type: YTN; PAM sequence: CTA
ttgatgttaaaggaggtttt

SEQ ID NO: 194920 - DNA, 20 bp, Artificial Sequence
  Description of Artificial Sequence: Synthetic oligonucleotide
  Target: ATXN1; (-) strand; PAM type: YTN; PAM sequence: TTG
atacatctattgatgttaaa

SEQ ID NO: 194921 - DNA, 20 bp, Artificial Sequence
  Description of Artificial Sequence: Synthetic oligonucleotide
  Target: ATXN1; (-) strand; PAM type: YTN; PAM sequence: TTA
tgatgttgatacatctattg

SEQ ID NO: 194922 - DNA, 20 bp, Artificial Sequence
  Description of Artificial Sequence: Synthetic oligonucleotide
  Target: ATXN1; (-) strand; PAM type: YTN; PAM sequence: CTC
aaatgttatgatgttgatac

SEQ ID NO: 194923 - DNA, 20 bp, Artificial Sequence
  Description of Artificial Sequence: Synthetic oligonucleotide
  Target: ATXN1; (-) strand; PAM type: YTN; PAM sequence: TTC
agtcctcaaatgttatgatg

SEQ ID NO: 194924 - DNA, 20 bp, Artificial Sequence
  Description of Artificial Sequence: Synthetic oligonucleotide
  Target: ATXN1; (-) strand; PAM type: YTN; PAM sequence: TTT
cagtcctcaaatgttatgat

SEQ ID NO: 194925 - DNA, 20 bp, Artificial Sequence
  Description of Artificial Sequence: Synthetic oligonucleotide
  Target: ATXN1; (-) strand; PAM type: YTN; PAM sequence: CTT
tcagtcctcaaatgttatga

SEQ ID NO: 194926 - DNA, 20 bp, Artificial Sequence
  Description of Artificial Sequence: Synthetic oligonucleotide
  Target: ATXN1; (-) strand; PAM type: YTN; PAM sequence: CTC
tttcagtcctcaaatgttat

SEQ ID NO: 194927 - DNA, 20 bp, Artificial Sequence
  Description of Artificial Sequence: Synthetic oligonucleotide
  Target: ATXN1; (-) strand; PAM type: YTN; PAM sequence: TTC
aatgtaatactctttcagtc

SEQ ID NO: 194928 - DNA, 20 bp, Artificial Sequence
  Description of Artificial Sequence: Synthetic oligonucleotide
  Target: ATXN1; (-) strand; PAM type: YTN; PAM sequence: CTT
caatgtaatactctttcagt

SEQ ID NO: 194929 - DNA, 20 bp, Artificial Sequence
  Description of Artificial Sequence: Synthetic oligonucleotide
  Target: ATXN1; (-) strand; PAM type: YTN; PAM sequence: TTC
cttcaatgtaatactctttc

SEQ ID NO: 194930 - DNA, 20 bp, Artificial Sequence
  Description of Artificial Sequence: Synthetic oligonucleotide
  Target: ATXN1; (-) strand; PAM type: YTN; PAM sequence: TTC
attccttcaatgtaatactc

SEQ ID NO: 194931 - DNA, 20 bp, Artificial Sequence
  Description of Artificial Sequence: Synthetic oligonucleotide
  Target: ATXN1; (-) strand; PAM type: YTN; PAM sequence: TTG
gttcattccttcaatgtaat

SEQ ID NO: 194932 - DNA, 20 bp, Artificial Sequence
  Description of Artificial Sequence: Synthetic oligonucleotide
  Target: ATXN1; (-) strand; PAM type: YTN; PAM sequence: TTC
aacaaataaatatgtattgg

SEQ ID NO: 194933 - DNA, 20 bp, Artificial Sequence
  Description of Artificial Sequence: Synthetic oligonucleotide
  Target: ATXN1; (-) strand; PAM type: YTN; PAM sequence: CTG
taaattcaacaaataaatat

SEQ ID NO: 194934 - DNA, 20 bp, Artificial Sequence
  Description of Artificial Sequence: Synthetic oligonucleotide
  Target: ATXN1; (-) strand; PAM type: YTN; PAM sequence: CTC
tgtaaattcaacaaataaat

SEQ ID NO: 194935 - DNA, 20 bp, Artificial Sequence
  Description of Artificial Sequence: Synthetic oligonucleotide
  Target: ATXN1; (-) strand; PAM type: YTN; PAM sequence: TTG
gtagactctgtaaattcaac

SEQ ID NO: 194936 - DNA, 20 bp, Artificial Sequence
  Description of Artificial Sequence: Synthetic oligonucleotide
  Target: ATXN1; (-) strand; PAM type: YTN; PAM sequence: TTT
ggtagactctgtaaattcaa

SEQ ID NO: 194937 - DNA, 20 bp, Artificial Sequence
  Description of Artificial Sequence: Synthetic oligonucleotide
  Target: ATXN1; (-) strand; PAM type: YTN; PAM sequence: CTT
tggtagactctgtaaattca

SEQ ID NO: 194938 - DNA, 20 bp, Artificial Sequence
  Description of Artificial Sequence: Synthetic oligonucleotide
  Target: ATXN1; (-) strand; PAM type: YTN; PAM sequence: TTG
ggacactttggtagactctg

SEQ ID NO: 194939 - DNA, 20 bp, Artificial Sequence
  Description of Artificial Sequence: Synthetic oligonucleotide
  Target: ATXN1; (-) strand; PAM type: YTN; PAM sequence: CTT
gggacactttggtagactct

SEQ ID NO: 194940 - DNA, 20 bp, Artificial Sequence
  Description of Artificial Sequence: Synthetic oligonucleotide
  Target: ATXN1; (-) strand; PAM type: YTN; PAM sequence: TTA
taaacttgggacactttggt

SEQ ID NO: 194941 - DNA, 20 bp, Artificial Sequence
  Description of Artificial Sequence: Synthetic oligonucleotide
  Target: ATXN1; (-) strand; PAM type: YTN; PAM sequence: CTT
ataaacttgggacactttgg

SEQ ID NO: 194942 - DNA, 20 bp, Artificial Sequence
  Description of Artificial Sequence: Synthetic oligonucleotide
  Target: ATXN1; (-) strand; PAM type: YTN; PAM sequence: TTC
ttataaacttgggacacttt

SEQ ID NO: 194943 - DNA, 20 bp, Artificial Sequence
  Description of Artificial Sequence: Synthetic oligonucleotide
  Target: ATXN1; (-) strand; PAM type: YTN; PAM sequence: CTT
cttataaacttgggacactt

SEQ ID NO: 194944 - DNA, 20 bp, Artificial Sequence
  Description of Artificial Sequence: Synthetic oligonucleotide
  Target: ATXN1; (-) strand; PAM type: YTN; PAM sequence: CTA
ccacaatatgtagtcacttc

SEQ ID NO: 194945 - DNA, 20 bp, Artificial Sequence
  Description of Artificial Sequence: Synthetic oligonucleotide
  Target: ATXN1; (-) strand; PAM type: YTN; PAM sequence: TTG
aaaaatgtagaagaaaaaga

SEQ ID NO: 194946 - DNA, 20 bp, Artificial Sequence
  Description of Artificial Sequence: Synthetic oligonucleotide
  Target: ATXN1; (-) strand; PAM type: YTN; PAM sequence: CTT
gaaaaatgtagaagaaaaag

SEQ ID NO: 194947 - DNA, 20 bp, Artificial Sequence
  Description of Artificial Sequence: Synthetic oligonucleotide
  Target: ATXN1; (-) strand; PAM type: YTN; PAM sequence: CTC
aatcttgaaaaatgtagaag

SEQ ID NO: 194948 - DNA, 20 bp, Artificial Sequence
  Description of Artificial Sequence: Synthetic oligonucleotide
  Target: ATXN1; (-) strand; PAM type: YTN; PAM sequence: TTC
tcaatcttgaaaaatgtaga

SEQ ID NO: 194949 - DNA, 20 bp, Artificial Sequence
  Description of Artificial Sequence: Synthetic oligonucleotide
  Target: ATXN1; (-) strand; PAM type: YTN; PAM sequence: TTT
ctcaatcttgaaaaatgtag

SEQ ID NO: 194950 - DNA, 20 bp, Artificial Sequence
  Description of Artificial Sequence: Synthetic oligonucleotide
  Target: ATXN1; (-) strand; PAM type: YTN; PAM sequence: CTT
tctcaatcttgaaaaatgta

SEQ ID NO: 194951 - DNA, 20 bp, Artificial Sequence
  Description of Artificial Sequence: Synthetic oligonucleotide
  Target: ATXN1; (-) strand; PAM type: YTN; PAM sequence: CTG
cctttctcaatcttgaaaaa

SEQ ID NO: 194952 - DNA, 20 bp, Artificial Sequence
  Description of Artificial Sequence: Synthetic oligonucleotide
  Target: ATXN1; (-) strand; PAM type: YTN; PAM sequence: TTC
agcctgcctttctcaatctt

SEQ ID NO: 194953 - DNA, 20 bp, Artificial Sequence
  Description of Artificial Sequence: Synthetic oligonucleotide
  Target: ATXN1; (-) strand; PAM type: YTN; PAM sequence: TTA
ttcagcctgcctttctcaat

SEQ ID NO: 194954 - DNA, 20 bp, Artificial Sequence
  Description of Artificial Sequence: Synthetic oligonucleotide
  Target: ATXN1; (-) strand; PAM type: YTN; PAM sequence: TTT
attcagcctgcctttctcaa

SEQ ID NO: 194955 - DNA, 20 bp, Artificial Sequence
  Description of Artificial Sequence: Synthetic oligonucleotide
  Target: ATXN1; (-) strand; PAM type: YTN; PAM sequence: TTA
tatttattcagcctgccttt

SEQ ID NO: 194956 - DNA, 20 bp, Artificial Sequence
  Description of Artificial Sequence: Synthetic oligonucleotide
  Target: ATXN1; (-) strand; PAM type: YTN; PAM sequence: TTT
atatttattcagcctgcctt

SEQ ID NO: 194957 - DNA, 20 bp, Artificial Sequence
  Description of Artificial Sequence: Synthetic oligonucleotide
  Target: ATXN1; (-) strand; PAM type: YTN; PAM sequence: TTT
tatatttattcagcctgcct

SEQ ID NO: 194958 - DNA, 20 bp, Artificial Sequence
  Description of Artificial Sequence: Synthetic oligonucleotide
  Target: ATXN1; (-) strand; PAM type: YTN; PAM sequence: TTT
ttatatttattcagcctgcc

SEQ ID NO: 194959 - DNA, 20 bp, Artificial Sequence
  Description of Artificial Sequence: Synthetic oligonucleotide
  Target: ATXN1; (-) strand; PAM type: YTN; PAM sequence: CTT
tttatatttattcagcctgc

SEQ ID NO: 194960 - DNA, 20 bp, Artificial Sequence
  Description of Artificial Sequence: Synthetic oligonucleotide
  Target: ATXN1; (-) strand; PAM type: YTN; PAM sequence: TTA
aggctttttatatttattca

SEQ ID NO: 194961 - DNA, 20 bp, Artificial Sequence
  Description of Artificial Sequence: Synthetic oligonucleotide
  Target: ATXN1; (-) strand; PAM type: YTN; PAM sequence: CTG
ttaaggctttttatatttat

SEQ ID NO: 194962 - DNA, 20 bp, Artificial Sequence
  Description of Artificial Sequence: Synthetic oligonucleotide
  Target: ATXN1; (-) strand; PAM type: YTN; PAM sequence: TTG
ctgttaaggctttttatatt

SEQ ID NO: 194963 - DNA, 20 bp, Artificial Sequence
  Description of Artificial Sequence: Synthetic oligonucleotide
  Target: ATXN1; (-) strand; PAM type: YTN; PAM sequence: TTT
gctgttaaggctttttatat

SEQ ID NO: 194964 - DNA, 20 bp, Artificial Sequence
  Description of Artificial Sequence: Synthetic oligonucleotide
  Target: ATXN1; (-) strand; PAM type: YTN; PAM sequence: TTT
tgctgttaaggctttttata

SEQ ID NO: 194965 - DNA, 20 bp, Artificial Sequence
  Description of Artificial Sequence: Synthetic oligonucleotide
  Target: ATXN1; (-) strand; PAM type: YTN; PAM sequence: TTT
ttgctgttaaggctttttat

SEQ ID NO: 194966 - DNA, 20 bp, Artificial Sequence
  Description of Artificial Sequence: Synthetic oligonucleotide
  Target: ATXN1; (-) strand; PAM type: YTN; PAM sequence: CTT
tttgctgttaaggcttttta

SEQ ID NO: 194967 - DNA, 20 bp, Artificial Sequence
  Description of Artificial Sequence: Synthetic oligonucleotide
  Target: ATXN1; (-) strand; PAM type: YTN; PAM sequence: CTC
aaaccaaaacaactttttgc

SEQ ID NO: 194968 - DNA, 20 bp, Artificial Sequence
  Description of Artificial Sequence: Synthetic oligonucleotide
  Target: ATXN1; (-) strand; PAM type: YTN; PAM sequence: CTA
cacccactcaaaccaaaaca

SEQ ID NO: 194969 - DNA, 20 bp, Artificial Sequence
  Description of Artificial Sequence: Synthetic oligonucleotide
  Target: ATXN1; (-) strand; PAM type: YTN; PAM sequence: CTA
tgctacacccactcaaacca

SEQ ID NO: 194970 - DNA, 20 bp, Artificial Sequence
  Description of Artificial Sequence: Synthetic oligonucleotide
  Target: ATXN1; (-) strand; PAM type: YTN; PAM sequence: TTC
tatgctacacccactcaaac

SEQ ID NO: 194971 - DNA, 20 bp, Artificial Sequence
  Description of Artificial Sequence: Synthetic oligonucleotide
  Target: ATXN1; (-) strand; PAM type: YTN; PAM sequence: CTT
ctatgctacacccactcaaa

SEQ ID NO: 194972 - DNA, 20 bp, Artificial Sequence
  Description of Artificial Sequence: Synthetic oligonucleotide
  Target: ATXN1; (-) strand; PAM type: YTN; PAM sequence: TTC
ttctatgctacacccactca

SEQ ID NO: 194973 - DNA, 20 bp, Artificial Sequence
  Description of Artificial Sequence: Synthetic oligonucleotide
  Target: ATXN1; (-) strand; PAM type: YTN; PAM sequence: TTG
tgttcttctatgctacaccc

SEQ ID NO: 194974 - DNA, 20 bp, Artificial Sequence
  Description of Artificial Sequence: Synthetic oligonucleotide
  Target: ATXN1; (-) strand; PAM type: YTN; PAM sequence: TTT
gtgttcttctatgctacacc

SEQ ID NO: 194975 - DNA, 20 bp, Artificial Sequence
  Description of Artificial Sequence: Synthetic oligonucleotide
  Target: ATXN1; (-) strand; PAM type: YTN; PAM sequence: TTA
gtttgtgttcttctatgcta

SEQ ID NO: 194976 - DNA, 20 bp, Artificial Sequence
  Description of Artificial Sequence: Synthetic oligonucleotide
  Target: ATXN1; (-) strand; PAM type: YTN; PAM sequence: CTG
tggtatatgtgttagtttgt

SEQ ID NO: 194977 - DNA, 20 bp, Artificial Sequence
  Description of Artificial Sequence: Synthetic oligonucleotide
  Target: ATXN1; (-) strand; PAM type: YTN; PAM sequence: TTC
cctgtggtatatgtgttagt

SEQ ID NO: 194978 - DNA, 20 bp, Artificial Sequence
  Description of Artificial Sequence: Synthetic oligonucleotide
  Target: ATXN1; (-) strand; PAM type: YTN; PAM sequence: CTA
ttccctgtggtatatgtgtt

SEQ ID NO: 194979 - DNA, 20 bp, Artificial Sequence
  Description of Artificial Sequence: Synthetic oligonucleotide
  Target: ATXN1; (-) strand; PAM type: YTN; PAM sequence: TTC
tattccctgtggtatatgtg

SEQ ID NO: 194980 - DNA, 20 bp, Artificial Sequence
  Description of Artificial Sequence: Synthetic oligonucleotide
  Target: ATXN1; (-) strand; PAM type: YTN; PAM sequence: CTA
atgtgtgattctattccctg

SEQ ID NO: 194981 - DNA, 20 bp, Artificial Sequence
  Description of Artificial Sequence: Synthetic oligonucleotide
  Target: ATXN1; (-) strand; PAM type: YTN; PAM sequence: TTC
taatgtgtgattctattccc

SEQ ID NO: 194982 - DNA, 20 bp, Artificial Sequence
  Description of Artificial Sequence: Synthetic oligonucleotide
  Target: ATXN1; (-) strand; PAM type: YTN; PAM sequence: CTG
aatattctaatgtgtgattc

SEQ ID NO: 194983 - DNA, 20 bp, Artificial Sequence
  Description of Artificial Sequence: Synthetic oligonucleotide
  Target: ATXN1; (-) strand; PAM type: YTN; PAM sequence: CTA
ctgaatattctaatgtgtga

SEQ ID NO: 194984 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccgcgtc

SEQ ID NO: 194985 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 194986 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 194987 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 194988 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 194989 - DNA, 20 bp, Artificial Sequence
  Description of Artificial Sequence: Synthetic oligonucleotide
  Target: ATXN1; (-) strand; PAM type: YTN; PAM sequence: CTC
aggtaatccacccgccttgg

SEQ ID NO: 194990 - DNA, 20 bp, Artificial Sequence
  Description of Artificial Sequence: Synthetic oligonucleotide
  Target: ATXN1; (-) strand; PAM type: YTN; PAM sequence: CTG
acctcaggtaatccacccgc

SEQ ID NO: 194991 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtaatccacc

SEQ ID NO: 194992 - DNA, 20 bp, Artificial Sequence
  Description of Artificial Sequence: Synthetic oligonucleotide
  Target: ATXN1; (-) strand; PAM type: YTN; PAM sequence: TTG
acctcctgacctcaggtaat

SEQ ID NO: 194993 - DNA, 20 bp, Artificial Sequence
  Description of Artificial Sequence: Synthetic oligonucleotide
  Target: ATXN1; (-) strand; PAM type: YTN; PAM sequence: CTT
gacctcctgacctcaggtaa

SEQ ID NO: 194994 - DNA, 20 bp, Artificial Sequence
  Description of Artificial Sequence: Synthetic oligonucleotide
  Target: ATXN1; (-) strand; PAM type: YTN; PAM sequence: CTG
gtcttgacctcctgacctca

SEQ ID NO: 194995 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgacctc

SEQ ID NO: 194996 - DNA, 20 bp, Artificial Sequence
  Description of Artificial Sequence: Synthetic oligonucleotide
  Target: ATXN1; (-) strand; PAM type: YTN; PAM sequence: TTT
ggccaggctggtcttgacct

SEQ ID NO: 194997 - DNA, 20 bp, Artificial Sequence
  Description of Artificial Sequence: Synthetic oligonucleotide
  Target: ATXN1; (-) strand; PAM type: YTN; PAM sequence: TTT
tggccaggctggtcttgacc

SEQ ID NO: 194998 - DNA, 20 bp, Artificial Sequence
  Description of Artificial Sequence: Synthetic oligonucleotide
  Target: ATXN1; (-) strand; PAM type: YTN; PAM sequence: TTC
accattttggccaggctggt

SEQ ID NO: 194999 - DNA, 20 bp, Artificial Sequence
  Description of Artificial Sequence: Synthetic oligonucleotide
  Target: ATXN1; (-) strand; PAM type: YTN; PAM sequence: TTT
caccattttggccaggctgg

SEQ ID NO: 195000 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcacca

SEQ ID NO: 195001 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcacc

SEQ ID NO: 195002 - DNA, 20 bp, Artificial Sequence
  Description of Artificial Sequence: Synthetic oligonucleotide
  Target: ATXN1; (-) strand; PAM type: YTN; PAM sequence: TTT
tagtagagacagggtttcac

SEQ ID NO: 195003 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacagggtttca

SEQ ID NO: 195004 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaggg

SEQ ID NO: 195005 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacagg

SEQ ID NO: 195006 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacag

SEQ ID NO: 195007 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 195008 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 195009 - DNA, 20 bp, Artificial Sequence
  Description of Artificial Sequence: Synthetic oligonucleotide
  Target: ATXN1; (-) strand; PAM type: YTN; PAM sequence: CTG
ccaccaagcccagctaattt

SEQ ID NO: 195010 - DNA, 20 bp, Artificial Sequence
  Description of Artificial Sequence: Synthetic oligonucleotide
  Target: ATXN1; (-) strand; PAM type: YTN; PAM sequence: TTA
caggcacctgccaccaagcc

SEQ ID NO: 195011 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcacctgccac

SEQ ID NO: 195012 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggattacag

SEQ ID NO: 195013 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 195014 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 195015 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 195016 - DNA, 20 bp, Artificial Sequence
  Description of Artificial Sequence: Synthetic oligonucleotide
  Target: ATXN1; (-) strand; PAM type: YTN; PAM sequence: TTC
aagtgatcctcctgcctcag

SEQ ID NO: 195017 - DNA, 20 bp, Artificial Sequence
  Description of Artificial Sequence: Synthetic oligonucleotide
  Target: ATXN1; (-) strand; PAM type: YTN; PAM sequence: CTC
ccgggttcaagtgatcctcc

SEQ ID NO: 195018 - DNA, 20 bp, Artificial Sequence
  Description of Artificial Sequence: Synthetic oligonucleotide
  Target: ATXN1; (-) strand; PAM type: YTN; PAM sequence: TTC
cacctcccgggttcaagtga

SEQ ID NO: 195019 - DNA, 20 bp, Artificial Sequence
  Description of Artificial Sequence: Synthetic oligonucleotide
  Target: ATXN1; (-) strand; PAM type: YTN; PAM sequence: CTT
ccacctcccgggttcaagtg

SEQ ID NO: 195020 - DNA, 20 bp, Artificial Sequence
  Description of Artificial Sequence: Synthetic oligonucleotide
  Target: ATXN1; (-) strand; PAM type: YTN; PAM sequence: CTG
cagcttccacctcccgggtt

SEQ ID NO: 195021 - DNA, 20 bp, Artificial Sequence
  Description of Artificial Sequence: Synthetic oligonucleotide
  Target: ATXN1; (-) strand; PAM type: YTN; PAM sequence: CTC
actgcagcttccacctcccg

SEQ ID NO: 195022 - DNA, 20 bp, Artificial Sequence
  Description of Artificial Sequence: Synthetic oligonucleotide
  Target: ATXN1; (-) strand; PAM type: YTN; PAM sequence: CTC
gactcactgcagcttccacc

SEQ ID NO: 195023 - DNA, 20 bp, Artificial Sequence
  Description of Artificial Sequence: Synthetic oligonucleotide
  Target: ATXN1; (-) strand; PAM type: YTN; PAM sequence: TTC
tcgactcactgcagcttcca

SEQ ID NO: 195024 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcattctc

SEQ ID NO: 195025 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtgg

SEQ ID NO: 195026 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggagtgcag

SEQ ID NO: 195027 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctggagtgca

SEQ ID NO: 195028 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccaggctggagtg

SEQ ID NO: 195029 - DNA, 20 bp, Artificial Sequence
  Description of Artificial Sequence: Synthetic oligonucleotide
  Target: ATXN1; (-) strand; PAM type: YTN; PAM sequence: TTG
ctcttgttgcccaggctgga

SEQ ID NO: 195030 - DNA, 20 bp, Artificial Sequence
  Description of Artificial Sequence: Synthetic oligonucleotide
  Target: ATXN1; (-) strand; PAM type: YTN; PAM sequence: TTT
gctcttgttgcccaggctgg

SEQ ID NO: 195031 - DNA, 20 bp, Artificial Sequence
  Description of Artificial Sequence: Synthetic oligonucleotide
  Target: ATXN1; (-) strand; PAM type: YTN; PAM sequence: TTT
tgctcttgttgcccaggctg

SEQ ID NO: 195032 - DNA, 20 bp, Artificial Sequence
  Description of Artificial Sequence: Synthetic oligonucleotide
  Target: ATXN1; (-) strand; PAM type: YTN; PAM sequence: TTG
agatgaagttttgctcttgt

SEQ ID NO: 195033 - DNA, 20 bp, Artificial Sequence
  Description of Artificial Sequence: Synthetic oligonucleotide
  Target: ATXN1; (-) strand; PAM type: YTN; PAM sequence: TTT
gagatgaagttttgctcttg

SEQ ID NO: 195034 - DNA, 20 bp, Artificial Sequence
  Description of Artificial Sequence: Synthetic oligonucleotide
  Target: ATXN1; (-) strand; PAM type: YTN; PAM sequence: TTT
tgagatgaagttttgctctt

SEQ ID NO: 195035 - DNA, 20 bp, Artificial Sequence
  Description of Artificial Sequence: Synthetic oligonucleotide
  Target: ATXN1; (-) strand; PAM type: YTN; PAM sequence: TTT
ttgagatgaagttttgctct

SEQ ID NO: 195036 - DNA, 20 bp, Artificial Sequence
  Description of Artificial Sequence: Synthetic oligonucleotide
  Target: ATXN1; (-) strand; PAM type: YTN; PAM sequence: TTT
tttgagatgaagttttgctc

SEQ ID NO: 195037 - DNA, 20 bp, Artificial Sequence
  Description of Artificial Sequence: Synthetic oligonucleotide
  Target: ATXN1; (-) strand; PAM type: YTN; PAM sequence: TTT
ttttgagatgaagttttgct

SEQ ID NO: 195038 - DNA, 20 bp, Artificial Sequence
  Description of Artificial Sequence: Synthetic oligonucleotide
  Target: ATXN1; (-) strand; PAM type: YTN; PAM sequence: TTT
tttttgagatgaagttttgc

SEQ ID NO: 195039 - DNA, 20 bp, Artificial Sequence
  Description of Artificial Sequence: Synthetic oligonucleotide
  Target: ATXN1; (-) strand; PAM type: YTN; PAM sequence: TTT
ttttttgagatgaagttttg

SEQ ID NO: 195040 - DNA, 20 bp, Artificial Sequence
  Description of Artificial Sequence: Synthetic oligonucleotide
  Target: ATXN1; (-) strand; PAM type: YTN; PAM sequence: TTT
tttttttgagatgaagtttt

SEQ ID NO: 195041 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagatgaagttt

SEQ ID NO: 195042 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagatgaagtt

SEQ ID NO: 195043 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagatgaagt

SEQ ID NO: 195044 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagatgaag

SEQ ID NO: 195045 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagatgaa

SEQ ID NO: 195046 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagatga

SEQ ID NO: 195047 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttgagatg

SEQ ID NO: 195048 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttttgaga

SEQ ID NO: 195049 - DNA, 20 bp, Artificial Sequence
  Description of Artificial Sequence: Synthetic oligonucleotide
  Target: ATXN1; (-) strand; PAM type: YTN; PAM sequence: CTG
aatattcttttttttttttt

SEQ ID NO: 195050 - DNA, 20 bp, Artificial Sequence
  Description of Artificial Sequence: Synthetic oligonucleotide
  Target: ATXN1; (-) strand; PAM type: YTN; PAM sequence: TTG
aacacccactgaatattctt

SEQ ID NO: 195051 - DNA, 20 bp, Artificial Sequence
  Description of Artificial Sequence: Synthetic oligonucleotide
  Target: ATXN1; (-) strand; PAM type: YTN; PAM sequence: TTC
gatatgttgaacacccactg

SEQ ID NO: 195052 - DNA, 20 bp, Artificial Sequence
  Description of Artificial Sequence: Synthetic oligonucleotide
  Target: ATXN1; (-) strand; PAM type: YTN; PAM sequence: TTT
cgatatgttgaacacccact

SEQ ID NO: 195053 - DNA, 20 bp, Artificial Sequence
  Description of Artificial Sequence: Synthetic oligonucleotide
  Target: ATXN1; (-) strand; PAM type: YTN; PAM sequence: TTT
tcgatatgttgaacacccac

SEQ ID NO: 195054 - DNA, 20 bp, Artificial Sequence
  Description of Artificial Sequence: Synthetic oligonucleotide
  Target: ATXN1; (-) strand; PAM type: YTN; PAM sequence: TTT
ttcgatatgttgaacaccca

SEQ ID NO: 195055 - DNA, 20 bp, Artificial Sequence
  Description of Artificial Sequence: Synthetic oligonucleotide
  Target: ATXN1; (-) strand; PAM type: YTN; PAM sequence: CTT
tttcgatatgttgaacaccc

SEQ ID NO: 195056 - DNA, 20 bp, Artificial Sequence
  Description of Artificial Sequence: Synthetic oligonucleotide
  Target: ATXN1; (-) strand; PAM type: YTN; PAM sequence: TTG
agtcctttttcgatatgttg

SEQ ID NO: 195057 - DNA, 20 bp, Artificial Sequence
  Description of Artificial Sequence: Synthetic oligonucleotide
  Target: ATXN1; (-) strand; PAM type: YTN; PAM sequence: TTA
aaattgagtcctttttcgat

SEQ ID NO: 195058 - DNA, 20 bp, Artificial Sequence
  Description of Artificial Sequence: Synthetic oligonucleotide
  Target: ATXN1; (-) strand; PAM type: YTN; PAM sequence: TTT
aaaattgagtcctttttcga

SEQ ID NO: 195059 - DNA, 20 bp, Artificial Sequence
  Description of Artificial Sequence: Synthetic oligonucleotide
  Target: ATXN1; (-) strand; PAM type: YTN; PAM sequence: CTT
taaaattgagtcctttttcg

SEQ ID NO: 195060 - DNA, 20 bp, Artificial Sequence
  Description of Artificial Sequence: Synthetic oligonucleotide
  Target: ATXN1; (-) strand; PAM type: YTN; PAM sequence: TTA
tcccgagtctttaaaattga

SEQ ID NO: 195061 - DNA, 20 bp, Artificial Sequence
  Description of Artificial Sequence: Synthetic oligonucleotide
  Target: ATXN1; (-) strand; PAM type: YTN; PAM sequence: TTC
acccattatcccgagtcttt

SEQ ID NO: 195062 - DNA, 20 bp, Artificial Sequence
  Description of Artificial Sequence: Synthetic oligonucleotide
  Target: ATXN1; (-) strand; PAM type: YTN; PAM sequence: CTA
ttcacccattatcccgagtc

SEQ ID NO: 195063 - DNA, 20 bp, Artificial Sequence
  Description of Artificial Sequence: Synthetic oligonucleotide
  Target: ATXN1; (-) strand; PAM type: YTN; PAM sequence: CTA
gccatccctattcacccatt

SEQ ID NO: 195064 - DNA, 20 bp, Artificial Sequence
  Description of Artificial Sequence: Synthetic oligonucleotide
  Target: ATXN1; (-) strand; PAM type: YTN; PAM sequence: TTG
atctagccatccctattcac

SEQ ID NO: 195065 - DNA, 20 bp, Artificial Sequence
  Description of Artificial Sequence: Synthetic oligonucleotide
  Target: ATXN1; (-) strand; PAM type: YTN; PAM sequence: CTT
gatctagccatccctattca

SEQ ID NO: 195066 - DNA, 20 bp, Artificial Sequence
  Description of Artificial Sequence: Synthetic oligonucleotide
  Target: ATXN1; (-) strand; PAM type: YTN; PAM sequence: TTA
atacttgatctagccatccc

SEQ ID NO: 195067 - DNA, 20 bp, Artificial Sequence
  Description of Artificial Sequence: Synthetic oligonucleotide
  Target: ATXN1; (-) strand; PAM type: YTN; PAM sequence: TTT
aatacttgatctagccatcc

SEQ ID NO: 195068 - DNA, 20 bp, Artificial Sequence
  Description of Artificial Sequence: Synthetic oligonucleotide
  Target: ATXN1; (-) strand; PAM type: YTN; PAM sequence: TTA
gcgatttaatacttgatcta

SEQ ID NO: 195069 - DNA, 20 bp, Artificial Sequence
  Description of Artificial Sequence: Synthetic oligonucleotide
  Target: ATXN1; (-) strand; PAM type: YTN; PAM sequence: CTT
agcgatttaatacttgatct

SEQ ID NO: 195070 - DNA, 20 bp, Artificial Sequence
  Description of Artificial Sequence: Synthetic oligonucleotide
  Target: ATXN1; (-) strand; PAM type: YTN; PAM sequence: TTC
agacttagcgatttaatact

SEQ ID NO: 195071 - DNA, 20 bp, Artificial Sequence
  Description of Artificial Sequence: Synthetic oligonucleotide
  Target: ATXN1; (-) strand; PAM type: YTN; PAM sequence: CTT
cagacttagcgatttaatac

SEQ ID NO: 195072 - DNA, 20 bp, Artificial Sequence
  Description of Artificial Sequence: Synthetic oligonucleotide
  Target: ATXN1; (-) strand; PAM type: YTN; PAM sequence: TTG
acttcagacttagcgattta

SEQ ID NO: 195073 - DNA, 20 bp, Artificial Sequence
  Description of Artificial Sequence: Synthetic oligonucleotide
  Target: ATXN1; (-) strand; PAM type: YTN; PAM sequence: CTT
gacttcagacttagcgattt

SEQ ID NO: 195074 - DNA, 20 bp, Artificial Sequence
  Description of Artificial Sequence: Synthetic oligonucleotide
  Target: ATXN1; (-) strand; PAM type: YTN; PAM sequence: TTG
cttgacttcagacttagcga

SEQ ID NO: 195075 - DNA, 20 bp, Artificial Sequence
  Description of Artificial Sequence: Synthetic oligonucleotide
  Target: ATXN1; (-) strand; PAM type: YTN; PAM sequence: TTT
gcttgacttcagacttagcg

SEQ ID NO: 195076 - DNA, 20 bp, Artificial Sequence
  Description of Artificial Sequence: Synthetic oligonucleotide
  Target: ATXN1; (-) strand; PAM type: YTN; PAM sequence: CTG
aaacaaggacatttgcttga

SEQ ID NO: 195077 - DNA, 20 bp, Artificial Sequence
  Description of Artificial Sequence: Synthetic oligonucleotide
  Target: ATXN1; (-) strand; PAM type: YTN; PAM sequence: TTG
ggctgaaacaaggacatttg

SEQ ID NO: 195078 - DNA, 20 bp, Artificial Sequence
  Description of Artificial Sequence: Synthetic oligonucleotide
  Target: ATXN1; (-) strand; PAM type: YTN; PAM sequence: CTA
ccatgattgggctgaaacaa

SEQ ID NO: 195079 - DNA, 20 bp, Artificial Sequence
  Description of Artificial Sequence: Synthetic oligonucleotide
  Target: ATXN1; (-) strand; PAM type: YTN; PAM sequence: CTC
taccatgattgggctgaaac

SEQ ID NO: 195080 - DNA, 20 bp, Artificial Sequence
  Description of Artificial Sequence: Synthetic oligonucleotide
  Target: ATXN1; (-) strand; PAM type: YTN; PAM sequence: TTA
agtaactctaccatgattgg

SEQ ID NO: 195081 - DNA, 20 bp, Artificial Sequence
  Description of Artificial Sequence: Synthetic oligonucleotide
  Target: ATXN1; (-) strand; PAM type: YTN; PAM sequence: CTG
tatcattaagtaactctacc

SEQ ID NO: 195082 - DNA, 20 bp, Artificial Sequence
  Description of Artificial Sequence: Synthetic oligonucleotide
  Target: ATXN1; (-) strand; PAM type: YTN; PAM sequence: CTC
tgtatcattaagtaactcta

SEQ ID NO: 195083 - DNA, 20 bp, Artificial Sequence
  Description of Artificial Sequence: Synthetic oligonucleotide
  Target: ATXN1; (-) strand; PAM type: YTN; PAM sequence: TTC
ctctgtatcattaagtaact

SEQ ID NO: 195084 - DNA, 20 bp, Artificial Sequence
  Description of Artificial Sequence: Synthetic oligonucleotide
  Target: ATXN1; (-) strand; PAM type: YTN; PAM sequence: TTT
cctctgtatcattaagtaac

SEQ ID NO: 195085 - DNA, 20 bp, Artificial Sequence
  Description of Artificial Sequence: Synthetic oligonucleotide
  Target: ATXN1; (-) strand; PAM type: YTN; PAM sequence: CTT
tcctctgtatcattaagtaa

SEQ ID NO: 195086 - DNA, 20 bp, Artificial Sequence
  Description of Artificial Sequence: Synthetic oligonucleotide
  Target: ATXN1; (-) strand; PAM type: YTN; PAM sequence: TTA
actttcctctgtatcattaa

SEQ ID NO: 195087 - DNA, 20 bp, Artificial Sequence
  Description of Artificial Sequence: Synthetic oligonucleotide
  Target: ATXN1; (-) strand; PAM type: YTN; PAM sequence: TTC
agttaactttcctctgtatc

SEQ ID NO: 195088 - DNA, 20 bp, Artificial Sequence
  Description of Artificial Sequence: Synthetic oligonucleotide
  Target: ATXN1; (-) strand; PAM type: YTN; PAM sequence: TTT
cagttaactttcctctgtat

SEQ ID NO: 195089 - DNA, 20 bp, Artificial Sequence
  Description of Artificial Sequence: Synthetic oligonucleotide
  Target: ATXN1; (-) strand; PAM type: YTN; PAM sequence: TTT
tcagttaactttcctctgta

SEQ ID NO: 195090 - DNA, 20 bp, Artificial Sequence
  Description of Artificial Sequence: Synthetic oligonucleotide
  Target: ATXN1; (-) strand; PAM type: YTN; PAM sequence: TTT
ttcagttaactttcctctgt

SEQ ID NO: 195091 - DNA, 20 bp, Artificial Sequence
  Description of Artificial Sequence: Synthetic oligonucleotide
  Target: ATXN1; (-) strand; PAM type: YTN; PAM sequence: TTT
tttcagttaactttcctctg

SEQ ID NO: 195092 - DNA, 20 bp, Artificial Sequence
  Description of Artificial Sequence: Synthetic oligonucleotide
  Target: ATXN1; (-) strand; PAM type: YTN; PAM sequence: CTC
aagatcatacagttttttca

SEQ ID NO: 195093 - DNA, 20 bp, Artificial Sequence
  Description of Artificial Sequence: Synthetic oligonucleotide
  Target: ATXN1; (-) strand; PAM type: YTN; PAM sequence: CTA
ggatcactcaagatcataca

SEQ ID NO: 195094 - DNA, 20 bp, Artificial Sequence
  Description of Artificial Sequence: Synthetic oligonucleotide
  Target: ATXN1; (-) strand; PAM type: YTN; PAM sequence: TTC
taggatcactcaagatcata

SEQ ID NO: 195095 - DNA, 20 bp, Artificial Sequence
  Description of Artificial Sequence: Synthetic oligonucleotide
  Target: ATXN1; (-) strand; PAM type: YTN; PAM sequence: TTT
ctaggatcactcaagatcat

SEQ ID NO: 195096 - DNA, 20 bp, Artificial Sequence
  Description of Artificial Sequence: Synthetic oligonucleotide
  Target: ATXN1; (-) strand; PAM type: YTN; PAM sequence: TTA
atttctaggatcactcaaga

SEQ ID NO: 195097 - DNA, 20 bp, Artificial Sequence
  Description of Artificial Sequence: Synthetic oligonucleotide
  Target: ATXN1; (-) strand; PAM type: YTN; PAM sequence: TTT
aatttctaggatcactcaag

SEQ ID NO: 195098 - DNA, 20 bp, Artificial Sequence
  Description of Artificial Sequence: Synthetic oligonucleotide
  Target: ATXN1; (-) strand; PAM type: YTN; PAM sequence: TTC
aaatagtgatttaatttcta

SEQ ID NO: 195099 - DNA, 20 bp, Artificial Sequence
  Description of Artificial Sequence: Synthetic oligonucleotide
  Target: ATXN1; (-) strand; PAM type: YTN; PAM sequence: CTT
caaatagtgatttaatttct

SEQ ID NO: 195100 - DNA, 20 bp, Artificial Sequence
  Description of Artificial Sequence: Synthetic oligonucleotide
  Target: ATXN1; (-) strand; PAM type: YTN; PAM sequence: TTC
accttcaaatagtgatttaa

SEQ ID NO: 195101 - DNA, 20 bp, Artificial Sequence
  Description of Artificial Sequence: Synthetic oligonucleotide
  Target: ATXN1; (-) strand; PAM type: YTN; PAM sequence: TTT
caccttcaaatagtgattta

SEQ ID NO: 195102 - DNA, 20 bp, Artificial Sequence
  Description of Artificial Sequence: Synthetic oligonucleotide
  Target: ATXN1; (-) strand; PAM type: YTN; PAM sequence: TTT
tcaccttcaaatagtgattt

SEQ ID NO: 195103 - DNA, 20 bp, Artificial Sequence
  Description of Artificial Sequence: Synthetic oligonucleotide
  Target: ATXN1; (-) strand; PAM type: YTN; PAM sequence: TTA
ggttttcaccttcaaatagt

SEQ ID NO: 195104 - DNA, 20 bp, Artificial Sequence
  Description of Artificial Sequence: Synthetic oligonucleotide
  Target: ATXN1; (-) strand; PAM type: YTN; PAM sequence: TTT
aggttttcaccttcaaatag

SEQ ID NO: 195105 - DNA, 20 bp, Artificial Sequence
  Description of Artificial Sequence: Synthetic oligonucleotide
  Target: ATXN1; (-) strand; PAM type: YTN; PAM sequence: TTT
taggttttcaccttcaaata

SEQ ID NO: 195106 - DNA, 20 bp, Artificial Sequence
  Description of Artificial Sequence: Synthetic oligonucleotide
  Target: ATXN1; (-) strand; PAM type: YTN; PAM sequence: TTT
ttaggttttcaccttcaaat

SEQ ID NO: 195107 - DNA, 20 bp, Artificial Sequence
  Description of Artificial Sequence: Synthetic oligonucleotide
  Target: ATXN1; (-) strand; PAM type: YTN; PAM sequence: TTT
tttaggttttcaccttcaaa

SEQ ID NO: 195108 - DNA, 20 bp, Artificial Sequence
  Description of Artificial Sequence: Synthetic oligonucleotide
  Target: ATXN1; (-) strand; PAM type: YTN; PAM sequence: TTT
ttttaggttttcaccttcaa

SEQ ID NO: 195109 - DNA, 20 bp, Artificial Sequence
  Description of Artificial Sequence: Synthetic oligonucleotide
  Target: ATXN1; (-) strand; PAM type: YTN; PAM sequence: TTT
tttttaggttttcaccttca

SEQ ID NO: 195110 - DNA, 20 bp, Artificial Sequence
  Description of Artificial Sequence: Synthetic oligonucleotide
  Target: ATXN1; (-) strand; PAM type: YTN; PAM sequence: TTT
ttttttaggttttcaccttc

SEQ ID NO: 195111 - DNA, 20 bp, Artificial Sequence
  Description of Artificial Sequence: Synthetic oligonucleotide
  Target: ATXN1; (-) strand; PAM type: YTN; PAM sequence: TTT
tttttttaggttttcacctt

SEQ ID NO: 195112 - DNA, 20 bp, Artificial Sequence
  Description of Artificial Sequence: Synthetic oligonucleotide
  Target: ATXN1; (-) strand; PAM type: YTN; PAM sequence: TTT
ttttttttaggttttcacct

SEQ ID NO: 195113 - DNA, 20 bp, Artificial Sequence
  Description of Artificial Sequence: Synthetic oligonucleotide
  Target: ATXN1; (-) strand; PAM type: YTN; PAM sequence: TTT
tttttttttaggttttcacc

SEQ ID NO: 195114 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaggttttcac

SEQ ID NO: 195115 - DNA, 20 bp, Artificial Sequence
  Description of Artificial Sequence: Synthetic oligonucleotide
  Target: ATXN1; (-) strand; PAM type: YTN; PAM sequence: TTT
tttttttttttaggttttca

SEQ ID NO: 195116 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttaggttttc

SEQ ID NO: 195117 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttaggtttt

SEQ ID NO: 195118 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttaggttt

SEQ ID NO: 195119 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttaggtt

SEQ ID NO: 195120 - DNA, 20 bp, Artificial Sequence
  Description of Artificial Sequence: Synthetic oligonucleotide
  Target: ATXN1; (-) strand; PAM type: YTN; PAM sequence: CTG
atttttttttttttttttta

SEQ ID NO: 195121 - DNA, 20 bp, Artificial Sequence
  Description of Artificial Sequence: Synthetic oligonucleotide
  Target: ATXN1; (-) strand; PAM type: YTN; PAM sequence: CTA
aagaaatatggtaagtcctg

SEQ ID NO: 195122 - DNA, 20 bp, Artificial Sequence
  Description of Artificial Sequence: Synthetic oligonucleotide
  Target: ATXN1; (-) strand; PAM type: YTN; PAM sequence: TTC
taaagaaatatggtaagtcc

SEQ ID NO: 195123 - DNA, 20 bp, Artificial Sequence
  Description of Artificial Sequence: Synthetic oligonucleotide
  Target: ATXN1; (-) strand; PAM type: YTN; PAM sequence: CTT
ctaaagaaatatggtaagtc

SEQ ID NO: 195124 - DNA, 20 bp, Artificial Sequence
  Description of Artificial Sequence: Synthetic oligonucleotide
  Target: ATXN1; (-) strand; PAM type: YTN; PAM sequence: TTG
ataccttctaaagaaatatg

SEQ ID NO: 195125 - DNA, 20 bp, Artificial Sequence
  Description of Artificial Sequence: Synthetic oligonucleotide
  Target: ATXN1; (-) strand; PAM type: YTN; PAM sequence: TTT
gataccttctaaagaaatat

SEQ ID NO: 195126 - DNA, 20 bp, Artificial Sequence
  Description of Artificial Sequence: Synthetic oligonucleotide
  Target: ATXN1; (-) strand; PAM type: YTN; PAM sequence: TTT
tgataccttctaaagaaata

SEQ ID NO: 195127 - DNA, 20 bp, Artificial Sequence
  Description of Artificial Sequence: Synthetic oligonucleotide
  Target: ATXN1; (-) strand; PAM type: YTN; PAM sequence: TTT
ttgataccttctaaagaaat

SEQ ID NO: 195128 - DNA, 20 bp, Artificial Sequence
  Description of Artificial Sequence: Synthetic oligonucleotide
  Target: ATXN1; (-) strand; PAM type: YTN; PAM sequence: TTA
atttttgataccttctaaag

SEQ ID NO: 195129 - DNA, 20 bp, Artificial Sequence
  Description of Artificial Sequence: Synthetic oligonucleotide
  Target: ATXN1; (-) strand; PAM type: YTN; PAM sequence: TTT
aatttttgataccttctaaa

SEQ ID NO: 195130 - DNA, 20 bp, Artificial Sequence
  Description of Artificial Sequence: Synthetic oligonucleotide
  Target: ATXN1; (-) strand; PAM type: YTN; PAM sequence: TTT
taatttttgataccttctaa

SEQ ID NO: 195131 - DNA, 20 bp, Artificial Sequence
  Description of Artificial Sequence: Synthetic oligonucleotide
  Target: ATXN1; (-) strand; PAM type: YTN; PAM sequence: CTG
aatgaatattttaatttttg

SEQ ID NO: 195132 - DNA, 20 bp, Artificial Sequence
  Description of Artificial Sequence: Synthetic oligonucleotide
  Target: ATXN1; (-) strand; PAM type: YTN; PAM sequence: TTA
acactgaatgaatattttaa

SEQ ID NO: 195133 - DNA, 20 bp, Artificial Sequence
  Description of Artificial Sequence: Synthetic oligonucleotide
  Target: ATXN1; (-) strand; PAM type: YTN; PAM sequence: TTA
gaaatattaacactgaatga

SEQ ID NO: 195134 - DNA, 20 bp, Artificial Sequence
  Description of Artificial Sequence: Synthetic oligonucleotide
  Target: ATXN1; (-) strand; PAM type: YTN; PAM sequence: TTA
gattagaaatattaacactg

SEQ ID NO: 195135 - DNA, 20 bp, Artificial Sequence
  Description of Artificial Sequence: Synthetic oligonucleotide
  Target: ATXN1; (-) strand; PAM type: YTN; PAM sequence: CTT
agattagaaatattaacact

SEQ ID NO: 195136 - DNA, 20 bp, Artificial Sequence
  Description of Artificial Sequence: Synthetic oligonucleotide
  Target: ATXN1; (-) strand; PAM type: YTN; PAM sequence: TTG
agaaggaacttagattagaa

SEQ ID NO: 195137 - DNA, 20 bp, Artificial Sequence
  Description of Artificial Sequence: Synthetic oligonucleotide
  Target: ATXN1; (-) strand; PAM type: YTN; PAM sequence: TTT
gagaaggaacttagattaga

SEQ ID NO: 195138 - DNA, 20 bp, Artificial Sequence
  Description of Artificial Sequence: Synthetic oligonucleotide
  Target: ATXN1; (-) strand; PAM type: YTN; PAM sequence: CTT
tgagaaggaacttagattag

SEQ ID NO: 195139 - DNA, 20 bp, Artificial Sequence
  Description of Artificial Sequence: Synthetic oligonucleotide
  Target: ATXN1; (-) strand; PAM type: YTN; PAM sequence: CTC
tttgagaaggaacttagatt

SEQ ID NO: 195140 - DNA, 20 bp, Artificial Sequence
  Description of Artificial Sequence: Synthetic oligonucleotide
  Target: ATXN1; (-) strand; PAM type: YTN; PAM sequence: TTC
tctttgagaaggaacttaga

SEQ ID NO: 195141 - DNA, 20 bp, Artificial Sequence
  Description of Artificial Sequence: Synthetic oligonucleotide
  Target: ATXN1; (-) strand; PAM type: YTN; PAM sequence: TTA
ccaaaccaaccattctcttt

SEQ ID NO: 195142 - DNA, 20 bp, Artificial Sequence
  Description of Artificial Sequence: Synthetic oligonucleotide
  Target: ATXN1; (-) strand; PAM type: YTN; PAM sequence: TTT
accaaaccaaccattctctt

SEQ ID NO: 195143 - DNA, 20 bp, Artificial Sequence
  Description of Artificial Sequence: Synthetic oligonucleotide
  Target: ATXN1; (-) strand; PAM type: YTN; PAM sequence: TTT
taccaaaccaaccattctct

SEQ ID NO: 195144 - DNA, 20 bp, Artificial Sequence
  Description of Artificial Sequence: Synthetic oligonucleotide
  Target: ATXN1; (-) strand; PAM type: YTN; PAM sequence: TTT
ttaccaaaccaaccattctc

SEQ ID NO: 195145 - DNA, 20 bp, Artificial Sequence
  Description of Artificial Sequence: Synthetic oligonucleotide
  Target: ATXN1; (-) strand; PAM type: YTN; PAM sequence: CTA
tcacatatatttttaccaaa

SEQ ID NO: 195146 - DNA, 20 bp, Artificial Sequence
  Description of Artificial Sequence: Synthetic oligonucleotide
  Target: ATXN1; (-) strand; PAM type: YTN; PAM sequence: TTC
agcaaatcctatcacatata

SEQ ID NO: 195147 - DNA, 20 bp, Artificial Sequence
  Description of Artificial Sequence: Synthetic oligonucleotide
  Target: ATXN1; (-) strand; PAM type: YTN; PAM sequence: CTT
cagcaaatcctatcacatat

SEQ ID NO: 195148 - DNA, 20 bp, Artificial Sequence
  Description of Artificial Sequence: Synthetic oligonucleotide
  Target: ATXN1; (-) strand; PAM type: YTN; PAM sequence: TTG
agggcaaggatgtgtcatgt

SEQ ID NO: 195149 - DNA, 20 bp, Artificial Sequence
  Description of Artificial Sequence: Synthetic oligonucleotide
  Target: ATXN1; (-) strand; PAM type: YTN; PAM sequence: TTA
attgagggcaaggatgtgtc

SEQ ID NO: 195150 - DNA, 20 bp, Artificial Sequence
  Description of Artificial Sequence: Synthetic oligonucleotide
  Target: ATXN1; (-) strand; PAM type: YTN; PAM sequence: CTT
aattgagggcaaggatgtgt

SEQ ID NO: 195151 - DNA, 20 bp, Artificial Sequence
  Description of Artificial Sequence: Synthetic oligonucleotide
  Target: ATXN1; (-) strand; PAM type: YTN; PAM sequence: CTA
gtcgcggggggaggtatggc

SEQ ID NO: 195152 - DNA, 20 bp, Artificial Sequence
  Description of Artificial Sequence: Synthetic oligonucleotide
  Target: ATXN1; (-) strand; PAM type: YTN; PAM sequence: CTG
gaatgtcactagtcgcgggg

SEQ ID NO: 195153 - DNA, 20 bp, Artificial Sequence
  Description of Artificial Sequence: Synthetic oligonucleotide
  Target: ATXN1; (-) strand; PAM type: YTN; PAM sequence: TTC
ctggaatgtcactagtcgcg

SEQ ID NO: 195154 - DNA, 20 bp, Artificial Sequence
  Description of Artificial Sequence: Synthetic oligonucleotide
  Target: ATXN1; (-) strand; PAM type: YTN; PAM sequence: TTT
cctggaatgtcactagtcgc

SEQ ID NO: 195155 - DNA, 20 bp, Artificial Sequence
  Description of Artificial Sequence: Synthetic oligonucleotide
  Target: ATXN1; (-) strand; PAM type: YTN; PAM sequence: TTT
tcctggaatgtcactagtcg

SEQ ID NO: 195156 - DNA, 20 bp, Artificial Sequence
  Description of Artificial Sequence: Synthetic oligonucleotide
  Target: ATXN1; (-) strand; PAM type: YTN; PAM sequence: CTC
aaaagtgagattttcctgga

SEQ ID NO: 195157 - DNA, 20 bp, Artificial Sequence
  Description of Artificial Sequence: Synthetic oligonucleotide
  Target: ATXN1; (-) strand; PAM type: YTN; PAM sequence: CTC
ccctcaaaagtgagattttc

SEQ ID NO: 195158 - DNA, 20 bp, Artificial Sequence
  Description of Artificial Sequence: Synthetic oligonucleotide
  Target: ATXN1; (-) strand; PAM type: YTN; PAM sequence: TTC
cccagcctcccctcaaaagt

SEQ ID NO: 195159 - DNA, 20 bp, Artificial Sequence
  Description of Artificial Sequence: Synthetic oligonucleotide
  Target: ATXN1; (-) strand; PAM type: YTN; PAM sequence: CTT
ccccagcctcccctcaaaag

SEQ ID NO: 195160 - DNA, 20 bp, Artificial Sequence
  Description of Artificial Sequence: Synthetic oligonucleotide
  Target: ATXN1; (-) strand; PAM type: YTN; PAM sequence: CTC
acttccccagcctcccctca

SEQ ID NO: 195161 - DNA, 20 bp, Artificial Sequence
  Description of Artificial Sequence: Synthetic oligonucleotide
  Target: ATXN1; (-) strand; PAM type: YTN; PAM sequence: TTG
cggggatatgctcacttccc

SEQ ID NO: 195162 - DNA, 20 bp, Artificial Sequence
  Description of Artificial Sequence: Synthetic oligonucleotide
  Target: ATXN1; (-) strand; PAM type: YTN; PAM sequence: CTG
cccattgcggggatatgctc

SEQ ID NO: 195163 - DNA, 20 bp, Artificial Sequence
  Description of Artificial Sequence: Synthetic oligonucleotide
  Target: ATXN1; (-) strand; PAM type: YTN; PAM sequence: CTC
tgcccattgcggggatatgc

SEQ ID NO: 195164 - DNA, 20 bp, Artificial Sequence
  Description of Artificial Sequence: Synthetic oligonucleotide
  Target: ATXN1; (-) strand; PAM type: YTN; PAM sequence: TTC
cacacactctgcccattgcg

SEQ ID NO: 195165 - DNA, 20 bp, Artificial Sequence
  Description of Artificial Sequence: Synthetic oligonucleotide
  Target: ATXN1; (-) strand; PAM type: YTN; PAM sequence: TTT
ccacacactctgcccattgc

SEQ ID NO: 195166 - DNA, 20 bp, Artificial Sequence
  Description of Artificial Sequence: Synthetic oligonucleotide
  Target: ATXN1; (-) strand; PAM type: YTN; PAM sequence: CTG
gagacacgatttccacacac

SEQ ID NO: 195167 - DNA, 20 bp, Artificial Sequence
  Description of Artificial Sequence: Synthetic oligonucleotide
  Target: ATXN1; (-) strand; PAM type: YTN; PAM sequence: CTC
catggctggagacacgattt

SEQ ID NO: 195168 - DNA, 20 bp, Artificial Sequence
  Description of Artificial Sequence: Synthetic oligonucleotide
  Target: ATXN1; (-) strand; PAM type: YTN; PAM sequence: TTC
gtgtctccatggctggagac

SEQ ID NO: 195169 - DNA, 20 bp, Artificial Sequence
  Description of Artificial Sequence: Synthetic oligonucleotide
  Target: ATXN1; (-) strand; PAM type: YTN; PAM sequence: CTG
cattcgtgtctccatggctg

SEQ ID NO: 195170 - DNA, 20 bp, Artificial Sequence
  Description of Artificial Sequence: Synthetic oligonucleotide
  Target: ATXN1; (-) strand; PAM type: YTN; PAM sequence: TTA
actgcattcgtgtctccatg

SEQ ID NO: 195171 - DNA, 20 bp, Artificial Sequence
  Description of Artificial Sequence: Synthetic oligonucleotide
  Target: ATXN1; (-) strand; PAM type: YTN; PAM sequence: TTA
gaaaaggttaactgcattcg

SEQ ID NO: 195172 - DNA, 20 bp, Artificial Sequence
  Description of Artificial Sequence: Synthetic oligonucleotide
  Target: ATXN1; (-) strand; PAM type: YTN; PAM sequence: CTT
agaaaaggttaactgcattc

SEQ ID NO: 195173 - DNA, 20 bp, Artificial Sequence
  Description of Artificial Sequence: Synthetic oligonucleotide
  Target: ATXN1; (-) strand; PAM type: YTN; PAM sequence: TTG
gatacttagaaaaggttaac

SEQ ID NO: 195174 - DNA, 20 bp, Artificial Sequence
  Description of Artificial Sequence: Synthetic oligonucleotide
  Target: ATXN1; (-) strand; PAM type: YTN; PAM sequence: TTC
atggagcagtgttggatact

SEQ ID NO: 195175 - DNA, 20 bp, Artificial Sequence
  Description of Artificial Sequence: Synthetic oligonucleotide
  Target: ATXN1; (-) strand; PAM type: YTN; PAM sequence: CTG
attcatggagcagtgttgga

SEQ ID NO: 195176 - DNA, 20 bp, Artificial Sequence
  Description of Artificial Sequence: Synthetic oligonucleotide
  Target: ATXN1; (-) strand; PAM type: YTN; PAM sequence: CTG
cctgattcatggagcagtgt

SEQ ID NO: 195177 - DNA, 20 bp, Artificial Sequence
  Description of Artificial Sequence: Synthetic oligonucleotide
  Target: ATXN1; (-) strand; PAM type: YTN; PAM sequence: CTC
ctgcctgattcatggagcag

SEQ ID NO: 195178 - DNA, 20 bp, Artificial Sequence
  Description of Artificial Sequence: Synthetic oligonucleotide
  Target: ATXN1; (-) strand; PAM type: YTN; PAM sequence: CTG
ccagccccatctcctgcctg

SEQ ID NO: 195179 - DNA, 20 bp, Artificial Sequence
  Description of Artificial Sequence: Synthetic oligonucleotide
  Target: ATXN1; (-) strand; PAM type: YTN; PAM sequence: CTC
tgccagccccatctcctgcc

SEQ ID NO: 195180 - DNA, 20 bp, Artificial Sequence
  Description of Artificial Sequence: Synthetic oligonucleotide
  Target: ATXN1; (-) strand; PAM type: YTN; PAM sequence: CTC
tctgccagccccatctcctg

SEQ ID NO: 195181 - DNA, 20 bp, Artificial Sequence
  Description of Artificial Sequence: Synthetic oligonucleotide
  Target: ATXN1; (-) strand; PAM type: YTN; PAM sequence: CTG
ctctctgccagccccatctc

SEQ ID NO: 195182 - DNA, 20 bp, Artificial Sequence
  Description of Artificial Sequence: Synthetic oligonucleotide
  Target: ATXN1; (-) strand; PAM type: YTN; PAM sequence: CTG
ctgctctctgccagccccat

SEQ ID NO: 195183 - DNA, 20 bp, Artificial Sequence
  Description of Artificial Sequence: Synthetic oligonucleotide
  Target: ATXN1; (-) strand; PAM type: YTN; PAM sequence: CTC
tgctgctctctgccagcccc

SEQ ID NO: 195184 - DNA, 20 bp, Artificial Sequence
  Description of Artificial Sequence: Synthetic oligonucleotide
  Target: ATXN1; (-) strand; PAM type: YTN; PAM sequence: CTC
cctctgctgctctctgccag

SEQ ID NO: 195185 - DNA, 20 bp, Artificial Sequence
  Description of Artificial Sequence: Synthetic oligonucleotide
  Target: ATXN1; (-) strand; PAM type: YTN; PAM sequence: TTC
tccctctgctgctctctgcc

SEQ ID NO: 195186 - DNA, 20 bp, Artificial Sequence
  Description of Artificial Sequence: Synthetic oligonucleotide
  Target: ATXN1; (-) strand; PAM type: YTN; PAM sequence: TTT
ctccctctgctgctctctgc

SEQ ID NO: 195187 - DNA, 20 bp, Artificial Sequence
  Description of Artificial Sequence: Synthetic oligonucleotide
  Target: ATXN1; (-) strand; PAM type: YTN; PAM sequence: CTT
tctccctctgctgctctctg

SEQ ID NO: 195188 - DNA, 20 bp, Artificial Sequence
  Description of Artificial Sequence: Synthetic oligonucleotide
  Target: ATXN1; (-) strand; PAM type: YTN; PAM sequence: TTC
tttctccctctgctgctctc

SEQ ID NO: 195189 - DNA, 20 bp, Artificial Sequence
  Description of Artificial Sequence: Synthetic oligonucleotide
  Target: ATXN1; (-) strand; PAM type: YTN; PAM sequence: CTA
tgtgttctttctccctctgc

SEQ ID NO: 195190 - DNA, 20 bp, Artificial Sequence
  Description of Artificial Sequence: Synthetic oligonucleotide
  Target: ATXN1; (-) strand; PAM type: YTN; PAM sequence: CTG
ctatgtgttctttctccctc

SEQ ID NO: 195191 - DNA, 20 bp, Artificial Sequence
  Description of Artificial Sequence: Synthetic oligonucleotide
  Target: ATXN1; (-) strand; PAM type: YTN; PAM sequence: CTG
ctgctatgtgttctttctcc

SEQ ID NO: 195192 - DNA, 20 bp, Artificial Sequence
  Description of Artificial Sequence: Synthetic oligonucleotide
  Target: ATXN1; (-) strand; PAM type: YTN; PAM sequence: TTG
ctgctgctatgtgttctttc

SEQ ID NO: 195193 - DNA, 20 bp, Artificial Sequence
  Description of Artificial Sequence: Synthetic oligonucleotide
  Target: ATXN1; (-) strand; PAM type: YTN; PAM sequence: TTT
gctgctgctatgtgttcttt

SEQ ID NO: 195194 - DNA, 20 bp, Artificial Sequence
  Description of Artificial Sequence: Synthetic oligonucleotide
  Target: ATXN1; (-) strand; PAM type: YTN; PAM sequence: CTT
tgctgctgctatgtgttctt

SEQ ID NO: 195195 - DNA, 20 bp, Artificial Sequence
  Description of Artificial Sequence: Synthetic oligonucleotide
  Target: ATXN1; (-) strand; PAM type: YTN; PAM sequence: TTC
tttgctgctgctatgtgttc

SEQ ID NO: 195196 - DNA, 20 bp, Artificial Sequence
  Description of Artificial Sequence: Synthetic oligonucleotide
  Target: ATXN1; (-) strand; PAM type: YTN; PAM sequence: TTT
ctttgctgctgctatgtgtt

SEQ ID NO: 195197 - DNA, 20 bp, Artificial Sequence
  Description of Artificial Sequence: Synthetic oligonucleotide
  Target: ATXN1; (-) strand; PAM type: YTN; PAM sequence: TTG
gcatttctttgctgctgcta

SEQ ID NO: 195198 - DNA, 20 bp, Artificial Sequence
  Description of Artificial Sequence: Synthetic oligonucleotide
  Target: ATXN1; (-) strand; PAM type: YTN; PAM sequence: TTT
ggcatttctttgctgctgct

SEQ ID NO: 195199 - DNA, 20 bp, Artificial Sequence
  Description of Artificial Sequence: Synthetic oligonucleotide
  Target: ATXN1; (-) strand; PAM type: YTN; PAM sequence: CTT
tggcatttctttgctgctgc

SEQ ID NO: 195200 - DNA, 20 bp, Artificial Sequence
  Description of Artificial Sequence: Synthetic oligonucleotide
  Target: ATXN1; (-) strand; PAM type: YTN; PAM sequence: CTC
ctttggcatttctttgctgc

SEQ ID NO: 195201 - DNA, 20 bp, Artificial Sequence
  Description of Artificial Sequence: Synthetic oligonucleotide
  Target: ATXN1; (-) strand; PAM type: YTN; PAM sequence: CTA
tctcctttggcatttctttg

SEQ ID NO: 195202 - DNA, 20 bp, Artificial Sequence
  Description of Artificial Sequence: Synthetic oligonucleotide
  Target: ATXN1; (-) strand; PAM type: YTN; PAM sequence: TTG
cagccagtatctatctcctt

SEQ ID NO: 195203 - DNA, 20 bp, Artificial Sequence
  Description of Artificial Sequence: Synthetic oligonucleotide
  Target: ATXN1; (-) strand; PAM type: YTN; PAM sequence: TTT
gcagccagtatctatctcct

SEQ ID NO: 195204 - DNA, 20 bp, Artificial Sequence
  Description of Artificial Sequence: Synthetic oligonucleotide
  Target: ATXN1; (-) strand; PAM type: YTN; PAM sequence: TTT
tgcagccagtatctatctcc

SEQ ID NO: 195205 - DNA, 20 bp, Artificial Sequence
  Description of Artificial Sequence: Synthetic oligonucleotide
  Target: ATXN1; (-) strand; PAM type: YTN; PAM sequence: CTG
ggattttgcagccagtatct

SEQ ID NO: 195206 - DNA, 20 bp, Artificial Sequence
  Description of Artificial Sequence: Synthetic oligonucleotide
  Target: ATXN1; (-) strand; PAM type: YTN; PAM sequence: CTC
gctgggattttgcagccagt

SEQ ID NO: 195207 - DNA, 20 bp, Artificial Sequence
  Description of Artificial Sequence: Synthetic oligonucleotide
  Target: ATXN1; (-) strand; PAM type: YTN; PAM sequence: TTG
atctcgctgggattttgcag

SEQ ID NO: 195208 - DNA, 20 bp, Artificial Sequence
  Description of Artificial Sequence: Synthetic oligonucleotide
  Target: ATXN1; (-) strand; PAM type: YTN; PAM sequence: TTT
gatctcgctgggattttgca

SEQ ID NO: 195209 - DNA, 20 bp, Artificial Sequence
  Description of Artificial Sequence: Synthetic oligonucleotide
  Target: ATXN1; (-) strand; PAM type: YTN; PAM sequence: CTT
tgatctcgctgggattttgc

SEQ ID NO: 195210 - DNA, 20 bp, Artificial Sequence
  Description of Artificial Sequence: Synthetic oligonucleotide
  Target: ATXN1; (-) strand; PAM type: YTN; PAM sequence: CTC
cgcctttgatctcgctggga

SEQ ID NO: 195211 - DNA, 20 bp, Artificial Sequence
  Description of Artificial Sequence: Synthetic oligonucleotide
  Target: ATXN1; (-) strand; PAM type: YTN; PAM sequence: TTG
catctccgcctttgatctcg

SEQ ID NO: 195212 - DNA, 20 bp, Artificial Sequence
  Description of Artificial Sequence: Synthetic oligonucleotide
  Target: ATXN1; (-) strand; PAM type: YTN; PAM sequence: TTT
gcatctccgcctttgatctc

SEQ ID NO: 195213 - DNA, 20 bp, Artificial Sequence
  Description of Artificial Sequence: Synthetic oligonucleotide
  Target: ATXN1; (-) strand; PAM type: YTN; PAM sequence: CTT
tgcatctccgcctttgatct

SEQ ID NO: 195214 - DNA, 20 bp, Artificial Sequence
  Description of Artificial Sequence: Synthetic oligonucleotide
  Target: ATXN1; (-) strand; PAM type: YTN; PAM sequence: CTA
ctttgcatctccgcctttga

SEQ ID NO: 195215 - DNA, 20 bp, Artificial Sequence
  Description of Artificial Sequence: Synthetic oligonucleotide
  Target: ATXN1; (-) strand; PAM type: YTN; PAM sequence: CTC
tactttgcatctccgccttt

SEQ ID NO: 195216 - DNA, 20 bp, Artificial Sequence
  Description of Artificial Sequence: Synthetic oligonucleotide
  Target: ATXN1; (-) strand; PAM type: YTN; PAM sequence: TTG
ctctactttgcatctccgcc

SEQ ID NO: 195217 - DNA, 20 bp, Artificial Sequence
  Description of Artificial Sequence: Synthetic oligonucleotide
  Target: ATXN1; (-) strand; PAM type: YTN; PAM sequence: CTG
tgttgctctactttgcatct

SEQ ID NO: 195218 - DNA, 20 bp, Artificial Sequence
  Description of Artificial Sequence: Synthetic oligonucleotide
  Target: ATXN1; (-) strand; PAM type: YTN; PAM sequence: CTC
tgtgttgctctactttgcat

SEQ ID NO: 195219 - DNA, 20 bp, Artificial Sequence
  Description of Artificial Sequence: Synthetic oligonucleotide
  Target: ATXN1; (-) strand; PAM type: YTN; PAM sequence: TTC
acagatcagactctgtgttg

SEQ ID NO: 195220 - DNA, 20 bp, Artificial Sequence
  Description of Artificial Sequence: Synthetic oligonucleotide
  Target: ATXN1; (-) strand; PAM type: YTN; PAM sequence: TTT
cacagatcagactctgtgtt

SEQ ID NO: 195221 - DNA, 20 bp, Artificial Sequence
  Description of Artificial Sequence: Synthetic oligonucleotide
  Target: ATXN1; (-) strand; PAM type: YTN; PAM sequence: TTG
gtttcacagatcagactctg

SEQ ID NO: 195222 - DNA, 20 bp, Artificial Sequence
  Description of Artificial Sequence: Synthetic oligonucleotide
  Target: ATXN1; (-) strand; PAM type: YTN; PAM sequence: CTT
ggtttcacagatcagactct

SEQ ID NO: 195223 - DNA, 20 bp, Artificial Sequence
  Description of Artificial Sequence: Synthetic oligonucleotide
  Target: ATXN1; (-) strand; PAM type: YTN; PAM sequence: TTA
tggaccttggtttcacagat

SEQ ID NO: 195224 - DNA, 20 bp, Artificial Sequence
  Description of Artificial Sequence: Synthetic oligonucleotide
  Target: ATXN1; (-) strand; PAM type: YTN; PAM sequence: TTG
gttatggaccttggtttcac

SEQ ID NO: 195225 - DNA, 20 bp, Artificial Sequence
  Description of Artificial Sequence: Synthetic oligonucleotide
  Target: ATXN1; (-) strand; PAM type: YTN; PAM sequence: CTG
ccattggttatggaccttgg

SEQ ID NO: 195226 - DNA, 20 bp, Artificial Sequence
  Description of Artificial Sequence: Synthetic oligonucleotide
  Target: ATXN1; (-) strand; PAM type: YTN; PAM sequence: CTG
tcacctgccattggttatgg

SEQ ID NO: 195227 - DNA, 20 bp, Artificial Sequence
  Description of Artificial Sequence: Synthetic oligonucleotide
  Target: ATXN1; (-) strand; PAM type: YTN; PAM sequence: TTG
taagggactgtcacctgcca

SEQ ID NO: 195228 - DNA, 20 bp, Artificial Sequence
  Description of Artificial Sequence: Synthetic oligonucleotide
  Target: ATXN1; (-) strand; PAM type: YTN; PAM sequence: TTG
ttgtaagggactgtcacctg

SEQ ID NO: 195229 - DNA, 20 bp, Artificial Sequence
  Description of Artificial Sequence: Synthetic oligonucleotide
  Target: ATXN1; (-) strand; PAM type: YTN; PAM sequence: TTT
gttgtaagggactgtcacct

SEQ ID NO: 195230 - DNA, 20 bp, Artificial Sequence
  Description of Artificial Sequence: Synthetic oligonucleotide
  Target: ATXN1; (-) strand; PAM type: YTN; PAM sequence: TTA
gggagcatttgttgtaaggg

SEQ ID NO: 195231 - DNA, 20 bp, Artificial Sequence
  Description of Artificial Sequence: Synthetic oligonucleotide
  Target: ATXN1; (-) strand; PAM type: YTN; PAM sequence: TTT
agggagcatttgttgtaagg

SEQ ID NO: 195232 - DNA, 20 bp, Artificial Sequence
  Description of Artificial Sequence: Synthetic oligonucleotide
  Target: ATXN1; (-) strand; PAM type: YTN; PAM sequence: CTG
gaccagggatgaagcattta

SEQ ID NO: 195233 - DNA, 20 bp, Artificial Sequence
  Description of Artificial Sequence: Synthetic oligonucleotide
  Target: ATXN1; (-) strand; PAM type: YTN; PAM sequence: TTG
catcggctggaccagggatg

SEQ ID NO: 195234 - DNA, 20 bp, Artificial Sequence
  Description of Artificial Sequence: Synthetic oligonucleotide
  Target: ATXN1; (-) strand; PAM type: YTN; PAM sequence: TTA
aaaattgcatcggctggacc

SEQ ID NO: 195235 - DNA, 20 bp, Artificial Sequence
  Description of Artificial Sequence: Synthetic oligonucleotide
  Target: ATXN1; (-) strand; PAM type: YTN; PAM sequence: CTT
aaaaattgcatcggctggac

SEQ ID NO: 195236 - DNA, 20 bp, Artificial Sequence
  Description of Artificial Sequence: Synthetic oligonucleotide
  Target: ATXN1; (-) strand; PAM type: YTN; PAM sequence: CTC
cccttaaaaattgcatcggc

SEQ ID NO: 195237 - DNA, 20 bp, Artificial Sequence
  Description of Artificial Sequence: Synthetic oligonucleotide
  Target: ATXN1; (-) strand; PAM type: YTN; PAM sequence: TTA
ccactccccttaaaaattgc

SEQ ID NO: 195238 - DNA, 20 bp, Artificial Sequence
  Description of Artificial Sequence: Synthetic oligonucleotide
  Target: ATXN1; (-) strand; PAM type: YTN; PAM sequence: CTA
agagcatgacccccaccaca

SEQ ID NO: 195239 - DNA, 20 bp, Artificial Sequence
  Description of Artificial Sequence: Synthetic oligonucleotide
  Target: ATXN1; (-) strand; PAM type: YTN; PAM sequence: TTC
taagagcatgacccccacca

SEQ ID NO: 195240 - DNA, 20 bp, Artificial Sequence
  Description of Artificial Sequence: Synthetic oligonucleotide
  Target: ATXN1; (-) strand; PAM type: YTN; PAM sequence: TTT
ctaagagcatgacccccacc

SEQ ID NO: 195241 - DNA, 20 bp, Artificial Sequence
  Description of Artificial Sequence: Synthetic oligonucleotide
  Target: ATXN1; (-) strand; PAM type: YTN; PAM sequence: TTT
tctaagagcatgacccccac

SEQ ID NO: 195242 - DNA, 20 bp, Artificial Sequence
  Description of Artificial Sequence: Synthetic oligonucleotide
  Target: ATXN1; (-) strand; PAM type: YTN; PAM sequence: TTT
ttctaagagcatgaccccca

SEQ ID NO: 195243 - DNA, 20 bp, Artificial Sequence
  Description of Artificial Sequence: Synthetic oligonucleotide
  Target: ATXN1; (-) strand; PAM type: YTN; PAM sequence: TTT
tttctaagagcatgaccccc

SEQ ID NO: 195244 - DNA, 20 bp, Artificial Sequence
  Description of Artificial Sequence: Synthetic oligonucleotide
  Target: ATXN1; (-) strand; PAM type: YTN; PAM sequence: TTC
acatggtcaaaatgtaatag

SEQ ID NO: 195245 - DNA, 20 bp, Artificial Sequence
  Description of Artificial Sequence: Synthetic oligonucleotide
  Target: ATXN1; (-) strand; PAM type: YTN; PAM sequence: TTT
cacatggtcaaaatgtaata

SEQ ID NO: 195246 - DNA, 20 bp, Artificial Sequence
  Description of Artificial Sequence: Synthetic oligonucleotide
  Target: ATXN1; (-) strand; PAM type: YTN; PAM sequence: CTA
tttcacatggtcaaaatgta

SEQ ID NO: 195247 - DNA, 20 bp, Artificial Sequence
  Description of Artificial Sequence: Synthetic oligonucleotide
  Target: ATXN1; (-) strand; PAM type: YTN; PAM sequence: TTC
tatttcacatggtcaaaatg

SEQ ID NO: 195248 - DNA, 20 bp, Artificial Sequence
  Description of Artificial Sequence: Synthetic oligonucleotide
  Target: ATXN1; (-) strand; PAM type: YTN; PAM sequence: TTG
attctatttcacatggtcaa

SEQ ID NO: 195249 - DNA, 20 bp, Artificial Sequence
  Description of Artificial Sequence: Synthetic oligonucleotide
  Target: ATXN1; (-) strand; PAM type: YTN; PAM sequence: TTC
ccaacattgattctatttca

SEQ ID NO: 195250 - DNA, 20 bp, Artificial Sequence
  Description of Artificial Sequence: Synthetic oligonucleotide
  Target: ATXN1; (-) strand; PAM type: YTN; PAM sequence: TTA
gttcccaacattgattctat

SEQ ID NO: 195251 - DNA, 20 bp, Artificial Sequence
  Description of Artificial Sequence: Synthetic oligonucleotide
  Target: ATXN1; (-) strand; PAM type: YTN; PAM sequence: CTT
agttcccaacattgattcta

SEQ ID NO: 195252 - DNA, 20 bp, Artificial Sequence
  Description of Artificial Sequence: Synthetic oligonucleotide
  Target: ATXN1; (-) strand; PAM type: YTN; PAM sequence: TTC
ttagttcccaacattgattc

SEQ ID NO: 195253 - DNA, 20 bp, Artificial Sequence
  Description of Artificial Sequence: Synthetic oligonucleotide
  Target: ATXN1; (-) strand; PAM type: YTN; PAM sequence: CTG
tgttcttagttcccaacatt

SEQ ID NO: 195254 - DNA, 20 bp, Artificial Sequence
  Description of Artificial Sequence: Synthetic oligonucleotide
  Target: ATXN1; (-) strand; PAM type: YTN; PAM sequence: TTA
aggtctgtgttcttagttcc

SEQ ID NO: 195255 - DNA, 20 bp, Artificial Sequence
  Description of Artificial Sequence: Synthetic oligonucleotide
  Target: ATXN1; (-) strand; PAM type: YTN; PAM sequence: TTT
aaggtctgtgttcttagttc

SEQ ID NO: 195256 - DNA, 20 bp, Artificial Sequence
  Description of Artificial Sequence: Synthetic oligonucleotide
  Target: ATXN1; (-) strand; PAM type: YTN; PAM sequence: CTG
acatttaaggtctgtgttct

SEQ ID NO: 195257 - DNA, 20 bp, Artificial Sequence
  Description of Artificial Sequence: Synthetic oligonucleotide
  Target: ATXN1; (-) strand; PAM type: YTN; PAM sequence: CTG
ctgacatttaaggtctgtgt

SEQ ID NO: 195258 - DNA, 20 bp, Artificial Sequence
  Description of Artificial Sequence: Synthetic oligonucleotide
  Target: ATXN1; (-) strand; PAM type: YTN; PAM sequence: CTC
catccactgctgacatttaa

SEQ ID NO: 195259 - DNA, 20 bp, Artificial Sequence
  Description of Artificial Sequence: Synthetic oligonucleotide
  Target: ATXN1; (-) strand; PAM type: YTN; PAM sequence: CTG
actccatccactgctgacat

SEQ ID NO: 195260 - DNA, 20 bp, Artificial Sequence
  Description of Artificial Sequence: Synthetic oligonucleotide
  Target: ATXN1; (-) strand; PAM type: YTN; PAM sequence: CTC
tgactccatccactgctgac

SEQ ID NO: 195261 - DNA, 20 bp, Artificial Sequence
  Description of Artificial Sequence: Synthetic oligonucleotide
  Target: ATXN1; (-) strand; PAM type: YTN; PAM sequence: CTC
tctgactccatccactgctg

SEQ ID NO: 195262 - DNA, 20 bp, Artificial Sequence
  Description of Artificial Sequence: Synthetic oligonucleotide
  Target: ATXN1; (-) strand; PAM type: YTN; PAM sequence: CTC
tctctgactccatccactgc

SEQ ID NO: 195263 - DNA, 20 bp, Artificial Sequence
  Description of Artificial Sequence: Synthetic oligonucleotide
  Target: ATXN1; (-) strand; PAM type: YTN; PAM sequence: TTG
tcaaagaaatgctctctctg

SEQ ID NO: 195264 - DNA, 20 bp, Artificial Sequence
  Description of Artificial Sequence: Synthetic oligonucleotide
  Target: ATXN1; (-) strand; PAM type: YTN; PAM sequence: CTA
gagtgaattgtcaaagaaat

SEQ ID NO: 195265 - DNA, 20 bp, Artificial Sequence
  Description of Artificial Sequence: Synthetic oligonucleotide
  Target: ATXN1; (-) strand; PAM type: YTN; PAM sequence: TTG
caaatgcctagagtgaattg

SEQ ID NO: 195266 - DNA, 20 bp, Artificial Sequence
  Description of Artificial Sequence: Synthetic oligonucleotide
  Target: ATXN1; (-) strand; PAM type: YTN; PAM sequence: TTC
catgatattgcaaatgccta

SEQ ID NO: 195267 - DNA, 20 bp, Artificial Sequence
  Description of Artificial Sequence: Synthetic oligonucleotide
  Target: ATXN1; (-) strand; PAM type: YTN; PAM sequence: TTC
atattccatgatattgcaaa

SEQ ID NO: 195268 - DNA, 20 bp, Artificial Sequence
  Description of Artificial Sequence: Synthetic oligonucleotide
  Target: ATXN1; (-) strand; PAM type: YTN; PAM sequence: CTC
agttcatattccatgatatt

SEQ ID NO: 195269 - DNA, 20 bp, Artificial Sequence
  Description of Artificial Sequence: Synthetic oligonucleotide
  Target: ATXN1; (-) strand; PAM type: YTN; PAM sequence: TTA
aaagtagctcagttcatatt

SEQ ID NO: 195270 - DNA, 20 bp, Artificial Sequence
  Description of Artificial Sequence: Synthetic oligonucleotide
  Target: ATXN1; (-) strand; PAM type: YTN; PAM sequence: TTG
ttaaaagtagctcagttcat

SEQ ID NO: 195271 - DNA, 20 bp, Artificial Sequence
  Description of Artificial Sequence: Synthetic oligonucleotide
  Target: ATXN1; (-) strand; PAM type: YTN; PAM sequence: TTT
gttaaaagtagctcagttca

SEQ ID NO: 195272 - DNA, 20 bp, Artificial Sequence
  Description of Artificial Sequence: Synthetic oligonucleotide
  Target: ATXN1; (-) strand; PAM type: YTN; PAM sequence: CTA
tgaaaagagatttgttaaaa

SEQ ID NO: 195273 - DNA, 20 bp, Artificial Sequence
  Description of Artificial Sequence: Synthetic oligonucleotide
  Target: ATXN1; (-) strand; PAM type: YTN; PAM sequence: TTG
tactatgaaaagagatttgt

SEQ ID NO: 195274 - DNA, 20 bp, Artificial Sequence
  Description of Artificial Sequence: Synthetic oligonucleotide
  Target: ATXN1; (-) strand; PAM type: YTN; PAM sequence: CTG
aattgtactatgaaaagaga

SEQ ID NO: 195275 - DNA, 20 bp, Artificial Sequence
  Description of Artificial Sequence: Synthetic oligonucleotide
  Target: ATXN1; (-) strand; PAM type: YTN; PAM sequence: CTC
accaggtcctgaattgtact

SEQ ID NO: 195276 - DNA, 20 bp, Artificial Sequence
  Description of Artificial Sequence: Synthetic oligonucleotide
  Target: ATXN1; (-) strand; PAM type: YTN; PAM sequence: CTG
gaaacatctcaccaggtcct

SEQ ID NO: 195277 - DNA, 20 bp, Artificial Sequence
  Description of Artificial Sequence: Synthetic oligonucleotide
  Target: ATXN1; (-) strand; PAM type: YTN; PAM sequence: TTA
gatctggaaacatctcacca

SEQ ID NO: 195278 - DNA, 20 bp, Artificial Sequence
  Description of Artificial Sequence: Synthetic oligonucleotide
  Target: ATXN1; (-) strand; PAM type: YTN; PAM sequence: TTG
ttagatctggaaacatctca

SEQ ID NO: 195279 - DNA, 20 bp, Artificial Sequence
  Description of Artificial Sequence: Synthetic oligonucleotide
  Target: ATXN1; (-) strand; PAM type: YTN; PAM sequence: CTA
taagaagtgcattgttagat

SEQ ID NO: 195280 - DNA, 20 bp, Artificial Sequence
  Description of Artificial Sequence: Synthetic oligonucleotide
  Target: ATXN1; (-) strand; PAM type: YTN; PAM sequence: CTG
tccctataagaagtgcattg

SEQ ID NO: 195281 - DNA, 20 bp, Artificial Sequence
  Description of Artificial Sequence: Synthetic oligonucleotide
  Target: ATXN1; (-) strand; PAM type: YTN; PAM sequence: CTC
tgtccctataagaagtgcat

SEQ ID NO: 195282 - DNA, 20 bp, Artificial Sequence
  Description of Artificial Sequence: Synthetic oligonucleotide
  Target: ATXN1; (-) strand; PAM type: YTN; PAM sequence: TTG
ggcaaagcaaaaactctgtc

SEQ ID NO: 195283 - DNA, 20 bp, Artificial Sequence
  Description of Artificial Sequence: Synthetic oligonucleotide
  Target: ATXN1; (-) strand; PAM type: YTN; PAM sequence: CTC
atgtaaaagcggtgaccacg

SEQ ID NO: 195284 - DNA, 20 bp, Artificial Sequence
  Description of Artificial Sequence: Synthetic oligonucleotide
  Target: ATXN1; (-) strand; PAM type: YTN; PAM sequence: CTC
actcatgtaaaagcggtgac

SEQ ID NO: 195285 - DNA, 20 bp, Artificial Sequence
  Description of Artificial Sequence: Synthetic oligonucleotide
  Target: ATXN1; (-) strand; PAM type: YTN; PAM sequence: CTA
atgctcactcatgtaaaagc

SEQ ID NO: 195286 - DNA, 20 bp, Artificial Sequence
  Description of Artificial Sequence: Synthetic oligonucleotide
  Target: ATXN1; (-) strand; PAM type: YTN; PAM sequence: CTG
accatctaatgctcactcat

SEQ ID NO: 195287 - DNA, 20 bp, Artificial Sequence
  Description of Artificial Sequence: Synthetic oligonucleotide
  Target: ATXN1; (-) strand; PAM type: YTN; PAM sequence: TTG
tatagcacacaacacagcct

SEQ ID NO: 195288 - DNA, 20 bp, Artificial Sequence
  Description of Artificial Sequence: Synthetic oligonucleotide
  Target: ATXN1; (-) strand; PAM type: YTN; PAM sequence: TTG
atggtgtaaaaaagccattg

SEQ ID NO: 195289 - DNA, 20 bp, Artificial Sequence
  Description of Artificial Sequence: Synthetic oligonucleotide
  Target: ATXN1; (-) strand; PAM type: YTN; PAM sequence: CTT
gatggtgtaaaaaagccatt

SEQ ID NO: 195290 - DNA, 20 bp, Artificial Sequence
  Description of Artificial Sequence: Synthetic oligonucleotide
  Target: ATXN1; (-) strand; PAM type: YTN; PAM sequence: TTA
gtcttgatggtgtaaaaaag

SEQ ID NO: 195291 - DNA, 20 bp, Artificial Sequence
  Description of Artificial Sequence: Synthetic oligonucleotide
  Target: ATXN1; (-) strand; PAM type: YTN; PAM sequence: TTT
agtcttgatggtgtaaaaaa

SEQ ID NO: 195292 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccacagcacc

SEQ ID NO: 195293 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 195294 - DNA, 20 bp, Artificial Sequence
  Description of Artificial Sequence: Synthetic oligonucleotide
  Target: ATXN1; (-) strand; PAM type: YTN; PAM sequence: CTC
cgaaagtgctgggattacag

SEQ ID NO: 195295 - DNA, 20 bp, Artificial Sequence
  Description of Artificial Sequence: Synthetic oligonucleotide
  Target: ATXN1; (-) strand; PAM type: YTN; PAM sequence: TTG
gcctccgaaagtgctgggat

SEQ ID NO: 195296 - DNA, 20 bp, Artificial Sequence
  Description of Artificial Sequence: Synthetic oligonucleotide
  Target: ATXN1; (-) strand; PAM type: YTN; PAM sequence: CTT
ggcctccgaaagtgctggga

SEQ ID NO: 195297 - DNA, 20 bp, Artificial Sequence
  Description of Artificial Sequence: Synthetic oligonucleotide
  Target: ATXN1; (-) strand; PAM type: YTN; PAM sequence: CTG
ccttggcctccgaaagtgct

SEQ ID NO: 195298 - DNA, 20 bp, Artificial Sequence
  Description of Artificial Sequence: Synthetic oligonucleotide
  Target: ATXN1; (-) strand; PAM type: YTN; PAM sequence: TTC
ctgccttggcctccgaaagt

SEQ ID NO: 195299 - DNA, 20 bp, Artificial Sequence
  Description of Artificial Sequence: Synthetic oligonucleotide
  Target: ATXN1; (-) strand; PAM type: YTN; PAM sequence: CTT
cctgccttggcctccgaaag

SEQ ID NO: 195300 - DNA, 20 bp, Artificial Sequence
  Description of Artificial Sequence: Synthetic oligonucleotide
  Target: ATXN1; (-) strand; PAM type: YTN; PAM sequence: CTC
aagtgatcttcctgccttgg

SEQ ID NO: 195301 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatcttcctgc

SEQ ID NO: 195302 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaagtgatcttcc

SEQ ID NO: 195303 - DNA, 20 bp, Artificial Sequence
  Description of Artificial Sequence: Synthetic oligonucleotide
  Target: ATXN1; (-) strand; PAM type: YTN; PAM sequence: TTG
aactcctgacctcaagtgat

SEQ ID NO: 195304 - DNA, 20 bp, Artificial Sequence
  Description of Artificial Sequence: Synthetic oligonucleotide
  Target: ATXN1; (-) strand; PAM type: YTN; PAM sequence: CTT
gaactcctgacctcaagtga

SEQ ID NO: 195305 - DNA, 20 bp, Artificial Sequence
  Description of Artificial Sequence: Synthetic oligonucleotide
  Target: ATXN1; (-) strand; PAM type: YTN; PAM sequence: TTG
tcttgaactcctgacctcaa

SEQ ID NO: 195306 - DNA, 20 bp, Artificial Sequence
  Description of Artificial Sequence: Synthetic oligonucleotide
  Target: ATXN1; (-) strand; PAM type: YTN; PAM sequence: CTT
gtcttgaactcctgacctca

SEQ ID NO: 195307 - DNA, 20 bp, Artificial Sequence
  Description of Artificial Sequence: Synthetic oligonucleotide
  Target: ATXN1; (-) strand; PAM type: YTN; PAM sequence: TTG
cccaggcttgtcttgaactc

SEQ ID NO: 195308 - DNA, 20 bp, Artificial Sequence
  Description of Artificial Sequence: Synthetic oligonucleotide
  Target: ATXN1; (-) strand; PAM type: YTN; PAM sequence: TTG
ccatgttgcccaggcttgtc

SEQ ID NO: 195309 - DNA, 20 bp, Artificial Sequence
  Description of Artificial Sequence: Synthetic oligonucleotide
  Target: ATXN1; (-) strand; PAM type: YTN; PAM sequence: TTT
gccatgttgcccaggcttgt

SEQ ID NO: 195310 - DNA, 20 bp, Artificial Sequence
  Description of Artificial Sequence: Synthetic oligonucleotide
  Target: ATXN1; (-) strand; PAM type: YTN; PAM sequence: TTT
tgccatgttgcccaggcttg

SEQ ID NO: 195311 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggttttgcca

SEQ ID NO: 195312 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggttttgcc

SEQ ID NO: 195313 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggttttgc

SEQ ID NO: 195314 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggttttg

SEQ ID NO: 195315 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 195316 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 195317 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 195318 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 195319 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 195320 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 195321 - DNA, 20 bp, Artificial Sequence
  Description of Artificial Sequence: Synthetic oligonucleotide
  Target: ATXN1; (-) strand; PAM type: YTN; PAM sequence: TTA
caggcgtgcaccaggacacc

SEQ ID NO: 195322 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgcaccag

SEQ ID NO: 195323 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggattacag

SEQ ID NO: 195324 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 195325 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 195326 - DNA, 20 bp, Artificial Sequence
  Description of Artificial Sequence: Synthetic oligonucleotide
  Target: ATXN1; (-) strand; PAM type: YTN; PAM sequence: CTG
ctgcctcagcctcccgagta

SEQ ID NO: 195327 - DNA, 20 bp, Artificial Sequence
  Description of Artificial Sequence: Synthetic oligonucleotide
  Target: ATXN1; (-) strand; PAM type: YTN; PAM sequence: TTC
tgctgcctcagcctcccgag

SEQ ID NO: 195328 - DNA, 20 bp, Artificial Sequence
  Description of Artificial Sequence: Synthetic oligonucleotide
  Target: ATXN1; (-) strand; PAM type: YTN; PAM sequence: TTA
aagagattctgctgcctcag

SEQ ID NO: 195329 - DNA, 20 bp, Artificial Sequence
  Description of Artificial Sequence: Synthetic oligonucleotide
  Target: ATXN1; (-) strand; PAM type: YTN; PAM sequence: CTC
ccgggttaaagagattctgc

SEQ ID NO: 195330 - DNA, 20 bp, Artificial Sequence
  Description of Artificial Sequence: Synthetic oligonucleotide
  Target: ATXN1; (-) strand; PAM type: YTN; PAM sequence: CTC
cacctcccgggttaaagaga

SEQ ID NO: 195331 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcccgggtt

SEQ ID NO: 195332 - DNA, 20 bp, Artificial Sequence
  Description of Artificial Sequence: Synthetic oligonucleotide
  Target: ATXN1; (-) strand; PAM type: YTN; PAM sequence: CTA
tctgcaacctccacctcccg

SEQ ID NO: 195333 - DNA, 20 bp, Artificial Sequence
  Description of Artificial Sequence: Synthetic oligonucleotide
  Target: ATXN1; (-) strand; PAM type: YTN; PAM sequence: CTC
agctatctgcaacctccacc

SEQ ID NO: 195334 - DNA, 20 bp, Artificial Sequence
  Description of Artificial Sequence: Synthetic oligonucleotide
  Target: ATXN1; (-) strand; PAM type: YTN; PAM sequence: TTG
gagtgcagtggtgcgatctc

SEQ ID NO: 195335 - DNA, 20 bp, Artificial Sequence
  Description of Artificial Sequence: Synthetic oligonucleotide
  Target: ATXN1; (-) strand; PAM type: YTN; PAM sequence: TTG
cccaggttggagtgcagtgg

SEQ ID NO: 195336 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggttggagtgcag

SEQ ID NO: 195337 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggttggagtgc

SEQ ID NO: 195338 - DNA, 20 bp, Artificial Sequence
  Description of Artificial Sequence: Synthetic oligonucleotide
  Target: ATXN1; (-) strand; PAM type: YTN; PAM sequence: CTC
actctgttgcccaggttgga

SEQ ID NO: 195339 - DNA, 20 bp, Artificial Sequence
  Description of Artificial Sequence: Synthetic oligonucleotide
  Target: ATXN1; (-) strand; PAM type: YTN; PAM sequence: TTG
agagggagtctcactctgtt

SEQ ID NO: 195340 - DNA, 20 bp, Artificial Sequence
  Description of Artificial Sequence: Synthetic oligonucleotide
  Target: ATXN1; (-) strand; PAM type: YTN; PAM sequence: TTT
gagagggagtctcactctgt

SEQ ID NO: 195341 - DNA, 20 bp, Artificial Sequence
  Description of Artificial Sequence: Synthetic oligonucleotide
  Target: ATXN1; (-) strand; PAM type: YTN; PAM sequence: TTT
tgagagggagtctcactctg

SEQ ID NO: 195342 - DNA, 20 bp, Artificial Sequence
  Description of Artificial Sequence: Synthetic oligonucleotide
  Target: ATXN1; (-) strand; PAM type: YTN; PAM sequence: TTT
ttgagagggagtctcactct

SEQ ID NO: 195343 - DNA, 20 bp, Artificial Sequence
  Description of Artificial Sequence: Synthetic oligonucleotide
  Target: ATXN1; (-) strand; PAM type: YTN; PAM sequence: TTT
tttgagagggagtctcactc

SEQ ID NO: 195344 - DNA, 20 bp, Artificial Sequence
  Description of Artificial Sequence: Synthetic oligonucleotide
  Target: ATXN1; (-) strand; PAM type: YTN; PAM sequence: TTT
ttttgagagggagtctcact

SEQ ID NO: 195345 - DNA, 20 bp, Artificial Sequence
  Description of Artificial Sequence: Synthetic oligonucleotide
  Target: ATXN1; (-) strand; PAM type: YTN; PAM sequence: TTT
tttttgagagggagtctcac

SEQ ID NO: 195346 - DNA, 20 bp, Artificial Sequence
  Description of Artificial Sequence: Synthetic oligonucleotide
  Target: ATXN1; (-) strand; PAM type: YTN; PAM sequence: TTT
ttttttgagagggagtctca

SEQ ID NO: 195347 - DNA, 20 bp, Artificial Sequence
  Description of Artificial Sequence: Synthetic oligonucleotide
  Target: ATXN1; (-) strand; PAM type: YTN; PAM sequence: TTT
tttttttgagagggagtctc

SEQ ID NO: 195348 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagagggagtct

SEQ ID NO: 195349 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagagggagtc

SEQ ID NO: 195350 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagagggagt

SEQ ID NO: 195351 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagagggag

SEQ ID NO: 195352 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagaggga

SEQ ID NO: 195353 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagaggg

SEQ ID NO: 195354 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagagg

SEQ ID NO: 195355 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttgagag

SEQ ID NO: 195356 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttttgag

SEQ ID NO: 195357 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttttttga

SEQ ID NO: 195358 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttttttttg

SEQ ID NO: 195359 - DNA, 20 bp, Artificial Sequence
  Description of Artificial Sequence: Synthetic oligonucleotide
  Target: ATXN1; (-) strand; PAM type: YTN; PAM sequence: TTT
ttcttttttttttttttttt

SEQ ID NO: 195360 - DNA, 20 bp, Artificial Sequence
  Description of Artificial Sequence: Synthetic oligonucleotide
  Target: ATXN1; (-) strand; PAM type: YTN; PAM sequence: TTA
gtgtttttcttttttttttt

SEQ ID NO: 195361 - DNA, 20 bp, Artificial Sequence
  Description of Artificial Sequence: Synthetic oligonucleotide
  Target: ATXN1; (-) strand; PAM type: YTN; PAM sequence: TTT
agtgtttttctttttttttt

SEQ ID NO: 195362 - DNA, 20 bp, Artificial Sequence
  Description of Artificial Sequence: Synthetic oligonucleotide
  Target: ATXN1; (-) strand; PAM type: YTN; PAM sequence: TTG
gaagcaatgtatgatttagt

SEQ ID NO: 195363 - DNA, 20 bp, Artificial Sequence
  Description of Artificial Sequence: Synthetic oligonucleotide
  Target: ATXN1; (-) strand; PAM type: YTN; PAM sequence: TTT
ggaagcaatgtatgatttag

SEQ ID NO: 195364 - DNA, 20 bp, Artificial Sequence
  Description of Artificial Sequence: Synthetic oligonucleotide
  Target: ATXN1; (-) strand; PAM type: YTN; PAM sequence: CTT
tggaagcaatgtatgattta

SEQ ID NO: 195365 - DNA, 20 bp, Artificial Sequence
  Description of Artificial Sequence: Synthetic oligonucleotide
  Target: ATXN1; (-) strand; PAM type: YTN; PAM sequence: CTA
cctttggaagcaatgtatga

SEQ ID NO: 195366 - DNA, 20 bp, Artificial Sequence
  Description of Artificial Sequence: Synthetic oligonucleotide
  Target: ATXN1; (-) strand; PAM type: YTN; PAM sequence: TTC
agaggatatggagctacctt

SEQ ID NO: 195367 - DNA, 20 bp, Artificial Sequence
  Description of Artificial Sequence: Synthetic oligonucleotide
  Target: ATXN1; (-) strand; PAM type: YTN; PAM sequence: CTT
cagaggatatggagctacct

SEQ ID NO: 195368 - DNA, 20 bp, Artificial Sequence
  Description of Artificial Sequence: Synthetic oligonucleotide
  Target: ATXN1; (-) strand; PAM type: YTN; PAM sequence: CTC
ccatgtataccttcagagga

SEQ ID NO: 195369 - DNA, 20 bp, Artificial Sequence
  Description of Artificial Sequence: Synthetic oligonucleotide
  Target: ATXN1; (-) strand; PAM type: YTN; PAM sequence: TTA
tgggccctcccatgtatacc

SEQ ID NO: 195370 - DNA, 20 bp, Artificial Sequence
  Description of Artificial Sequence: Synthetic oligonucleotide
  Target: ATXN1; (-) strand; PAM type: YTN; PAM sequence: CTG
gaatacatgatatgttatgg

SEQ ID NO: 195371 - DNA, 20 bp, Artificial Sequence
  Description of Artificial Sequence: Synthetic oligonucleotide
  Target: ATXN1; (-) strand; PAM type: YTN; PAM sequence: CTA
gatctggaatacatgatatg

SEQ ID NO: 195372 - DNA, 20 bp, Artificial Sequence
  Description of Artificial Sequence: Synthetic oligonucleotide
  Target: ATXN1; (-) strand; PAM type: YTN; PAM sequence: TTA
tggctagatctggaatacat

SEQ ID NO: 195373 - DNA, 20 bp, Artificial Sequence
  Description of Artificial Sequence: Synthetic oligonucleotide
  Target: ATXN1; (-) strand; PAM type: YTN; PAM sequence: TTT
atggctagatctggaataca

SEQ ID NO: 195374 - DNA, 20 bp, Artificial Sequence
  Description of Artificial Sequence: Synthetic oligonucleotide
  Target: ATXN1; (-) strand; PAM type: YTN; PAM sequence: TTT
tatggctagatctggaatac

SEQ ID NO: 195375 - DNA, 20 bp, Artificial Sequence
  Description of Artificial Sequence: Synthetic oligonucleotide
  Target: ATXN1; (-) strand; PAM type: YTN; PAM sequence: CTA
aaccgcatggttttatggct

SEQ ID NO: 195376 - DNA, 20 bp, Artificial Sequence
  Description of Artificial Sequence: Synthetic oligonucleotide
  Target: ATXN1; (-) strand; PAM type: YTN; PAM sequence: TTA
aaatctaaaccgcatggttt

SEQ ID NO: 195377 - DNA, 20 bp, Artificial Sequence
  Description of Artificial Sequence: Synthetic oligonucleotide
  Target: ATXN1; (-) strand; PAM type: YTN; PAM sequence: TTG
gatgttaaaatctaaaccgc

SEQ ID NO: 195378 - DNA, 20 bp, Artificial Sequence
  Description of Artificial Sequence: Synthetic oligonucleotide
  Target: ATXN1; (-) strand; PAM type: YTN; PAM sequence: TTT
ggatgttaaaatctaaaccg

SEQ ID NO: 195379 - DNA, 20 bp, Artificial Sequence
  Description of Artificial Sequence: Synthetic oligonucleotide
  Target: ATXN1; (-) strand; PAM type: YTN; PAM sequence: TTG
gatttggatgttaaaatcta

SEQ ID NO: 195380 - DNA, 20 bp, Artificial Sequence
  Description of Artificial Sequence: Synthetic oligonucleotide
  Target: ATXN1; (-) strand; PAM type: YTN; PAM sequence: TTA
ccagagacacacaattggat

SEQ ID NO: 195381 - DNA, 20 bp, Artificial Sequence
  Description of Artificial Sequence: Synthetic oligonucleotide
  Target: ATXN1; (-) strand; PAM type: YTN; PAM sequence: TTT
accagagacacacaattgga

SEQ ID NO: 195382 - DNA, 20 bp, Artificial Sequence
  Description of Artificial Sequence: Synthetic oligonucleotide
  Target: ATXN1; (-) strand; PAM type: YTN; PAM sequence: CTG
ggcaagtcatgtttaccaga

SEQ ID NO: 195383 - DNA, 20 bp, Artificial Sequence
  Description of Artificial Sequence: Synthetic oligonucleotide
  Target: ATXN1; (-) strand; PAM type: YTN; PAM sequence: TTA
ctgggcaagtcatgtttacc

SEQ ID NO: 195384 - DNA, 20 bp, Artificial Sequence
  Description of Artificial Sequence: Synthetic oligonucleotide
  Target: ATXN1; (-) strand; PAM type: YTN; PAM sequence: TTT
actgggcaagtcatgtttac

SEQ ID NO: 195385 - DNA, 20 bp, Artificial Sequence
  Description of Artificial Sequence: Synthetic oligonucleotide
  Target: ATXN1; (-) strand; PAM type: YTN; PAM sequence: TTT
tactgggcaagtcatgttta

SEQ ID NO: 195386 - DNA, 20 bp, Artificial Sequence
  Description of Artificial Sequence: Synthetic oligonucleotide
  Target: ATXN1; (-) strand; PAM type: YTN; PAM sequence: CTG
tggaacatgtagtatcagca

SEQ ID NO: 195387 - DNA, 20 bp, Artificial Sequence
  Description of Artificial Sequence: Synthetic oligonucleotide
  Target: ATXN1; (-) strand; PAM type: YTN; PAM sequence: TTA
gtccgaaaatataatgataa

SEQ ID NO: 195388 - DNA, 20 bp, Artificial Sequence
  Description of Artificial Sequence: Synthetic oligonucleotide
  Target: ATXN1; (-) strand; PAM type: YTN; PAM sequence: TTC
caaaagttagtccgaaaata

SEQ ID NO: 195389 - DNA, 20 bp, Artificial Sequence
  Description of Artificial Sequence: Synthetic oligonucleotide
  Target: ATXN1; (-) strand; PAM type: YTN; PAM sequence: TTT
ccaaaagttagtccgaaaat

SEQ ID NO: 195390 - DNA, 20 bp, Artificial Sequence
  Description of Artificial Sequence: Synthetic oligonucleotide
  Target: ATXN1; (-) strand; PAM type: YTN; PAM sequence: CTC
aggatgatacaatacaacga

SEQ ID NO: 195391 - DNA, 20 bp, Artificial Sequence
  Description of Artificial Sequence: Synthetic oligonucleotide
  Target: ATXN1; (-) strand; PAM type: YTN; PAM sequence: TTA
ctcaggatgatacaatacaa

SEQ ID NO: 195392 - DNA, 20 bp, Artificial Sequence
  Description of Artificial Sequence: Synthetic oligonucleotide
  Target: ATXN1; (-) strand; PAM type: YTN; PAM sequence: CTT
actcaggatgatacaataca

SEQ ID NO: 195393 - DNA, 20 bp, Artificial Sequence
  Description of Artificial Sequence: Synthetic oligonucleotide
  Target: ATXN1; (-) strand; PAM type: YTN; PAM sequence: TTA
atacttactcaggatgatac

SEQ ID NO: 195394 - DNA, 20 bp, Artificial Sequence
  Description of Artificial Sequence: Synthetic oligonucleotide
  Target: ATXN1; (-) strand; PAM type: YTN; PAM sequence: TTT
aatacttactcaggatgata

SEQ ID NO: 195395 - DNA, 20 bp, Artificial Sequence
  Description of Artificial Sequence: Synthetic oligonucleotide
  Target: ATXN1; (-) strand; PAM type: YTN; PAM sequence: TTA
aggaatttaatacttactca

SEQ ID NO: 195396 - DNA, 20 bp, Artificial Sequence
  Description of Artificial Sequence: Synthetic oligonucleotide
  Target: ATXN1; (-) strand; PAM type: YTN; PAM sequence: TTG
tggcaaatattaaggaattt

SEQ ID NO: 195397 - DNA, 20 bp, Artificial Sequence
  Description of Artificial Sequence: Synthetic oligonucleotide
  Target: ATXN1; (-) strand; PAM type: YTN; PAM sequence: CTC
agcaaatggttgtggcaaat

SEQ ID NO: 195398 - DNA, 20 bp, Artificial Sequence
  Description of Artificial Sequence: Synthetic oligonucleotide
  Target: ATXN1; (-) strand; PAM type: YTN; PAM sequence: TTA
gccactcagcaaatggttgt

SEQ ID NO: 195399 - DNA, 20 bp, Artificial Sequence
  Description of Artificial Sequence: Synthetic oligonucleotide
  Target: ATXN1; (-) strand; PAM type: YTN; PAM sequence: TTA
aagataatagataaaaatgt

SEQ ID NO: 195400 - DNA, 20 bp, Artificial Sequence
  Description of Artificial Sequence: Synthetic oligonucleotide
  Target: ATXN1; (-) strand; PAM type: YTN; PAM sequence: TTG
tcaggattaaagataataga

SEQ ID NO: 195401 - DNA, 20 bp, Artificial Sequence
  Description of Artificial Sequence: Synthetic oligonucleotide
  Target: ATXN1; (-) strand; PAM type: YTN; PAM sequence: TTT
gtcaggattaaagataatag

SEQ ID NO: 195402 - DNA, 20 bp, Artificial Sequence
  Description of Artificial Sequence: Synthetic oligonucleotide
  Target: ATXN1; (-) strand; PAM type: YTN; PAM sequence: TTT
tgtcaggattaaagataata

SEQ ID NO: 195403 - DNA, 20 bp, Artificial Sequence
  Description of Artificial Sequence: Synthetic oligonucleotide
  Target: ATXN1; (-) strand; PAM type: YTN; PAM sequence: TTA
cagagattttgtcaggatta

SEQ ID NO: 195404 - DNA, 20 bp, Artificial Sequence
  Description of Artificial Sequence: Synthetic oligonucleotide
  Target: ATXN1; (-) strand; PAM type: YTN; PAM sequence: TTT
acagagattttgtcaggatt

SEQ ID NO: 195405 - DNA, 20 bp, Artificial Sequence
  Description of Artificial Sequence: Synthetic oligonucleotide
  Target: ATXN1; (-) strand; PAM type: YTN; PAM sequence: TTT
tacagagattttgtcaggat

SEQ ID NO: 195406 - DNA, 20 bp, Artificial Sequence
  Description of Artificial Sequence: Synthetic oligonucleotide
  Target: ATXN1; (-) strand; PAM type: YTN; PAM sequence: CTA
ttttacagagattttgtcag

SEQ ID NO: 195407 - DNA, 20 bp, Artificial Sequence
  Description of Artificial Sequence: Synthetic oligonucleotide
  Target: ATXN1; (-) strand; PAM type: YTN; PAM sequence: CTG
tacaatgaggccaataaaac

SEQ ID NO: 195408 - DNA, 20 bp, Artificial Sequence
  Description of Artificial Sequence: Synthetic oligonucleotide
  Target: ATXN1; (-) strand; PAM type: YTN; PAM sequence: CTC
atctgtacaatgaggccaat

SEQ ID NO: 195409 - DNA, 20 bp, Artificial Sequence
  Description of Artificial Sequence: Synthetic oligonucleotide
  Target: ATXN1; (-) strand; PAM type: YTN; PAM sequence: TTC
ctcatctgtacaatgaggcc

SEQ ID NO: 195410 - DNA, 20 bp, Artificial Sequence
  Description of Artificial Sequence: Synthetic oligonucleotide
  Target: ATXN1; (-) strand; PAM type: YTN; PAM sequence: TTT
cctcatctgtacaatgaggc

SEQ ID NO: 195411 - DNA, 20 bp, Artificial Sequence
  Description of Artificial Sequence: Synthetic oligonucleotide
  Target: ATXN1; (-) strand; PAM type: YTN; PAM sequence: TTT
tcctcatctgtacaatgagg

SEQ ID NO: 195412 - DNA, 20 bp, Artificial Sequence
  Description of Artificial Sequence: Synthetic oligonucleotide
  Target: ATXN1; (-) strand; PAM type: YTN; PAM sequence: TTA
ttttcctcatctgtacaatg

SEQ ID NO: 195413 - DNA, 20 bp, Artificial Sequence
  Description of Artificial Sequence: Synthetic oligonucleotide
  Target: ATXN1; (-) strand; PAM type: YTN; PAM sequence: CTT
attttcctcatctgtacaat

SEQ ID NO: 195414 - DNA, 20 bp, Artificial Sequence
  Description of Artificial Sequence: Synthetic oligonucleotide
  Target: ATXN1; (-) strand; PAM type: YTN; PAM sequence: TTG
agccttattttcctcatctg

SEQ ID NO: 195415 - DNA, 20 bp, Artificial Sequence
  Description of Artificial Sequence: Synthetic oligonucleotide
  Target: ATXN1; (-) strand; PAM type: YTN; PAM sequence: CTT
gagccttattttcctcatct

SEQ ID NO: 195416 - DNA, 20 bp, Artificial Sequence
  Description of Artificial Sequence: Synthetic oligonucleotide
  Target: ATXN1; (-) strand; PAM type: YTN; PAM sequence: TTC
ttgagccttattttcctcat

SEQ ID NO: 195417 - DNA, 20 bp, Artificial Sequence
  Description of Artificial Sequence: Synthetic oligonucleotide
  Target: ATXN1; (-) strand; PAM type: YTN; PAM sequence: TTT
cttgagccttattttcctca

SEQ ID NO: 195418 - DNA, 20 bp, Artificial Sequence
  Description of Artificial Sequence: Synthetic oligonucleotide
  Target: ATXN1; (-) strand; PAM type: YTN; PAM sequence: TTT
tcttgagccttattttcctc

SEQ ID NO: 195419 - DNA, 20 bp, Artificial Sequence
  Description of Artificial Sequence: Synthetic oligonucleotide
  Target: ATXN1; (-) strand; PAM type: YTN; PAM sequence: CTT
ttcttgagccttattttcct

SEQ ID NO: 195420 - DNA, 20 bp, Artificial Sequence
  Description of Artificial Sequence: Synthetic oligonucleotide
  Target: ATXN1; (-) strand; PAM type: YTN; PAM sequence: TTA
cttttcttgagccttatttt

SEQ ID NO: 195421 - DNA, 20 bp, Artificial Sequence
  Description of Artificial Sequence: Synthetic oligonucleotide
  Target: ATXN1; (-) strand; PAM type: YTN; PAM sequence: TTA
ggttacttttcttgagcctt

SEQ ID NO: 195422 - DNA, 20 bp, Artificial Sequence
  Description of Artificial Sequence: Synthetic oligonucleotide
  Target: ATXN1; (-) strand; PAM type: YTN; PAM sequence: TTG
gttaggttacttttcttgag

SEQ ID NO: 195423 - DNA, 20 bp, Artificial Sequence
  Description of Artificial Sequence: Synthetic oligonucleotide
  Target: ATXN1; (-) strand; PAM type: YTN; PAM sequence: CTT
ggttaggttacttttcttga

SEQ ID NO: 195424 - DNA, 20 bp, Artificial Sequence
  Description of Artificial Sequence: Synthetic oligonucleotide
  Target: ATXN1; (-) strand; PAM type: YTN; PAM sequence: CTG
gtgaccttggttaggttact

SEQ ID NO: 195425 - DNA, 20 bp, Artificial Sequence
  Description of Artificial Sequence: Synthetic oligonucleotide
  Target: ATXN1; (-) strand; PAM type: YTN; PAM sequence: TTA
ctggtgaccttggttaggtt

SEQ ID NO: 195426 - DNA, 20 bp, Artificial Sequence
  Description of Artificial Sequence: Synthetic oligonucleotide
  Target: ATXN1; (-) strand; PAM type: YTN; PAM sequence: CTT
actggtgaccttggttaggt

SEQ ID NO: 195427 - DNA, 20 bp, Artificial Sequence
  Description of Artificial Sequence: Synthetic oligonucleotide
  Target: ATXN1; (-) strand; PAM type: YTN; PAM sequence: TTG
tcacttactggtgaccttgg

SEQ ID NO: 195428 - DNA, 20 bp, Artificial Sequence
  Description of Artificial Sequence: Synthetic oligonucleotide
  Target: ATXN1; (-) strand; PAM type: YTN; PAM sequence: TTT
gtcacttactggtgaccttg

SEQ ID NO: 195429 - DNA, 20 bp, Artificial Sequence
  Description of Artificial Sequence: Synthetic oligonucleotide
  Target: ATXN1; (-) strand; PAM type: YTN; PAM sequence: CTT
tgtcacttactggtgacctt

SEQ ID NO: 195430 - DNA, 20 bp, Artificial Sequence
  Description of Artificial Sequence: Synthetic oligonucleotide
  Target: ATXN1; (-) strand; PAM type: YTN; PAM sequence: CTA
gctttgtcacttactggtga

SEQ ID NO: 195431 - DNA, 20 bp, Artificial Sequence
  Description of Artificial Sequence: Synthetic oligonucleotide
  Target: ATXN1; (-) strand; PAM type: YTN; PAM sequence: TTG
accgtgaaacccagacaaac

SEQ ID NO: 195432 - DNA, 20 bp, Artificial Sequence
  Description of Artificial Sequence: Synthetic oligonucleotide
  Target: ATXN1; (-) strand; PAM type: YTN; PAM sequence: TTT
gaccgtgaaacccagacaaa

SEQ ID NO: 195433 - DNA, 20 bp, Artificial Sequence
  Description of Artificial Sequence: Synthetic oligonucleotide
  Target: ATXN1; (-) strand; PAM type: YTN; PAM sequence: CTT
tgaccgtgaaacccagacaa

SEQ ID NO: 195434 - DNA, 20 bp, Artificial Sequence
  Description of Artificial Sequence: Synthetic oligonucleotide
  Target: ATXN1; (-) strand; PAM type: YTN; PAM sequence: CTC
tttgaccgtgaaacccagac

SEQ ID NO: 195435 - DNA, 20 bp, Artificial Sequence
  Description of Artificial Sequence: Synthetic oligonucleotide
  Target: ATXN1; (-) strand; PAM type: YTN; PAM sequence: TTC
tctttgaccgtgaaacccag

SEQ ID NO: 195436 - DNA, 20 bp, Artificial Sequence
  Description of Artificial Sequence: Synthetic oligonucleotide
  Target: ATXN1; (-) strand; PAM type: YTN; PAM sequence: TTT
ctctttgaccgtgaaaccca

SEQ ID NO: 195437 - DNA, 20 bp, Artificial Sequence
  Description of Artificial Sequence: Synthetic oligonucleotide
  Target: ATXN1; (-) strand; PAM type: YTN; PAM sequence: TTT
tctctttgaccgtgaaaccc

SEQ ID NO: 195438 - DNA, 20 bp, Artificial Sequence
  Description of Artificial Sequence: Synthetic oligonucleotide
  Target: ATXN1; (-) strand; PAM type: YTN; PAM sequence: CTT
ttctctttgaccgtgaaacc

SEQ ID NO: 195439 - DNA, 20 bp, Artificial Sequence
  Description of Artificial Sequence: Synthetic oligonucleotide
  Target: ATXN1; (-) strand; PAM type: YTN; PAM sequence: CTC
atcttttctctttgaccgtg

SEQ ID NO: 195440 - DNA, 20 bp, Artificial Sequence
  Description of Artificial Sequence: Synthetic oligonucleotide
  Target: ATXN1; (-) strand; PAM type: YTN; PAM sequence: TTG
ccagggagctcatcttttct

SEQ ID NO: 195441 - DNA, 20 bp, Artificial Sequence
  Description of Artificial Sequence: Synthetic oligonucleotide
  Target: ATXN1; (-) strand; PAM type: YTN; PAM sequence: CTC
gtgcatgttgccagggagct

SEQ ID NO: 195442 - DNA, 20 bp, Artificial Sequence
  Description of Artificial Sequence: Synthetic oligonucleotide
  Target: ATXN1; (-) strand; PAM type: YTN; PAM sequence: CTC
tcgtgcatgttgccagggag

SEQ ID NO: 195443 - DNA, 20 bp, Artificial Sequence
  Description of Artificial Sequence: Synthetic oligonucleotide
  Target: ATXN1; (-) strand; PAM type: YTN; PAM sequence: TTA
atctctcgtgcatgttgcca

SEQ ID NO: 195444 - DNA, 20 bp, Artificial Sequence
  Description of Artificial Sequence: Synthetic oligonucleotide
  Target: ATXN1; (-) strand; PAM type: YTN; PAM sequence: TTT
aatctctcgtgcatgttgcc

SEQ ID NO: 195445 - DNA, 20 bp, Artificial Sequence
  Description of Artificial Sequence: Synthetic oligonucleotide
  Target: ATXN1; (-) strand; PAM type: YTN; PAM sequence: CTT
taatctctcgtgcatgttgc

SEQ ID NO: 195446 - DNA, 20 bp, Artificial Sequence
  Description of Artificial Sequence: Synthetic oligonucleotide
  Target: ATXN1; (-) strand; PAM type: YTN; PAM sequence: TTG
agactttaatctctcgtgca

SEQ ID NO: 195447 - DNA, 20 bp, Artificial Sequence
  Description of Artificial Sequence: Synthetic oligonucleotide
  Target: ATXN1; (-) strand; PAM type: YTN; PAM sequence: TTA
tgtattgagactttaatctc

SEQ ID NO: 195448 - DNA, 20 bp, Artificial Sequence
  Description of Artificial Sequence: Synthetic oligonucleotide
  Target: ATXN1; (-) strand; PAM type: YTN; PAM sequence: CTT
atgtattgagactttaatct

SEQ ID NO: 195449 - DNA, 20 bp, Artificial Sequence
  Description of Artificial Sequence: Synthetic oligonucleotide
  Target: ATXN1; (-) strand; PAM type: YTN; PAM sequence: TTG
tcagaatgcttatgtattga

SEQ ID NO: 195450 - DNA, 20 bp, Artificial Sequence
  Description of Artificial Sequence: Synthetic oligonucleotide
  Target: ATXN1; (-) strand; PAM type: YTN; PAM sequence: TTT
gtcagaatgcttatgtattg

SEQ ID NO: 195451 - DNA, 20 bp, Artificial Sequence
  Description of Artificial Sequence: Synthetic oligonucleotide
  Target: ATXN1; (-) strand; PAM type: YTN; PAM sequence: TTG
tttgtcagaatgcttatgta

SEQ ID NO: 195452 - DNA, 20 bp, Artificial Sequence
  Description of Artificial Sequence: Synthetic oligonucleotide
  Target: ATXN1; (-) strand; PAM type: YTN; PAM sequence: TTT
gtttgtcagaatgcttatgt

SEQ ID NO: 195453 - DNA, 20 bp, Artificial Sequence
  Description of Artificial Sequence: Synthetic oligonucleotide
  Target: ATXN1; (-) strand; PAM type: YTN; PAM sequence: TTT
tgtttgtcagaatgcttatg

SEQ ID NO: 195454 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtcagaatgcttat

SEQ ID NO: 195455 - DNA, 20 bp, Artificial Sequence
  Description of Artificial Sequence: Synthetic oligonucleotide
  Target: ATXN1; (-) strand; PAM type: YTN; PAM sequence: TTT
tttgtttgtcagaatgctta

SEQ ID NO: 195456 - DNA, 20 bp, Artificial Sequence
  Description of Artificial Sequence: Synthetic oligonucleotide
  Target: ATXN1; (-) strand; PAM type: YTN; PAM sequence: TTA
ttttttgtttgtcagaatgc

SEQ ID NO: 195457 - DNA, 20 bp, Artificial Sequence
  Description of Artificial Sequence: Synthetic oligonucleotide
  Target: ATXN1; (-) strand; PAM type: YTN; PAM sequence: CTT
attttttgtttgtcagaatg

SEQ ID NO: 195458 - DNA, 20 bp, Artificial Sequence
  Description of Artificial Sequence: Synthetic oligonucleotide
  Target: ATXN1; (-) strand; PAM type: YTN; PAM sequence: CTG
caagtgcttattttttgttt

SEQ ID NO: 195459 - DNA, 20 bp, Artificial Sequence
  Description of Artificial Sequence: Synthetic oligonucleotide
  Target: ATXN1; (-) strand; PAM type: YTN; PAM sequence: CTG
tgcccggctgcaagtgctta

SEQ ID NO: 195460 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgtgcc

SEQ ID NO: 195461 - DNA, 20 bp, Artificial Sequence
  Description of Artificial Sequence: Synthetic oligonucleotide
  Target: ATXN1; (-) strand; PAM type: YTN; PAM sequence: CTG
agattacaggtgtgagccac

SEQ ID NO: 195462 - DNA, 20 bp, Artificial Sequence
  Description of Artificial Sequence: Synthetic oligonucleotide
  Target: ATXN1; (-) strand; PAM type: YTN; PAM sequence: TTC
ccaaagtgctgagattacag

SEQ ID NO: 195463 - DNA, 20 bp, Artificial Sequence
  Description of Artificial Sequence: Synthetic oligonucleotide
  Target: ATXN1; (-) strand; PAM type: YTN; PAM sequence: CTT
cccaaagtgctgagattaca

SEQ ID NO: 195464 - DNA, 20 bp, Artificial Sequence
  Description of Artificial Sequence: Synthetic oligonucleotide
  Target: ATXN1; (-) strand; PAM type: YTN; PAM sequence: CTC
ggcttcccaaagtgctgaga

SEQ ID NO: 195465 - DNA, 20 bp, Artificial Sequence
  Description of Artificial Sequence: Synthetic oligonucleotide
  Target: ATXN1; (-) strand; PAM type: YTN; PAM sequence: CTC
cctcggcttcccaaagtgct

SEQ ID NO: 195466 - DNA, 20 bp, Artificial Sequence
  Description of Artificial Sequence: Synthetic oligonucleotide
  Target: ATXN1; (-) strand; PAM type: YTN; PAM sequence: CTC
aggtgatccacctccctcgg

SEQ ID NO: 195467 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccacctcc

SEQ ID NO: 195468 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccacc

SEQ ID NO: 195469 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaggtga

SEQ ID NO: 195470 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 195471 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtctcgaactc

SEQ ID NO: 195472 - DNA, 20 bp, Artificial Sequence
  Description of Artificial Sequence: Synthetic oligonucleotide
  Target: ATXN1; (-) strand; PAM type: YTN; PAM sequence: TTC
accatgttgcccaggctggt

SEQ ID NO: 195473 - DNA, 20 bp, Artificial Sequence
  Description of Artificial Sequence: Synthetic oligonucleotide
  Target: ATXN1; (-) strand; PAM type: YTN; PAM sequence: TTT
caccatgttgcccaggctgg

SEQ ID NO: 195474 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcacca

SEQ ID NO: 195475 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcacc

SEQ ID NO: 195476 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 195477 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 195478 - DNA, 20 bp, Artificial Sequence
  Description of Artificial Sequence: Synthetic oligonucleotide
  Target: ATXN1; (-) strand; PAM type: YTN; PAM sequence: CTG
tatttttagtagagatgggg

SEQ ID NO: 195479 - DNA, 20 bp, Artificial Sequence
  Description of Artificial Sequence: Synthetic oligonucleotide
  Target: ATXN1; (-) strand; PAM type: YTN; PAM sequence: TTC
tgtatttttagtagagatgg

SEQ ID NO: 195480 - DNA, 20 bp, Artificial Sequence
  Description of Artificial Sequence: Synthetic oligonucleotide
  Target: ATXN1; (-) strand; PAM type: YTN; PAM sequence: TTT
ctgtatttttagtagagatg

SEQ ID NO: 195481 - DNA, 20 bp, Artificial Sequence
  Description of Artificial Sequence: Synthetic oligonucleotide
  Target: ATXN1; (-) strand; PAM type: YTN; PAM sequence: CTA
atttctgtatttttagtaga

SEQ ID NO: 195482 - DNA, 20 bp, Artificial Sequence
  Description of Artificial Sequence: Synthetic oligonucleotide
  Target: ATXN1; (-) strand; PAM type: YTN; PAM sequence: TTA
caggcacacaccgccatgcc

SEQ ID NO: 195483 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcacacaccgc

SEQ ID NO: 195484 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgggattacag

SEQ ID NO: 195485 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtagctggga

SEQ ID NO: 195486 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccaagtagct

SEQ ID NO: 195487 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccaagta

SEQ ID NO: 195488 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccaag

SEQ ID NO: 195489 - DNA, 20 bp, Artificial Sequence
  Description of Artificial Sequence: Synthetic oligonucleotide
  Target: ATXN1; (-) strand; PAM type: YTN; PAM sequence: TTA
agcaattctcctgcctcagc

SEQ ID NO: 195490 - DNA, 20 bp, Artificial Sequence
  Description of Artificial Sequence: Synthetic oligonucleotide
  Target: ATXN1; (-) strand; PAM type: YTN; PAM sequence: TTT
aagcaattctcctgcctcag

SEQ ID NO: 195491 - DNA, 20 bp, Artificial Sequence
  Description of Artificial Sequence: Synthetic oligonucleotide
  Target: ATXN1; (-) strand; PAM type: YTN; PAM sequence: CTC
ccaggtttaagcaattctcc

SEQ ID NO: 195492 - DNA, 20 bp, Artificial Sequence
  Description of Artificial Sequence: Synthetic oligonucleotide
  Target: ATXN1; (-) strand; PAM type: YTN; PAM sequence: CTC
cacctcccaggtttaagcaa

SEQ ID NO: 195493 - DNA, 20 bp, Artificial Sequence
  Description of Artificial Sequence: Synthetic oligonucleotide
  Target: ATXN1; (-) strand; PAM type: YTN; PAM sequence: CTG
caacctccacctcccaggtt

SEQ ID NO: 195494 - DNA, 20 bp, Artificial Sequence
  Description of Artificial Sequence: Synthetic oligonucleotide
  Target: ATXN1; (-) strand; PAM type: YTN; PAM sequence: TTA
ctgcaacctccacctcccag

SEQ ID NO: 195495 - DNA, 20 bp, Artificial Sequence
  Description of Artificial Sequence: Synthetic oligonucleotide
  Target: ATXN1; (-) strand; PAM type: YTN; PAM sequence: CTT
actgcaacctccacctccca

SEQ ID NO: 195496 - DNA, 20 bp, Artificial Sequence
  Description of Artificial Sequence: Synthetic oligonucleotide
  Target: ATXN1; (-) strand; PAM type: YTN; PAM sequence: CTC
agcttactgcaacctccacc

SEQ ID NO: 195497 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcacagtctc

SEQ ID NO: 195498 - DNA, 20 bp, Artificial Sequence
  Description of Artificial Sequence: Synthetic oligonucleotide
  Target: ATXN1; (-) strand; PAM type: YTN; PAM sequence: TTG
tccaggctggagtgcagtgg

SEQ ID NO: 195499 - DNA, 20 bp, Artificial Sequence
  Description of Artificial Sequence: Synthetic oligonucleotide
  Target: ATXN1; (-) strand; PAM type: YTN; PAM sequence: TTG
atgtgttgtccaggctggag

SEQ ID NO: 195500 - DNA, 20 bp, Artificial Sequence
  Description of Artificial Sequence: Synthetic oligonucleotide
  Target: ATXN1; (-) strand; PAM type: YTN; PAM sequence: CTT
gatgtgttgtccaggctgga

SEQ ID NO: 195501 - DNA, 20 bp, Artificial Sequence
  Description of Artificial Sequence: Synthetic oligonucleotide
  Target: ATXN1; (-) strand; PAM type: YTN; PAM sequence: TTG
acagagtcttgatgtgttgt

SEQ ID NO: 195502 - DNA, 20 bp, Artificial Sequence
  Description of Artificial Sequence: Synthetic oligonucleotide
  Target: ATXN1; (-) strand; PAM type: YTN; PAM sequence: TTT
gacagagtcttgatgtgttg

SEQ ID NO: 195503 - DNA, 20 bp, Artificial Sequence
  Description of Artificial Sequence: Synthetic oligonucleotide
  Target: ATXN1; (-) strand; PAM type: YTN; PAM sequence: TTT
tgacagagtcttgatgtgtt

SEQ ID NO: 195504 - DNA, 20 bp, Artificial Sequence
  Description of Artificial Sequence: Synthetic oligonucleotide
  Target: ATXN1; (-) strand; PAM type: YTN; PAM sequence: TTT
ttgacagagtcttgatgtgt

SEQ ID NO: 195505 - DNA, 20 bp, Artificial Sequence
  Description of Artificial Sequence: Synthetic oligonucleotide
  Target: ATXN1; (-) strand; PAM type: YTN; PAM sequence: TTT
tttgacagagtcttgatgtg

SEQ ID NO: 195506 - DNA, 20 bp, Artificial Sequence
  Description of Artificial Sequence: Synthetic oligonucleotide
  Target: ATXN1; (-) strand; PAM type: YTN; PAM sequence: TTT
ttttgacagagtcttgatgt

SEQ ID NO: 195507 - DNA, 20 bp, Artificial Sequence
  Description of Artificial Sequence: Synthetic oligonucleotide
  Target: ATXN1; (-) strand; PAM type: YTN; PAM sequence: TTT
tttttgacagagtcttgatg

SEQ ID NO: 195508 - DNA, 20 bp, Artificial Sequence
  Description of Artificial Sequence: Synthetic oligonucleotide
  Target: ATXN1; (-) strand; PAM type: YTN; PAM sequence: TTT
ttttttgacagagtcttgat

SEQ ID NO: 195509 - DNA, 20 bp, Artificial Sequence
  Description of Artificial Sequence: Synthetic oligonucleotide
  Target: ATXN1; (-) strand; PAM type: YTN; PAM sequence: TTT
tttttttgacagagtcttga

SEQ ID NO: 195510 - DNA, 20 bp, Artificial Sequence
  Description of Artificial Sequence: Synthetic oligonucleotide
  Target: ATXN1; (-) strand; PAM type: YTN; PAM sequence: TTT
ttttttttgacagagtcttg

SEQ ID NO: 195511 - DNA, 20 bp, Artificial Sequence
  Description of Artificial Sequence: Synthetic oligonucleotide
  Target: ATXN1; (-) strand; PAM type: YTN; PAM sequence: TTT
tttttttttgacagagtctt

SEQ ID NO: 195512 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgacagagtct

SEQ ID NO: 195513 - DNA, 20 bp, Artificial Sequence
  Description of Artificial Sequence: Synthetic oligonucleotide
  Target: ATXN1; (-) strand; PAM type: YTN; PAM sequence: CTG
acaaagattttttttttttt

SEQ ID NO: 195514 - DNA, 20 bp, Artificial Sequence
  Description of Artificial Sequence: Synthetic oligonucleotide
  Target: ATXN1; (-) strand; PAM type: YTN; PAM sequence: TTC
acaaaaaaaaaaaaaaaaca

SEQ ID NO: 195515 - DNA, 20 bp, Artificial Sequence
  Description of Artificial Sequence: Synthetic oligonucleotide
  Target: ATXN1; (-) strand; PAM type: YTN; PAM sequence: CTT
cacaaaaaaaaaaaaaaaac

SEQ ID NO: 195516 - DNA, 20 bp, Artificial Sequence
  Description of Artificial Sequence: Synthetic oligonucleotide
  Target: ATXN1; (-) strand; PAM type: YTN; PAM sequence: CTA
tcttcacaaaaaaaaaaaaa

SEQ ID NO: 195517 - DNA, 20 bp, Artificial Sequence
  Description of Artificial Sequence: Synthetic oligonucleotide
  Target: ATXN1; (-) strand; PAM type: YTN; PAM sequence: TTG
ctatcttcacaaaaaaaaaa

SEQ ID NO: 195518 - DNA, 20 bp, Artificial Sequence
  Description of Artificial Sequence: Synthetic oligonucleotide
  Target: ATXN1; (-) strand; PAM type: YTN; PAM sequence: CTT
gctatcttcacaaaaaaaaa

SEQ ID NO: 195519 - DNA, 20 bp, Artificial Sequence
  Description of Artificial Sequence: Synthetic oligonucleotide
  Target: ATXN1; (-) strand; PAM type: YTN; PAM sequence: CTC
gcttgctatcttcacaaaaa

SEQ ID NO: 195520 - DNA, 20 bp, Artificial Sequence
  Description of Artificial Sequence: Synthetic oligonucleotide
  Target: ATXN1; (-) strand; PAM type: YTN; PAM sequence: CTC
atatcctcgcttgctatctt

SEQ ID NO: 195521 - DNA, 20 bp, Artificial Sequence
  Description of Artificial Sequence: Synthetic oligonucleotide
  Target: ATXN1; (-) strand; PAM type: YTN; PAM sequence: TTC
tcatatcctcgcttgctatc

SEQ ID NO: 195522 - DNA, 20 bp, Artificial Sequence
  Description of Artificial Sequence: Synthetic oligonucleotide
  Target: ATXN1; (-) strand; PAM type: YTN; PAM sequence: TTG
ttctcatatcctcgcttgct

SEQ ID NO: 195523 - DNA, 20 bp, Artificial Sequence
  Description of Artificial Sequence: Synthetic oligonucleotide
  Target: ATXN1; (-) strand; PAM type: YTN; PAM sequence: TTT
gttctcatatcctcgcttgc

SEQ ID NO: 195524 - DNA, 20 bp, Artificial Sequence
  Description of Artificial Sequence: Synthetic oligonucleotide
  Target: ATXN1; (-) strand; PAM type: YTN; PAM sequence: TTT
tgttctcatatcctcgcttg

SEQ ID NO: 195525 - DNA, 20 bp, Artificial Sequence
  Description of Artificial Sequence: Synthetic oligonucleotide
  Target: ATXN1; (-) strand; PAM type: YTN; PAM sequence: CTT
ttgttctcatatcctcgctt

SEQ ID NO: 195526 - DNA, 20 bp, Artificial Sequence
  Description of Artificial Sequence: Synthetic oligonucleotide
  Target: ATXN1; (-) strand; PAM type: YTN; PAM sequence: CTG
aatgtcatgggtaacttttg

SEQ ID NO: 195527 - DNA, 20 bp, Artificial Sequence
  Description of Artificial Sequence: Synthetic oligonucleotide
  Target: ATXN1; (-) strand; PAM type: YTN; PAM sequence: TTC
cactgaatgtcatgggtaac

SEQ ID NO: 195528 - DNA, 20 bp, Artificial Sequence
  Description of Artificial Sequence: Synthetic oligonucleotide
  Target: ATXN1; (-) strand; PAM type: YTN; PAM sequence: TTT
ccactgaatgtcatgggtaa

SEQ ID NO: 195529 - DNA, 20 bp, Artificial Sequence
  Description of Artificial Sequence: Synthetic oligonucleotide
  Target: ATXN1; (-) strand; PAM type: YTN; PAM sequence: CTT
tccactgaatgtcatgggta

SEQ ID NO: 195530 - DNA, 20 bp, Artificial Sequence
  Description of Artificial Sequence: Synthetic oligonucleotide
  Target: ATXN1; (-) strand; PAM type: YTN; PAM sequence: CTA
atacacaactttccactgaa

SEQ ID NO: 195531 - DNA, 20 bp, Artificial Sequence
  Description of Artificial Sequence: Synthetic oligonucleotide
  Target: ATXN1; (-) strand; PAM type: YTN; PAM sequence: TTG
ggcactaatacacaactttc

SEQ ID NO: 195532 - DNA, 20 bp, Artificial Sequence
  Description of Artificial Sequence: Synthetic oligonucleotide
  Target: ATXN1; (-) strand; PAM type: YTN; PAM sequence: CTG
ttgggcactaatacacaact

SEQ ID NO: 195533 - DNA, 20 bp, Artificial Sequence
  Description of Artificial Sequence: Synthetic oligonucleotide
  Target: ATXN1; (-) strand; PAM type: YTN; PAM sequence: CTG
gcacctgttgggcactaata

SEQ ID NO: 195534 - DNA, 20 bp, Artificial Sequence
  Description of Artificial Sequence: Synthetic oligonucleotide
  Target: ATXN1; (-) strand; PAM type: YTN; PAM sequence: TTG
cctggcacctgttgggcact

SEQ ID NO: 195535 - DNA, 20 bp, Artificial Sequence
  Description of Artificial Sequence: Synthetic oligonucleotide
  Target: ATXN1; (-) strand; PAM type: YTN; PAM sequence: CTT
gcctggcacctgttgggcac

SEQ ID NO: 195536 - DNA, 20 bp, Artificial Sequence
  Description of Artificial Sequence: Synthetic oligonucleotide
  Target: ATXN1; (-) strand; PAM type: YTN; PAM sequence: CTG
aagaacgcttgcctggcacc

SEQ ID NO: 195537 - DNA, 20 bp, Artificial Sequence
  Description of Artificial Sequence: Synthetic oligonucleotide
  Target: ATXN1; (-) strand; PAM type: YTN; PAM sequence: CTG
cctgaagaacgcttgcctgg

SEQ ID NO: 195538 - DNA, 20 bp, Artificial Sequence
  Description of Artificial Sequence: Synthetic oligonucleotide
  Target: ATXN1; (-) strand; PAM type: YTN; PAM sequence: CTG
tgctgcctgaagaacgcttg

SEQ ID NO: 195539 - DNA, 20 bp, Artificial Sequence
  Description of Artificial Sequence: Synthetic oligonucleotide
  Target: ATXN1; (-) strand; PAM type: YTN; PAM sequence: TTG
gtcccgctgtgctgcctgaa

SEQ ID NO: 195540 - DNA, 20 bp, Artificial Sequence
  Description of Artificial Sequence: Synthetic oligonucleotide
  Target: ATXN1; (-) strand; PAM type: YTN; PAM sequence: TTT
ggtcccgctgtgctgcctga

SEQ ID NO: 195541 - DNA, 20 bp, Artificial Sequence
  Description of Artificial Sequence: Synthetic oligonucleotide
  Target: ATXN1; (-) strand; PAM type: YTN; PAM sequence: CTT
tggtcccgctgtgctgcctg

SEQ ID NO: 195542 - DNA, 20 bp, Artificial Sequence
  Description of Artificial Sequence: Synthetic oligonucleotide
  Target: ATXN1; (-) strand; PAM type: YTN; PAM sequence: CTG
tcagcactttggtcccgctg

SEQ ID NO: 195543 - DNA, 20 bp, Artificial Sequence
  Description of Artificial Sequence: Synthetic oligonucleotide
  Target: ATXN1; (-) strand; PAM type: YTN; PAM sequence: TTG
ccactgtcagcactttggtc

SEQ ID NO: 195544 - DNA, 20 bp, Artificial Sequence
  Description of Artificial Sequence: Synthetic oligonucleotide
  Target: ATXN1; (-) strand; PAM type: YTN; PAM sequence: TTG
tgtcgttgccactgtcagca

SEQ ID NO: 195545 - DNA, 20 bp, Artificial Sequence
  Description of Artificial Sequence: Synthetic oligonucleotide
  Target: ATXN1; (-) strand; PAM type: YTN; PAM sequence: TTT
gtgtcgttgccactgtcagc

SEQ ID NO: 195546 - DNA, 20 bp, Artificial Sequence
  Description of Artificial Sequence: Synthetic oligonucleotide
  Target: ATXN1; (-) strand; PAM type: YTN; PAM sequence: TTT
tgtgtcgttgccactgtcag

SEQ ID NO: 195547 - DNA, 20 bp, Artificial Sequence
  Description of Artificial Sequence: Synthetic oligonucleotide
  Target: ATXN1; (-) strand; PAM type: YTN; PAM sequence: CTA
cattttgtgtcgttgccact

SEQ ID NO: 195548 - DNA, 20 bp, Artificial Sequence
  Description of Artificial Sequence: Synthetic oligonucleotide
  Target: ATXN1; (-) strand; PAM type: YTN; PAM sequence: TTG
ccaaggctacattttgtgtc

SEQ ID NO: 195549 - DNA, 20 bp, Artificial Sequence
  Description of Artificial Sequence: Synthetic oligonucleotide
  Target: ATXN1; (-) strand; PAM type: YTN; PAM sequence: CTT
gccaaggctacattttgtgt

SEQ ID NO: 195550 - DNA, 20 bp, Artificial Sequence
  Description of Artificial Sequence: Synthetic oligonucleotide
  Target: ATXN1; (-) strand; PAM type: YTN; PAM sequence: CTG
acttgccaaggctacatttt

SEQ ID NO: 195551 - DNA, 20 bp, Artificial Sequence
  Description of Artificial Sequence: Synthetic oligonucleotide
  Target: ATXN1; (-) strand; PAM type: YTN; PAM sequence: TTA
gactgacttgccaaggctac

SEQ ID NO: 195552 - DNA, 20 bp, Artificial Sequence
  Description of Artificial Sequence: Synthetic oligonucleotide
  Target: ATXN1; (-) strand; PAM type: YTN; PAM sequence: TTG
ttagactgacttgccaaggc

SEQ ID NO: 195553 - DNA, 20 bp, Artificial Sequence
  Description of Artificial Sequence: Synthetic oligonucleotide
  Target: ATXN1; (-) strand; PAM type: YTN; PAM sequence: CTC
ataatcagaatgatgcaaag

SEQ ID NO: 195554 - DNA, 20 bp, Artificial Sequence
  Description of Artificial Sequence: Synthetic oligonucleotide
  Target: ATXN1; (-) strand; PAM type: YTN; PAM sequence: TTG
tggctcataatcagaatgat

SEQ ID NO: 195555 - DNA, 20 bp, Artificial Sequence
  Description of Artificial Sequence: Synthetic oligonucleotide
  Target: ATXN1; (-) strand; PAM type: YTN; PAM sequence: CTT
gtggctcataatcagaatga

SEQ ID NO: 195556 - DNA, 20 bp, Artificial Sequence
  Description of Artificial Sequence: Synthetic oligonucleotide
  Target: ATXN1; (-) strand; PAM type: YTN; PAM sequence: TTG
catgcttgtggctcataatc

SEQ ID NO: 195557 - DNA, 20 bp, Artificial Sequence
  Description of Artificial Sequence: Synthetic oligonucleotide
  Target: ATXN1; (-) strand; PAM type: YTN; PAM sequence: TTG
attgcatgcttgtggctcat

SEQ ID NO: 195558 - DNA, 20 bp, Artificial Sequence
  Description of Artificial Sequence: Synthetic oligonucleotide
  Target: ATXN1; (-) strand; PAM type: YTN; PAM sequence: CTG
ttgattgcatgcttgtggct

SEQ ID NO: 195559 - DNA, 20 bp, Artificial Sequence
  Description of Artificial Sequence: Synthetic oligonucleotide
  Target: ATXN1; (-) strand; PAM type: YTN; PAM sequence: CTA
tgctgttgattgcatgcttg

SEQ ID NO: 195560 - DNA, 20 bp, Artificial Sequence
  Description of Artificial Sequence: Synthetic oligonucleotide
  Target: ATXN1; (-) strand; PAM type: YTN; PAM sequence: CTC
tatgctgttgattgcatgct

SEQ ID NO: 195561 - DNA, 20 bp, Artificial Sequence
  Description of Artificial Sequence: Synthetic oligonucleotide
  Target: ATXN1; (-) strand; PAM type: YTN; PAM sequence: CTG
tctctatgctgttgattgca

SEQ ID NO: 195562 - DNA, 20 bp, Artificial Sequence
  Description of Artificial Sequence: Synthetic oligonucleotide
  Target: ATXN1; (-) strand; PAM type: YTN; PAM sequence: TTA
agactgtctctatgctgttg

SEQ ID NO: 195563 - DNA, 20 bp, Artificial Sequence
  Description of Artificial Sequence: Synthetic oligonucleotide
  Target: ATXN1; (-) strand; PAM type: YTN; PAM sequence: TTT
aagactgtctctatgctgtt

SEQ ID NO: 195564 - DNA, 20 bp, Artificial Sequence
  Description of Artificial Sequence: Synthetic oligonucleotide
  Target: ATXN1; (-) strand; PAM type: YTN; PAM sequence: CTG
atggagatcatttaagactg

SEQ ID NO: 195565 - DNA, 20 bp, Artificial Sequence
  Description of Artificial Sequence: Synthetic oligonucleotide
  Target: ATXN1; (-) strand; PAM type: YTN; PAM sequence: CTA
aagtaaaatgctgatggaga

SEQ ID NO: 195566 - DNA, 20 bp, Artificial Sequence
  Description of Artificial Sequence: Synthetic oligonucleotide
  Target: ATXN1; (-) strand; PAM type: YTN; PAM sequence: TTG
ataactaaagtaaaatgctg

SEQ ID NO: 195567 - DNA, 20 bp, Artificial Sequence
  Description of Artificial Sequence: Synthetic oligonucleotide
  Target: ATXN1; (-) strand; PAM type: YTN; PAM sequence: TTT
gataactaaagtaaaatgct

SEQ ID NO: 195568 - DNA, 20 bp, Artificial Sequence
  Description of Artificial Sequence: Synthetic oligonucleotide
  Target: ATXN1; (-) strand; PAM type: YTN; PAM sequence: CTT
tgataactaaagtaaaatgc

SEQ ID NO: 195569 - DNA, 20 bp, Artificial Sequence
  Description of Artificial Sequence: Synthetic oligonucleotide
  Target: ATXN1; (-) strand; PAM type: YTN; PAM sequence: CTG
ccacactttgataactaaag

SEQ ID NO: 195570 - DNA, 20 bp, Artificial Sequence
  Description of Artificial Sequence: Synthetic oligonucleotide
  Target: ATXN1; (-) strand; PAM type: YTN; PAM sequence: TTC
aatctgccacactttgataa

SEQ ID NO: 195571 - DNA, 20 bp, Artificial Sequence
  Description of Artificial Sequence: Synthetic oligonucleotide
  Target: ATXN1; (-) strand; PAM type: YTN; PAM sequence: TTA
ggtcagatgagcgggtgttc

SEQ ID NO: 195572 - DNA, 20 bp, Artificial Sequence
  Description of Artificial Sequence: Synthetic oligonucleotide
  Target: ATXN1; (-) strand; PAM type: YTN; PAM sequence: CTT
aggtcagatgagcgggtgtt

SEQ ID NO: 195573 - DNA, 20 bp, Artificial Sequence
  Description of Artificial Sequence: Synthetic oligonucleotide
  Target: ATXN1; (-) strand; PAM type: YTN; PAM sequence: TTG
cgcttaggtcagatgagcgg

SEQ ID NO: 195574 - DNA, 20 bp, Artificial Sequence
  Description of Artificial Sequence: Synthetic oligonucleotide
  Target: ATXN1; (-) strand; PAM type: YTN; PAM sequence: TTA
acattgcgcttaggtcagat

SEQ ID NO: 195575 - DNA, 20 bp, Artificial Sequence
  Description of Artificial Sequence: Synthetic oligonucleotide
  Target: ATXN1; (-) strand; PAM type: YTN; PAM sequence: TTA
ttaacattgcgcttaggtca

SEQ ID NO: 195576 - DNA, 20 bp, Artificial Sequence
  Description of Artificial Sequence: Synthetic oligonucleotide
  Target: ATXN1; (-) strand; PAM type: YTN; PAM sequence: TTG
ggttattaacattgcgctta

SEQ ID NO: 195577 - DNA, 20 bp, Artificial Sequence
  Description of Artificial Sequence: Synthetic oligonucleotide
  Target: ATXN1; (-) strand; PAM type: YTN; PAM sequence: TTT
gggttattaacattgcgctt

SEQ ID NO: 195578 - DNA, 20 bp, Artificial Sequence
  Description of Artificial Sequence: Synthetic oligonucleotide
  Target: ATXN1; (-) strand; PAM type: YTN; PAM sequence: TTG
tgtttgggttattaacattg

SEQ ID NO: 195579 - DNA, 20 bp, Artificial Sequence
  Description of Artificial Sequence: Synthetic oligonucleotide
  Target: ATXN1; (-) strand; PAM type: YTN; PAM sequence: TTT
gtgtttgggttattaacatt

SEQ ID NO: 195580 - DNA, 20 bp, Artificial Sequence
  Description of Artificial Sequence: Synthetic oligonucleotide
  Target: ATXN1; (-) strand; PAM type: YTN; PAM sequence: CTT
tgtgtttgggttattaacat

SEQ ID NO: 195581 - DNA, 20 bp, Artificial Sequence
  Description of Artificial Sequence: Synthetic oligonucleotide
  Target: ATXN1; (-) strand; PAM type: YTN; PAM sequence: TTC
tttgtgtttgggttattaac

SEQ ID NO: 195582 - DNA, 20 bp, Artificial Sequence
  Description of Artificial Sequence: Synthetic oligonucleotide
  Target: ATXN1; (-) strand; PAM type: YTN; PAM sequence: CTG
cacattctttgtgtttgggt

SEQ ID NO: 195583 - DNA, 20 bp, Artificial Sequence
  Description of Artificial Sequence: Synthetic oligonucleotide
  Target: ATXN1; (-) strand; PAM type: YTN; PAM sequence: TTC
ctgcacattctttgtgtttg

SEQ ID NO: 195584 - DNA, 20 bp, Artificial Sequence
  Description of Artificial Sequence: Synthetic oligonucleotide
  Target: ATXN1; (-) strand; PAM type: YTN; PAM sequence: TTA
ttcctgcacattctttgtgt

SEQ ID NO: 195585 - DNA, 20 bp, Artificial Sequence
  Description of Artificial Sequence: Synthetic oligonucleotide
  Target: ATXN1; (-) strand; PAM type: YTN; PAM sequence: TTA
ttattcctgcacattctttg

SEQ ID NO: 195586 - DNA, 20 bp, Artificial Sequence
  Description of Artificial Sequence: Synthetic oligonucleotide
  Target: ATXN1; (-) strand; PAM type: YTN; PAM sequence: TTG
agccattattattcctgcac

SEQ ID NO: 195587 - DNA, 20 bp, Artificial Sequence
  Description of Artificial Sequence: Synthetic oligonucleotide
  Target: ATXN1; (-) strand; PAM type: YTN; PAM sequence: CTT
gagccattattattcctgca

SEQ ID NO: 195588 - DNA, 20 bp, Artificial Sequence
  Description of Artificial Sequence: Synthetic oligonucleotide
  Target: ATXN1; (-) strand; PAM type: YTN; PAM sequence: CTC
ttgagccattattattcctg

SEQ ID NO: 195589 - DNA, 20 bp, Artificial Sequence
  Description of Artificial Sequence: Synthetic oligonucleotide
  Target: ATXN1; (-) strand; PAM type: YTN; PAM sequence: TTA
taaccaatggcccccagcaa

SEQ ID NO: 195590 - DNA, 20 bp, Artificial Sequence
  Description of Artificial Sequence: Synthetic oligonucleotide
  Target: ATXN1; (-) strand; PAM type: YTN; PAM sequence: CTG
ttataaccaatggcccccag

SEQ ID NO: 195591 - DNA, 20 bp, Artificial Sequence
  Description of Artificial Sequence: Synthetic oligonucleotide
  Target: ATXN1; (-) strand; PAM type: YTN; PAM sequence: TTG
gataaaataaaatacatctg

SEQ ID NO: 195592 - DNA, 20 bp, Artificial Sequence
  Description of Artificial Sequence: Synthetic oligonucleotide
  Target: ATXN1; (-) strand; PAM type: YTN; PAM sequence: CTG
aggtaataaatgaaaaaagt

SEQ ID NO: 195593 - DNA, 20 bp, Artificial Sequence
  Description of Artificial Sequence: Synthetic oligonucleotide
  Target: ATXN1; (-) strand; PAM type: YTN; PAM sequence: CTC
tgaggtaataaatgaaaaaa

SEQ ID NO: 195594 - DNA, 20 bp, Artificial Sequence
  Description of Artificial Sequence: Synthetic oligonucleotide
  Target: ATXN1; (-) strand; PAM type: YTN; PAM sequence: CTA
ctctgaggtaataaatgaaa

SEQ ID NO: 195595 - DNA, 20 bp, Artificial Sequence
  Description of Artificial Sequence: Synthetic oligonucleotide
  Target: ATXN1; (-) strand; PAM type: YTN; PAM sequence: TTA
tccgacgagaaacacataat

SEQ ID NO: 195596 - DNA, 20 bp, Artificial Sequence
  Description of Artificial Sequence: Synthetic oligonucleotide
  Target: ATXN1; (-) strand; PAM type: YTN; PAM sequence: TTT
atccgacgagaaacacataa

SEQ ID NO: 195597 - DNA, 20 bp, Artificial Sequence
  Description of Artificial Sequence: Synthetic oligonucleotide
  Target: ATXN1; (-) strand; PAM type: YTN; PAM sequence: CTG
tggataaatttatccgacga

SEQ ID NO: 195598 - DNA, 20 bp, Artificial Sequence
  Description of Artificial Sequence: Synthetic oligonucleotide
  Target: ATXN1; (-) strand; PAM type: YTN; PAM sequence: TTA
gactgtggataaatttatcc

SEQ ID NO: 195599 - DNA, 20 bp, Artificial Sequence
  Description of Artificial Sequence: Synthetic oligonucleotide
  Target: ATXN1; (-) strand; PAM type: YTN; PAM sequence: TTG
tgttagactgtggataaatt

SEQ ID NO: 195600 - DNA, 20 bp, Artificial Sequence
  Description of Artificial Sequence: Synthetic oligonucleotide
  Target: ATXN1; (-) strand; PAM type: YTN; PAM sequence: TTA
aattgtgttagactgtggat

SEQ ID NO: 195601 - DNA, 20 bp, Artificial Sequence
  Description of Artificial Sequence: Synthetic oligonucleotide
  Target: ATXN1; (-) strand; PAM type: YTN; PAM sequence: TTT
aaattgtgttagactgtgga

SEQ ID NO: 195602 - DNA, 20 bp, Artificial Sequence
  Description of Artificial Sequence: Synthetic oligonucleotide
  Target: ATXN1; (-) strand; PAM type: YTN; PAM sequence: CTC
aatttaaattgtgttagact

SEQ ID NO: 195603 - DNA, 20 bp, Artificial Sequence
  Description of Artificial Sequence: Synthetic oligonucleotide
  Target: ATXN1; (-) strand; PAM type: YTN; PAM sequence: CTA
actcaatttaaattgtgtta

SEQ ID NO: 195604 - DNA, 20 bp, Artificial Sequence
  Description of Artificial Sequence: Synthetic oligonucleotide
  Target: ATXN1; (-) strand; PAM type: YTN; PAM sequence: TTA
agtcctaactcaatttaaat

SEQ ID NO: 195605 - DNA, 20 bp, Artificial Sequence
  Description of Artificial Sequence: Synthetic oligonucleotide
  Target: ATXN1; (-) strand; PAM type: YTN; PAM sequence: CTT
aagtcctaactcaatttaaa

SEQ ID NO: 195606 - DNA, 20 bp, Artificial Sequence
  Description of Artificial Sequence: Synthetic oligonucleotide
  Target: ATXN1; (-) strand; PAM type: YTN; PAM sequence: CTC
acttaagtcctaactcaatt

SEQ ID NO: 195607 - DNA, 20 bp, Artificial Sequence
  Description of Artificial Sequence: Synthetic oligonucleotide
  Target: ATXN1; (-) strand; PAM type: YTN; PAM sequence: TTG
gaaactcacttaagtcctaa

SEQ ID NO: 195608 - DNA, 20 bp, Artificial Sequence
  Description of Artificial Sequence: Synthetic oligonucleotide
  Target: ATXN1; (-) strand; PAM type: YTN; PAM sequence: TTT
ggaaactcacttaagtccta

SEQ ID NO: 195609 - DNA, 20 bp, Artificial Sequence
  Description of Artificial Sequence: Synthetic oligonucleotide
  Target: ATXN1; (-) strand; PAM type: YTN; PAM sequence: TTA
gggaatttggaaactcactt

SEQ ID NO: 195610 - DNA, 20 bp, Artificial Sequence
  Description of Artificial Sequence: Synthetic oligonucleotide
  Target: ATXN1; (-) strand; PAM type: YTN; PAM sequence: TTT
agggaatttggaaactcact

SEQ ID NO: 195611 - DNA, 20 bp, Artificial Sequence
  Description of Artificial Sequence: Synthetic oligonucleotide
  Target: ATXN1; (-) strand; PAM type: YTN; PAM sequence: CTC
atagagacatgtacatcatg

SEQ ID NO: 195612 - DNA, 20 bp, Artificial Sequence
  Description of Artificial Sequence: Synthetic oligonucleotide
  Target: ATXN1; (-) strand; PAM type: YTN; PAM sequence: CTC
ctcatagagacatgtacatc

SEQ ID NO: 195613 - DNA, 20 bp, Artificial Sequence
  Description of Artificial Sequence: Synthetic oligonucleotide
  Target: ATXN1; (-) strand; PAM type: YTN; PAM sequence: TTA
ccatggagtgtgaaaagtgc

SEQ ID NO: 195614 - DNA, 20 bp, Artificial Sequence
  Description of Artificial Sequence: Synthetic oligonucleotide
  Target: ATXN1; (-) strand; PAM type: YTN; PAM sequence: TTT
accatggagtgtgaaaagtg

SEQ ID NO: 195615 - DNA, 20 bp, Artificial Sequence
  Description of Artificial Sequence: Synthetic oligonucleotide
  Target: ATXN1; (-) strand; PAM type: YTN; PAM sequence: TTA
gtggagaagatgagtacgac

SEQ ID NO: 195616 - DNA, 20 bp, Artificial Sequence
  Description of Artificial Sequence: Synthetic oligonucleotide
  Target: ATXN1; (-) strand; PAM type: YTN; PAM sequence: TTT
agtggagaagatgagtacga

SEQ ID NO: 195617 - DNA, 20 bp, Artificial Sequence
  Description of Artificial Sequence: Synthetic oligonucleotide
  Target: ATXN1; (-) strand; PAM type: YTN; PAM sequence: CTG
ggtcacaatttagtggagaa

SEQ ID NO: 195618 - DNA, 20 bp, Artificial Sequence
  Description of Artificial Sequence: Synthetic oligonucleotide
  Target: ATXN1; (-) strand; PAM type: YTN; PAM sequence: CTA
tcagagctgggtcacaattt

SEQ ID NO: 195619 - DNA, 20 bp, Artificial Sequence
  Description of Artificial Sequence: Synthetic oligonucleotide
  Target: ATXN1; (-) strand; PAM type: YTN; PAM sequence: CTA
cacagagataaatgatgtaa

SEQ ID NO: 195620 - DNA, 20 bp, Artificial Sequence
  Description of Artificial Sequence: Synthetic oligonucleotide
  Target: ATXN1; (-) strand; PAM type: YTN; PAM sequence: CTG
ctacacagagataaatgatg

SEQ ID NO: 195621 - DNA, 20 bp, Artificial Sequence
  Description of Artificial Sequence: Synthetic oligonucleotide
  Target: ATXN1; (-) strand; PAM type: YTN; PAM sequence: TTG
aatgtctgctacacagagat

SEQ ID NO: 195622 - DNA, 20 bp, Artificial Sequence
  Description of Artificial Sequence: Synthetic oligonucleotide
  Target: ATXN1; (-) strand; PAM type: YTN; PAM sequence: TTT
gaatgtctgctacacagaga

SEQ ID NO: 195623 - DNA, 20 bp, Artificial Sequence
  Description of Artificial Sequence: Synthetic oligonucleotide
  Target: ATXN1; (-) strand; PAM type: YTN; PAM sequence: TTT
tgaatgtctgctacacagag

SEQ ID NO: 195624 - DNA, 20 bp, Artificial Sequence
  Description of Artificial Sequence: Synthetic oligonucleotide
  Target: ATXN1; (-) strand; PAM type: YTN; PAM sequence: CTG
catattttgaatgtctgcta

SEQ ID NO: 195625 - DNA, 20 bp, Artificial Sequence
  Description of Artificial Sequence: Synthetic oligonucleotide
  Target: ATXN1; (-) strand; PAM type: YTN; PAM sequence: TTC
tgcatattttgaatgtctgc

SEQ ID NO: 195626 - DNA, 20 bp, Artificial Sequence
  Description of Artificial Sequence: Synthetic oligonucleotide
  Target: ATXN1; (-) strand; PAM type: YTN; PAM sequence: TTT
ctgcatattttgaatgtctg

SEQ ID NO: 195627 - DNA, 20 bp, Artificial Sequence
  Description of Artificial Sequence: Synthetic oligonucleotide
  Target: ATXN1; (-) strand; PAM type: YTN; PAM sequence: TTC
atttctgcatattttgaatg

SEQ ID NO: 195628 - DNA, 20 bp, Artificial Sequence
  Description of Artificial Sequence: Synthetic oligonucleotide
  Target: ATXN1; (-) strand; PAM type: YTN; PAM sequence: TTC
attcatttctgcatattttg

SEQ ID NO: 195629 - DNA, 20 bp, Artificial Sequence
  Description of Artificial Sequence: Synthetic oligonucleotide
  Target: ATXN1; (-) strand; PAM type: YTN; PAM sequence: CTG
aggattcattcatttctgca

SEQ ID NO: 195630 - DNA, 20 bp, Artificial Sequence
  Description of Artificial Sequence: Synthetic oligonucleotide
  Target: ATXN1; (-) strand; PAM type: YTN; PAM sequence: CTC
tgaggattcattcatttctg

SEQ ID NO: 195631 - DNA, 20 bp, Artificial Sequence
  Description of Artificial Sequence: Synthetic oligonucleotide
  Target: ATXN1; (-) strand; PAM type: YTN; PAM sequence: TTC
tctgaggattcattcatttc

SEQ ID NO: 195632 - DNA, 20 bp, Artificial Sequence
  Description of Artificial Sequence: Synthetic oligonucleotide
  Target: ATXN1; (-) strand; PAM type: YTN; PAM sequence: TTA
tgattctctgaggattcatt

SEQ ID NO: 195633 - DNA, 20 bp, Artificial Sequence
  Description of Artificial Sequence: Synthetic oligonucleotide
  Target: ATXN1; (-) strand; PAM type: YTN; PAM sequence: TTT
atgattctctgaggattcat

SEQ ID NO: 195634 - DNA, 20 bp, Artificial Sequence
  Description of Artificial Sequence: Synthetic oligonucleotide
  Target: ATXN1; (-) strand; PAM type: YTN; PAM sequence: TTA
tttatgattctctgaggatt

SEQ ID NO: 195635 - DNA, 20 bp, Artificial Sequence
  Description of Artificial Sequence: Synthetic oligonucleotide
  Target: ATXN1; (-) strand; PAM type: YTN; PAM sequence: TTT
atttatgattctctgaggat

SEQ ID NO: 195636 - DNA, 20 bp, Artificial Sequence
  Description of Artificial Sequence: Synthetic oligonucleotide
  Target: ATXN1; (-) strand; PAM type: YTN; PAM sequence: TTT
tatttatgattctctgagga

SEQ ID NO: 195637 - DNA, 20 bp, Artificial Sequence
  Description of Artificial Sequence: Synthetic oligonucleotide
  Target: ATXN1; (-) strand; PAM type: YTN; PAM sequence: CTT
ttatttatgattctctgagg

SEQ ID NO: 195638 - DNA, 20 bp, Artificial Sequence
  Description of Artificial Sequence: Synthetic oligonucleotide
  Target: ATXN1; (-) strand; PAM type: YTN; PAM sequence: CTC
aataagcatgccttttattt

SEQ ID NO: 195639 - DNA, 20 bp, Artificial Sequence
  Description of Artificial Sequence: Synthetic oligonucleotide
  Target: ATXN1; (-) strand; PAM type: YTN; PAM sequence: TTC
acggactcaataagcatgcc

SEQ ID NO: 195640 - DNA, 20 bp, Artificial Sequence
  Description of Artificial Sequence: Synthetic oligonucleotide
  Target: ATXN1; (-) strand; PAM type: YTN; PAM sequence: TTG
gggacattcacggactcaat

SEQ ID NO: 195641 - DNA, 20 bp, Artificial Sequence
  Description of Artificial Sequence: Synthetic oligonucleotide
  Target: ATXN1; (-) strand; PAM type: YTN; PAM sequence: CTT
ggggacattcacggactcaa

SEQ ID NO: 195642 - DNA, 20 bp, Artificial Sequence
  Description of Artificial Sequence: Synthetic oligonucleotide
  Target: ATXN1; (-) strand; PAM type: YTN; PAM sequence: CTC
caacttggggacattcacgg

SEQ ID NO: 195643 - DNA, 20 bp, Artificial Sequence
  Description of Artificial Sequence: Synthetic oligonucleotide
  Target: ATXN1; (-) strand; PAM type: YTN; PAM sequence: TTC
tccaacttggggacattcac

SEQ ID NO: 195644 - DNA, 20 bp, Artificial Sequence
  Description of Artificial Sequence: Synthetic oligonucleotide
  Target: ATXN1; (-) strand; PAM type: YTN; PAM sequence: CTT
ctccaacttggggacattca

SEQ ID NO: 195645 - DNA, 20 bp, Artificial Sequence
  Description of Artificial Sequence: Synthetic oligonucleotide
  Target: ATXN1; (-) strand; PAM type: YTN; PAM sequence: CTG
gtgacttctccaacttgggg

SEQ ID NO: 195646 - DNA, 20 bp, Artificial Sequence
  Description of Artificial Sequence: Synthetic oligonucleotide
  Target: ATXN1; (-) strand; PAM type: YTN; PAM sequence: TTG
aaatgctggtgacttctcca

SEQ ID NO: 195647 - DNA, 20 bp, Artificial Sequence
  Description of Artificial Sequence: Synthetic oligonucleotide
  Target: ATXN1; (-) strand; PAM type: YTN; PAM sequence: TTT
gaaatgctggtgacttctcc

SEQ ID NO: 195648 - DNA, 20 bp, Artificial Sequence
  Description of Artificial Sequence: Synthetic oligonucleotide
  Target: ATXN1; (-) strand; PAM type: YTN; PAM sequence: CTT
tgaaatgctggtgacttctc

SEQ ID NO: 195649 - DNA, 20 bp, Artificial Sequence
  Description of Artificial Sequence: Synthetic oligonucleotide
  Target: ATXN1; (-) strand; PAM type: YTN; PAM sequence: CTC
tttgaaatgctggtgacttc

SEQ ID NO: 195650 - DNA, 20 bp, Artificial Sequence
  Description of Artificial Sequence: Synthetic oligonucleotide
  Target: ATXN1; (-) strand; PAM type: YTN; PAM sequence: TTG
ctctttgaaatgctggtgac

SEQ ID NO: 195651 - DNA, 20 bp, Artificial Sequence
  Description of Artificial Sequence: Synthetic oligonucleotide
  Target: ATXN1; (-) strand; PAM type: YTN; PAM sequence: TTC
agatgttgctctttgaaatg

SEQ ID NO: 195652 - DNA, 20 bp, Artificial Sequence
  Description of Artificial Sequence: Synthetic oligonucleotide
  Target: ATXN1; (-) strand; PAM type: YTN; PAM sequence: TTG
gaattcagatgttgctcttt

SEQ ID NO: 195653 - DNA, 20 bp, Artificial Sequence
  Description of Artificial Sequence: Synthetic oligonucleotide
  Target: ATXN1; (-) strand; PAM type: YTN; PAM sequence: TTT
ggaattcagatgttgctctt

SEQ ID NO: 195654 - DNA, 20 bp, Artificial Sequence
  Description of Artificial Sequence: Synthetic oligonucleotide
  Target: ATXN1; (-) strand; PAM type: YTN; PAM sequence: TTT
tggaattcagatgttgctct

SEQ ID NO: 195655 - DNA, 20 bp, Artificial Sequence
  Description of Artificial Sequence: Synthetic oligonucleotide
  Target: ATXN1; (-) strand; PAM type: YTN; PAM sequence: TTA
gacaaattttggaattcaga

SEQ ID NO: 195656 - DNA, 20 bp, Artificial Sequence
  Description of Artificial Sequence: Synthetic oligonucleotide
  Target: ATXN1; (-) strand; PAM type: YTN; PAM sequence: TTT
agacaaattttggaattcag

SEQ ID NO: 195657 - DNA, 20 bp, Artificial Sequence
  Description of Artificial Sequence: Synthetic oligonucleotide
  Target: ATXN1; (-) strand; PAM type: YTN; PAM sequence: TTT
tagacaaattttggaattca

SEQ ID NO: 195658 - DNA, 20 bp, Artificial Sequence
  Description of Artificial Sequence: Synthetic oligonucleotide
  Target: ATXN1; (-) strand; PAM type: YTN; PAM sequence: TTC
aattttagacaaattttgga

SEQ ID NO: 195659 - DNA, 20 bp, Artificial Sequence
  Description of Artificial Sequence: Synthetic oligonucleotide
  Target: ATXN1; (-) strand; PAM type: YTN; PAM sequence: TTT
caattttagacaaattttgg

SEQ ID NO: 195660 - DNA, 20 bp, Artificial Sequence
  Description of Artificial Sequence: Synthetic oligonucleotide
  Target: ATXN1; (-) strand; PAM type: YTN; PAM sequence: TTT
tcaattttagacaaattttg

SEQ ID NO: 195661 - DNA, 20 bp, Artificial Sequence
  Description of Artificial Sequence: Synthetic oligonucleotide
  Target: ATXN1; (-) strand; PAM type: YTN; PAM sequence: CTT
ttcaattttagacaaatttt

SEQ ID NO: 195662 - DNA, 20 bp, Artificial Sequence
  Description of Artificial Sequence: Synthetic oligonucleotide
  Target: ATXN1; (-) strand; PAM type: YTN; PAM sequence: TTA
taatcatcttttcaatttta

SEQ ID NO: 195663 - DNA, 20 bp, Artificial Sequence
  Description of Artificial Sequence: Synthetic oligonucleotide
  Target: ATXN1; (-) strand; PAM type: YTN; PAM sequence: TTT
ataatcatcttttcaatttt

SEQ ID NO: 195664 - DNA, 20 bp, Artificial Sequence
  Description of Artificial Sequence: Synthetic oligonucleotide
  Target: ATXN1; (-) strand; PAM type: YTN; PAM sequence: TTC
atggtatagatttataatca

SEQ ID NO: 195665 - DNA, 20 bp, Artificial Sequence
  Description of Artificial Sequence: Synthetic oligonucleotide
  Target: ATXN1; (-) strand; PAM type: YTN; PAM sequence: TTT
catggtatagatttataatc

SEQ ID NO: 195666 - DNA, 20 bp, Artificial Sequence
  Description of Artificial Sequence: Synthetic oligonucleotide
  Target: ATXN1; (-) strand; PAM type: YTN; PAM sequence: CTA
ccaaatttcatggtatagat

SEQ ID NO: 195667 - DNA, 20 bp, Artificial Sequence
  Description of Artificial Sequence: Synthetic oligonucleotide
  Target: ATXN1; (-) strand; PAM type: YTN; PAM sequence: TTA
agaacagatatctaccaaat

SEQ ID NO: 195668 - DNA, 20 bp, Artificial Sequence
  Description of Artificial Sequence: Synthetic oligonucleotide
  Target: ATXN1; (-) strand; PAM type: YTN; PAM sequence: CTT
aagaacagatatctaccaaa

SEQ ID NO: 195669 - DNA, 20 bp, Artificial Sequence
  Description of Artificial Sequence: Synthetic oligonucleotide
  Target: ATXN1; (-) strand; PAM type: YTN; PAM sequence: TTC
cttaagaacagatatctacc

SEQ ID NO: 195670 - DNA, 20 bp, Artificial Sequence
  Description of Artificial Sequence: Synthetic oligonucleotide
  Target: ATXN1; (-) strand; PAM type: YTN; PAM sequence: TTA
attccttaagaacagatatc

SEQ ID NO: 195671 - DNA, 20 bp, Artificial Sequence
  Description of Artificial Sequence: Synthetic oligonucleotide
  Target: ATXN1; (-) strand; PAM type: YTN; PAM sequence: TTT
aattccttaagaacagatat

SEQ ID NO: 195672 - DNA, 20 bp, Artificial Sequence
  Description of Artificial Sequence: Synthetic oligonucleotide
  Target: ATXN1; (-) strand; PAM type: YTN; PAM sequence: TTT
taattccttaagaacagata

SEQ ID NO: 195673 - DNA, 20 bp, Artificial Sequence
  Description of Artificial Sequence: Synthetic oligonucleotide
  Target: ATXN1; (-) strand; PAM type: YTN; PAM sequence: TTA
tatgttttaattccttaaga

SEQ ID NO: 195674 - DNA, 20 bp, Artificial Sequence
  Description of Artificial Sequence: Synthetic oligonucleotide
  Target: ATXN1; (-) strand; PAM type: YTN; PAM sequence: TTT
atatgttttaattccttaag

SEQ ID NO: 195675 - DNA, 20 bp, Artificial Sequence
  Description of Artificial Sequence: Synthetic oligonucleotide
  Target: ATXN1; (-) strand; PAM type: YTN; PAM sequence: TTA
tatttatatgttttaattcc

SEQ ID NO: 195676 - DNA, 20 bp, Artificial Sequence
  Description of Artificial Sequence: Synthetic oligonucleotide
  Target: ATXN1; (-) strand; PAM type: YTN; PAM sequence: TTT
atatttatatgttttaattc

SEQ ID NO: 195677 - DNA, 20 bp, Artificial Sequence
  Description of Artificial Sequence: Synthetic oligonucleotide
  Target: ATXN1; (-) strand; PAM type: YTN; PAM sequence: TTT
tatatttatatgttttaatt

SEQ ID NO: 195678 - DNA, 20 bp, Artificial Sequence
  Description of Artificial Sequence: Synthetic oligonucleotide
  Target: ATXN1; (-) strand; PAM type: YTN; PAM sequence: TTT
ttatatttatatgttttaat

SEQ ID NO: 195679 - DNA, 20 bp, Artificial Sequence
  Description of Artificial Sequence: Synthetic oligonucleotide
  Target: ATXN1; (-) strand; PAM type: YTN; PAM sequence: TTA
tttttatatttatatgtttt

SEQ ID NO: 195680 - DNA, 20 bp, Artificial Sequence
  Description of Artificial Sequence: Synthetic oligonucleotide
  Target: ATXN1; (-) strand; PAM type: YTN; PAM sequence: CTT
atttttatatttatatgttt

SEQ ID NO: 195681 - DNA, 20 bp, Artificial Sequence
  Description of Artificial Sequence: Synthetic oligonucleotide
  Target: ATXN1; (-) strand; PAM type: YTN; PAM sequence: TTC
cttatttttatatttatatg

SEQ ID NO: 195682 - DNA, 20 bp, Artificial Sequence
  Description of Artificial Sequence: Synthetic oligonucleotide
  Target: ATXN1; (-) strand; PAM type: YTN; PAM sequence: TTT
ccttatttttatatttatat

SEQ ID NO: 195683 - DNA, 20 bp, Artificial Sequence
  Description of Artificial Sequence: Synthetic oligonucleotide
  Target: ATXN1; (-) strand; PAM type: YTN; PAM sequence: TTC
agccaatatcagaggagtat

SEQ ID NO: 195684 - DNA, 20 bp, Artificial Sequence
  Description of Artificial Sequence: Synthetic oligonucleotide
  Target: ATXN1; (-) strand; PAM type: YTN; PAM sequence: CTT
cagccaatatcagaggagta

SEQ ID NO: 195685 - DNA, 20 bp, Artificial Sequence
  Description of Artificial Sequence: Synthetic oligonucleotide
  Target: ATXN1; (-) strand; PAM type: YTN; PAM sequence: TTC
ttcagccaatatcagaggag

SEQ ID NO: 195686 - DNA, 20 bp, Artificial Sequence
  Description of Artificial Sequence: Synthetic oligonucleotide
  Target: ATXN1; (-) strand; PAM type: YTN; PAM sequence: TTT
cttcagccaatatcagagga

SEQ ID NO: 195687 - DNA, 20 bp, Artificial Sequence
  Description of Artificial Sequence: Synthetic oligonucleotide
  Target: ATXN1; (-) strand; PAM type: YTN; PAM sequence: TTT
tcttcagccaatatcagagg

SEQ ID NO: 195688 - DNA, 20 bp, Artificial Sequence
  Description of Artificial Sequence: Synthetic oligonucleotide
  Target: ATXN1; (-) strand; PAM type: YTN; PAM sequence: TTG
aaaatgattttcttcagcca

SEQ ID NO: 195689 - DNA, 20 bp, Artificial Sequence
  Description of Artificial Sequence: Synthetic oligonucleotide
  Target: ATXN1; (-) strand; PAM type: YTN; PAM sequence: CTT
gaaaatgattttcttcagcc

SEQ ID NO: 195690 - DNA, 20 bp, Artificial Sequence
  Description of Artificial Sequence: Synthetic oligonucleotide
  Target: ATXN1; (-) strand; PAM type: YTN; PAM sequence: CTC
cttgaaaatgattttcttca

SEQ ID NO: 195691 - DNA, 20 bp, Artificial Sequence
  Description of Artificial Sequence: Synthetic oligonucleotide
  Target: ATXN1; (-) strand; PAM type: YTN; PAM sequence: TTG
gtaagagtctccttgaaaat

SEQ ID NO: 195692 - DNA, 20 bp, Artificial Sequence
  Description of Artificial Sequence: Synthetic oligonucleotide
  Target: ATXN1; (-) strand; PAM type: YTN; PAM sequence: TTT
ggtaagagtctccttgaaaa

SEQ ID NO: 195693 - DNA, 20 bp, Artificial Sequence
  Description of Artificial Sequence: Synthetic oligonucleotide
  Target: ATXN1; (-) strand; PAM type: YTN; PAM sequence: CTT
tggtaagagtctccttgaaa

SEQ ID NO: 195694 - DNA, 20 bp, Artificial Sequence
  Description of Artificial Sequence: Synthetic oligonucleotide
  Target: ATXN1; (-) strand; PAM type: YTN; PAM sequence: TTG
aaaatagagctttggtaaga

SEQ ID NO: 195695 - DNA, 20 bp, Artificial Sequence
  Description of Artificial Sequence: Synthetic oligonucleotide
  Target: ATXN1; (-) strand; PAM type: YTN; PAM sequence: TTA
atgttgaaaatagagctttg

SEQ ID NO: 195696 - DNA, 20 bp, Artificial Sequence
  Description of Artificial Sequence: Synthetic oligonucleotide
  Target: ATXN1; (-) strand; PAM type: YTN; PAM sequence: TTT
aatgttgaaaatagagcttt

SEQ ID NO: 195697 - DNA, 20 bp, Artificial Sequence
  Description of Artificial Sequence: Synthetic oligonucleotide
  Target: ATXN1; (-) strand; PAM type: YTN; PAM sequence: CTT
taatgttgaaaatagagctt

SEQ ID NO: 195698 - DNA, 20 bp, Artificial Sequence
  Description of Artificial Sequence: Synthetic oligonucleotide
  Target: ATXN1; (-) strand; PAM type: YTN; PAM sequence: TTA
agctttaatgttgaaaatag

SEQ ID NO: 195699 - DNA, 20 bp, Artificial Sequence
  Description of Artificial Sequence: Synthetic oligonucleotide
  Target: ATXN1; (-) strand; PAM type: YTN; PAM sequence: TTT
aagctttaatgttgaaaata

SEQ ID NO: 195700 - DNA, 20 bp, Artificial Sequence
  Description of Artificial Sequence: Synthetic oligonucleotide
  Target: ATXN1; (-) strand; PAM type: YTN; PAM sequence: TTT
taagctttaatgttgaaaat

SEQ ID NO: 195701 - DNA, 20 bp, Artificial Sequence
  Description of Artificial Sequence: Synthetic oligonucleotide
  Target: ATXN1; (-) strand; PAM type: YTN; PAM sequence: TTA
cattttaagctttaatgttg

SEQ ID NO: 195702 - DNA, 20 bp, Artificial Sequence
  Description of Artificial Sequence: Synthetic oligonucleotide
  Target: ATXN1; (-) strand; PAM type: YTN; PAM sequence: CTT
acattttaagctttaatgtt

SEQ ID NO: 195703 - DNA, 20 bp, Artificial Sequence
  Description of Artificial Sequence: Synthetic oligonucleotide
  Target: ATXN1; (-) strand; PAM type: YTN; PAM sequence: CTG
ccccttacattttaagcttt

SEQ ID NO: 195704 - DNA, 20 bp, Artificial Sequence
  Description of Artificial Sequence: Synthetic oligonucleotide
  Target: ATXN1; (-) strand; PAM type: YTN; PAM sequence: CTC
tgccccttacattttaagct

SEQ ID NO: 195705 - DNA, 20 bp, Artificial Sequence
  Description of Artificial Sequence: Synthetic oligonucleotide
  Target: ATXN1; (-) strand; PAM type: YTN; PAM sequence: CTC
tctgccccttacattttaag

SEQ ID NO: 195706 - DNA, 20 bp, Artificial Sequence
  Description of Artificial Sequence: Synthetic oligonucleotide
  Target: ATXN1; (-) strand; PAM type: YTN; PAM sequence: CTC
aaaatactctctgcccctta

SEQ ID NO: 195707 - DNA, 20 bp, Artificial Sequence
  Description of Artificial Sequence: Synthetic oligonucleotide
  Target: ATXN1; (-) strand; PAM type: YTN; PAM sequence: TTC
tcaaaatactctctgcccct

SEQ ID NO: 195708 - DNA, 20 bp, Artificial Sequence
  Description of Artificial Sequence: Synthetic oligonucleotide
  Target: ATXN1; (-) strand; PAM type: YTN; PAM sequence: TTG
aaaaccattctcaaaatact

SEQ ID NO: 195709 - DNA, 20 bp, Artificial Sequence
  Description of Artificial Sequence: Synthetic oligonucleotide
  Target: ATXN1; (-) strand; PAM type: YTN; PAM sequence: CTT
gaaaaccattctcaaaatac

SEQ ID NO: 195710 - DNA, 20 bp, Artificial Sequence
  Description of Artificial Sequence: Synthetic oligonucleotide
  Target: ATXN1; (-) strand; PAM type: YTN; PAM sequence: TTC
cttgaaaaccattctcaaaa

SEQ ID NO: 195711 - DNA, 20 bp, Artificial Sequence
  Description of Artificial Sequence: Synthetic oligonucleotide
  Target: ATXN1; (-) strand; PAM type: YTN; PAM sequence: TTT
ccttgaaaaccattctcaaa

SEQ ID NO: 195712 - DNA, 20 bp, Artificial Sequence
  Description of Artificial Sequence: Synthetic oligonucleotide
  Target: ATXN1; (-) strand; PAM type: YTN; PAM sequence: CTT
tccttgaaaaccattctcaa

SEQ ID NO: 195713 - DNA, 20 bp, Artificial Sequence
  Description of Artificial Sequence: Synthetic oligonucleotide
  Target: ATXN1; (-) strand; PAM type: YTN; PAM sequence: TTA
ctttccttgaaaaccattct

SEQ ID NO: 195714 - DNA, 20 bp, Artificial Sequence
  Description of Artificial Sequence: Synthetic oligonucleotide
  Target: ATXN1; (-) strand; PAM type: YTN; PAM sequence: TTA
attactttccttgaaaacca

SEQ ID NO: 195715 - DNA, 20 bp, Artificial Sequence
  Description of Artificial Sequence: Synthetic oligonucleotide
  Target: ATXN1; (-) strand; PAM type: YTN; PAM sequence: TTT
aattactttccttgaaaacc

SEQ ID NO: 195716 - DNA, 20 bp, Artificial Sequence
  Description of Artificial Sequence: Synthetic oligonucleotide
  Target: ATXN1; (-) strand; PAM type: YTN; PAM sequence: TTT
taattactttccttgaaaac

SEQ ID NO: 195717 - DNA, 20 bp, Artificial Sequence
  Description of Artificial Sequence: Synthetic oligonucleotide
  Target: ATXN1; (-) strand; PAM type: YTN; PAM sequence: TTG
attttaattactttccttga

SEQ ID NO: 195718 - DNA, 20 bp, Artificial Sequence
  Description of Artificial Sequence: Synthetic oligonucleotide
  Target: ATXN1; (-) strand; PAM type: YTN; PAM sequence: CTA
cgttgattttaattactttc

SEQ ID NO: 195719 - DNA, 20 bp, Artificial Sequence
  Description of Artificial Sequence: Synthetic oligonucleotide
  Target: ATXN1; (-) strand; PAM type: YTN; PAM sequence: CTA
caacctacgttgattttaat

SEQ ID NO: 195720 - DNA, 20 bp, Artificial Sequence
  Description of Artificial Sequence: Synthetic oligonucleotide
  Target: ATXN1; (-) strand; PAM type: YTN; PAM sequence: TTC
tacaacctacgttgatttta

SEQ ID NO: 195721 - DNA, 20 bp, Artificial Sequence
  Description of Artificial Sequence: Synthetic oligonucleotide
  Target: ATXN1; (-) strand; PAM type: YTN; PAM sequence: CTG
gttctacaacctacgttgat

SEQ ID NO: 195722 - DNA, 20 bp, Artificial Sequence
  Description of Artificial Sequence: Synthetic oligonucleotide
  Target: ATXN1; (-) strand; PAM type: YTN; PAM sequence: CTG
gatctggttctacaacctac

SEQ ID NO: 195723 - DNA, 20 bp, Artificial Sequence
  Description of Artificial Sequence: Synthetic oligonucleotide
  Target: ATXN1; (-) strand; PAM type: YTN; PAM sequence: TTC
tggatctggttctacaacct

SEQ ID NO: 195724 - DNA, 20 bp, Artificial Sequence
  Description of Artificial Sequence: Synthetic oligonucleotide
  Target: ATXN1; (-) strand; PAM type: YTN; PAM sequence: CTT
ctggatctggttctacaacc

SEQ ID NO: 195725 - DNA, 20 bp, Artificial Sequence
  Description of Artificial Sequence: Synthetic oligonucleotide
  Target: ATXN1; (-) strand; PAM type: YTN; PAM sequence: CTC
ttctggatctggttctacaa

SEQ ID NO: 195726 - DNA, 20 bp, Artificial Sequence
  Description of Artificial Sequence: Synthetic oligonucleotide
  Target: ATXN1; (-) strand; PAM type: YTN; PAM sequence: TTC
tcttctggatctggttctac

SEQ ID NO: 195727 - DNA, 20 bp, Artificial Sequence
  Description of Artificial Sequence: Synthetic oligonucleotide
  Target: ATXN1; (-) strand; PAM type: YTN; PAM sequence: TTT
ctcttctggatctggttcta

SEQ ID NO: 195728 - DNA, 20 bp, Artificial Sequence
  Description of Artificial Sequence: Synthetic oligonucleotide
  Target: ATXN1; (-) strand; PAM type: YTN; PAM sequence: CTG
aaatatagcaatcagtattt

SEQ ID NO: 195729 - DNA, 20 bp, Artificial Sequence
  Description of Artificial Sequence: Synthetic oligonucleotide
  Target: ATXN1; (-) strand; PAM type: YTN; PAM sequence: TTC
acccctgaaatatagcaatc

SEQ ID NO: 195730 - DNA, 20 bp, Artificial Sequence
  Description of Artificial Sequence: Synthetic oligonucleotide
  Target: ATXN1; (-) strand; PAM type: YTN; PAM sequence: TTT
cacccctgaaatatagcaat

SEQ ID NO: 195731 - DNA, 20 bp, Artificial Sequence
  Description of Artificial Sequence: Synthetic oligonucleotide
  Target: ATXN1; (-) strand; PAM type: YTN; PAM sequence: TTT
tcacccctgaaatatagcaa

SEQ ID NO: 195732 - DNA, 20 bp, Artificial Sequence
  Description of Artificial Sequence: Synthetic oligonucleotide
  Target: ATXN1; (-) strand; PAM type: YTN; PAM sequence: TTT
ttcacccctgaaatatagca

SEQ ID NO: 195733 - DNA, 20 bp, Artificial Sequence
  Description of Artificial Sequence: Synthetic oligonucleotide
  Target: ATXN1; (-) strand; PAM type: YTN; PAM sequence: TTT
tttcacccctgaaatatagc

SEQ ID NO: 195734 - DNA, 20 bp, Artificial Sequence
  Description of Artificial Sequence: Synthetic oligonucleotide
  Target: ATXN1; (-) strand; PAM type: YTN; PAM sequence: CTT
ttttcacccctgaaatatag

SEQ ID NO: 195735 - DNA, 20 bp, Artificial Sequence
  Description of Artificial Sequence: Synthetic oligonucleotide
  Target: ATXN1; (-) strand; PAM type: YTN; PAM sequence: TTG
accttttttcacccctgaaa

SEQ ID NO: 195736 - DNA, 20 bp, Artificial Sequence
  Description of Artificial Sequence: Synthetic oligonucleotide
  Target: ATXN1; (-) strand; PAM type: YTN; PAM sequence: TTT
gaccttttttcacccctgaa

SEQ ID NO: 195737 - DNA, 20 bp, Artificial Sequence
  Description of Artificial Sequence: Synthetic oligonucleotide
  Target: ATXN1; (-) strand; PAM type: YTN; PAM sequence: TTG
acaatttgaccttttttcac

SEQ ID NO: 195738 - DNA, 20 bp, Artificial Sequence
  Description of Artificial Sequence: Synthetic oligonucleotide
  Target: ATXN1; (-) strand; PAM type: YTN; PAM sequence: TTT
gacaatttgaccttttttca

SEQ ID NO: 195739 - DNA, 20 bp, Artificial Sequence
  Description of Artificial Sequence: Synthetic oligonucleotide
  Target: ATXN1; (-) strand; PAM type: YTN; PAM sequence: TTT
tgacaatttgaccttttttc

SEQ ID NO: 195740 - DNA, 20 bp, Artificial Sequence
  Description of Artificial Sequence: Synthetic oligonucleotide
  Target: ATXN1; (-) strand; PAM type: YTN; PAM sequence: TTT
ttgacaatttgacctttttt

SEQ ID NO: 195741 - DNA, 20 bp, Artificial Sequence
  Description of Artificial Sequence: Synthetic oligonucleotide
  Target: ATXN1; (-) strand; PAM type: YTN; PAM sequence: CTT
tttgacaatttgaccttttt

SEQ ID NO: 195742 - DNA, 20 bp, Artificial Sequence
  Description of Artificial Sequence: Synthetic oligonucleotide
  Target: ATXN1; (-) strand; PAM type: YTN; PAM sequence: TTA
ctttttgacaatttgacctt

SEQ ID NO: 195743 - DNA, 20 bp, Artificial Sequence
  Description of Artificial Sequence: Synthetic oligonucleotide
  Target: ATXN1; (-) strand; PAM type: YTN; PAM sequence: TTT
actttttgacaatttgacct

SEQ ID NO: 195744 - DNA, 20 bp, Artificial Sequence
  Description of Artificial Sequence: Synthetic oligonucleotide
  Target: ATXN1; (-) strand; PAM type: YTN; PAM sequence: CTT
tactttttgacaatttgacc

SEQ ID NO: 195745 - DNA, 20 bp, Artificial Sequence
  Description of Artificial Sequence: Synthetic oligonucleotide
  Target: ATXN1; (-) strand; PAM type: YTN; PAM sequence: TTC
tttactttttgacaatttga

SEQ ID NO: 195746 - DNA, 20 bp, Artificial Sequence
  Description of Artificial Sequence: Synthetic oligonucleotide
  Target: ATXN1; (-) strand; PAM type: YTN; PAM sequence: TTT
ctttactttttgacaatttg

SEQ ID NO: 195747 - DNA, 20 bp, Artificial Sequence
  Description of Artificial Sequence: Synthetic oligonucleotide
  Target: ATXN1; (-) strand; PAM type: YTN; PAM sequence: TTT
tctttactttttgacaattt

SEQ ID NO: 195748 - DNA, 20 bp, Artificial Sequence
  Description of Artificial Sequence: Synthetic oligonucleotide
  Target: ATXN1; (-) strand; PAM type: YTN; PAM sequence: CTT
ttctttactttttgacaatt

SEQ ID NO: 195749 - DNA, 20 bp, Artificial Sequence
  Description of Artificial Sequence: Synthetic oligonucleotide
  Target: ATXN1; (-) strand; PAM type: YTN; PAM sequence: TTC
aggcccttttctttactttt

SEQ ID NO: 195750 - DNA, 20 bp, Artificial Sequence
  Description of Artificial Sequence: Synthetic oligonucleotide
  Target: ATXN1; (-) strand; PAM type: YTN; PAM sequence: TTT
caggcccttttctttacttt

SEQ ID NO: 195751 - DNA, 20 bp, Artificial Sequence
  Description of Artificial Sequence: Synthetic oligonucleotide
  Target: ATXN1; (-) strand; PAM type: YTN; PAM sequence: CTT
tcaggcccttttctttactt

SEQ ID NO: 195752 - DNA, 20 bp, Artificial Sequence
  Description of Artificial Sequence: Synthetic oligonucleotide
  Target: ATXN1; (-) strand; PAM type: YTN; PAM sequence: TTG
aaaactttcaggcccttttc

SEQ ID NO: 195753 - DNA, 20 bp, Artificial Sequence
  Description of Artificial Sequence: Synthetic oligonucleotide
  Target: ATXN1; (-) strand; PAM type: YTN; PAM sequence: TTG
atacagtattgaaaactttc

SEQ ID NO: 195754 - DNA, 20 bp, Artificial Sequence
  Description of Artificial Sequence: Synthetic oligonucleotide
  Target: ATXN1; (-) strand; PAM type: YTN; PAM sequence: TTG
agtgaagtgatgggcattga

SEQ ID NO: 195755 - DNA, 20 bp, Artificial Sequence
  Description of Artificial Sequence: Synthetic oligonucleotide
  Target: ATXN1; (-) strand; PAM type: YTN; PAM sequence: TTT
gagtgaagtgatgggcattg

SEQ ID NO: 195756 - DNA, 20 bp, Artificial Sequence
  Description of Artificial Sequence: Synthetic oligonucleotide
  Target: ATXN1; (-) strand; PAM type: YTN; PAM sequence: TTT
tgagtgaagtgatgggcatt

SEQ ID NO: 195757 - DNA, 20 bp, Artificial Sequence
  Description of Artificial Sequence: Synthetic oligonucleotide
  Target: ATXN1; (-) strand; PAM type: YTN; PAM sequence: TTT
ttgagtgaagtgatgggcat

SEQ ID NO: 195758 - DNA, 20 bp, Artificial Sequence
  Description of Artificial Sequence: Synthetic oligonucleotide
  Target: ATXN1; (-) strand; PAM type: YTN; PAM sequence: CTT
tttgagtgaagtgatgggca

SEQ ID NO: 195759 - DNA, 20 bp, Artificial Sequence
  Description of Artificial Sequence: Synthetic oligonucleotide
  Target: ATXN1; (-) strand; PAM type: YTN; PAM sequence: CTA
actttttgagtgaagtgatg

SEQ ID NO: 195760 - DNA, 20 bp, Artificial Sequence
  Description of Artificial Sequence: Synthetic oligonucleotide
  Target: ATXN1; (-) strand; PAM type: YTN; PAM sequence: TTC
actaactttttgagtgaagt

SEQ ID NO: 195761 - DNA, 20 bp, Artificial Sequence
  Description of Artificial Sequence: Synthetic oligonucleotide
  Target: ATXN1; (-) strand; PAM type: YTN; PAM sequence: CTT
cactaactttttgagtgaag

SEQ ID NO: 195762 - DNA, 20 bp, Artificial Sequence
  Description of Artificial Sequence: Synthetic oligonucleotide
  Target: ATXN1; (-) strand; PAM type: YTN; PAM sequence: CTG
cttcactaactttttgagtg

SEQ ID NO: 195763 - DNA, 20 bp, Artificial Sequence
  Description of Artificial Sequence: Synthetic oligonucleotide
  Target: ATXN1; (-) strand; PAM type: YTN; PAM sequence: TTC
catggaatcgtactgcttca

SEQ ID NO: 195764 - DNA, 20 bp, Artificial Sequence
  Description of Artificial Sequence: Synthetic oligonucleotide
  Target: ATXN1; (-) strand; PAM type: YTN; PAM sequence: CTT
ccatggaatcgtactgcttc

SEQ ID NO: 195765 - DNA, 20 bp, Artificial Sequence
  Description of Artificial Sequence: Synthetic oligonucleotide
  Target: ATXN1; (-) strand; PAM type: YTN; PAM sequence: TTA
acccttccatggaatcgtac

SEQ ID NO: 195766 - DNA, 20 bp, Artificial Sequence
  Description of Artificial Sequence: Synthetic oligonucleotide
  Target: ATXN1; (-) strand; PAM type: YTN; PAM sequence: CTT
aacccttccatggaatcgta

SEQ ID NO: 195767 - DNA, 20 bp, Artificial Sequence
  Description of Artificial Sequence: Synthetic oligonucleotide
  Target: ATXN1; (-) strand; PAM type: YTN; PAM sequence: CTA
aaaggaaaatgaacccttaa

SEQ ID NO: 195768 - DNA, 20 bp, Artificial Sequence
  Description of Artificial Sequence: Synthetic oligonucleotide
  Target: ATXN1; (-) strand; PAM type: YTN; PAM sequence: TTA
tctaaaaggaaaatgaaccc

SEQ ID NO: 195769 - DNA, 20 bp, Artificial Sequence
  Description of Artificial Sequence: Synthetic oligonucleotide
  Target: ATXN1; (-) strand; PAM type: YTN; PAM sequence: TTT
atctaaaaggaaaatgaacc

SEQ ID NO: 195770 - DNA, 20 bp, Artificial Sequence
  Description of Artificial Sequence: Synthetic oligonucleotide
  Target: ATXN1; (-) strand; PAM type: YTN; PAM sequence: CTC
cagatacaatatttatctaa

SEQ ID NO: 195771 - DNA, 20 bp, Artificial Sequence
  Description of Artificial Sequence: Synthetic oligonucleotide
  Target: ATXN1; (-) strand; PAM type: YTN; PAM sequence: TTG
ctccagatacaatatttatc

SEQ ID NO: 195772 - DNA, 20 bp, Artificial Sequence
  Description of Artificial Sequence: Synthetic oligonucleotide
  Target: ATXN1; (-) strand; PAM type: YTN; PAM sequence: TTT
gctccagatacaatatttat

SEQ ID NO: 195773 - DNA, 20 bp, Artificial Sequence
  Description of Artificial Sequence: Synthetic oligonucleotide
  Target: ATXN1; (-) strand; PAM type: YTN; PAM sequence: TTT
tgctccagatacaatattta

SEQ ID NO: 195774 - DNA, 20 bp, Artificial Sequence
  Description of Artificial Sequence: Synthetic oligonucleotide
  Target: ATXN1; (-) strand; PAM type: YTN; PAM sequence: CTT
ttgctccagatacaatattt

SEQ ID NO: 195775 - DNA, 20 bp, Artificial Sequence
  Description of Artificial Sequence: Synthetic oligonucleotide
  Target: ATXN1; (-) strand; PAM type: YTN; PAM sequence: TTA
ccttttgctccagatacaat

SEQ ID NO: 195776 - DNA, 20 bp, Artificial Sequence
  Description of Artificial Sequence: Synthetic oligonucleotide
  Target: ATXN1; (-) strand; PAM type: YTN; PAM sequence: CTA
agaggttaccttttgctcca

SEQ ID NO: 195777 - DNA, 20 bp, Artificial Sequence
  Description of Artificial Sequence: Synthetic oligonucleotide
  Target: ATXN1; (-) strand; PAM type: YTN; PAM sequence: CTG
ctaagaggttaccttttgct

SEQ ID NO: 195778 - DNA, 20 bp, Artificial Sequence
  Description of Artificial Sequence: Synthetic oligonucleotide
  Target: ATXN1; (-) strand; PAM type: YTN; PAM sequence: TTC
cgacaatggatgaatctgct

SEQ ID NO: 195779 - DNA, 20 bp, Artificial Sequence
  Description of Artificial Sequence: Synthetic oligonucleotide
  Target: ATXN1; (-) strand; PAM type: YTN; PAM sequence: TTG
tacagtccaaataagattcc

SEQ ID NO: 195780 - DNA, 20 bp, Artificial Sequence
  Description of Artificial Sequence: Synthetic oligonucleotide
  Target: ATXN1; (-) strand; PAM type: YTN; PAM sequence: TTT
gtacagtccaaataagattc

SEQ ID NO: 195781 - DNA, 20 bp, Artificial Sequence
  Description of Artificial Sequence: Synthetic oligonucleotide
  Target: ATXN1; (-) strand; PAM type: YTN; PAM sequence: TTT
tgtacagtccaaataagatt

SEQ ID NO: 195782 - DNA, 20 bp, Artificial Sequence
  Description of Artificial Sequence: Synthetic oligonucleotide
  Target: ATXN1; (-) strand; PAM type: YTN; PAM sequence: TTA
agtaaaacgatggggtagtc

SEQ ID NO: 195783 - DNA, 20 bp, Artificial Sequence
  Description of Artificial Sequence: Synthetic oligonucleotide
  Target: ATXN1; (-) strand; PAM type: YTN; PAM sequence: CTT
aagtaaaacgatggggtagt

SEQ ID NO: 195784 - DNA, 20 bp, Artificial Sequence
  Description of Artificial Sequence: Synthetic oligonucleotide
  Target: ATXN1; (-) strand; PAM type: YTN; PAM sequence: CTC
ttaagtaaaacgatggggta

SEQ ID NO: 195785 - DNA, 20 bp, Artificial Sequence
  Description of Artificial Sequence: Synthetic oligonucleotide
  Target: ATXN1; (-) strand; PAM type: YTN; PAM sequence: TTC
tcttaagtaaaacgatgggg

SEQ ID NO: 195786 - DNA, 20 bp, Artificial Sequence
  Description of Artificial Sequence: Synthetic oligonucleotide
  Target: ATXN1; (-) strand; PAM type: YTN; PAM sequence: TTC
cagtgtagatgttctcttaa

SEQ ID NO: 195787 - DNA, 20 bp, Artificial Sequence
  Description of Artificial Sequence: Synthetic oligonucleotide
  Target: ATXN1; (-) strand; PAM type: YTN; PAM sequence: CTC
cagtagattccagtgtagat

SEQ ID NO: 195788 - DNA, 20 bp, Artificial Sequence
  Description of Artificial Sequence: Synthetic oligonucleotide
  Target: ATXN1; (-) strand; PAM type: YTN; PAM sequence: CTC
caccctccagtagattccag

SEQ ID NO: 195789 - DNA, 20 bp, Artificial Sequence
  Description of Artificial Sequence: Synthetic oligonucleotide
  Target: ATXN1; (-) strand; PAM type: YTN; PAM sequence: CTC
ccacctccaccctccagtag

SEQ ID NO: 195790 - DNA, 20 bp, Artificial Sequence
  Description of Artificial Sequence: Synthetic oligonucleotide
  Target: ATXN1; (-) strand; PAM type: YTN; PAM sequence: TTG
tcctcccacctccaccctcc

SEQ ID NO: 195791 - DNA, 20 bp, Artificial Sequence
  Description of Artificial Sequence: Synthetic oligonucleotide
  Target: ATXN1; (-) strand; PAM type: YTN; PAM sequence: TTT
gtcctcccacctccaccctc

SEQ ID NO: 195792 - DNA, 20 bp, Artificial Sequence
  Description of Artificial Sequence: Synthetic oligonucleotide
  Target: ATXN1; (-) strand; PAM type: YTN; PAM sequence: CTT
tgtcctcccacctccaccct

SEQ ID NO: 195793 - DNA, 20 bp, Artificial Sequence
  Description of Artificial Sequence: Synthetic oligonucleotide
  Target: ATXN1; (-) strand; PAM type: YTN; PAM sequence: TTC
tttgtcctcccacctccacc

SEQ ID NO: 195794 - DNA, 20 bp, Artificial Sequence
  Description of Artificial Sequence: Synthetic oligonucleotide
  Target: ATXN1; (-) strand; PAM type: YTN; PAM sequence: CTT
ctttgtcctcccacctccac

SEQ ID NO: 195795 - DNA, 20 bp, Artificial Sequence
  Description of Artificial Sequence: Synthetic oligonucleotide
  Target: ATXN1; (-) strand; PAM type: YTN; PAM sequence: TTC
ccgatcttctttgtcctccc

SEQ ID NO: 195796 - DNA, 20 bp, Artificial Sequence
  Description of Artificial Sequence: Synthetic oligonucleotide
  Target: ATXN1; (-) strand; PAM type: YTN; PAM sequence: TTT
cccgatcttctttgtcctcc

SEQ ID NO: 195797 - DNA, 20 bp, Artificial Sequence
  Description of Artificial Sequence: Synthetic oligonucleotide
  Target: ATXN1; (-) strand; PAM type: YTN; PAM sequence: TTT
tcccgatcttctttgtcctc

SEQ ID NO: 195798 - DNA, 20 bp, Artificial Sequence
  Description of Artificial Sequence: Synthetic oligonucleotide
  Target: ATXN1; (-) strand; PAM type: YTN; PAM sequence: TTT
ttcccgatcttctttgtcct

SEQ ID NO: 195799 - DNA, 20 bp, Artificial Sequence
  Description of Artificial Sequence: Synthetic oligonucleotide
  Target: ATXN1; (-) strand; PAM type: YTN; PAM sequence: TTA
tttttcccgatcttctttgt

SEQ ID NO: 195800 - DNA, 20 bp, Artificial Sequence
  Description of Artificial Sequence: Synthetic oligonucleotide
  Target: ATXN1; (-) strand; PAM type: YTN; PAM sequence: TTA
gttatttttcccgatcttct

SEQ ID NO: 195801 - DNA, 20 bp, Artificial Sequence
  Description of Artificial Sequence: Synthetic oligonucleotide
  Target: ATXN1; (-) strand; PAM type: YTN; PAM sequence: CTA
gtaaccattagttatttttc

SEQ ID NO: 195802 - DNA, 20 bp, Artificial Sequence
  Description of Artificial Sequence: Synthetic oligonucleotide
  Target: ATXN1; (-) strand; PAM type: YTN; PAM sequence: CTA
agcctagtaaccattagtta

SEQ ID NO: 195803 - DNA, 20 bp, Artificial Sequence
  Description of Artificial Sequence: Synthetic oligonucleotide
  Target: ATXN1; (-) strand; PAM type: YTN; PAM sequence: TTG
tcaccaggtactaagcctag

SEQ ID NO: 195804 - DNA, 20 bp, Artificial Sequence
  Description of Artificial Sequence: Synthetic oligonucleotide
  Target: ATXN1; (-) strand; PAM type: YTN; PAM sequence: TTT
gtcaccaggtactaagccta

SEQ ID NO: 195805 - DNA, 20 bp, Artificial Sequence
  Description of Artificial Sequence: Synthetic oligonucleotide
  Target: ATXN1; (-) strand; PAM type: YTN; PAM sequence: TTT
tgtcaccaggtactaagcct

SEQ ID NO: 195806 - DNA, 20 bp, Artificial Sequence
  Description of Artificial Sequence: Synthetic oligonucleotide
  Target: ATXN1; (-) strand; PAM type: YTN; PAM sequence: TTA
ttttgtcaccaggtactaag

SEQ ID NO: 195807 - DNA, 20 bp, Artificial Sequence
  Description of Artificial Sequence: Synthetic oligonucleotide
  Target: ATXN1; (-) strand; PAM type: YTN; PAM sequence: TTA
cagattattttgtcaccagg

SEQ ID NO: 195808 - DNA, 20 bp, Artificial Sequence
  Description of Artificial Sequence: Synthetic oligonucleotide
  Target: ATXN1; (-) strand; PAM type: YTN; PAM sequence: TTT
acagattattttgtcaccag

SEQ ID NO: 195809 - DNA, 20 bp, Artificial Sequence
  Description of Artificial Sequence: Synthetic oligonucleotide
  Target: ATXN1; (-) strand; PAM type: YTN; PAM sequence: TTT
tacagattattttgtcacca

SEQ ID NO: 195810 - DNA, 20 bp, Artificial Sequence
  Description of Artificial Sequence: Synthetic oligonucleotide
  Target: ATXN1; (-) strand; PAM type: YTN; PAM sequence: TTG
ttttacagattattttgtca

SEQ ID NO: 195811 - DNA, 20 bp, Artificial Sequence
  Description of Artificial Sequence: Synthetic oligonucleotide
  Target: ATXN1; (-) strand; PAM type: YTN; PAM sequence: TTT
gttttacagattattttgtc

SEQ ID NO: 195812 - DNA, 20 bp, Artificial Sequence
  Description of Artificial Sequence: Synthetic oligonucleotide
  Target: ATXN1; (-) strand; PAM type: YTN; PAM sequence: TTG
tgtcatgggggtttgtttta

SEQ ID NO: 195813 - DNA, 20 bp, Artificial Sequence
  Description of Artificial Sequence: Synthetic oligonucleotide
  Target: ATXN1; (-) strand; PAM type: YTN; PAM sequence: CTT
gtgtcatgggggtttgtttt

SEQ ID NO: 195814 - DNA, 20 bp, Artificial Sequence
  Description of Artificial Sequence: Synthetic oligonucleotide
  Target: ATXN1; (-) strand; PAM type: YTN; PAM sequence: TTA
tataggtaaacttgtgtcat

SEQ ID NO: 195815 - DNA, 20 bp, Artificial Sequence
  Description of Artificial Sequence: Synthetic oligonucleotide
  Target: ATXN1; (-) strand; PAM type: YTN; PAM sequence: TTC
gttatataggtaaacttgtg

SEQ ID NO: 195816 - DNA, 20 bp, Artificial Sequence
  Description of Artificial Sequence: Synthetic oligonucleotide
  Target: ATXN1; (-) strand; PAM type: YTN; PAM sequence: TTC
agatgtacgtgtgcaggttc

SEQ ID NO: 195817 - DNA, 20 bp, Artificial Sequence
  Description of Artificial Sequence: Synthetic oligonucleotide
  Target: ATXN1; (-) strand; PAM type: YTN; PAM sequence: TTA
agttcagatgtacgtgtgca

SEQ ID NO: 195818 - DNA, 20 bp, Artificial Sequence
  Description of Artificial Sequence: Synthetic oligonucleotide
  Target: ATXN1; (-) strand; PAM type: YTN; PAM sequence: TTT
aagttcagatgtacgtgtgc

SEQ ID NO: 195819 - DNA, 20 bp, Artificial Sequence
  Description of Artificial Sequence: Synthetic oligonucleotide
  Target: ATXN1; (-) strand; PAM type: YTN; PAM sequence: TTT
taagttcagatgtacgtgtg

SEQ ID NO: 195820 - DNA, 20 bp, Artificial Sequence
  Description of Artificial Sequence: Synthetic oligonucleotide
  Target: ATXN1; (-) strand; PAM type: YTN; PAM sequence: TTA
tattttaagttcagatgtac

SEQ ID NO: 195821 - DNA, 20 bp, Artificial Sequence
  Description of Artificial Sequence: Synthetic oligonucleotide
  Target: ATXN1; (-) strand; PAM type: YTN; PAM sequence: CTT
atattttaagttcagatgta

SEQ ID NO: 195822 - DNA, 20 bp, Artificial Sequence
  Description of Artificial Sequence: Synthetic oligonucleotide
  Target: ATXN1; (-) strand; PAM type: YTN; PAM sequence: TTA
acttatattttaagttcaga

SEQ ID NO: 195823 - DNA, 20 bp, Artificial Sequence
  Description of Artificial Sequence: Synthetic oligonucleotide
  Target: ATXN1; (-) strand; PAM type: YTN; PAM sequence: TTT
aacttatattttaagttcag

SEQ ID NO: 195824 - DNA, 20 bp, Artificial Sequence
  Description of Artificial Sequence: Synthetic oligonucleotide
  Target: ATXN1; (-) strand; PAM type: YTN; PAM sequence: TTC
atttaacttatattttaagt

SEQ ID NO: 195825 - DNA, 20 bp, Artificial Sequence
  Description of Artificial Sequence: Synthetic oligonucleotide
  Target: ATXN1; (-) strand; PAM type: YTN; PAM sequence: TTA
ttcatttaacttatatttta

SEQ ID NO: 195826 - DNA, 20 bp, Artificial Sequence
  Description of Artificial Sequence: Synthetic oligonucleotide
  Target: ATXN1; (-) strand; PAM type: YTN; PAM sequence: TTT
attcatttaacttatatttt

SEQ ID NO: 195827 - DNA, 20 bp, Artificial Sequence
  Description of Artificial Sequence: Synthetic oligonucleotide
  Target: ATXN1; (-) strand; PAM type: YTN; PAM sequence: TTT
tattcatttaacttatattt

SEQ ID NO: 195828 - DNA, 20 bp, Artificial Sequence
  Description of Artificial Sequence: Synthetic oligonucleotide
  Target: ATXN1; (-) strand; PAM type: YTN; PAM sequence: TTT
ttattcatttaacttatatt

SEQ ID NO: 195829 - DNA, 20 bp, Artificial Sequence
  Description of Artificial Sequence: Synthetic oligonucleotide
  Target: ATXN1; (-) strand; PAM type: YTN; PAM sequence: TTT
tttattcatttaacttatat

SEQ ID NO: 195830 - DNA, 20 bp, Artificial Sequence
  Description of Artificial Sequence: Synthetic oligonucleotide
  Target: ATXN1; (-) strand; PAM type: YTN; PAM sequence: TTT
ttttattcatttaacttata

SEQ ID NO: 195831 - DNA, 20 bp, Artificial Sequence
  Description of Artificial Sequence: Synthetic oligonucleotide
  Target: ATXN1; (-) strand; PAM type: YTN; PAM sequence: CTT
tttttattcatttaacttat

SEQ ID NO: 195832 - DNA, 20 bp, Artificial Sequence
  Description of Artificial Sequence: Synthetic oligonucleotide
  Target: ATXN1; (-) strand; PAM type: YTN; PAM sequence: TTC
tttttttattcatttaactt

SEQ ID NO: 195833 - DNA, 20 bp, Artificial Sequence
  Description of Artificial Sequence: Synthetic oligonucleotide
  Target: ATXN1; (-) strand; PAM type: YTN; PAM sequence: TTT
ctttttttattcatttaact

SEQ ID NO: 195834 - DNA, 20 bp, Artificial Sequence
  Description of Artificial Sequence: Synthetic oligonucleotide
  Target: ATXN1; (-) strand; PAM type: YTN; PAM sequence: TTT
tctttttttattcatttaac

SEQ ID NO: 195835 - DNA, 20 bp, Artificial Sequence
  Description of Artificial Sequence: Synthetic oligonucleotide
  Target: ATXN1; (-) strand; PAM type: YTN; PAM sequence: CTA
tgtgtggatgttttcttttt

SEQ ID NO: 195836 - DNA, 20 bp, Artificial Sequence
  Description of Artificial Sequence: Synthetic oligonucleotide
  Target: ATXN1; (-) strand; PAM type: YTN; PAM sequence: TTC
tatgtgtggatgttttcttt

SEQ ID NO: 195837 - DNA, 20 bp, Artificial Sequence
  Description of Artificial Sequence: Synthetic oligonucleotide
  Target: ATXN1; (-) strand; PAM type: YTN; PAM sequence: CTT
ctatgtgtggatgttttctt

SEQ ID NO: 195838 - DNA, 20 bp, Artificial Sequence
  Description of Artificial Sequence: Synthetic oligonucleotide
  Target: ATXN1; (-) strand; PAM type: YTN; PAM sequence: TTG
acttctatgtgtggatgttt

SEQ ID NO: 195839 - DNA, 20 bp, Artificial Sequence
  Description of Artificial Sequence: Synthetic oligonucleotide
  Target: ATXN1; (-) strand; PAM type: YTN; PAM sequence: CTG
attgacttctatgtgtggat

SEQ ID NO: 195840 - DNA, 20 bp, Artificial Sequence
  Description of Artificial Sequence: Synthetic oligonucleotide
  Target: ATXN1; (-) strand; PAM type: YTN; PAM sequence: CTA
cacatacacacacacgcata

SEQ ID NO: 195841 - DNA, 20 bp, Artificial Sequence
  Description of Artificial Sequence: Synthetic oligonucleotide
  Target: ATXN1; (-) strand; PAM type: YTN; PAM sequence: TTG
agataatgggaaagaaatgc

SEQ ID NO: 195842 - DNA, 20 bp, Artificial Sequence
  Description of Artificial Sequence: Synthetic oligonucleotide
  Target: ATXN1; (-) strand; PAM type: YTN; PAM sequence: TTA
tgtataataagcattgagat

SEQ ID NO: 195843 - DNA, 20 bp, Artificial Sequence
  Description of Artificial Sequence: Synthetic oligonucleotide
  Target: ATXN1; (-) strand; PAM type: YTN; PAM sequence: TTA
aaaaattatgtataataagc

SEQ ID NO: 195844 - DNA, 20 bp, Artificial Sequence
  Description of Artificial Sequence: Synthetic oligonucleotide
  Target: ATXN1; (-) strand; PAM type: YTN; PAM sequence: CTT
aaaaaattatgtataataag

SEQ ID NO: 195845 - DNA, 20 bp, Artificial Sequence
  Description of Artificial Sequence: Synthetic oligonucleotide
  Target: ATXN1; (-) strand; PAM type: YTN; PAM sequence: TTG
acttaaaaaattatgtataa

SEQ ID NO: 195846 - DNA, 20 bp, Artificial Sequence
  Description of Artificial Sequence: Synthetic oligonucleotide
  Target: ATXN1; (-) strand; PAM type: YTN; PAM sequence: TTA
agcattgacttaaaaaatta

SEQ ID NO: 195847 - DNA, 20 bp, Artificial Sequence
  Description of Artificial Sequence: Synthetic oligonucleotide
  Target: ATXN1; (-) strand; PAM type: YTN; PAM sequence: TTG
aagagtattaagcattgact

SEQ ID NO: 195848 - DNA, 20 bp, Artificial Sequence
  Description of Artificial Sequence: Synthetic oligonucleotide
  Target: ATXN1; (-) strand; PAM type: YTN; PAM sequence: TTG
gcagttgaagagtattaagc

SEQ ID NO: 195849 - DNA, 20 bp, Artificial Sequence
  Description of Artificial Sequence: Synthetic oligonucleotide
  Target: ATXN1; (-) strand; PAM type: YTN; PAM sequence: TTT
ggcagttgaagagtattaag

SEQ ID NO: 195850 - DNA, 20 bp, Artificial Sequence
  Description of Artificial Sequence: Synthetic oligonucleotide
  Target: ATXN1; (-) strand; PAM type: YTN; PAM sequence: TTT
tggcagttgaagagtattaa

SEQ ID NO: 195851 - DNA, 20 bp, Artificial Sequence
  Description of Artificial Sequence: Synthetic oligonucleotide
  Target: ATXN1; (-) strand; PAM type: YTN; PAM sequence: TTA
tatggtatgttttggcagtt

SEQ ID NO: 195852 - DNA, 20 bp, Artificial Sequence
  Description of Artificial Sequence: Synthetic oligonucleotide
  Target: ATXN1; (-) strand; PAM type: YTN; PAM sequence: TTT
atatggtatgttttggcagt

SEQ ID NO: 195853 - DNA, 20 bp, Artificial Sequence
  Description of Artificial Sequence: Synthetic oligonucleotide
  Target: ATXN1; (-) strand; PAM type: YTN; PAM sequence: TTG
aagagtttatatggtatgtt

SEQ ID NO: 195854 - DNA, 20 bp, Artificial Sequence
  Description of Artificial Sequence: Synthetic oligonucleotide
  Target: ATXN1; (-) strand; PAM type: YTN; PAM sequence: TTT
gaagagtttatatggtatgt

SEQ ID NO: 195855 - DNA, 20 bp, Artificial Sequence
  Description of Artificial Sequence: Synthetic oligonucleotide
  Target: ATXN1; (-) strand; PAM type: YTN; PAM sequence: CTT
tgaagagtttatatggtatg

SEQ ID NO: 195856 - DNA, 20 bp, Artificial Sequence
  Description of Artificial Sequence: Synthetic oligonucleotide
  Target: ATXN1; (-) strand; PAM type: YTN; PAM sequence: CTG
tctttgaagagtttatatgg

SEQ ID NO: 195857 - DNA, 20 bp, Artificial Sequence
  Description of Artificial Sequence: Synthetic oligonucleotide
  Target: ATXN1; (-) strand; PAM type: YTN; PAM sequence: TTA
aggtgtatggacactgtctt

SEQ ID NO: 195858 - DNA, 20 bp, Artificial Sequence
  Description of Artificial Sequence: Synthetic oligonucleotide
  Target: ATXN1; (-) strand; PAM type: YTN; PAM sequence: TTA
ttaaggtgtatggacactgt

SEQ ID NO: 195859 - DNA, 20 bp, Artificial Sequence
  Description of Artificial Sequence: Synthetic oligonucleotide
  Target: ATXN1; (-) strand; PAM type: YTN; PAM sequence: CTT
attaaggtgtatggacactg

SEQ ID NO: 195860 - DNA, 20 bp, Artificial Sequence
  Description of Artificial Sequence: Synthetic oligonucleotide
  Target: ATXN1; (-) strand; PAM type: YTN; PAM sequence: TTA
gaggacttattaaggtgtat

SEQ ID NO: 195861 - DNA, 20 bp, Artificial Sequence
  Description of Artificial Sequence: Synthetic oligonucleotide
  Target: ATXN1; (-) strand; PAM type: YTN; PAM sequence: CTG
ttagaggacttattaaggtg

SEQ ID NO: 195862 - DNA, 20 bp, Artificial Sequence
  Description of Artificial Sequence: Synthetic oligonucleotide
  Target: ATXN1; (-) strand; PAM type: YTN; PAM sequence: CTA
gctgttagaggacttattaa

SEQ ID NO: 195863 - DNA, 20 bp, Artificial Sequence
  Description of Artificial Sequence: Synthetic oligonucleotide
  Target: ATXN1; (-) strand; PAM type: YTN; PAM sequence: TTA
tgctagctgttagaggactt

SEQ ID NO: 195864 - DNA, 20 bp, Artificial Sequence
  Description of Artificial Sequence: Synthetic oligonucleotide
  Target: ATXN1; (-) strand; PAM type: YTN; PAM sequence: CTT
atgctagctgttagaggact

SEQ ID NO: 195865 - DNA, 20 bp, Artificial Sequence
  Description of Artificial Sequence: Synthetic oligonucleotide
  Target: ATXN1; (-) strand; PAM type: YTN; PAM sequence: TTG
accatgtatacagtaaactt

SEQ ID NO: 195866 - DNA, 20 bp, Artificial Sequence
  Description of Artificial Sequence: Synthetic oligonucleotide
  Target: ATXN1; (-) strand; PAM type: YTN; PAM sequence: CTT
gaccatgtatacagtaaact

SEQ ID NO: 195867 - DNA, 20 bp, Artificial Sequence
  Description of Artificial Sequence: Synthetic oligonucleotide
  Target: ATXN1; (-) strand; PAM type: YTN; PAM sequence: TTC
aataccttgaccatgtatac

SEQ ID NO: 195868 - DNA, 20 bp, Artificial Sequence
  Description of Artificial Sequence: Synthetic oligonucleotide
  Target: ATXN1; (-) strand; PAM type: YTN; PAM sequence: CTT
caataccttgaccatgtata

SEQ ID NO: 195869 - DNA, 20 bp, Artificial Sequence
  Description of Artificial Sequence: Synthetic oligonucleotide
  Target: ATXN1; (-) strand; PAM type: YTN; PAM sequence: CTC
ttcaataccttgaccatgta

SEQ ID NO: 195870 - DNA, 20 bp, Artificial Sequence
  Description of Artificial Sequence: Synthetic oligonucleotide
  Target: ATXN1; (-) strand; PAM type: YTN; PAM sequence: TTC
tcttcaataccttgaccatg

SEQ ID NO: 195871 - DNA, 20 bp, Artificial Sequence
  Description of Artificial Sequence: Synthetic oligonucleotide
  Target: ATXN1; (-) strand; PAM type: YTN; PAM sequence: TTG
tacaaattctcttcaatacc

SEQ ID NO: 195872 - DNA, 20 bp, Artificial Sequence
  Description of Artificial Sequence: Synthetic oligonucleotide
  Target: ATXN1; (-) strand; PAM type: YTN; PAM sequence: TTT
gtacaaattctcttcaatac

SEQ ID NO: 195873 - DNA, 20 bp, Artificial Sequence
  Description of Artificial Sequence: Synthetic oligonucleotide
  Target: ATXN1; (-) strand; PAM type: YTN; PAM sequence: TTT
tgtacaaattctcttcaata

SEQ ID NO: 195874 - DNA, 20 bp, Artificial Sequence
  Description of Artificial Sequence: Synthetic oligonucleotide
  Target: ATXN1; (-) strand; PAM type: YTN; PAM sequence: TTG
ttttgtacaaattctcttca

SEQ ID NO: 195875 - DNA, 20 bp, Artificial Sequence
  Description of Artificial Sequence: Synthetic oligonucleotide
  Target: ATXN1; (-) strand; PAM type: YTN; PAM sequence: CTG
attgttttgtacaaattctc

SEQ ID NO: 195876 - DNA, 20 bp, Artificial Sequence
  Description of Artificial Sequence: Synthetic oligonucleotide
  Target: ATXN1; (-) strand; PAM type: YTN; PAM sequence: CTG
tggatgtgctgattgttttg

SEQ ID NO: 195877 - DNA, 20 bp, Artificial Sequence
  Description of Artificial Sequence: Synthetic oligonucleotide
  Target: ATXN1; (-) strand; PAM type: YTN; PAM sequence: TTG
agatactgtggatgtgctga

SEQ ID NO: 195878 - DNA, 20 bp, Artificial Sequence
  Description of Artificial Sequence: Synthetic oligonucleotide
  Target: ATXN1; (-) strand; PAM type: YTN; PAM sequence: TTT
gagatactgtggatgtgctg

SEQ ID NO: 195879 - DNA, 20 bp, Artificial Sequence
  Description of Artificial Sequence: Synthetic oligonucleotide
  Target: ATXN1; (-) strand; PAM type: YTN; PAM sequence: TTT
tgagatactgtggatgtgct

SEQ ID NO: 195880 - DNA, 20 bp, Artificial Sequence
  Description of Artificial Sequence: Synthetic oligonucleotide
  Target: ATXN1; (-) strand; PAM type: YTN; PAM sequence: TTG
ggaattttgagatactgtgg

SEQ ID NO: 195881 - DNA, 20 bp, Artificial Sequence
  Description of Artificial Sequence: Synthetic oligonucleotide
  Target: ATXN1; (-) strand; PAM type: YTN; PAM sequence: TTT
gggaattttgagatactgtg

SEQ ID NO: 195882 - DNA, 20 bp, Artificial Sequence
  Description of Artificial Sequence: Synthetic oligonucleotide
  Target: ATXN1; (-) strand; PAM type: YTN; PAM sequence: TTG
ccaatttgggaattttgaga

SEQ ID NO: 195883 - DNA, 20 bp, Artificial Sequence
  Description of Artificial Sequence: Synthetic oligonucleotide
  Target: ATXN1; (-) strand; PAM type: YTN; PAM sequence: CTA
aggcagtgattgccaatttg

SEQ ID NO: 195884 - DNA, 20 bp, Artificial Sequence
  Description of Artificial Sequence: Synthetic oligonucleotide
  Target: ATXN1; (-) strand; PAM type: YTN; PAM sequence: TTG
ctaaggcagtgattgccaat

SEQ ID NO: 195885 - DNA, 20 bp, Artificial Sequence
  Description of Artificial Sequence: Synthetic oligonucleotide
  Target: ATXN1; (-) strand; PAM type: YTN; PAM sequence: TTT
gctaaggcagtgattgccaa

SEQ ID NO: 195886 - DNA, 20 bp, Artificial Sequence
  Description of Artificial Sequence: Synthetic oligonucleotide
  Target: ATXN1; (-) strand; PAM type: YTN; PAM sequence: CTT
tgctaaggcagtgattgcca

SEQ ID NO: 195887 - DNA, 20 bp, Artificial Sequence
  Description of Artificial Sequence: Synthetic oligonucleotide
  Target: ATXN1; (-) strand; PAM type: YTN; PAM sequence: CTC
caggtcagagatgcagcttt

SEQ ID NO: 195888 - DNA, 20 bp, Artificial Sequence
  Description of Artificial Sequence: Synthetic oligonucleotide
  Target: ATXN1; (-) strand; PAM type: YTN; PAM sequence: CTA
tctccaggtcagagatgcag

SEQ ID NO: 195889 - DNA, 20 bp, Artificial Sequence
  Description of Artificial Sequence: Synthetic oligonucleotide
  Target: ATXN1; (-) strand; PAM type: YTN; PAM sequence: CTC
tatctccaggtcagagatgc

SEQ ID NO: 195890 - DNA, 20 bp, Artificial Sequence
  Description of Artificial Sequence: Synthetic oligonucleotide
  Target: ATXN1; (-) strand; PAM type: YTN; PAM sequence: TTC
ccctctatctccaggtcaga

SEQ ID NO: 195891 - DNA, 20 bp, Artificial Sequence
  Description of Artificial Sequence: Synthetic oligonucleotide
  Target: ATXN1; (-) strand; PAM type: YTN; PAM sequence: CTT
cccctctatctccaggtcag

SEQ ID NO: 195892 - DNA, 20 bp, Artificial Sequence
  Description of Artificial Sequence: Synthetic oligonucleotide
  Target: ATXN1; (-) strand; PAM type: YTN; PAM sequence: CTC
ttcccctctatctccaggtc

SEQ ID NO: 195893 - DNA, 20 bp, Artificial Sequence
  Description of Artificial Sequence: Synthetic oligonucleotide
  Target: ATXN1; (-) strand; PAM type: YTN; PAM sequence: TTC
tcttcccctctatctccagg

SEQ ID NO: 195894 - DNA, 20 bp, Artificial Sequence
  Description of Artificial Sequence: Synthetic oligonucleotide
  Target: ATXN1; (-) strand; PAM type: YTN; PAM sequence: CTT
ctcttcccctctatctccag

SEQ ID NO: 195895 - DNA, 20 bp, Artificial Sequence
  Description of Artificial Sequence: Synthetic oligonucleotide
  Target: ATXN1; (-) strand; PAM type: YTN; PAM sequence: CTG
cttctcttcccctctatctc

SEQ ID NO: 195896 - DNA, 20 bp, Artificial Sequence
  Description of Artificial Sequence: Synthetic oligonucleotide
  Target: ATXN1; (-) strand; PAM type: YTN; PAM sequence: TTC
ctgcttctcttcccctctat

SEQ ID NO: 195897 - DNA, 20 bp, Artificial Sequence
  Description of Artificial Sequence: Synthetic oligonucleotide
  Target: ATXN1; (-) strand; PAM type: YTN; PAM sequence: TTT
cctgcttctcttcccctcta

SEQ ID NO: 195898 - DNA, 20 bp, Artificial Sequence
  Description of Artificial Sequence: Synthetic oligonucleotide
  Target: ATXN1; (-) strand; PAM type: YTN; PAM sequence: CTA
aagatggtttcctgcttctc

SEQ ID NO: 195899 - DNA, 20 bp, Artificial Sequence
  Description of Artificial Sequence: Synthetic oligonucleotide
  Target: ATXN1; (-) strand; PAM type: YTN; PAM sequence: CTG
gcaccctaaagatggtttcc

SEQ ID NO: 195900 - DNA, 20 bp, Artificial Sequence
  Description of Artificial Sequence: Synthetic oligonucleotide
  Target: ATXN1; (-) strand; PAM type: YTN; PAM sequence: CTG
cctggcaccctaaagatggt

SEQ ID NO: 195901 - DNA, 20 bp, Artificial Sequence
  Description of Artificial Sequence: Synthetic oligonucleotide
  Target: ATXN1; (-) strand; PAM type: YTN; PAM sequence: TTG
ctgcctggcaccctaaagat

SEQ ID NO: 195902 - DNA, 20 bp, Artificial Sequence
  Description of Artificial Sequence: Synthetic oligonucleotide
  Target: ATXN1; (-) strand; PAM type: YTN; PAM sequence: CTT
gctgcctggcaccctaaaga

SEQ ID NO: 195903 - DNA, 20 bp, Artificial Sequence
  Description of Artificial Sequence: Synthetic oligonucleotide
  Target: ATXN1; (-) strand; PAM type: YTN; PAM sequence: CTG
ccccgaaacgtagaccacag

SEQ ID NO: 195904 - DNA, 20 bp, Artificial Sequence
  Description of Artificial Sequence: Synthetic oligonucleotide
  Target: ATXN1; (-) strand; PAM type: YTN; PAM sequence: TTA
tggaagagggacctgccccg

SEQ ID NO: 195905 - DNA, 20 bp, Artificial Sequence
  Description of Artificial Sequence: Synthetic oligonucleotide
  Target: ATXN1; (-) strand; PAM type: YTN; PAM sequence: CTG
tggtgagaggagttatggaa

SEQ ID NO: 195906 - DNA, 20 bp, Artificial Sequence
  Description of Artificial Sequence: Synthetic oligonucleotide
  Target: ATXN1; (-) strand; PAM type: YTN; PAM sequence: TTA
gctgtggtgagaggagttat

SEQ ID NO: 195907 - DNA, 20 bp, Artificial Sequence
  Description of Artificial Sequence: Synthetic oligonucleotide
  Target: ATXN1; (-) strand; PAM type: YTN; PAM sequence: TTT
agctgtggtgagaggagtta

SEQ ID NO: 195908 - DNA, 20 bp, Artificial Sequence
  Description of Artificial Sequence: Synthetic oligonucleotide
  Target: ATXN1; (-) strand; PAM type: YTN; PAM sequence: CTT
tagctgtggtgagaggagtt

SEQ ID NO: 195909 - DNA, 20 bp, Artificial Sequence
  Description of Artificial Sequence: Synthetic oligonucleotide
  Target: ATXN1; (-) strand; PAM type: YTN; PAM sequence: CTG
atctttagctgtggtgagag

SEQ ID NO: 195910 - DNA, 20 bp, Artificial Sequence
  Description of Artificial Sequence: Synthetic oligonucleotide
  Target: ATXN1; (-) strand; PAM type: YTN; PAM sequence: CTC
tgatctttagctgtggtgag

SEQ ID NO: 195911 - DNA, 20 bp, Artificial Sequence
  Description of Artificial Sequence: Synthetic oligonucleotide
  Target: ATXN1; (-) strand; PAM type: YTN; PAM sequence: TTG
gtgaagtagctctgatcttt

SEQ ID NO: 195912 - DNA, 20 bp, Artificial Sequence
  Description of Artificial Sequence: Synthetic oligonucleotide
  Target: ATXN1; (-) strand; PAM type: YTN; PAM sequence: TTT
ggtgaagtagctctgatctt

SEQ ID NO: 195913 - DNA, 20 bp, Artificial Sequence
  Description of Artificial Sequence: Synthetic oligonucleotide
  Target: ATXN1; (-) strand; PAM type: YTN; PAM sequence: CTT
tggtgaagtagctctgatct

SEQ ID NO: 195914 - DNA, 20 bp, Artificial Sequence
  Description of Artificial Sequence: Synthetic oligonucleotide
  Target: ATXN1; (-) strand; PAM type: YTN; PAM sequence: CTA
aactttggtgaagtagctct

SEQ ID NO: 195915 - DNA, 20 bp, Artificial Sequence
  Description of Artificial Sequence: Synthetic oligonucleotide
  Target: ATXN1; (-) strand; PAM type: YTN; PAM sequence: TTC
gtactaaactttggtgaagt

SEQ ID NO: 195916 - DNA, 20 bp, Artificial Sequence
  Description of Artificial Sequence: Synthetic oligonucleotide
  Target: ATXN1; (-) strand; PAM type: YTN; PAM sequence: CTA
ttcgtactaaactttggtga

SEQ ID NO: 195917 - DNA, 20 bp, Artificial Sequence
  Description of Artificial Sequence: Synthetic oligonucleotide
  Target: ATXN1; (-) strand; PAM type: YTN; PAM sequence: TTC
ctattcgtactaaactttgg

SEQ ID NO: 195918 - DNA, 20 bp, Artificial Sequence
  Description of Artificial Sequence: Synthetic oligonucleotide
  Target: ATXN1; (-) strand; PAM type: YTN; PAM sequence: TTT
cctattcgtactaaactttg

SEQ ID NO: 195919 - DNA, 20 bp, Artificial Sequence
  Description of Artificial Sequence: Synthetic oligonucleotide
  Target: ATXN1; (-) strand; PAM type: YTN; PAM sequence: CTG
tgatatttcctattcgtact

SEQ ID NO: 195920 - DNA, 20 bp, Artificial Sequence
  Description of Artificial Sequence: Synthetic oligonucleotide
  Target: ATXN1; (-) strand; PAM type: YTN; PAM sequence: CTC
tgtgatatttcctattcgta

SEQ ID NO: 195921 - DNA, 20 bp, Artificial Sequence
  Description of Artificial Sequence: Synthetic oligonucleotide
  Target: ATXN1; (-) strand; PAM type: YTN; PAM sequence: TTC
ctctgtgatatttcctattc

SEQ ID NO: 195922 - DNA, 20 bp, Artificial Sequence
  Description of Artificial Sequence: Synthetic oligonucleotide
  Target: ATXN1; (-) strand; PAM type: YTN; PAM sequence: TTT
cctctgtgatatttcctatt

SEQ ID NO: 195923 - DNA, 20 bp, Artificial Sequence
  Description of Artificial Sequence: Synthetic oligonucleotide
  Target: ATXN1; (-) strand; PAM type: YTN; PAM sequence: CTT
tcctctgtgatatttcctat

SEQ ID NO: 195924 - DNA, 20 bp, Artificial Sequence
  Description of Artificial Sequence: Synthetic oligonucleotide
  Target: ATXN1; (-) strand; PAM type: YTN; PAM sequence: CTG
cctttcctctgtgatatttc

SEQ ID NO: 195925 - DNA, 20 bp, Artificial Sequence
  Description of Artificial Sequence: Synthetic oligonucleotide
  Target: ATXN1; (-) strand; PAM type: YTN; PAM sequence: TTC
tgcctttcctctgtgatatt

SEQ ID NO: 195926 - DNA, 20 bp, Artificial Sequence
  Description of Artificial Sequence: Synthetic oligonucleotide
  Target: ATXN1; (-) strand; PAM type: YTN; PAM sequence: CTG
aattctgcctttcctctgtg

SEQ ID NO: 195927 - DNA, 20 bp, Artificial Sequence
  Description of Artificial Sequence: Synthetic oligonucleotide
  Target: ATXN1; (-) strand; PAM type: YTN; PAM sequence: TTA
aagtcacagaatctgaattc

SEQ ID NO: 195928 - DNA, 20 bp, Artificial Sequence
  Description of Artificial Sequence: Synthetic oligonucleotide
  Target: ATXN1; (-) strand; PAM type: YTN; PAM sequence: TTT
aaagtcacagaatctgaatt

SEQ ID NO: 195929 - DNA, 20 bp, Artificial Sequence
  Description of Artificial Sequence: Synthetic oligonucleotide
  Target: ATXN1; (-) strand; PAM type: YTN; PAM sequence: TTT
taaagtcacagaatctgaat

SEQ ID NO: 195930 - DNA, 20 bp, Artificial Sequence
  Description of Artificial Sequence: Synthetic oligonucleotide
  Target: ATXN1; (-) strand; PAM type: YTN; PAM sequence: TTT
ttaaagtcacagaatctgaa

SEQ ID NO: 195931 - DNA, 20 bp, Artificial Sequence
  Description of Artificial Sequence: Synthetic oligonucleotide
  Target: ATXN1; (-) strand; PAM type: YTN; PAM sequence: CTT
tttaaagtcacagaatctga

SEQ ID NO: 195932 - DNA, 20 bp, Artificial Sequence
  Description of Artificial Sequence: Synthetic oligonucleotide
  Target: ATXN1; (-) strand; PAM type: YTN; PAM sequence: TTG
cactttttaaagtcacagaa

SEQ ID NO: 195933 - DNA, 20 bp, Artificial Sequence
  Description of Artificial Sequence: Synthetic oligonucleotide
  Target: ATXN1; (-) strand; PAM type: YTN; PAM sequence: CTG
ggttgcactttttaaagtca

SEQ ID NO: 195934 - DNA, 20 bp, Artificial Sequence
  Description of Artificial Sequence: Synthetic oligonucleotide
  Target: ATXN1; (-) strand; PAM type: YTN; PAM sequence: CTG
cctgggttgcactttttaaa

SEQ ID NO: 195935 - DNA, 20 bp, Artificial Sequence
  Description of Artificial Sequence: Synthetic oligonucleotide
  Target: ATXN1; (-) strand; PAM type: YTN; PAM sequence: CTG
cgtcctgcctgggttgcact

SEQ ID NO: 195936 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgcgtc

SEQ ID NO: 195937 - DNA, 20 bp, Artificial Sequence
  Description of Artificial Sequence: Synthetic oligonucleotide
  Target: ATXN1; (-) strand; PAM type: YTN; PAM sequence: TTA
ggattacaggtgtgagccac

SEQ ID NO: 195938 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgttaggattacag

SEQ ID NO: 195939 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgttagga

SEQ ID NO: 195940 - DNA, 20 bp, Artificial Sequence
  Description of Artificial Sequence: Synthetic oligonucleotide
  Target: ATXN1; (-) strand; PAM type: YTN; PAM sequence: CTG
gcctcggcctcccaaagtgt

SEQ ID NO: 195941 - DNA, 20 bp, Artificial Sequence
  Description of Artificial Sequence: Synthetic oligonucleotide
  Target: ATXN1; (-) strand; PAM type: YTN; PAM sequence: CTC
aggtgatccactggcctcgg

SEQ ID NO: 195942 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccactggc

SEQ ID NO: 195943 - DNA, 20 bp, Artificial Sequence
  Description of Artificial Sequence: Synthetic oligonucleotide
  Target: ATXN1; (-) strand; PAM type: YTN; PAM sequence: TTC
tgacctcaggtgatccactg

SEQ ID NO: 195944 - DNA, 20 bp, Artificial Sequence
  Description of Artificial Sequence: Synthetic oligonucleotide
  Target: ATXN1; (-) strand; PAM type: YTN; PAM sequence: CTT
ctgacctcaggtgatccact

SEQ ID NO: 195945 - DNA, 20 bp, Artificial Sequence
  Description of Artificial Sequence: Synthetic oligonucleotide
  Target: ATXN1; (-) strand; PAM type: YTN; PAM sequence: TTG
aacttctgacctcaggtgat

SEQ ID NO: 195946 - DNA, 20 bp, Artificial Sequence
  Description of Artificial Sequence: Synthetic oligonucleotide
  Target: ATXN1; (-) strand; PAM type: YTN; PAM sequence: CTT
gaacttctgacctcaggtga

SEQ ID NO: 195947 - DNA, 20 bp, Artificial Sequence
  Description of Artificial Sequence: Synthetic oligonucleotide
  Target: ATXN1; (-) strand; PAM type: YTN; PAM sequence: CTG
gtcttgaacttctgacctca

SEQ ID NO: 195948 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtcttgaactt

SEQ ID NO: 195949 - DNA, 20 bp, Artificial Sequence
  Description of Artificial Sequence: Synthetic oligonucleotide
  Target: ATXN1; (-) strand; PAM type: YTN; PAM sequence: TTC
gccatgttggccaggctggt

SEQ ID NO: 195950 - DNA, 20 bp, Artificial Sequence
  Description of Artificial Sequence: Synthetic oligonucleotide
  Target: ATXN1; (-) strand; PAM type: YTN; PAM sequence: TTT
cgccatgttggccaggctgg

SEQ ID NO: 195951 - DNA, 20 bp, Artificial Sequence
  Description of Artificial Sequence: Synthetic oligonucleotide
  Target: ATXN1; (-) strand; PAM type: YTN; PAM sequence: TTA
gtagagacagggtttcgcca

SEQ ID NO: 195952 - DNA, 20 bp, Artificial Sequence
  Description of Artificial Sequence: Synthetic oligonucleotide
  Target: ATXN1; (-) strand; PAM type: YTN; PAM sequence: TTT
agtagagacagggtttcgcc

SEQ ID NO: 195953 - DNA, 20 bp, Artificial Sequence
  Description of Artificial Sequence: Synthetic oligonucleotide
  Target: ATXN1; (-) strand; PAM type: YTN; PAM sequence: TTG
tatatttagtagagacaggg

SEQ ID NO: 195954 - DNA, 20 bp, Artificial Sequence
  Description of Artificial Sequence: Synthetic oligonucleotide
  Target: ATXN1; (-) strand; PAM type: YTN; PAM sequence: TTT
gtatatttagtagagacagg

SEQ ID NO: 195955 - DNA, 20 bp, Artificial Sequence
  Description of Artificial Sequence: Synthetic oligonucleotide
  Target: ATXN1; (-) strand; PAM type: YTN; PAM sequence: TTT
tgtatatttagtagagacag

SEQ ID NO: 195956 - DNA, 20 bp, Artificial Sequence
  Description of Artificial Sequence: Synthetic oligonucleotide
  Target: ATXN1; (-) strand; PAM type: YTN; PAM sequence: TTT
ttgtatatttagtagagaca

SEQ ID NO: 195957 - DNA, 20 bp, Artificial Sequence
  Description of Artificial Sequence: Synthetic oligonucleotide
  Target: ATXN1; (-) strand; PAM type: YTN; PAM sequence: CTC
atttttgtatatttagtaga

SEQ ID NO: 195958 - DNA, 20 bp, Artificial Sequence
  Description of Artificial Sequence: Synthetic oligonucleotide
  Target: ATXN1; (-) strand; PAM type: YTN; PAM sequence: CTG
ccaccacgcccagctcattt

SEQ ID NO: 195959 - DNA, 20 bp, Artificial Sequence
  Description of Artificial Sequence: Synthetic oligonucleotide
  Target: ATXN1; (-) strand; PAM type: YTN; PAM sequence: TTA
caggtgtctgccaccacgcc

SEQ ID NO: 195960 - DNA, 20 bp, Artificial Sequence
  Description of Artificial Sequence: Synthetic oligonucleotide
  Target: ATXN1; (-) strand; PAM type: YTN; PAM sequence: CTG
agattacaggtgtctgccac

SEQ ID NO: 195961 - DNA, 20 bp, Artificial Sequence
  Description of Artificial Sequence: Synthetic oligonucleotide
  Target: ATXN1; (-) strand; PAM type: YTN; PAM sequence: CTG
agtagctgagattacaggtg

SEQ ID NO: 195962 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgagattacag

SEQ ID NO: 195963 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctgaga

SEQ ID NO: 195964 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 195965 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 195966 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 195967 - DNA, 20 bp, Artificial Sequence
  Description of Artificial Sequence: Synthetic oligonucleotide
  Target: ATXN1; (-) strand; PAM type: YTN; PAM sequence: TTC
aagcaattctcctgcctcag

SEQ ID NO: 195968 - DNA, 20 bp, Artificial Sequence
  Description of Artificial Sequence: Synthetic oligonucleotide
  Target: ATXN1; (-) strand; PAM type: YTN; PAM sequence: CTC
cacatcccaggttcaagcaa

SEQ ID NO: 195969 - DNA, 20 bp, Artificial Sequence
  Description of Artificial Sequence: Synthetic oligonucleotide
  Target: ATXN1; (-) strand; PAM type: YTN; PAM sequence: CTG
caacctccacatcccaggtt

SEQ ID NO: 195970 - DNA, 20 bp, Artificial Sequence
  Description of Artificial Sequence: Synthetic oligonucleotide
  Target: ATXN1; (-) strand; PAM type: YTN; PAM sequence: CTC
actgcaacctccacatccca

SEQ ID NO: 195971 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctccaca

SEQ ID NO: 195972 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatggcatgatctc

SEQ ID NO: 195973 - DNA, 20 bp, Artificial Sequence
  Description of Artificial Sequence: Synthetic oligonucleotide
  Target: ATXN1; (-) strand; PAM type: YTN; PAM sequence: TTC
ccaggctggagtgcaatggc

SEQ ID NO: 195974 - DNA, 20 bp, Artificial Sequence
  Description of Artificial Sequence: Synthetic oligonucleotide
  Target: ATXN1; (-) strand; PAM type: YTN; PAM sequence: TTT
cccaggctggagtgcaatgg

SEQ ID NO: 195975 - DNA, 20 bp, Artificial Sequence
  Description of Artificial Sequence: Synthetic oligonucleotide
  Target: ATXN1; (-) strand; PAM type: YTN; PAM sequence: TTG
tttcccaggctggagtgcaa

SEQ ID NO: 195976 - DNA, 20 bp, Artificial Sequence
  Description of Artificial Sequence: Synthetic oligonucleotide
  Target: ATXN1; (-) strand; PAM type: YTN; PAM sequence: CTT
gtttcccaggctggagtgca

SEQ ID NO: 195977 - DNA, 20 bp, Artificial Sequence
  Description of Artificial Sequence: Synthetic oligonucleotide
  Target: ATXN1; (-) strand; PAM type: YTN; PAM sequence: CTC
ttgtttcccaggctggagtg

SEQ ID NO: 195978 - DNA, 20 bp, Artificial Sequence
  Description of Artificial Sequence: Synthetic oligonucleotide
  Target: ATXN1; (-) strand; PAM type: YTN; PAM sequence: TTC
gctcttgtttcccaggctgg

SEQ ID NO: 195979 - DNA, 20 bp, Artificial Sequence
  Description of Artificial Sequence: Synthetic oligonucleotide
  Target: ATXN1; (-) strand; PAM type: YTN; PAM sequence: TTT
cgctcttgtttcccaggctg

SEQ ID NO: 195980 - DNA, 20 bp, Artificial Sequence
  Description of Artificial Sequence: Synthetic oligonucleotide
  Target: ATXN1; (-) strand; PAM type: YTN; PAM sequence: TTG
agacacagtttcgctcttgt

SEQ ID NO: 195981 - DNA, 20 bp, Artificial Sequence
  Description of Artificial Sequence: Synthetic oligonucleotide
  Target: ATXN1; (-) strand; PAM type: YTN; PAM sequence: TTT
gagacacagtttcgctcttg

SEQ ID NO: 195982 - DNA, 20 bp, Artificial Sequence
  Description of Artificial Sequence: Synthetic oligonucleotide
  Target: ATXN1; (-) strand; PAM type: YTN; PAM sequence: TTT
tgagacacagtttcgctctt

SEQ ID NO: 195983 - DNA, 20 bp, Artificial Sequence
  Description of Artificial Sequence: Synthetic oligonucleotide
  Target: ATXN1; (-) strand; PAM type: YTN; PAM sequence: TTT
ttgagacacagtttcgctct

SEQ ID NO: 195984 - DNA, 20 bp, Artificial Sequence
  Description of Artificial Sequence: Synthetic oligonucleotide
  Target: ATXN1; (-) strand; PAM type: YTN; PAM sequence: TTT
tttgagacacagtttcgctc

SEQ ID NO: 195985 - DNA, 20 bp, Artificial Sequence
  Description of Artificial Sequence: Synthetic oligonucleotide
  Target: ATXN1; (-) strand; PAM type: YTN; PAM sequence: TTT
ttttgagacacagtttcgct

SEQ ID NO: 195986 - DNA, 20 bp, Artificial Sequence
  Description of Artificial Sequence: Synthetic oligonucleotide
  Target: ATXN1; (-) strand; PAM type: YTN; PAM sequence: TTT
tttttgagacacagtttcgc

SEQ ID NO: 195987 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacacagtttcg

SEQ ID NO: 195988 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacacagtttc

SEQ ID NO: 195989 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacacagttt

SEQ ID NO: 195990 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacacagtt

SEQ ID NO: 195991 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacacagt

SEQ ID NO: 195992 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacacag

SEQ ID NO: 195993 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaca

SEQ ID NO: 195994 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacac

SEQ ID NO: 195995 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagaca

SEQ ID NO: 195996 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 195997 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 195998 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttgag

SEQ ID NO: 195999 - DNA, 20 bp, Artificial Sequence
  Description of Artificial Sequence: Synthetic oligonucleotide
  Target: ATXN1; (-) strand; PAM type: YTN; PAM sequence: CTA
acatgggtagcacttttttt

SEQ ID NO: 196000 - DNA, 20 bp, Artificial Sequence
  Description of Artificial Sequence: Synthetic oligonucleotide
  Target: ATXN1; (-) strand; PAM type: YTN; PAM sequence: TTC
taacatgggtagcacttttt

SEQ ID NO: 196001 - DNA, 20 bp, Artificial Sequence
  Description of Artificial Sequence: Synthetic oligonucleotide
  Target: ATXN1; (-) strand; PAM type: YTN; PAM sequence: TTT
ctaacatgggtagcactttt

SEQ ID NO: 196002 - DNA, 20 bp, Artificial Sequence
  Description of Artificial Sequence: Synthetic oligonucleotide
  Target: ATXN1; (-) strand; PAM type: YTN; PAM sequence: TTA
ccagatgtgaccaaaaggtt

SEQ ID NO: 196003 - DNA, 20 bp, Artificial Sequence
  Description of Artificial Sequence: Synthetic oligonucleotide
  Target: ATXN1; (-) strand; PAM type: YTN; PAM sequence: CTG
ttaccagatgtgaccaaaag

SEQ ID NO: 196004 - DNA, 20 bp, Artificial Sequence
  Description of Artificial Sequence: Synthetic oligonucleotide
  Target: ATXN1; (-) strand; PAM type: YTN; PAM sequence: CTG
gggctgttaccagatgtgac

SEQ ID NO: 196005 - DNA, 20 bp, Artificial Sequence
  Description of Artificial Sequence: Synthetic oligonucleotide
  Target: ATXN1; (-) strand; PAM type: YTN; PAM sequence: TTA
gcaccactggggctgttacc

SEQ ID NO: 196006 - DNA, 20 bp, Artificial Sequence
  Description of Artificial Sequence: Synthetic oligonucleotide
  Target: ATXN1; (-) strand; PAM type: YTN; PAM sequence: CTT
agcaccactggggctgttac

SEQ ID NO: 196007 - DNA, 20 bp, Artificial Sequence
  Description of Artificial Sequence: Synthetic oligonucleotide
  Target: ATXN1; (-) strand; PAM type: YTN; PAM sequence: TTC
atgtccttagcaccactggg

SEQ ID NO: 196008 - DNA, 20 bp, Artificial Sequence
  Description of Artificial Sequence: Synthetic oligonucleotide
  Target: ATXN1; (-) strand; PAM type: YTN; PAM sequence: TTT
catgtccttagcaccactgg

SEQ ID NO: 196009 - DNA, 20 bp, Artificial Sequence
  Description of Artificial Sequence: Synthetic oligonucleotide
  Target: ATXN1; (-) strand; PAM type: YTN; PAM sequence: CTT
tcatgtccttagcaccactg

SEQ ID NO: 196010 - DNA, 20 bp, Artificial Sequence
  Description of Artificial Sequence: Synthetic oligonucleotide
  Target: ATXN1; (-) strand; PAM type: YTN; PAM sequence: TTG
gggcaatggctttcatgtcc

SEQ ID NO: 196011 - DNA, 20 bp, Artificial Sequence
  Description of Artificial Sequence: Synthetic oligonucleotide
  Target: ATXN1; (-) strand; PAM type: YTN; PAM sequence: TTG
attggggcaatggctttcat

SEQ ID NO: 196012 - DNA, 20 bp, Artificial Sequence
  Description of Artificial Sequence: Synthetic oligonucleotide
  Target: ATXN1; (-) strand; PAM type: YTN; PAM sequence: TTT
gattggggcaatggctttca

SEQ ID NO: 196013 - DNA, 20 bp, Artificial Sequence
  Description of Artificial Sequence: Synthetic oligonucleotide
  Target: ATXN1; (-) strand; PAM type: YTN; PAM sequence: TTT
tgattggggcaatggctttc

SEQ ID NO: 196014 - DNA, 20 bp, Artificial Sequence
  Description of Artificial Sequence: Synthetic oligonucleotide
  Target: ATXN1; (-) strand; PAM type: YTN; PAM sequence: TTT
ttgattggggcaatggcttt

SEQ ID NO: 196015 - DNA, 20 bp, Artificial Sequence
  Description of Artificial Sequence: Synthetic oligonucleotide
  Target: ATXN1; (-) strand; PAM type: YTN; PAM sequence: TTT
tttgattggggcaatggctt

SEQ ID NO: 196016 - DNA, 20 bp, Artificial Sequence
  Description of Artificial Sequence: Synthetic oligonucleotide
  Target: ATXN1; (-) strand; PAM type: YTN; PAM sequence: TTG
ttttttgattggggcaatgg

SEQ ID NO: 196017 - DNA, 20 bp, Artificial Sequence
  Description of Artificial Sequence: Synthetic oligonucleotide
  Target: ATXN1; (-) strand; PAM type: YTN; PAM sequence: TTT
gttttttgattggggcaatg

SEQ ID NO: 196018 - DNA, 20 bp, Artificial Sequence
  Description of Artificial Sequence: Synthetic oligonucleotide
  Target: ATXN1; (-) strand; PAM type: YTN; PAM sequence: CTT
tgttttttgattggggcaat

SEQ ID NO: 196019 - DNA, 20 bp, Artificial Sequence
  Description of Artificial Sequence: Synthetic oligonucleotide
  Target: ATXN1; (-) strand; PAM type: YTN; PAM sequence: TTG
cctttgttttttgattgggg

SEQ ID NO: 196020 - DNA, 20 bp, Artificial Sequence
  Description of Artificial Sequence: Synthetic oligonucleotide
  Target: ATXN1; (-) strand; PAM type: YTN; PAM sequence: TTT
gcctttgttttttgattggg

SEQ ID NO: 196021 - DNA, 20 bp, Artificial Sequence
  Description of Artificial Sequence: Synthetic oligonucleotide
  Target: ATXN1; (-) strand; PAM type: YTN; PAM sequence: CTT
tgcctttgttttttgattgg

SEQ ID NO: 196022 - DNA, 20 bp, Artificial Sequence
  Description of Artificial Sequence: Synthetic oligonucleotide
  Target: ATXN1; (-) strand; PAM type: YTN; PAM sequence: TTC
tttgcctttgttttttgatt

SEQ ID NO: 196023 - DNA, 20 bp, Artificial Sequence
  Description of Artificial Sequence: Synthetic oligonucleotide
  Target: ATXN1; (-) strand; PAM type: YTN; PAM sequence: CTG
tgttctttgcctttgttttt

SEQ ID NO: 196024 - DNA, 20 bp, Artificial Sequence
  Description of Artificial Sequence: Synthetic oligonucleotide
  Target: ATXN1; (-) strand; PAM type: YTN; PAM sequence: TTG
tgtccagagctgtgttcttt

SEQ ID NO: 196025 - DNA, 20 bp, Artificial Sequence
  Description of Artificial Sequence: Synthetic oligonucleotide
  Target: ATXN1; (-) strand; PAM type: YTN; PAM sequence: TTT
gtgtccagagctgtgttctt

SEQ ID NO: 196026 - DNA, 20 bp, Artificial Sequence
  Description of Artificial Sequence: Synthetic oligonucleotide
  Target: ATXN1; (-) strand; PAM type: YTN; PAM sequence: TTT
tgtgtccagagctgtgttct

SEQ ID NO: 196027 - DNA, 20 bp, Artificial Sequence
  Description of Artificial Sequence: Synthetic oligonucleotide
  Target: ATXN1; (-) strand; PAM type: YTN; PAM sequence: TTC
caattttgtgtccagagctg

SEQ ID NO: 196028 - DNA, 20 bp, Artificial Sequence
  Description of Artificial Sequence: Synthetic oligonucleotide
  Target: ATXN1; (-) strand; PAM type: YTN; PAM sequence: CTG
aattccaattttgtgtccag

SEQ ID NO: 196029 - DNA, 20 bp, Artificial Sequence
  Description of Artificial Sequence: Synthetic oligonucleotide
  Target: ATXN1; (-) strand; PAM type: YTN; PAM sequence: TTA
ctgaattccaattttgtgtc

SEQ ID NO: 196030 - DNA, 20 bp, Artificial Sequence
  Description of Artificial Sequence: Synthetic oligonucleotide
  Target: ATXN1; (-) strand; PAM type: YTN; PAM sequence: TTT
actgaattccaattttgtgt

SEQ ID NO: 196031 - DNA, 20 bp, Artificial Sequence
  Description of Artificial Sequence: Synthetic oligonucleotide
  Target: ATXN1; (-) strand; PAM type: YTN; PAM sequence: TTA
agtatttactgaattccaat

SEQ ID NO: 196032 - DNA, 20 bp, Artificial Sequence
  Description of Artificial Sequence: Synthetic oligonucleotide
  Target: ATXN1; (-) strand; PAM type: YTN; PAM sequence: TTT
aagtatttactgaattccaa

SEQ ID NO: 196033 - DNA, 20 bp, Artificial Sequence
  Description of Artificial Sequence: Synthetic oligonucleotide
  Target: ATXN1; (-) strand; PAM type: YTN; PAM sequence: TTT
taagtatttactgaattcca

SEQ ID NO: 196034 - DNA, 20 bp, Artificial Sequence
  Description of Artificial Sequence: Synthetic oligonucleotide
  Target: ATXN1; (-) strand; PAM type: YTN; PAM sequence: CTT
ttaagtatttactgaattcc

SEQ ID NO: 196035 - DNA, 20 bp, Artificial Sequence
  Description of Artificial Sequence: Synthetic oligonucleotide
  Target: ATXN1; (-) strand; PAM type: YTN; PAM sequence: CTG
cttttaagtatttactgaat

SEQ ID NO: 196036 - DNA, 20 bp, Artificial Sequence
  Description of Artificial Sequence: Synthetic oligonucleotide
  Target: ATXN1; (-) strand; PAM type: YTN; PAM sequence: TTA
ctgcttttaagtatttactg

SEQ ID NO: 196037 - DNA, 20 bp, Artificial Sequence
  Description of Artificial Sequence: Synthetic oligonucleotide
  Target: ATXN1; (-) strand; PAM type: YTN; PAM sequence: TTA
cattactgcttttaagtatt

SEQ ID NO: 196038 - DNA, 20 bp, Artificial Sequence
  Description of Artificial Sequence: Synthetic oligonucleotide
  Target: ATXN1; (-) strand; PAM type: YTN; PAM sequence: CTG
ttacattactgcttttaagt

SEQ ID NO: 196039 - DNA, 20 bp, Artificial Sequence
  Description of Artificial Sequence: Synthetic oligonucleotide
  Target: ATXN1; (-) strand; PAM type: YTN; PAM sequence: CTG
aataagatagacccctgtta

SEQ ID NO: 196040 - DNA, 20 bp, Artificial Sequence
  Description of Artificial Sequence: Synthetic oligonucleotide
  Target: ATXN1; (-) strand; PAM type: YTN; PAM sequence: TTA
ctgaataagatagacccctg

SEQ ID NO: 196041 - DNA, 20 bp, Artificial Sequence
  Description of Artificial Sequence: Synthetic oligonucleotide
  Target: ATXN1; (-) strand; PAM type: YTN; PAM sequence: TTT
actgaataagatagacccct

SEQ ID NO: 196042 - DNA, 20 bp, Artificial Sequence
  Description of Artificial Sequence: Synthetic oligonucleotide
  Target: ATXN1; (-) strand; PAM type: YTN; PAM sequence: TTA
agtatttactgaataagata

SEQ ID NO: 196043 - DNA, 20 bp, Artificial Sequence
  Description of Artificial Sequence: Synthetic oligonucleotide
  Target: ATXN1; (-) strand; PAM type: YTN; PAM sequence: TTT
aagtatttactgaataagat

SEQ ID NO: 196044 - DNA, 20 bp, Artificial Sequence
  Description of Artificial Sequence: Synthetic oligonucleotide
  Target: ATXN1; (-) strand; PAM type: YTN; PAM sequence: TTT
taagtatttactgaataaga

SEQ ID NO: 196045 - DNA, 20 bp, Artificial Sequence
  Description of Artificial Sequence: Synthetic oligonucleotide
  Target: ATXN1; (-) strand; PAM type: YTN; PAM sequence: CTG
ttttaagtatttactgaata

SEQ ID NO: 196046 - DNA, 20 bp, Artificial Sequence
  Description of Artificial Sequence: Synthetic oligonucleotide
  Target: ATXN1; (-) strand; PAM type: YTN; PAM sequence: TTA
ctgttttaagtatttactga

SEQ ID NO: 196047 - DNA, 20 bp, Artificial Sequence
  Description of Artificial Sequence: Synthetic oligonucleotide
  Target: ATXN1; (-) strand; PAM type: YTN; PAM sequence: TTA
tgtagtagatattactgttt

SEQ ID NO: 196048 - DNA, 20 bp, Artificial Sequence
  Description of Artificial Sequence: Synthetic oligonucleotide
  Target: ATXN1; (-) strand; PAM type: YTN; PAM sequence: CTT
atgtagtagatattactgtt

SEQ ID NO: 196049 - DNA, 20 bp, Artificial Sequence
  Description of Artificial Sequence: Synthetic oligonucleotide
  Target: ATXN1; (-) strand; PAM type: YTN; PAM sequence: TTG
aaaacaataaagcttatgta

SEQ ID NO: 196050 - DNA, 20 bp, Artificial Sequence
  Description of Artificial Sequence: Synthetic oligonucleotide
  Target: ATXN1; (-) strand; PAM type: YTN; PAM sequence: TTT
gaaaacaataaagcttatgt

SEQ ID NO: 196051 - DNA, 20 bp, Artificial Sequence
  Description of Artificial Sequence: Synthetic oligonucleotide
  Target: ATXN1; (-) strand; PAM type: YTN; PAM sequence: CTT
tgaaaacaataaagcttatg

SEQ ID NO: 196052 - DNA, 20 bp, Artificial Sequence
  Description of Artificial Sequence: Synthetic oligonucleotide
  Target: ATXN1; (-) strand; PAM type: YTN; PAM sequence: TTC
actttgaaaacaataaagct

SEQ ID NO: 196053 - DNA, 20 bp, Artificial Sequence
  Description of Artificial Sequence: Synthetic oligonucleotide
  Target: ATXN1; (-) strand; PAM type: YTN; PAM sequence: CTA
ttcactttgaaaacaataaa

SEQ ID NO: 196054 - DNA, 20 bp, Artificial Sequence
  Description of Artificial Sequence: Synthetic oligonucleotide
  Target: ATXN1; (-) strand; PAM type: YTN; PAM sequence: CTG
caagctattcactttgaaaa

SEQ ID NO: 196055 - DNA, 20 bp, Artificial Sequence
  Description of Artificial Sequence: Synthetic oligonucleotide
  Target: ATXN1; (-) strand; PAM type: YTN; PAM sequence: TTG
actgcaagctattcactttg

SEQ ID NO: 196056 - DNA, 20 bp, Artificial Sequence
  Description of Artificial Sequence: Synthetic oligonucleotide
  Target: ATXN1; (-) strand; PAM type: YTN; PAM sequence: TTA
gaaccgtatatataatgtag

SEQ ID NO: 196057 - DNA, 20 bp, Artificial Sequence
  Description of Artificial Sequence: Synthetic oligonucleotide
  Target: ATXN1; (-) strand; PAM type: YTN; PAM sequence: TTT
agaaccgtatatataatgta

SEQ ID NO: 196058 - DNA, 20 bp, Artificial Sequence
  Description of Artificial Sequence: Synthetic oligonucleotide
  Target: ATXN1; (-) strand; PAM type: YTN; PAM sequence: TTT
tagaaccgtatatataatgt

SEQ ID NO: 196059 - DNA, 20 bp, Artificial Sequence
  Description of Artificial Sequence: Synthetic oligonucleotide
  Target: ATXN1; (-) strand; PAM type: YTN; PAM sequence: TTT
ttagaaccgtatatataatg

SEQ ID NO: 196060 - DNA, 20 bp, Artificial Sequence
  Description of Artificial Sequence: Synthetic oligonucleotide
  Target: ATXN1; (-) strand; PAM type: YTN; PAM sequence: CTA
tttttagaaccgtatatata

SEQ ID NO: 196061 - DNA, 20 bp, Artificial Sequence
  Description of Artificial Sequence: Synthetic oligonucleotide
  Target: ATXN1; (-) strand; PAM type: YTN; PAM sequence: TTA
agaaatactatttttagaac

SEQ ID NO: 196062 - DNA, 20 bp, Artificial Sequence
  Description of Artificial Sequence: Synthetic oligonucleotide
  Target: ATXN1; (-) strand; PAM type: YTN; PAM sequence: TTT
aagaaatactatttttagaa

SEQ ID NO: 196063 - DNA, 20 bp, Artificial Sequence
  Description of Artificial Sequence: Synthetic oligonucleotide
  Target: ATXN1; (-) strand; PAM type: YTN; PAM sequence: CTA
ggtgtttaagaaatactatt

SEQ ID NO: 196064 - DNA, 20 bp, Artificial Sequence
  Description of Artificial Sequence: Synthetic oligonucleotide
  Target: ATXN1; (-) strand; PAM type: YTN; PAM sequence: TTC
taggtgtttaagaaatacta

SEQ ID NO: 196065 - DNA, 20 bp, Artificial Sequence
  Description of Artificial Sequence: Synthetic oligonucleotide
  Target: ATXN1; (-) strand; PAM type: YTN; PAM sequence: CTG
ttctaggtgtttaagaaata

SEQ ID NO: 196066 - DNA, 20 bp, Artificial Sequence
  Description of Artificial Sequence: Synthetic oligonucleotide
  Target: ATXN1; (-) strand; PAM type: YTN; PAM sequence: TTG
gctgttctaggtgtttaaga

SEQ ID NO: 196067 - DNA, 20 bp, Artificial Sequence
  Description of Artificial Sequence: Synthetic oligonucleotide
  Target: ATXN1; (-) strand; PAM type: YTN; PAM sequence: TTT
ggctgttctaggtgtttaag

SEQ ID NO: 196068 - DNA, 20 bp, Artificial Sequence
  Description of Artificial Sequence: Synthetic oligonucleotide
  Target: ATXN1; (-) strand; PAM type: YTN; PAM sequence: CTT
tggctgttctaggtgtttaa

SEQ ID NO: 196069 - DNA, 20 bp, Artificial Sequence
  Description of Artificial Sequence: Synthetic oligonucleotide
  Target: ATXN1; (-) strand; PAM type: YTN; PAM sequence: TTG
ccaacctttggctgttctag

SEQ ID NO: 196070 - DNA, 20 bp, Artificial Sequence
  Description of Artificial Sequence: Synthetic oligonucleotide
  Target: ATXN1; (-) strand; PAM type: YTN; PAM sequence: TTT
gccaacctttggctgttcta

SEQ ID NO: 196071 - DNA, 20 bp, Artificial Sequence
  Description of Artificial Sequence: Synthetic oligonucleotide
  Target: ATXN1; (-) strand; PAM type: YTN; PAM sequence: TTA
tagaaaaagtttgccaacct

SEQ ID NO: 196072 - DNA, 20 bp, Artificial Sequence
  Description of Artificial Sequence: Synthetic oligonucleotide
  Target: ATXN1; (-) strand; PAM type: YTN; PAM sequence: TTT
atagaaaaagtttgccaacc

SEQ ID NO: 196073 - DNA, 20 bp, Artificial Sequence
  Description of Artificial Sequence: Synthetic oligonucleotide
  Target: ATXN1; (-) strand; PAM type: YTN; PAM sequence: CTT
tatagaaaaagtttgccaac

SEQ ID NO: 196074 - DNA, 20 bp, Artificial Sequence
  Description of Artificial Sequence: Synthetic oligonucleotide
  Target: ATXN1; (-) strand; PAM type: YTN; PAM sequence: CTG
gtcctttatagaaaaagttt

SEQ ID NO: 196075 - DNA, 20 bp, Artificial Sequence
  Description of Artificial Sequence: Synthetic oligonucleotide
  Target: ATXN1; (-) strand; PAM type: YTN; PAM sequence: CTC
cctggtcctttatagaaaaa

SEQ ID NO: 196076 - DNA, 20 bp, Artificial Sequence
  Description of Artificial Sequence: Synthetic oligonucleotide
  Target: ATXN1; (-) strand; PAM type: YTN; PAM sequence: TTG
ctccctggtcctttatagaa

SEQ ID NO: 196077 - DNA, 20 bp, Artificial Sequence
  Description of Artificial Sequence: Synthetic oligonucleotide
  Target: ATXN1; (-) strand; PAM type: YTN; PAM sequence: TTT
gctccctggtcctttataga

SEQ ID NO: 196078 - DNA, 20 bp, Artificial Sequence
  Description of Artificial Sequence: Synthetic oligonucleotide
  Target: ATXN1; (-) strand; PAM type: YTN; PAM sequence: CTA
aagcatttgctccctggtcc

SEQ ID NO: 196079 - DNA, 20 bp, Artificial Sequence
  Description of Artificial Sequence: Synthetic oligonucleotide
  Target: ATXN1; (-) strand; PAM type: YTN; PAM sequence: CTG
gcccacacagcctaaagcat

SEQ ID NO: 196080 - DNA, 20 bp, Artificial Sequence
  Description of Artificial Sequence: Synthetic oligonucleotide
  Target: ATXN1; (-) strand; PAM type: YTN; PAM sequence: TTG
caatggagatgtctggccca

SEQ ID NO: 196081 - DNA, 20 bp, Artificial Sequence
  Description of Artificial Sequence: Synthetic oligonucleotide
  Target: ATXN1; (-) strand; PAM type: YTN; PAM sequence: TTG
agtagttgcaatggagatgt

SEQ ID NO: 196082 - DNA, 20 bp, Artificial Sequence
  Description of Artificial Sequence: Synthetic oligonucleotide
  Target: ATXN1; (-) strand; PAM type: YTN; PAM sequence: TTG
cacgacaatgacagattgag

SEQ ID NO: 196083 - DNA, 20 bp, Artificial Sequence
  Description of Artificial Sequence: Synthetic oligonucleotide
  Target: ATXN1; (-) strand; PAM type: YTN; PAM sequence: TTT
gcacgacaatgacagattga

SEQ ID NO: 196084 - DNA, 20 bp, Artificial Sequence
  Description of Artificial Sequence: Synthetic oligonucleotide
  Target: ATXN1; (-) strand; PAM type: YTN; PAM sequence: TTT
tgcacgacaatgacagattg

SEQ ID NO: 196085 - DNA, 20 bp, Artificial Sequence
  Description of Artificial Sequence: Synthetic oligonucleotide
  Target: ATXN1; (-) strand; PAM type: YTN; PAM sequence: CTT
ttgcacgacaatgacagatt

SEQ ID NO: 196086 - DNA, 20 bp, Artificial Sequence
  Description of Artificial Sequence: Synthetic oligonucleotide
  Target: ATXN1; (-) strand; PAM type: YTN; PAM sequence: CTG
cttttgcacgacaatgacag

SEQ ID NO: 196087 - DNA, 20 bp, Artificial Sequence
  Description of Artificial Sequence: Synthetic oligonucleotide
  Target: ATXN1; (-) strand; PAM type: YTN; PAM sequence: TTG
ctgcttttgcacgacaatga

SEQ ID NO: 196088 - DNA, 20 bp, Artificial Sequence
  Description of Artificial Sequence: Synthetic oligonucleotide
  Target: ATXN1; (-) strand; PAM type: YTN; PAM sequence: TTC
aattgctgcttttgcacgac

SEQ ID NO: 196089 - DNA, 20 bp, Artificial Sequence
  Description of Artificial Sequence: Synthetic oligonucleotide
  Target: ATXN1; (-) strand; PAM type: YTN; PAM sequence: CTT
caattgctgcttttgcacga

SEQ ID NO: 196090 - DNA, 20 bp, Artificial Sequence
  Description of Artificial Sequence: Synthetic oligonucleotide
  Target: ATXN1; (-) strand; PAM type: YTN; PAM sequence: TTG
tatgagtatcttcaattgct

SEQ ID NO: 196091 - DNA, 20 bp, Artificial Sequence
  Description of Artificial Sequence: Synthetic oligonucleotide
  Target: ATXN1; (-) strand; PAM type: YTN; PAM sequence: TTT
gtatgagtatcttcaattgc

SEQ ID NO: 196092 - DNA, 20 bp, Artificial Sequence
  Description of Artificial Sequence: Synthetic oligonucleotide
  Target: ATXN1; (-) strand; PAM type: YTN; PAM sequence: CTG
tttgtatgagtatcttcaat

SEQ ID NO: 196093 - DNA, 20 bp, Artificial Sequence
  Description of Artificial Sequence: Synthetic oligonucleotide
  Target: ATXN1; (-) strand; PAM type: YTN; PAM sequence: TTG
gaacaccgacatgcctgttt

SEQ ID NO: 196094 - DNA, 20 bp, Artificial Sequence
  Description of Artificial Sequence: Synthetic oligonucleotide
  Target: ATXN1; (-) strand; PAM type: YTN; PAM sequence: TTA
ttggaacaccgacatgcctg

SEQ ID NO: 196095 - DNA, 20 bp, Artificial Sequence
  Description of Artificial Sequence: Synthetic oligonucleotide
  Target: ATXN1; (-) strand; PAM type: YTN; PAM sequence: TTT
attggaacaccgacatgcct

SEQ ID NO: 196096 - DNA, 20 bp, Artificial Sequence
  Description of Artificial Sequence: Synthetic oligonucleotide
  Target: ATXN1; (-) strand; PAM type: YTN; PAM sequence: TTT
tattggaacaccgacatgcc

SEQ ID NO: 196097 - DNA, 20 bp, Artificial Sequence
  Description of Artificial Sequence: Synthetic oligonucleotide
  Target: ATXN1; (-) strand; PAM type: YTN; PAM sequence: TTA
agttttattggaacaccgac

SEQ ID NO: 196098 - DNA, 20 bp, Artificial Sequence
  Description of Artificial Sequence: Synthetic oligonucleotide
  Target: ATXN1; (-) strand; PAM type: YTN; PAM sequence: CTG
taaattaagttttattggaa

SEQ ID NO: 196099 - DNA, 20 bp, Artificial Sequence
  Description of Artificial Sequence: Synthetic oligonucleotide
  Target: ATXN1; (-) strand; PAM type: YTN; PAM sequence: TTC
tgtaaattaagttttattgg

SEQ ID NO: 196100 - DNA, 20 bp, Artificial Sequence
  Description of Artificial Sequence: Synthetic oligonucleotide
  Target: ATXN1; (-) strand; PAM type: YTN; PAM sequence: TTT
ctgtaaattaagttttattg

SEQ ID NO: 196101 - DNA, 20 bp, Artificial Sequence
  Description of Artificial Sequence: Synthetic oligonucleotide
  Target: ATXN1; (-) strand; PAM type: YTN; PAM sequence: CTG
tttctgtaaattaagtttta

SEQ ID NO: 196102 - DNA, 20 bp, Artificial Sequence
  Description of Artificial Sequence: Synthetic oligonucleotide
  Target: ATXN1; (-) strand; PAM type: YTN; PAM sequence: CTG
gaccatgggccaaatatcac

SEQ ID NO: 196103 - DNA, 20 bp, Artificial Sequence
  Description of Artificial Sequence: Synthetic oligonucleotide
  Target: ATXN1; (-) strand; PAM type: YTN; PAM sequence: TTG
acaaactggaccatgggcca

SEQ ID NO: 196104 - DNA, 20 bp, Artificial Sequence
  Description of Artificial Sequence: Synthetic oligonucleotide
  Target: ATXN1; (-) strand; PAM type: YTN; PAM sequence: CTA
gaccaggtattgacaaactg

SEQ ID NO: 196105 - DNA, 20 bp, Artificial Sequence
  Description of Artificial Sequence: Synthetic oligonucleotide
  Target: ATXN1; (-) strand; PAM type: YTN; PAM sequence: TTC
tagaccaggtattgacaaac

SEQ ID NO: 196106 - DNA, 20 bp, Artificial Sequence
  Description of Artificial Sequence: Synthetic oligonucleotide
  Target: ATXN1; (-) strand; PAM type: YTN; PAM sequence: TTC
agtgtaataatattctagac

SEQ ID NO: 196107 - DNA, 20 bp, Artificial Sequence
  Description of Artificial Sequence: Synthetic oligonucleotide
  Target: ATXN1; (-) strand; PAM type: YTN; PAM sequence: TTT
cagtgtaataatattctaga

SEQ ID NO: 196108 - DNA, 20 bp, Artificial Sequence
  Description of Artificial Sequence: Synthetic oligonucleotide
  Target: ATXN1; (-) strand; PAM type: YTN; PAM sequence: TTT
tcagtgtaataatattctag

SEQ ID NO: 196109 - DNA, 20 bp, Artificial Sequence
  Description of Artificial Sequence: Synthetic oligonucleotide
  Target: ATXN1; (-) strand; PAM type: YTN; PAM sequence: TTT
ttcagtgtaataatattcta

SEQ ID NO: 196110 - DNA, 20 bp, Artificial Sequence
  Description of Artificial Sequence: Synthetic oligonucleotide
  Target: ATXN1; (-) strand; PAM type: YTN; PAM sequence: TTA
taatttttcagtgtaataat

SEQ ID NO: 196111 - DNA, 20 bp, Artificial Sequence
  Description of Artificial Sequence: Synthetic oligonucleotide
  Target: ATXN1; (-) strand; PAM type: YTN; PAM sequence: CTT
ataatttttcagtgtaataa

SEQ ID NO: 196112 - DNA, 20 bp, Artificial Sequence
  Description of Artificial Sequence: Synthetic oligonucleotide
  Target: ATXN1; (-) strand; PAM type: YTN; PAM sequence: TTG
agagtccatcttataatttt

SEQ ID NO: 196113 - DNA, 20 bp, Artificial Sequence
  Description of Artificial Sequence: Synthetic oligonucleotide
  Target: ATXN1; (-) strand; PAM type: YTN; PAM sequence: TTA
gaggaaaggaaggaagttga

SEQ ID NO: 196114 - DNA, 20 bp, Artificial Sequence
  Description of Artificial Sequence: Synthetic oligonucleotide
  Target: ATXN1; (-) strand; PAM type: YTN; PAM sequence: TTT
agaggaaaggaaggaagttg

SEQ ID NO: 196115 - DNA, 20 bp, Artificial Sequence
  Description of Artificial Sequence: Synthetic oligonucleotide
  Target: ATXN1; (-) strand; PAM type: YTN; PAM sequence: CTT
tagaggaaaggaaggaagtt

SEQ ID NO: 196116 - DNA, 20 bp, Artificial Sequence
  Description of Artificial Sequence: Synthetic oligonucleotide
  Target: ATXN1; (-) strand; PAM type: YTN; PAM sequence: CTC
tttagaggaaaggaaggaag

SEQ ID NO: 196117 - DNA, 20 bp, Artificial Sequence
  Description of Artificial Sequence: Synthetic oligonucleotide
  Target: ATXN1; (-) strand; PAM type: YTN; PAM sequence: CTA
agaaaaataatctctttaga

SEQ ID NO: 196118 - DNA, 20 bp, Artificial Sequence
  Description of Artificial Sequence: Synthetic oligonucleotide
  Target: ATXN1; (-) strand; PAM type: YTN; PAM sequence: TTC
actaagaaaaataatctctt

SEQ ID NO: 196119 - DNA, 20 bp, Artificial Sequence
  Description of Artificial Sequence: Synthetic oligonucleotide
  Target: ATXN1; (-) strand; PAM type: YTN; PAM sequence: TTT
cactaagaaaaataatctct

SEQ ID NO: 196120 - DNA, 20 bp, Artificial Sequence
  Description of Artificial Sequence: Synthetic oligonucleotide
  Target: ATXN1; (-) strand; PAM type: YTN; PAM sequence: TTT
tcactaagaaaaataatctc

SEQ ID NO: 196121 - DNA, 20 bp, Artificial Sequence
  Description of Artificial Sequence: Synthetic oligonucleotide
  Target: ATXN1; (-) strand; PAM type: YTN; PAM sequence: CTT
ttcactaagaaaaataatct

SEQ ID NO: 196122 - DNA, 20 bp, Artificial Sequence
  Description of Artificial Sequence: Synthetic oligonucleotide
  Target: ATXN1; (-) strand; PAM type: YTN; PAM sequence: CTA
acttttcactaagaaaaata

SEQ ID NO: 196123 - DNA, 20 bp, Artificial Sequence
  Description of Artificial Sequence: Synthetic oligonucleotide
  Target: ATXN1; (-) strand; PAM type: YTN; PAM sequence: TTG
tcatctaacttttcactaag

SEQ ID NO: 196124 - DNA, 20 bp, Artificial Sequence
  Description of Artificial Sequence: Synthetic oligonucleotide
  Target: ATXN1; (-) strand; PAM type: YTN; PAM sequence: CTG
tgtgacattgtcatctaact

SEQ ID NO: 196125 - DNA, 20 bp, Artificial Sequence
  Description of Artificial Sequence: Synthetic oligonucleotide
  Target: ATXN1; (-) strand; PAM type: YTN; PAM sequence: CTA
ctgtgtgacattgtcatcta

SEQ ID NO: 196126 - DNA, 20 bp, Artificial Sequence
  Description of Artificial Sequence: Synthetic oligonucleotide
  Target: ATXN1; (-) strand; PAM type: YTN; PAM sequence: TTG
gctactgtgtgacattgtca

SEQ ID NO: 196127 - DNA, 20 bp, Artificial Sequence
  Description of Artificial Sequence: Synthetic oligonucleotide
  Target: ATXN1; (-) strand; PAM type: YTN; PAM sequence: TTT
ggctactgtgtgacattgtc

SEQ ID NO: 196128 - DNA, 20 bp, Artificial Sequence
  Description of Artificial Sequence: Synthetic oligonucleotide
  Target: ATXN1; (-) strand; PAM type: YTN; PAM sequence: TTT
tggctactgtgtgacattgt

SEQ ID NO: 196129 - DNA, 20 bp, Artificial Sequence
  Description of Artificial Sequence: Synthetic oligonucleotide
  Target: ATXN1; (-) strand; PAM type: YTN; PAM sequence: CTT
ttggctactgtgtgacattg

SEQ ID NO: 196130 - DNA, 20 bp, Artificial Sequence
  Description of Artificial Sequence: Synthetic oligonucleotide
  Target: ATXN1; (-) strand; PAM type: YTN; PAM sequence: CTG
cttttggctactgtgtgaca

SEQ ID NO: 196131 - DNA, 20 bp, Artificial Sequence
  Description of Artificial Sequence: Synthetic oligonucleotide
  Target: ATXN1; (-) strand; PAM type: YTN; PAM sequence: CTG
cagaatataccaccgactgc

SEQ ID NO: 196132 - DNA, 20 bp, Artificial Sequence
  Description of Artificial Sequence: Synthetic oligonucleotide
  Target: ATXN1; (-) strand; PAM type: YTN; PAM sequence: TTC
agtggtggatgctgcagaat

SEQ ID NO: 196133 - DNA, 20 bp, Artificial Sequence
  Description of Artificial Sequence: Synthetic oligonucleotide
  Target: ATXN1; (-) strand; PAM type: YTN; PAM sequence: TTA
tcatggacgaggttcagtgg

SEQ ID NO: 196134 - DNA, 20 bp, Artificial Sequence
  Description of Artificial Sequence: Synthetic oligonucleotide
  Target: ATXN1; (-) strand; PAM type: YTN; PAM sequence: CTT
atcatggacgaggttcagtg

SEQ ID NO: 196135 - DNA, 20 bp, Artificial Sequence
  Description of Artificial Sequence: Synthetic oligonucleotide
  Target: ATXN1; (-) strand; PAM type: YTN; PAM sequence: CTG
cttatcatggacgaggttca

SEQ ID NO: 196136 - DNA, 20 bp, Artificial Sequence
  Description of Artificial Sequence: Synthetic oligonucleotide
  Target: ATXN1; (-) strand; PAM type: YTN; PAM sequence: TTG
cccatatctgcttatcatgg

SEQ ID NO: 196137 - DNA, 20 bp, Artificial Sequence
  Description of Artificial Sequence: Synthetic oligonucleotide
  Target: ATXN1; (-) strand; PAM type: YTN; PAM sequence: TTT
gcccatatctgcttatcatg

SEQ ID NO: 196138 - DNA, 20 bp, Artificial Sequence
  Description of Artificial Sequence: Synthetic oligonucleotide
  Target: ATXN1; (-) strand; PAM type: YTN; PAM sequence: CTC
agatttgcccatatctgctt

SEQ ID NO: 196139 - DNA, 20 bp, Artificial Sequence
  Description of Artificial Sequence: Synthetic oligonucleotide
  Target: ATXN1; (-) strand; PAM type: YTN; PAM sequence: TTC
tcagatttgcccatatctgc

SEQ ID NO: 196140 - DNA, 20 bp, Artificial Sequence
  Description of Artificial Sequence: Synthetic oligonucleotide
  Target: ATXN1; (-) strand; PAM type: YTN; PAM sequence: CTG
gaattctcagatttgcccat

SEQ ID NO: 196141 - DNA, 20 bp, Artificial Sequence
  Description of Artificial Sequence: Synthetic oligonucleotide
  Target: ATXN1; (-) strand; PAM type: YTN; PAM sequence: CTG
cacctggaattctcagattt

SEQ ID NO: 196142 - DNA, 20 bp, Artificial Sequence
  Description of Artificial Sequence: Synthetic oligonucleotide
  Target: ATXN1; (-) strand; PAM type: YTN; PAM sequence: CTG
gaaaactgcacctggaattc

SEQ ID NO: 196143 - DNA, 20 bp, Artificial Sequence
  Description of Artificial Sequence: Synthetic oligonucleotide
  Target: ATXN1; (-) strand; PAM type: YTN; PAM sequence: TTA
ccactggaaaactgcacctg

SEQ ID NO: 196144 - DNA, 20 bp, Artificial Sequence
  Description of Artificial Sequence: Synthetic oligonucleotide
  Target: ATXN1; (-) strand; PAM type: YTN; PAM sequence: CTT
accactggaaaactgcacct

SEQ ID NO: 196145 - DNA, 20 bp, Artificial Sequence
  Description of Artificial Sequence: Synthetic oligonucleotide
  Target: ATXN1; (-) strand; PAM type: YTN; PAM sequence: TTG
cacatatgtaatgcagagat

SEQ ID NO: 196146 - DNA, 20 bp, Artificial Sequence
  Description of Artificial Sequence: Synthetic oligonucleotide
  Target: ATXN1; (-) strand; PAM type: YTN; PAM sequence: TTT
gcacatatgtaatgcagaga

SEQ ID NO: 196147 - DNA, 20 bp, Artificial Sequence
  Description of Artificial Sequence: Synthetic oligonucleotide
  Target: ATXN1; (-) strand; PAM type: YTN; PAM sequence: CTT
tgcacatatgtaatgcagag

SEQ ID NO: 196148 - DNA, 20 bp, Artificial Sequence
  Description of Artificial Sequence: Synthetic oligonucleotide
  Target: ATXN1; (-) strand; PAM type: YTN; PAM sequence: TTC
cctttgcacatatgtaatgc

SEQ ID NO: 196149 - DNA, 20 bp, Artificial Sequence
  Description of Artificial Sequence: Synthetic oligonucleotide
  Target: ATXN1; (-) strand; PAM type: YTN; PAM sequence: CTG
ttccctttgcacatatgtaa

SEQ ID NO: 196150 - DNA, 20 bp, Artificial Sequence
  Description of Artificial Sequence: Synthetic oligonucleotide
  Target: ATXN1; (-) strand; PAM type: YTN; PAM sequence: TTC
catggggcagcctgttccct

SEQ ID NO: 196151 - DNA, 20 bp, Artificial Sequence
  Description of Artificial Sequence: Synthetic oligonucleotide
  Target: ATXN1; (-) strand; PAM type: YTN; PAM sequence: CTG
gggttccatggggcagcctg

SEQ ID NO: 196152 - DNA, 20 bp, Artificial Sequence
  Description of Artificial Sequence: Synthetic oligonucleotide
  Target: ATXN1; (-) strand; PAM type: YTN; PAM sequence: TTA
tctggggttccatggggcag

SEQ ID NO: 196153 - DNA, 20 bp, Artificial Sequence
  Description of Artificial Sequence: Synthetic oligonucleotide
  Target: ATXN1; (-) strand; PAM type: YTN; PAM sequence: TTT
atctggggttccatggggca

SEQ ID NO: 196154 - DNA, 20 bp, Artificial Sequence
  Description of Artificial Sequence: Synthetic oligonucleotide
  Target: ATXN1; (-) strand; PAM type: YTN; PAM sequence: TTA
gcatttatctggggttccat

SEQ ID NO: 196155 - DNA, 20 bp, Artificial Sequence
  Description of Artificial Sequence: Synthetic oligonucleotide
  Target: ATXN1; (-) strand; PAM type: YTN; PAM sequence: TTT
agcatttatctggggttcca

SEQ ID NO: 196156 - DNA, 20 bp, Artificial Sequence
  Description of Artificial Sequence: Synthetic oligonucleotide
  Target: ATXN1; (-) strand; PAM type: YTN; PAM sequence: CTA
tttagcatttatctggggtt

SEQ ID NO: 196157 - DNA, 20 bp, Artificial Sequence
  Description of Artificial Sequence: Synthetic oligonucleotide
  Target: ATXN1; (-) strand; PAM type: YTN; PAM sequence: TTC
aagaggctatttagcattta

SEQ ID NO: 196158 - DNA, 20 bp, Artificial Sequence
  Description of Artificial Sequence: Synthetic oligonucleotide
  Target: ATXN1; (-) strand; PAM type: YTN; PAM sequence: CTT
caagaggctatttagcattt

SEQ ID NO: 196159 - DNA, 20 bp, Artificial Sequence
  Description of Artificial Sequence: Synthetic oligonucleotide
  Target: ATXN1; (-) strand; PAM type: YTN; PAM sequence: CTA
cttcaagaggctatttagca

SEQ ID NO: 196160 - DNA, 20 bp, Artificial Sequence
  Description of Artificial Sequence: Synthetic oligonucleotide
  Target: ATXN1; (-) strand; PAM type: YTN; PAM sequence: CTA
gatagtacactacttcaaga

SEQ ID NO: 196161 - DNA, 20 bp, Artificial Sequence
  Description of Artificial Sequence: Synthetic oligonucleotide
  Target: ATXN1; (-) strand; PAM type: YTN; PAM sequence: TTG
catgcctagatagtacacta

SEQ ID NO: 196162 - DNA, 20 bp, Artificial Sequence
  Description of Artificial Sequence: Synthetic oligonucleotide
  Target: ATXN1; (-) strand; PAM type: YTN; PAM sequence: CTT
gcatgcctagatagtacact

SEQ ID NO: 196163 - DNA, 20 bp, Artificial Sequence
  Description of Artificial Sequence: Synthetic oligonucleotide
  Target: ATXN1; (-) strand; PAM type: YTN; PAM sequence: TTC
ttgcatgcctagatagtaca

SEQ ID NO: 196164 - DNA, 20 bp, Artificial Sequence
  Description of Artificial Sequence: Synthetic oligonucleotide
  Target: ATXN1; (-) strand; PAM type: YTN; PAM sequence: CTT
cttgcatgcctagatagtac

SEQ ID NO: 196165 - DNA, 20 bp, Artificial Sequence
  Description of Artificial Sequence: Synthetic oligonucleotide
  Target: ATXN1; (-) strand; PAM type: YTN; PAM sequence: CTC
aagagtcttcttgcatgcct

SEQ ID NO: 196166 - DNA, 20 bp, Artificial Sequence
  Description of Artificial Sequence: Synthetic oligonucleotide
  Target: ATXN1; (-) strand; PAM type: YTN; PAM sequence: TTG
ctcaagagtcttcttgcatg

SEQ ID NO: 196167 - DNA, 20 bp, Artificial Sequence
  Description of Artificial Sequence: Synthetic oligonucleotide
  Target: ATXN1; (-) strand; PAM type: YTN; PAM sequence: TTG
ttgctcaagagtcttcttgc

SEQ ID NO: 196168 - DNA, 20 bp, Artificial Sequence
  Description of Artificial Sequence: Synthetic oligonucleotide
  Target: ATXN1; (-) strand; PAM type: YTN; PAM sequence: TTG
ttgttgctcaagagtcttct

SEQ ID NO: 196169 - DNA, 20 bp, Artificial Sequence
  Description of Artificial Sequence: Synthetic oligonucleotide
  Target: ATXN1; (-) strand; PAM type: YTN; PAM sequence: TTT
gttgttgctcaagagtcttc

SEQ ID NO: 196170 - DNA, 20 bp, Artificial Sequence
  Description of Artificial Sequence: Synthetic oligonucleotide
  Target: ATXN1; (-) strand; PAM type: YTN; PAM sequence: TTT
tgttgttgctcaagagtctt

SEQ ID NO: 196171 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgctcaagagtct

SEQ ID NO: 196172 - DNA, 20 bp, Artificial Sequence
  Description of Artificial Sequence: Synthetic oligonucleotide
  Target: ATXN1; (-) strand; PAM type: YTN; PAM sequence: TTT
tttgttgttgctcaagagtc

SEQ ID NO: 196173 - DNA, 20 bp, Artificial Sequence
  Description of Artificial Sequence: Synthetic oligonucleotide
  Target: ATXN1; (-) strand; PAM type: YTN; PAM sequence: TTG
ttttttgttgttgctcaaga

SEQ ID NO: 196174 - DNA, 20 bp, Artificial Sequence
  Description of Artificial Sequence: Synthetic oligonucleotide
  Target: ATXN1; (-) strand; PAM type: YTN; PAM sequence: TTT
gttttttgttgttgctcaag

SEQ ID NO: 196175 - DNA, 20 bp, Artificial Sequence
  Description of Artificial Sequence: Synthetic oligonucleotide
  Target: ATXN1; (-) strand; PAM type: YTN; PAM sequence: TTA
atcaaggtatttgttttttg

SEQ ID NO: 196176 - DNA, 20 bp, Artificial Sequence
  Description of Artificial Sequence: Synthetic oligonucleotide
  Target: ATXN1; (-) strand; PAM type: YTN; PAM sequence: TTT
aatcaaggtatttgtttttt

SEQ ID NO: 196177 - DNA, 20 bp, Artificial Sequence
  Description of Artificial Sequence: Synthetic oligonucleotide
  Target: ATXN1; (-) strand; PAM type: YTN; PAM sequence: TTT
taatcaaggtatttgttttt

SEQ ID NO: 196178 - DNA, 20 bp, Artificial Sequence
  Description of Artificial Sequence: Synthetic oligonucleotide
  Target: ATXN1; (-) strand; PAM type: YTN; PAM sequence: TTT
ttaatcaaggtatttgtttt

SEQ ID NO: 196179 - DNA, 20 bp, Artificial Sequence
  Description of Artificial Sequence: Synthetic oligonucleotide
  Target: ATXN1; (-) strand; PAM type: YTN; PAM sequence: TTT
tttaatcaaggtatttgttt

SEQ ID NO: 196180 - DNA, 20 bp, Artificial Sequence
  Description of Artificial Sequence: Synthetic oligonucleotide
  Target: ATXN1; (-) strand; PAM type: YTN; PAM sequence: TTG
cccattttttaatcaaggta

SEQ ID NO: 196181 - DNA, 20 bp, Artificial Sequence
  Description of Artificial Sequence: Synthetic oligonucleotide
  Target: ATXN1; (-) strand; PAM type: YTN; PAM sequence: TTT
gcccattttttaatcaaggt

SEQ ID NO: 196182 - DNA, 20 bp, Artificial Sequence
  Description of Artificial Sequence: Synthetic oligonucleotide
  Target: ATXN1; (-) strand; PAM type: YTN; PAM sequence: CTT
tgcccattttttaatcaagg

SEQ ID NO: 196183 - DNA, 20 bp, Artificial Sequence
  Description of Artificial Sequence: Synthetic oligonucleotide
  Target: ATXN1; (-) strand; PAM type: YTN; PAM sequence: TTC
aagtcctttgcccatttttt

SEQ ID NO: 196184 - DNA, 20 bp, Artificial Sequence
  Description of Artificial Sequence: Synthetic oligonucleotide
  Target: ATXN1; (-) strand; PAM type: YTN; PAM sequence: TTG
aagaaatgtcaattcaagtc

SEQ ID NO: 196185 - DNA, 20 bp, Artificial Sequence
  Description of Artificial Sequence: Synthetic oligonucleotide
  Target: ATXN1; (-) strand; PAM type: YTN; PAM sequence: TTT
gaagaaatgtcaattcaagt

SEQ ID NO: 196186 - DNA, 20 bp, Artificial Sequence
  Description of Artificial Sequence: Synthetic oligonucleotide
  Target: ATXN1; (-) strand; PAM type: YTN; PAM sequence: CTT
tgaagaaatgtcaattcaag

SEQ ID NO: 196187 - DNA, 20 bp, Artificial Sequence
  Description of Artificial Sequence: Synthetic oligonucleotide
  Target: ATXN1; (-) strand; PAM type: YTN; PAM sequence: TTC
tttgaagaaatgtcaattca

SEQ ID NO: 196188 - DNA, 20 bp, Artificial Sequence
  Description of Artificial Sequence: Synthetic oligonucleotide
  Target: ATXN1; (-) strand; PAM type: YTN; PAM sequence: TTT
ctttgaagaaatgtcaattc

SEQ ID NO: 196189 - DNA, 20 bp, Artificial Sequence
  Description of Artificial Sequence: Synthetic oligonucleotide
  Target: ATXN1; (-) strand; PAM type: YTN; PAM sequence: TTT
tctttgaagaaatgtcaatt

SEQ ID NO: 196190 - DNA, 20 bp, Artificial Sequence
  Description of Artificial Sequence: Synthetic oligonucleotide
  Target: ATXN1; (-) strand; PAM type: YTN; PAM sequence: TTG
catattttctttgaagaaat

SEQ ID NO: 196191 - DNA, 20 bp, Artificial Sequence
  Description of Artificial Sequence: Synthetic oligonucleotide
  Target: ATXN1; (-) strand; PAM type: YTN; PAM sequence: TTT
gcatattttctttgaagaaa

SEQ ID NO: 196192 - DNA, 20 bp, Artificial Sequence
  Description of Artificial Sequence: Synthetic oligonucleotide
  Target: ATXN1; (-) strand; PAM type: YTN; PAM sequence: TTA
atggtcatttgcatattttc

SEQ ID NO: 196193 - DNA, 20 bp, Artificial Sequence
  Description of Artificial Sequence: Synthetic oligonucleotide
  Target: ATXN1; (-) strand; PAM type: YTN; PAM sequence: CTT
aatggtcatttgcatatttt

SEQ ID NO: 196194 - DNA, 20 bp, Artificial Sequence
  Description of Artificial Sequence: Synthetic oligonucleotide
  Target: ATXN1; (-) strand; PAM type: YTN; PAM sequence: TTC
gtgtgcttaatggtcatttg

SEQ ID NO: 196195 - DNA, 20 bp, Artificial Sequence
  Description of Artificial Sequence: Synthetic oligonucleotide
  Target: ATXN1; (-) strand; PAM type: YTN; PAM sequence: TTT
cgtgtgcttaatggtcattt

SEQ ID NO: 196196 - DNA, 20 bp, Artificial Sequence
  Description of Artificial Sequence: Synthetic oligonucleotide
  Target: ATXN1; (-) strand; PAM type: YTN; PAM sequence: TTT
tcgtgtgcttaatggtcatt

SEQ ID NO: 196197 - DNA, 20 bp, Artificial Sequence
  Description of Artificial Sequence: Synthetic oligonucleotide
  Target: ATXN1; (-) strand; PAM type: YTN; PAM sequence: CTT
ttcgtgtgcttaatggtcat

SEQ ID NO: 196198 - DNA, 20 bp, Artificial Sequence
  Description of Artificial Sequence: Synthetic oligonucleotide
  Target: ATXN1; (-) strand; PAM type: YTN; PAM sequence: TTG
agtgtcttttcgtgtgctta

SEQ ID NO: 196199 - DNA, 20 bp, Artificial Sequence
  Description of Artificial Sequence: Synthetic oligonucleotide
  Target: ATXN1; (-) strand; PAM type: YTN; PAM sequence: TTA
gtgatgttgagtgtcttttc

SEQ ID NO: 196200 - DNA, 20 bp, Artificial Sequence
  Description of Artificial Sequence: Synthetic oligonucleotide
  Target: ATXN1; (-) strand; PAM type: YTN; PAM sequence: CTA
atgattagtgatgttgagtg

SEQ ID NO: 196201 - DNA, 20 bp, Artificial Sequence
  Description of Artificial Sequence: Synthetic oligonucleotide
  Target: ATXN1; (-) strand; PAM type: YTN; PAM sequence: TTC
ctaatgattagtgatgttga

SEQ ID NO: 196202 - DNA, 20 bp, Artificial Sequence
  Description of Artificial Sequence: Synthetic oligonucleotide
  Target: ATXN1; (-) strand; PAM type: YTN; PAM sequence: TTT
cctaatgattagtgatgttg

SEQ ID NO: 196203 - DNA, 20 bp, Artificial Sequence
  Description of Artificial Sequence: Synthetic oligonucleotide
  Target: ATXN1; (-) strand; PAM type: YTN; PAM sequence: TTT
tcctaatgattagtgatgtt

SEQ ID NO: 196204 - DNA, 20 bp, Artificial Sequence
  Description of Artificial Sequence: Synthetic oligonucleotide
  Target: ATXN1; (-) strand; PAM type: YTN; PAM sequence: TTG
cattttcctaatgattagtg

SEQ ID NO: 196205 - DNA, 20 bp, Artificial Sequence
  Description of Artificial Sequence: Synthetic oligonucleotide
  Target: ATXN1; (-) strand; PAM type: YTN; PAM sequence: TTT
gcattttcctaatgattagt

SEQ ID NO: 196206 - DNA, 20 bp, Artificial Sequence
  Description of Artificial Sequence: Synthetic oligonucleotide
  Target: ATXN1; (-) strand; PAM type: YTN; PAM sequence: TTG
atttgcattttcctaatgat

SEQ ID NO: 196207 - DNA, 20 bp, Artificial Sequence
  Description of Artificial Sequence: Synthetic oligonucleotide
  Target: ATXN1; (-) strand; PAM type: YTN; PAM sequence: TTT
gatttgcattttcctaatga

SEQ ID NO: 196208 - DNA, 20 bp, Artificial Sequence
  Description of Artificial Sequence: Synthetic oligonucleotide
  Target: ATXN1; (-) strand; PAM type: YTN; PAM sequence: TTT
tgatttgcattttcctaatg

SEQ ID NO: 196209 - DNA, 20 bp, Artificial Sequence
  Description of Artificial Sequence: Synthetic oligonucleotide
  Target: ATXN1; (-) strand; PAM type: YTN; PAM sequence: TTG
tggttttgatttgcattttc

SEQ ID NO: 196210 - DNA, 20 bp, Artificial Sequence
  Description of Artificial Sequence: Synthetic oligonucleotide
  Target: ATXN1; (-) strand; PAM type: YTN; PAM sequence: TTA
atgtgagtgaaatggtatgt

SEQ ID NO: 196211 - DNA, 20 bp, Artificial Sequence
  Description of Artificial Sequence: Synthetic oligonucleotide
  Target: ATXN1; (-) strand; PAM type: YTN; PAM sequence: CTT
aatgtgagtgaaatggtatg

SEQ ID NO: 196212 - DNA, 20 bp, Artificial Sequence
  Description of Artificial Sequence: Synthetic oligonucleotide
  Target: ATXN1; (-) strand; PAM type: YTN; PAM sequence: TTA
atcagagccatcttaatgtg

SEQ ID NO: 196213 - DNA, 20 bp, Artificial Sequence
  Description of Artificial Sequence: Synthetic oligonucleotide
  Target: ATXN1; (-) strand; PAM type: YTN; PAM sequence: TTG
ttaatcagagccatcttaat

SEQ ID NO: 196214 - DNA, 20 bp, Artificial Sequence
  Description of Artificial Sequence: Synthetic oligonucleotide
  Target: ATXN1; (-) strand; PAM type: YTN; PAM sequence: TTG
ttgttaatcagagccatctt

SEQ ID NO: 196215 - DNA, 20 bp, Artificial Sequence
  Description of Artificial Sequence: Synthetic oligonucleotide
  Target: ATXN1; (-) strand; PAM type: YTN; PAM sequence: TTT
gttgttaatcagagccatct

SEQ ID NO: 196216 - DNA, 20 bp, Artificial Sequence
  Description of Artificial Sequence: Synthetic oligonucleotide
  Target: ATXN1; (-) strand; PAM type: YTN; PAM sequence: TTT
tgttgttaatcagagccatc

SEQ ID NO: 196217 - DNA, 20 bp, Artificial Sequence
  Description of Artificial Sequence: Synthetic oligonucleotide
  Target: ATXN1; (-) strand; PAM type: YTN; PAM sequence: TTT
ttgttgttaatcagagccat

SEQ ID NO: 196218 - DNA, 20 bp, Artificial Sequence
  Description of Artificial Sequence: Synthetic oligonucleotide
  Target: ATXN1; (-) strand; PAM type: YTN; PAM sequence: TTT
tttgttgttaatcagagcca

SEQ ID NO: 196219 - DNA, 20 bp, Artificial Sequence
  Description of Artificial Sequence: Synthetic oligonucleotide
  Target: ATXN1; (-) strand; PAM type: YTN; PAM sequence: TTT
ttttgttgttaatcagagcc

SEQ ID NO: 196220 - DNA, 20 bp, Artificial Sequence
  Description of Artificial Sequence: Synthetic oligonucleotide
  Target: ATXN1; (-) strand; PAM type: YTN; PAM sequence: TTT
tttttgttgttaatcagagc

SEQ ID NO: 196221 - DNA, 20 bp, Artificial Sequence
  Description of Artificial Sequence: Synthetic oligonucleotide
  Target: ATXN1; (-) strand; PAM type: YTN; PAM sequence: TTG
ttttttttgttgttaatcag

SEQ ID NO: 196222 - DNA, 20 bp, Artificial Sequence
  Description of Artificial Sequence: Synthetic oligonucleotide
  Target: ATXN1; (-) strand; PAM type: YTN; PAM sequence: TTG
ggggttgttttttttgttgt

SEQ ID NO: 196223 - DNA, 20 bp, Artificial Sequence
  Description of Artificial Sequence: Synthetic oligonucleotide
  Target: ATXN1; (-) strand; PAM type: YTN; PAM sequence: TTT
gggggttgttttttttgttg

SEQ ID NO: 196224 - DNA, 20 bp, Artificial Sequence
  Description of Artificial Sequence: Synthetic oligonucleotide
  Target: ATXN1; (-) strand; PAM type: YTN; PAM sequence: TTT
tgggggttgttttttttgtt

SEQ ID NO: 196225 - DNA, 20 bp, Artificial Sequence
  Description of Artificial Sequence: Synthetic oligonucleotide
  Target: ATXN1; (-) strand; PAM type: YTN; PAM sequence: TTG
ttttgggggttgtttttttt

SEQ ID NO: 196226 - DNA, 20 bp, Artificial Sequence
  Description of Artificial Sequence: Synthetic oligonucleotide
  Target: ATXN1; (-) strand; PAM type: YTN; PAM sequence: CTT
gttttgggggttgttttttt

SEQ ID NO: 196227 - DNA, 20 bp, Artificial Sequence
  Description of Artificial Sequence: Synthetic oligonucleotide
  Target: ATXN1; (-) strand; PAM type: YTN; PAM sequence: TTC
ttgttttgggggttgttttt

SEQ ID NO: 196228 - DNA, 20 bp, Artificial Sequence
  Description of Artificial Sequence: Synthetic oligonucleotide
  Target: ATXN1; (-) strand; PAM type: YTN; PAM sequence: TTT
cttgttttgggggttgtttt

SEQ ID NO: 196229 - DNA, 20 bp, Artificial Sequence
  Description of Artificial Sequence: Synthetic oligonucleotide
  Target: ATXN1; (-) strand; PAM type: YTN; PAM sequence: TTT
tcttgttttgggggttgttt

SEQ ID NO: 196230 - DNA, 20 bp, Artificial Sequence
  Description of Artificial Sequence: Synthetic oligonucleotide
  Target: ATXN1; (-) strand; PAM type: YTN; PAM sequence: TTA
ttttcttgttttgggggttg

SEQ ID NO: 196231 - DNA, 20 bp, Artificial Sequence
  Description of Artificial Sequence: Synthetic oligonucleotide
  Target: ATXN1; (-) strand; PAM type: YTN; PAM sequence: TTG
ttattttcttgttttggggg

SEQ ID NO: 196232 - DNA, 20 bp, Artificial Sequence
  Description of Artificial Sequence: Synthetic oligonucleotide
  Target: ATXN1; (-) strand; PAM type: YTN; PAM sequence: TTT
gttattttcttgttttgggg

SEQ ID NO: 196233 - DNA, 20 bp, Artificial Sequence
  Description of Artificial Sequence: Synthetic oligonucleotide
  Target: ATXN1; (-) strand; PAM type: YTN; PAM sequence: TTG
ccaacatttgttattttctt

SEQ ID NO: 196234 - DNA, 20 bp, Artificial Sequence
  Description of Artificial Sequence: Synthetic oligonucleotide
  Target: ATXN1; (-) strand; PAM type: YTN; PAM sequence: CTT
gccaacatttgttattttct

SEQ ID NO: 196235 - DNA, 20 bp, Artificial Sequence
  Description of Artificial Sequence: Synthetic oligonucleotide
  Target: ATXN1; (-) strand; PAM type: YTN; PAM sequence: TTG
tccacatccttgccaacatt

SEQ ID NO: 196236 - DNA, 20 bp, Artificial Sequence
  Description of Artificial Sequence: Synthetic oligonucleotide
  Target: ATXN1; (-) strand; PAM type: YTN; PAM sequence: TTT
gtccacatccttgccaacat

SEQ ID NO: 196237 - DNA, 20 bp, Artificial Sequence
  Description of Artificial Sequence: Synthetic oligonucleotide
  Target: ATXN1; (-) strand; PAM type: YTN; PAM sequence: TTC
caatttgtccacatccttgc

SEQ ID NO: 196238 - DNA, 20 bp, Artificial Sequence
  Description of Artificial Sequence: Synthetic oligonucleotide
  Target: ATXN1; (-) strand; PAM type: YTN; PAM sequence: CTA
tcagtaatgtacacagagtt

SEQ ID NO: 196239 - DNA, 20 bp, Artificial Sequence
  Description of Artificial Sequence: Synthetic oligonucleotide
  Target: ATXN1; (-) strand; PAM type: YTN; PAM sequence: TTC
tatcagtaatgtacacagag

SEQ ID NO: 196240 - DNA, 20 bp, Artificial Sequence
  Description of Artificial Sequence: Synthetic oligonucleotide
  Target: ATXN1; (-) strand; PAM type: YTN; PAM sequence: TTT
ctatcagtaatgtacacaga

SEQ ID NO: 196241 - DNA, 20 bp, Artificial Sequence
  Description of Artificial Sequence: Synthetic oligonucleotide
  Target: ATXN1; (-) strand; PAM type: YTN; PAM sequence: TTG
catttctatcagtaatgtac

SEQ ID NO: 196242 - DNA, 20 bp, Artificial Sequence
  Description of Artificial Sequence: Synthetic oligonucleotide
  Target: ATXN1; (-) strand; PAM type: YTN; PAM sequence: TTT
gcatttctatcagtaatgta

SEQ ID NO: 196243 - DNA, 20 bp, Artificial Sequence
  Description of Artificial Sequence: Synthetic oligonucleotide
  Target: ATXN1; (-) strand; PAM type: YTN; PAM sequence: TTT
tgcatttctatcagtaatgt

SEQ ID NO: 196244 - DNA, 20 bp, Artificial Sequence
  Description of Artificial Sequence: Synthetic oligonucleotide
  Target: ATXN1; (-) strand; PAM type: YTN; PAM sequence: CTG
taccattttgcatttctatc

SEQ ID NO: 196245 - DNA, 20 bp, Artificial Sequence
  Description of Artificial Sequence: Synthetic oligonucleotide
  Target: ATXN1; (-) strand; PAM type: YTN; PAM sequence: TTC
acagcagctgtaccattttg

SEQ ID NO: 196246 - DNA, 20 bp, Artificial Sequence
  Description of Artificial Sequence: Synthetic oligonucleotide
  Target: ATXN1; (-) strand; PAM type: YTN; PAM sequence: TTT
cacagcagctgtaccatttt

SEQ ID NO: 196247 - DNA, 20 bp, Artificial Sequence
  Description of Artificial Sequence: Synthetic oligonucleotide
  Target: ATXN1; (-) strand; PAM type: YTN; PAM sequence: TTT
tcacagcagctgtaccattt

SEQ ID NO: 196248 - DNA, 20 bp, Artificial Sequence
  Description of Artificial Sequence: Synthetic oligonucleotide
  Target: ATXN1; (-) strand; PAM type: YTN; PAM sequence: TTT
ttcacagcagctgtaccatt

SEQ ID NO: 196249 - DNA, 20 bp, Artificial Sequence
  Description of Artificial Sequence: Synthetic oligonucleotide
  Target: ATXN1; (-) strand; PAM type: YTN; PAM sequence: TTG
aggaaccatcatggtatttt

SEQ ID NO: 196250 - DNA, 20 bp, Artificial Sequence
  Description of Artificial Sequence: Synthetic oligonucleotide
  Target: ATXN1; (-) strand; PAM type: YTN; PAM sequence: TTT
gaggaaccatcatggtattt

SEQ ID NO: 196251 - DNA, 20 bp, Artificial Sequence
  Description of Artificial Sequence: Synthetic oligonucleotide
  Target: ATXN1; (-) strand; PAM type: YTN; PAM sequence: TTT
tgaggaaccatcatggtatt

SEQ ID NO: 196252 - DNA, 20 bp, Artificial Sequence
  Description of Artificial Sequence: Synthetic oligonucleotide
  Target: ATXN1; (-) strand; PAM type: YTN; PAM sequence: TTT
ttgaggaaccatcatggtat

SEQ ID NO: 196253 - DNA, 20 bp, Artificial Sequence
  Description of Artificial Sequence: Synthetic oligonucleotide
  Target: ATXN1; (-) strand; PAM type: YTN; PAM sequence: TTT
tttgaggaaccatcatggta

SEQ ID NO: 196254 - DNA, 20 bp, Artificial Sequence
  Description of Artificial Sequence: Synthetic oligonucleotide
  Target: ATXN1; (-) strand; PAM type: YTN; PAM sequence: TTA
aattttttgaggaaccatca

SEQ ID NO: 196255 - DNA, 20 bp, Artificial Sequence
  Description of Artificial Sequence: Synthetic oligonucleotide
  Target: ATXN1; (-) strand; PAM type: YTN; PAM sequence: TTT
aaattttttgaggaaccatc

SEQ ID NO: 196256 - DNA, 20 bp, Artificial Sequence
  Description of Artificial Sequence: Synthetic oligonucleotide
  Target: ATXN1; (-) strand; PAM type: YTN; PAM sequence: TTT
taaattttttgaggaaccat

SEQ ID NO: 196257 - DNA, 20 bp, Artificial Sequence
  Description of Artificial Sequence: Synthetic oligonucleotide
  Target: ATXN1; (-) strand; PAM type: YTN; PAM sequence: TTT
ttaaattttttgaggaacca

SEQ ID NO: 196258 - DNA, 20 bp, Artificial Sequence
  Description of Artificial Sequence: Synthetic oligonucleotide
  Target: ATXN1; (-) strand; PAM type: YTN; PAM sequence: TTT
tttaaattttttgaggaacc

SEQ ID NO: 196259 - DNA, 20 bp, Artificial Sequence
  Description of Artificial Sequence: Synthetic oligonucleotide
  Target: ATXN1; (-) strand; PAM type: YTN; PAM sequence: TTG
gtgaatcatgtagtattttt

SEQ ID NO: 196260 - DNA, 20 bp, Artificial Sequence
  Description of Artificial Sequence: Synthetic oligonucleotide
  Target: ATXN1; (-) strand; PAM type: YTN; PAM sequence: CTA
gaagtggaattggtgaatca

SEQ ID NO: 196261 - DNA, 20 bp, Artificial Sequence
  Description of Artificial Sequence: Synthetic oligonucleotide
  Target: ATXN1; (-) strand; PAM type: YTN; PAM sequence: TTG
ggtatatacctagaagtgga

SEQ ID NO: 196262 - DNA, 20 bp, Artificial Sequence
  Description of Artificial Sequence: Synthetic oligonucleotide
  Target: ATXN1; (-) strand; PAM type: YTN; PAM sequence: TTT
gggtatatacctagaagtgg

SEQ ID NO: 196263 - DNA, 20 bp, Artificial Sequence
  Description of Artificial Sequence: Synthetic oligonucleotide
  Target: ATXN1; (-) strand; PAM type: YTN; PAM sequence: TTT
tgggtatatacctagaagtg

SEQ ID NO: 196264 - DNA, 20 bp, Artificial Sequence
  Description of Artificial Sequence: Synthetic oligonucleotide
  Target: ATXN1; (-) strand; PAM type: YTN; PAM sequence: TTT
ttgggtatatacctagaagt

SEQ ID NO: 196265 - DNA, 20 bp, Artificial Sequence
  Description of Artificial Sequence: Synthetic oligonucleotide
  Target: ATXN1; (-) strand; PAM type: YTN; PAM sequence: TTT
tttgggtatatacctagaag

SEQ ID NO: 196266 - DNA, 20 bp, Artificial Sequence
  Description of Artificial Sequence: Synthetic oligonucleotide
  Target: ATXN1; (-) strand; PAM type: YTN; PAM sequence: TTT
ttttgggtatatacctagaa

SEQ ID NO: 196267 - DNA, 20 bp, Artificial Sequence
  Description of Artificial Sequence: Synthetic oligonucleotide
  Target: ATXN1; (-) strand; PAM type: YTN; PAM sequence: TTC
agtttttttgggtatatacc

SEQ ID NO: 196268 - DNA, 20 bp, Artificial Sequence
  Description of Artificial Sequence: Synthetic oligonucleotide
  Target: ATXN1; (-) strand; PAM type: YTN; PAM sequence: TTT
cagtttttttgggtatatac

SEQ ID NO: 196269 - DNA, 20 bp, Artificial Sequence
  Description of Artificial Sequence: Synthetic oligonucleotide
  Target: ATXN1; (-) strand; PAM type: YTN; PAM sequence: CTT
tcagtttttttgggtatata

SEQ ID NO: 196270 - DNA, 20 bp, Artificial Sequence
  Description of Artificial Sequence: Synthetic oligonucleotide
  Target: ATXN1; (-) strand; PAM type: YTN; PAM sequence: CTC
ctttcagtttttttgggtat

SEQ ID NO: 196271 - DNA, 20 bp, Artificial Sequence
  Description of Artificial Sequence: Synthetic oligonucleotide
  Target: ATXN1; (-) strand; PAM type: YTN; PAM sequence: TTC
aagtgcctcctttcagtttt

SEQ ID NO: 196272 - DNA, 20 bp, Artificial Sequence
  Description of Artificial Sequence: Synthetic oligonucleotide
  Target: ATXN1; (-) strand; PAM type: YTN; PAM sequence: CTG
ttcaagtgcctcctttcagt

SEQ ID NO: 196273 - DNA, 20 bp, Artificial Sequence
  Description of Artificial Sequence: Synthetic oligonucleotide
  Target: ATXN1; (-) strand; PAM type: YTN; PAM sequence: CTG
gtatacaaatatctgttcaa

SEQ ID NO: 196274 - DNA, 20 bp, Artificial Sequence
  Description of Artificial Sequence: Synthetic oligonucleotide
  Target: ATXN1; (-) strand; PAM type: YTN; PAM sequence: CTA
tgaacactggtatacaaata

SEQ ID NO: 196275 - DNA, 20 bp, Artificial Sequence
  Description of Artificial Sequence: Synthetic oligonucleotide
  Target: ATXN1; (-) strand; PAM type: YTN; PAM sequence: TTA
tgtggctatgaacactggta

SEQ ID NO: 196276 - DNA, 20 bp, Artificial Sequence
  Description of Artificial Sequence: Synthetic oligonucleotide
  Target: ATXN1; (-) strand; PAM type: YTN; PAM sequence: TTG
tgaattatgtggctatgaac

SEQ ID NO: 196277 - DNA, 20 bp, Artificial Sequence
  Description of Artificial Sequence: Synthetic oligonucleotide
  Target: ATXN1; (-) strand; PAM type: YTN; PAM sequence: TTA
ttgtgaattatgtggctatg

SEQ ID NO: 196278 - DNA, 20 bp, Artificial Sequence
  Description of Artificial Sequence: Synthetic oligonucleotide
  Target: ATXN1; (-) strand; PAM type: YTN; PAM sequence: TTA
ggttattgtgaattatgtgg

SEQ ID NO: 196279 - DNA, 20 bp, Artificial Sequence
  Description of Artificial Sequence: Synthetic oligonucleotide
  Target: ATXN1; (-) strand; PAM type: YTN; PAM sequence: TTT
aggttattgtgaattatgtg

SEQ ID NO: 196280 - DNA, 20 bp, Artificial Sequence
  Description of Artificial Sequence: Synthetic oligonucleotide
  Target: ATXN1; (-) strand; PAM type: YTN; PAM sequence: CTT
taggttattgtgaattatgt

SEQ ID NO: 196281 - DNA, 20 bp, Artificial Sequence
  Description of Artificial Sequence: Synthetic oligonucleotide
  Target: ATXN1; (-) strand; PAM type: YTN; PAM sequence: TTC
cactttaggttattgtgaat

SEQ ID NO: 196282 - DNA, 20 bp, Artificial Sequence
  Description of Artificial Sequence: Synthetic oligonucleotide
  Target: ATXN1; (-) strand; PAM type: YTN; PAM sequence: CTT
ccactttaggttattgtgaa

SEQ ID NO: 196283 - DNA, 20 bp, Artificial Sequence
  Description of Artificial Sequence: Synthetic oligonucleotide
  Target: ATXN1; (-) strand; PAM type: YTN; PAM sequence: TTG
cttccactttaggttattgt

SEQ ID NO: 196284 - DNA, 20 bp, Artificial Sequence
  Description of Artificial Sequence: Synthetic oligonucleotide
  Target: ATXN1; (-) strand; PAM type: YTN; PAM sequence: TTA
ggttgcttccactttaggtt

SEQ ID NO: 196285 - DNA, 20 bp, Artificial Sequence
  Description of Artificial Sequence: Synthetic oligonucleotide
  Target: ATXN1; (-) strand; PAM type: YTN; PAM sequence: CTT
aggttgcttccactttaggt

SEQ ID NO: 196286 - DNA, 20 bp, Artificial Sequence
  Description of Artificial Sequence: Synthetic oligonucleotide
  Target: ATXN1; (-) strand; PAM type: YTN; PAM sequence: TTG
atggacacttaggttgcttc

SEQ ID NO: 196287 - DNA, 20 bp, Artificial Sequence
  Description of Artificial Sequence: Synthetic oligonucleotide
  Target: ATXN1; (-) strand; PAM type: YTN; PAM sequence: TTC
atccattgatggacacttag

SEQ ID NO: 196288 - DNA, 20 bp, Artificial Sequence
  Description of Artificial Sequence: Synthetic oligonucleotide
  Target: ATXN1; (-) strand; PAM type: YTN; PAM sequence: CTA
ttcatccattgatggacact

SEQ ID NO: 196289 - DNA, 20 bp, Artificial Sequence
  Description of Artificial Sequence: Synthetic oligonucleotide
  Target: ATXN1; (-) strand; PAM type: YTN; PAM sequence: TTG
tatctattcatccattgatg

SEQ ID NO: 196290 - DNA, 20 bp, Artificial Sequence
  Description of Artificial Sequence: Synthetic oligonucleotide
  Target: ATXN1; (-) strand; PAM type: YTN; PAM sequence: TTT
gtatctattcatccattgat

SEQ ID NO: 196291 - DNA, 20 bp, Artificial Sequence
  Description of Artificial Sequence: Synthetic oligonucleotide
  Target: ATXN1; (-) strand; PAM type: YTN; PAM sequence: TTT
tgtatctattcatccattga

SEQ ID NO: 196292 - DNA, 20 bp, Artificial Sequence
  Description of Artificial Sequence: Synthetic oligonucleotide
  Target: ATXN1; (-) strand; PAM type: YTN; PAM sequence: TTG
cacatatgtatcacattttg

SEQ ID NO: 196293 - DNA, 20 bp, Artificial Sequence
  Description of Artificial Sequence: Synthetic oligonucleotide
  Target: ATXN1; (-) strand; PAM type: YTN; PAM sequence: CTG
aataatattgcacatatgta

SEQ ID NO: 196294 - DNA, 20 bp, Artificial Sequence
  Description of Artificial Sequence: Synthetic oligonucleotide
  Target: ATXN1; (-) strand; PAM type: YTN; PAM sequence: TTA
gggctgaataatattgcaca

SEQ ID NO: 196295 - DNA, 20 bp, Artificial Sequence
  Description of Artificial Sequence: Synthetic oligonucleotide
  Target: ATXN1; (-) strand; PAM type: YTN; PAM sequence: TTT
agggctgaataatattgcac

SEQ ID NO: 196296 - DNA, 20 bp, Artificial Sequence
  Description of Artificial Sequence: Synthetic oligonucleotide
  Target: ATXN1; (-) strand; PAM type: YTN; PAM sequence: CTT
tagggctgaataatattgca

SEQ ID NO: 196297 - DNA, 20 bp, Artificial Sequence
  Description of Artificial Sequence: Synthetic oligonucleotide
  Target: ATXN1; (-) strand; PAM type: YTN; PAM sequence: CTC
tttagggctgaataatattg

SEQ ID NO: 196298 - DNA, 20 bp, Artificial Sequence
  Description of Artificial Sequence: Synthetic oligonucleotide
  Target: ATXN1; (-) strand; PAM type: YTN; PAM sequence: TTC
ctctttagggctgaataata

SEQ ID NO: 196299 - DNA, 20 bp, Artificial Sequence
  Description of Artificial Sequence: Synthetic oligonucleotide
  Target: ATXN1; (-) strand; PAM type: YTN; PAM sequence: CTT
cctctttagggctgaataat

SEQ ID NO: 196300 - DNA, 20 bp, Artificial Sequence
  Description of Artificial Sequence: Synthetic oligonucleotide
  Target: ATXN1; (-) strand; PAM type: YTN; PAM sequence: CTC
cttcctctttagggctgaat

SEQ ID NO: 196301 - DNA, 20 bp, Artificial Sequence
  Description of Artificial Sequence: Synthetic oligonucleotide
  Target: ATXN1; (-) strand; PAM type: YTN; PAM sequence: TTG
tagcatgtgtcagaatctcc

SEQ ID NO: 196302 - DNA, 20 bp, Artificial Sequence
  Description of Artificial Sequence: Synthetic oligonucleotide
  Target: ATXN1; (-) strand; PAM type: YTN; PAM sequence: CTG
catatccatgttgtagcatg

SEQ ID NO: 196303 - DNA, 20 bp, Artificial Sequence
  Description of Artificial Sequence: Synthetic oligonucleotide
  Target: ATXN1; (-) strand; PAM type: YTN; PAM sequence: TTC
ccaaagcaaaactgcatatc

SEQ ID NO: 196304 - DNA, 20 bp, Artificial Sequence
  Description of Artificial Sequence: Synthetic oligonucleotide
  Target: ATXN1; (-) strand; PAM type: YTN; PAM sequence: CTT
cccaaagcaaaactgcatat

SEQ ID NO: 196305 - DNA, 20 bp, Artificial Sequence
  Description of Artificial Sequence: Synthetic oligonucleotide
  Target: ATXN1; (-) strand; PAM type: YTN; PAM sequence: TTC
atcttcccaaagcaaaactg

SEQ ID NO: 196306 - DNA, 20 bp, Artificial Sequence
  Description of Artificial Sequence: Synthetic oligonucleotide
  Target: ATXN1; (-) strand; PAM type: YTN; PAM sequence: TTT
catcttcccaaagcaaaact

SEQ ID NO: 196307 - DNA, 20 bp, Artificial Sequence
  Description of Artificial Sequence: Synthetic oligonucleotide
  Target: ATXN1; (-) strand; PAM type: YTN; PAM sequence: TTT
tcatcttcccaaagcaaaac

SEQ ID NO: 196308 - DNA, 20 bp, Artificial Sequence
  Description of Artificial Sequence: Synthetic oligonucleotide
  Target: ATXN1; (-) strand; PAM type: YTN; PAM sequence: TTC
agaacgttttcatcttccca

SEQ ID NO: 196309 - DNA, 20 bp, Artificial Sequence
  Description of Artificial Sequence: Synthetic oligonucleotide
  Target: ATXN1; (-) strand; PAM type: YTN; PAM sequence: CTT
cagaacgttttcatcttccc

SEQ ID NO: 196310 - DNA, 20 bp, Artificial Sequence
  Description of Artificial Sequence: Synthetic oligonucleotide
  Target: ATXN1; (-) strand; PAM type: YTN; PAM sequence: TTG
cagtcatcaccacgatccat

SEQ ID NO: 196311 - DNA, 20 bp, Artificial Sequence
  Description of Artificial Sequence: Synthetic oligonucleotide
  Target: ATXN1; (-) strand; PAM type: YTN; PAM sequence: TTA
tattgcagtcatcaccacga

SEQ ID NO: 196312 - DNA, 20 bp, Artificial Sequence
  Description of Artificial Sequence: Synthetic oligonucleotide
  Target: ATXN1; (-) strand; PAM type: YTN; PAM sequence: TTC
acattatattgcagtcatca

SEQ ID NO: 196313 - DNA, 20 bp, Artificial Sequence
  Description of Artificial Sequence: Synthetic oligonucleotide
  Target: ATXN1; (-) strand; PAM type: YTN; PAM sequence: TTA
agtacattcacattatattg

SEQ ID NO: 196314 - DNA, 20 bp, Artificial Sequence
  Description of Artificial Sequence: Synthetic oligonucleotide
  Target: ATXN1; (-) strand; PAM type: YTN; PAM sequence: TTC
agtggcattaagtacattca

SEQ ID NO: 196315 - DNA, 20 bp, Artificial Sequence
  Description of Artificial Sequence: Synthetic oligonucleotide
  Target: ATXN1; (-) strand; PAM type: YTN; PAM sequence: TTA
agtgtacagttcagtggcat

SEQ ID NO: 196316 - DNA, 20 bp, Artificial Sequence
  Description of Artificial Sequence: Synthetic oligonucleotide
  Target: ATXN1; (-) strand; PAM type: YTN; PAM sequence: TTT
aagtgtacagttcagtggca

SEQ ID NO: 196317 - DNA, 20 bp, Artificial Sequence
  Description of Artificial Sequence: Synthetic oligonucleotide
  Target: ATXN1; (-) strand; PAM type: YTN; PAM sequence: TTT
taagtgtacagttcagtggc

SEQ ID NO: 196318 - DNA, 20 bp, Artificial Sequence
  Description of Artificial Sequence: Synthetic oligonucleotide
  Target: ATXN1; (-) strand; PAM type: YTN; PAM sequence: TTT
ttaagtgtacagttcagtgg

SEQ ID NO: 196319 - DNA, 20 bp, Artificial Sequence
  Description of Artificial Sequence: Synthetic oligonucleotide
  Target: ATXN1; (-) strand; PAM type: YTN; PAM sequence: TTC
ccatttttaagtgtacagtt

SEQ ID NO: 196320 - DNA, 20 bp, Artificial Sequence
  Description of Artificial Sequence: Synthetic oligonucleotide
  Target: ATXN1; (-) strand; PAM type: YTN; PAM sequence: TTT
cccatttttaagtgtacagt

SEQ ID NO: 196321 - DNA, 20 bp, Artificial Sequence
  Description of Artificial Sequence: Synthetic oligonucleotide
  Target: ATXN1; (-) strand; PAM type: YTN; PAM sequence: TTT
tcccatttttaagtgtacag

SEQ ID NO: 196322 - DNA, 20 bp, Artificial Sequence
  Description of Artificial Sequence: Synthetic oligonucleotide
  Target: ATXN1; (-) strand; PAM type: YTN; PAM sequence: TTT
ttcccatttttaagtgtaca

SEQ ID NO: 196323 - DNA, 20 bp, Artificial Sequence
  Description of Artificial Sequence: Synthetic oligonucleotide
  Target: ATXN1; (-) strand; PAM type: YTN; PAM sequence: TTC
atcatttttcccatttttaa

SEQ ID NO: 196324 - DNA, 20 bp, Artificial Sequence
  Description of Artificial Sequence: Synthetic oligonucleotide
  Target: ATXN1; (-) strand; PAM type: YTN; PAM sequence: TTG
tgataaaattcatcattttt

SEQ ID NO: 196325 - DNA, 20 bp, Artificial Sequence
  Description of Artificial Sequence: Synthetic oligonucleotide
  Target: ATXN1; (-) strand; PAM type: YTN; PAM sequence: TTA
ttgtgataaaattcatcatt

SEQ ID NO: 196326 - DNA, 20 bp, Artificial Sequence
  Description of Artificial Sequence: Synthetic oligonucleotide
  Target: ATXN1; (-) strand; PAM type: YTN; PAM sequence: TTT
attgtgataaaattcatcat

SEQ ID NO: 196327 - DNA, 20 bp, Artificial Sequence
  Description of Artificial Sequence: Synthetic oligonucleotide
  Target: ATXN1; (-) strand; PAM type: YTN; PAM sequence: TTT
tattgtgataaaattcatca

SEQ ID NO: 196328 - DNA, 20 bp, Artificial Sequence
  Description of Artificial Sequence: Synthetic oligonucleotide
  Target: ATXN1; (-) strand; PAM type: YTN; PAM sequence: TTT
ttattgtgataaaattcatc

SEQ ID NO: 196329 - DNA, 20 bp, Artificial Sequence
  Description of Artificial Sequence: Synthetic oligonucleotide
  Target: ATXN1; (-) strand; PAM type: YTN; PAM sequence: CTT
tttattgtgataaaattcat

SEQ ID NO: 196330 - DNA, 20 bp, Artificial Sequence
  Description of Artificial Sequence: Synthetic oligonucleotide
  Target: ATXN1; (-) strand; PAM type: YTN; PAM sequence: TTC
tttttattgtgataaaattc

SEQ ID NO: 196331 - DNA, 20 bp, Artificial Sequence
  Description of Artificial Sequence: Synthetic oligonucleotide
  Target: ATXN1; (-) strand; PAM type: YTN; PAM sequence: CTT
ctttttattgtgataaaatt

SEQ ID NO: 196332 - DNA, 20 bp, Artificial Sequence
  Description of Artificial Sequence: Synthetic oligonucleotide
  Target: ATXN1; (-) strand; PAM type: YTN; PAM sequence: TTC
ttctttttattgtgataaaa

SEQ ID NO: 196333 - DNA, 20 bp, Artificial Sequence
  Description of Artificial Sequence: Synthetic oligonucleotide
  Target: ATXN1; (-) strand; PAM type: YTN; PAM sequence: CTT
cttctttttattgtgataaa

SEQ ID NO: 196334 - DNA, 20 bp, Artificial Sequence
  Description of Artificial Sequence: Synthetic oligonucleotide
  Target: ATXN1; (-) strand; PAM type: YTN; PAM sequence: TTC
ttcttctttttattgtgata

SEQ ID NO: 196335 - DNA, 20 bp, Artificial Sequence
  Description of Artificial Sequence: Synthetic oligonucleotide
  Target: ATXN1; (-) strand; PAM type: YTN; PAM sequence: CTT
cttcttctttttattgtgat

SEQ ID NO: 196336 - DNA, 20 bp, Artificial Sequence
  Description of Artificial Sequence: Synthetic oligonucleotide
  Target: ATXN1; (-) strand; PAM type: YTN; PAM sequence: TTC
ttcttcttctttttattgtg

SEQ ID NO: 196337 - DNA, 20 bp, Artificial Sequence
  Description of Artificial Sequence: Synthetic oligonucleotide
  Target: ATXN1; (-) strand; PAM type: YTN; PAM sequence: CTT
cttcttcttctttttattgt

SEQ ID NO: 196338 - DNA, 20 bp, Artificial Sequence
  Description of Artificial Sequence: Synthetic oligonucleotide
  Target: ATXN1; (-) strand; PAM type: YTN; PAM sequence: TTC
ttcttcttcttctttttatt

SEQ ID NO: 196339 - DNA, 20 bp, Artificial Sequence
  Description of Artificial Sequence: Synthetic oligonucleotide
  Target: ATXN1; (-) strand; PAM type: YTN; PAM sequence: CTT
cttcttcttcttctttttat

SEQ ID NO: 196340 - DNA, 20 bp, Artificial Sequence
  Description of Artificial Sequence: Synthetic oligonucleotide
  Target: ATXN1; (-) strand; PAM type: YTN; PAM sequence: TTA
taaggtcaagtgatcacagg

SEQ ID NO: 196341 - DNA, 20 bp, Artificial Sequence
  Description of Artificial Sequence: Synthetic oligonucleotide
  Target: ATXN1; (-) strand; PAM type: YTN; PAM sequence: CTT
ataaggtcaagtgatcacag

SEQ ID NO: 196342 - DNA, 20 bp, Artificial Sequence
  Description of Artificial Sequence: Synthetic oligonucleotide
  Target: ATXN1; (-) strand; PAM type: YTN; PAM sequence: CTC
ccttataaggtcaagtgatc

SEQ ID NO: 196343 - DNA, 20 bp, Artificial Sequence
  Description of Artificial Sequence: Synthetic oligonucleotide
  Target: ATXN1; (-) strand; PAM type: YTN; PAM sequence: CTG
aaaagctcccttataaggtc

SEQ ID NO: 196344 - DNA, 20 bp, Artificial Sequence
  Description of Artificial Sequence: Synthetic oligonucleotide
  Target: ATXN1; (-) strand; PAM type: YTN; PAM sequence: TTG
atccaaacagatcacctgaa

SEQ ID NO: 196345 - DNA, 20 bp, Artificial Sequence
  Description of Artificial Sequence: Synthetic oligonucleotide
  Target: ATXN1; (-) strand; PAM type: YTN; PAM sequence: CTT
gatccaaacagatcacctga

SEQ ID NO: 196346 - DNA, 20 bp, Artificial Sequence
  Description of Artificial Sequence: Synthetic oligonucleotide
  Target: ATXN1; (-) strand; PAM type: YTN; PAM sequence: TTG
ggatatcttgatccaaacag

SEQ ID NO: 196347 - DNA, 20 bp, Artificial Sequence
  Description of Artificial Sequence: Synthetic oligonucleotide
  Target: ATXN1; (-) strand; PAM type: YTN; PAM sequence: CTT
gggatatcttgatccaaaca

SEQ ID NO: 196348 - DNA, 20 bp, Artificial Sequence
  Description of Artificial Sequence: Synthetic oligonucleotide
  Target: ATXN1; (-) strand; PAM type: YTN; PAM sequence: TTC
ttgggatatcttgatccaaa

SEQ ID NO: 196349 - DNA, 20 bp, Artificial Sequence
  Description of Artificial Sequence: Synthetic oligonucleotide
  Target: ATXN1; (-) strand; PAM type: YTN; PAM sequence: CTT
cttgggatatcttgatccaa

SEQ ID NO: 196350 - DNA, 20 bp, Artificial Sequence
  Description of Artificial Sequence: Synthetic oligonucleotide
  Target: ATXN1; (-) strand; PAM type: YTN; PAM sequence: TTG
aaacttcttgggatatcttg

SEQ ID NO: 196351 - DNA, 20 bp, Artificial Sequence
  Description of Artificial Sequence: Synthetic oligonucleotide
  Target: ATXN1; (-) strand; PAM type: YTN; PAM sequence: TTT
gaaacttcttgggatatctt

SEQ ID NO: 196352 - DNA, 20 bp, Artificial Sequence
  Description of Artificial Sequence: Synthetic oligonucleotide
  Target: ATXN1; (-) strand; PAM type: YTN; PAM sequence: CTC
atttgaaacttcttgggata

SEQ ID NO: 196353 - DNA, 20 bp, Artificial Sequence
  Description of Artificial Sequence: Synthetic oligonucleotide
  Target: ATXN1; (-) strand; PAM type: YTN; PAM sequence: CTC
tcatttgaaacttcttggga

SEQ ID NO: 196354 - DNA, 20 bp, Artificial Sequence
  Description of Artificial Sequence: Synthetic oligonucleotide
  Target: ATXN1; (-) strand; PAM type: YTN; PAM sequence: TTC
aactctcatttgaaacttct

SEQ ID NO: 196355 - DNA, 20 bp, Artificial Sequence
  Description of Artificial Sequence: Synthetic oligonucleotide
  Target: ATXN1; (-) strand; PAM type: YTN; PAM sequence: TTT
caactctcatttgaaacttc

SEQ ID NO: 196356 - DNA, 20 bp, Artificial Sequence
  Description of Artificial Sequence: Synthetic oligonucleotide
  Target: ATXN1; (-) strand; PAM type: YTN; PAM sequence: CTC
aagtttcaactctcatttga

SEQ ID NO: 196357 - DNA, 20 bp, Artificial Sequence
  Description of Artificial Sequence: Synthetic oligonucleotide
  Target: ATXN1; (-) strand; PAM type: YTN; PAM sequence: CTC
tcaagtttcaactctcattt

SEQ ID NO: 196358 - DNA, 20 bp, Artificial Sequence
  Description of Artificial Sequence: Synthetic oligonucleotide
  Target: ATXN1; (-) strand; PAM type: YTN; PAM sequence: CTC
ccataaaccaaccctctcaa

SEQ ID NO: 196359 - DNA, 20 bp, Artificial Sequence
  Description of Artificial Sequence: Synthetic oligonucleotide
  Target: ATXN1; (-) strand; PAM type: YTN; PAM sequence: CTG
cctcccataaaccaaccctc

SEQ ID NO: 196360 - DNA, 20 bp, Artificial Sequence
  Description of Artificial Sequence: Synthetic oligonucleotide
  Target: ATXN1; (-) strand; PAM type: YTN; PAM sequence: TTC
atcagctgcctcccataaac

SEQ ID NO: 196361 - DNA, 20 bp, Artificial Sequence
  Description of Artificial Sequence: Synthetic oligonucleotide
  Target: ATXN1; (-) strand; PAM type: YTN; PAM sequence: CTC
aaacgaggtcacagttcatc

SEQ ID NO: 196362 - DNA, 20 bp, Artificial Sequence
  Description of Artificial Sequence: Synthetic oligonucleotide
  Target: ATXN1; (-) strand; PAM type: YTN; PAM sequence: CTG
gaacactcaaacgaggtcac

SEQ ID NO: 196363 - DNA, 20 bp, Artificial Sequence
  Description of Artificial Sequence: Synthetic oligonucleotide
  Target: ATXN1; (-) strand; PAM type: YTN; PAM sequence: TTC
ctggaacactcaaacgaggt

SEQ ID NO: 196364 - DNA, 20 bp, Artificial Sequence
  Description of Artificial Sequence: Synthetic oligonucleotide
  Target: ATXN1; (-) strand; PAM type: YTN; PAM sequence: TTT
cctggaacactcaaacgagg

SEQ ID NO: 196365 - DNA, 20 bp, Artificial Sequence
  Description of Artificial Sequence: Synthetic oligonucleotide
  Target: ATXN1; (-) strand; PAM type: YTN; PAM sequence: CTA
gatgtggaagccgatttcct

SEQ ID NO: 196366 - DNA, 20 bp, Artificial Sequence
  Description of Artificial Sequence: Synthetic oligonucleotide
  Target: ATXN1; (-) strand; PAM type: YTN; PAM sequence: TTC
ctagatgtggaagccgattt

SEQ ID NO: 196367 - DNA, 20 bp, Artificial Sequence
  Description of Artificial Sequence: Synthetic oligonucleotide
  Target: ATXN1; (-) strand; PAM type: YTN; PAM sequence: TTA
gtccaagtgattcctagatg

SEQ ID NO: 196368 - DNA, 20 bp, Artificial Sequence
  Description of Artificial Sequence: Synthetic oligonucleotide
  Target: ATXN1; (-) strand; PAM type: YTN; PAM sequence: TTT
agtccaagtgattcctagat

SEQ ID NO: 196369 - DNA, 20 bp, Artificial Sequence
  Description of Artificial Sequence: Synthetic oligonucleotide
  Target: ATXN1; (-) strand; PAM type: YTN; PAM sequence: TTT
tagtccaagtgattcctaga

SEQ ID NO: 196370 - DNA, 20 bp, Artificial Sequence
  Description of Artificial Sequence: Synthetic oligonucleotide
  Target: ATXN1; (-) strand; PAM type: YTN; PAM sequence: TTT
ttagtccaagtgattcctag

SEQ ID NO: 196371 - DNA, 20 bp, Artificial Sequence
  Description of Artificial Sequence: Synthetic oligonucleotide
  Target: ATXN1; (-) strand; PAM type: YTN; PAM sequence: TTT
tttagtccaagtgattccta

SEQ ID NO: 196372 - DNA, 20 bp, Artificial Sequence
  Description of Artificial Sequence: Synthetic oligonucleotide
  Target: ATXN1; (-) strand; PAM type: YTN; PAM sequence: CTT
ttttagtccaagtgattcct

SEQ ID NO: 196373 - DNA, 20 bp, Artificial Sequence
  Description of Artificial Sequence: Synthetic oligonucleotide
  Target: ATXN1; (-) strand; PAM type: YTN; PAM sequence: TTC
ttttttagtccaagtgattc

SEQ ID NO: 196374 - DNA, 20 bp, Artificial Sequence
  Description of Artificial Sequence: Synthetic oligonucleotide
  Target: ATXN1; (-) strand; PAM type: YTN; PAM sequence: CTC
acattcttttttagtccaag

SEQ ID NO: 196375 - DNA, 20 bp, Artificial Sequence
  Description of Artificial Sequence: Synthetic oligonucleotide
  Target: ATXN1; (-) strand; PAM type: YTN; PAM sequence: CTC
tcacattcttttttagtcca

SEQ ID NO: 196376 - DNA, 20 bp, Artificial Sequence
  Description of Artificial Sequence: Synthetic oligonucleotide
  Target: ATXN1; (-) strand; PAM type: YTN; PAM sequence: CTG
aatcaaaggagctctcacat

SEQ ID NO: 196377 - DNA, 20 bp, Artificial Sequence
  Description of Artificial Sequence: Synthetic oligonucleotide
  Target: ATXN1; (-) strand; PAM type: YTN; PAM sequence: CTC
tgaatcaaaggagctctcac

SEQ ID NO: 196378 - DNA, 20 bp, Artificial Sequence
  Description of Artificial Sequence: Synthetic oligonucleotide
  Target: ATXN1; (-) strand; PAM type: YTN; PAM sequence: CTC
actctgaatcaaaggagctc

SEQ ID NO: 196379 - DNA, 20 bp, Artificial Sequence
  Description of Artificial Sequence: Synthetic oligonucleotide
  Target: ATXN1; (-) strand; PAM type: YTN; PAM sequence: CTC
atgtgagagctcactctgaa

SEQ ID NO: 196380 - DNA, 20 bp, Artificial Sequence
  Description of Artificial Sequence: Synthetic oligonucleotide
  Target: ATXN1; (-) strand; PAM type: YTN; PAM sequence: TTA
caaatctcatgtgagagctc

SEQ ID NO: 196381 - DNA, 20 bp, Artificial Sequence
  Description of Artificial Sequence: Synthetic oligonucleotide
  Target: ATXN1; (-) strand; PAM type: YTN; PAM sequence: CTG
gccatattacaaatctcatg

SEQ ID NO: 196382 - DNA, 20 bp, Artificial Sequence
  Description of Artificial Sequence: Synthetic oligonucleotide
  Target: ATXN1; (-) strand; PAM type: YTN; PAM sequence: TTC
tggccatattacaaatctca

SEQ ID NO: 196383 - DNA, 20 bp, Artificial Sequence
  Description of Artificial Sequence: Synthetic oligonucleotide
  Target: ATXN1; (-) strand; PAM type: YTN; PAM sequence: TTG
caagcattctggccatatta

SEQ ID NO: 196384 - DNA, 20 bp, Artificial Sequence
  Description of Artificial Sequence: Synthetic oligonucleotide
  Target: ATXN1; (-) strand; PAM type: YTN; PAM sequence: CTC
agaaaaggatattgcaagca

SEQ ID NO: 196385 - DNA, 20 bp, Artificial Sequence
  Description of Artificial Sequence: Synthetic oligonucleotide
  Target: ATXN1; (-) strand; PAM type: YTN; PAM sequence: TTG
taaaactcagaaaaggatat

SEQ ID NO: 196386 - DNA, 20 bp, Artificial Sequence
  Description of Artificial Sequence: Synthetic oligonucleotide
  Target: ATXN1; (-) strand; PAM type: YTN; PAM sequence: CTG
aggttgtaaaactcagaaaa

SEQ ID NO: 196387 - DNA, 20 bp, Artificial Sequence
  Description of Artificial Sequence: Synthetic oligonucleotide
  Target: ATXN1; (-) strand; PAM type: YTN; PAM sequence: CTC
tgaggttgtaaaactcagaa

SEQ ID NO: 196388 - DNA, 20 bp, Artificial Sequence
  Description of Artificial Sequence: Synthetic oligonucleotide
  Target: ATXN1; (-) strand; PAM type: YTN; PAM sequence: TTG
ggtctctgaggttgtaaaac

SEQ ID NO: 196389 - DNA, 20 bp, Artificial Sequence
  Description of Artificial Sequence: Synthetic oligonucleotide
  Target: ATXN1; (-) strand; PAM type: YTN; PAM sequence: CTG
ccaaattgggtctctgaggt

SEQ ID NO: 196390 - DNA, 20 bp, Artificial Sequence
  Description of Artificial Sequence: Synthetic oligonucleotide
  Target: ATXN1; (-) strand; PAM type: YTN; PAM sequence: CTG
atccactgccaaattgggtc

SEQ ID NO: 196391 - DNA, 20 bp, Artificial Sequence
  Description of Artificial Sequence: Synthetic oligonucleotide
  Target: ATXN1; (-) strand; PAM type: YTN; PAM sequence: CTC
ctgatccactgccaaattgg

SEQ ID NO: 196392 - DNA, 20 bp, Artificial Sequence
  Description of Artificial Sequence: Synthetic oligonucleotide
  Target: ATXN1; (-) strand; PAM type: YTN; PAM sequence: TTA
ctcctgatccactgccaaat

SEQ ID NO: 196393 - DNA, 20 bp, Artificial Sequence
  Description of Artificial Sequence: Synthetic oligonucleotide
  Target: ATXN1; (-) strand; PAM type: YTN; PAM sequence: TTT
actcctgatccactgccaaa

SEQ ID NO: 196394 - DNA, 20 bp, Artificial Sequence
  Description of Artificial Sequence: Synthetic oligonucleotide
  Target: ATXN1; (-) strand; PAM type: YTN; PAM sequence: CTT
tactcctgatccactgccaa

SEQ ID NO: 196395 - DNA, 20 bp, Artificial Sequence
  Description of Artificial Sequence: Synthetic oligonucleotide
  Target: ATXN1; (-) strand; PAM type: YTN; PAM sequence: TTA
gtgactttactcctgatcca

SEQ ID NO: 196396 - DNA, 20 bp, Artificial Sequence
  Description of Artificial Sequence: Synthetic oligonucleotide
  Target: ATXN1; (-) strand; PAM type: YTN; PAM sequence: CTA
ttagtgactttactcctgat

SEQ ID NO: 196397 - DNA, 20 bp, Artificial Sequence
  Description of Artificial Sequence: Synthetic oligonucleotide
  Target: ATXN1; (-) strand; PAM type: YTN; PAM sequence: TTC
ctattagtgactttactcct

SEQ ID NO: 196398 - DNA, 20 bp, Artificial Sequence
  Description of Artificial Sequence: Synthetic oligonucleotide
  Target: ATXN1; (-) strand; PAM type: YTN; PAM sequence: TTG
ttcctattagtgactttact

SEQ ID NO: 196399 - DNA, 20 bp, Artificial Sequence
  Description of Artificial Sequence: Synthetic oligonucleotide
  Target: ATXN1; (-) strand; PAM type: YTN; PAM sequence: TTT
gttcctattagtgactttac

SEQ ID NO: 196400 - DNA, 20 bp, Artificial Sequence
  Description of Artificial Sequence: Synthetic oligonucleotide
  Target: ATXN1; (-) strand; PAM type: YTN; PAM sequence: TTT
tgttcctattagtgacttta

SEQ ID NO: 196401 - DNA, 20 bp, Artificial Sequence
  Description of Artificial Sequence: Synthetic oligonucleotide
  Target: ATXN1; (-) strand; PAM type: YTN; PAM sequence: CTT
ttgttcctattagtgacttt

SEQ ID NO: 196402 - DNA, 20 bp, Artificial Sequence
  Description of Artificial Sequence: Synthetic oligonucleotide
  Target: ATXN1; (-) strand; PAM type: YTN; PAM sequence: CTA
gcttttgttcctattagtga

SEQ ID NO: 196403 - DNA, 20 bp, Artificial Sequence
  Description of Artificial Sequence: Synthetic oligonucleotide
  Target: ATXN1; (-) strand; PAM type: YTN; PAM sequence: TTC
ctagcttttgttcctattag

SEQ ID NO: 196404 - DNA, 20 bp, Artificial Sequence
  Description of Artificial Sequence: Synthetic oligonucleotide
  Target: ATXN1; (-) strand; PAM type: YTN; PAM sequence: TTT
cctagcttttgttcctatta

SEQ ID NO: 196405 - DNA, 20 bp, Artificial Sequence
  Description of Artificial Sequence: Synthetic oligonucleotide
  Target: ATXN1; (-) strand; PAM type: YTN; PAM sequence: TTT
tcctagcttttgttcctatt

SEQ ID NO: 196406 - DNA, 20 bp, Artificial Sequence
  Description of Artificial Sequence: Synthetic oligonucleotide
  Target: ATXN1; (-) strand; PAM type: YTN; PAM sequence: CTC
catcaggtatggtaaatttt

SEQ ID NO: 196407 - DNA, 20 bp, Artificial Sequence
  Description of Artificial Sequence: Synthetic oligonucleotide
  Target: ATXN1; (-) strand; PAM type: YTN; PAM sequence: CTA
tgtccctccatcaggtatgg

SEQ ID NO: 196408 - DNA, 20 bp, Artificial Sequence
  Description of Artificial Sequence: Synthetic oligonucleotide
  Target: ATXN1; (-) strand; PAM type: YTN; PAM sequence: TTC
ctatgtccctccatcaggta

SEQ ID NO: 196409 - DNA, 20 bp, Artificial Sequence
  Description of Artificial Sequence: Synthetic oligonucleotide
  Target: ATXN1; (-) strand; PAM type: YTN; PAM sequence: TTT
cctatgtccctccatcaggt

SEQ ID NO: 196410 - DNA, 20 bp, Artificial Sequence
  Description of Artificial Sequence: Synthetic oligonucleotide
  Target: ATXN1; (-) strand; PAM type: YTN; PAM sequence: CTT
tcctatgtccctccatcagg

SEQ ID NO: 196411 - DNA, 20 bp, Artificial Sequence
  Description of Artificial Sequence: Synthetic oligonucleotide
  Target: ATXN1; (-) strand; PAM type: YTN; PAM sequence: TTG
ccctttcctatgtccctcca

SEQ ID NO: 196412 - DNA, 20 bp, Artificial Sequence
  Description of Artificial Sequence: Synthetic oligonucleotide
  Target: ATXN1; (-) strand; PAM type: YTN; PAM sequence: TTT
gccctttcctatgtccctcc

SEQ ID NO: 196413 - DNA, 20 bp, Artificial Sequence
  Description of Artificial Sequence: Synthetic oligonucleotide
  Target: ATXN1; (-) strand; PAM type: YTN; PAM sequence: CTT
tgccctttcctatgtccctc

SEQ ID NO: 196414 - DNA, 20 bp, Artificial Sequence
  Description of Artificial Sequence: Synthetic oligonucleotide
  Target: ATXN1; (-) strand; PAM type: YTN; PAM sequence: CTC
tttgccctttcctatgtccc

SEQ ID NO: 196415 - DNA, 20 bp, Artificial Sequence
  Description of Artificial Sequence: Synthetic oligonucleotide
  Target: ATXN1; (-) strand; PAM type: YTN; PAM sequence: TTA
cctctttgccctttcctatg

SEQ ID NO: 196416 - DNA, 20 bp, Artificial Sequence
  Description of Artificial Sequence: Synthetic oligonucleotide
  Target: ATXN1; (-) strand; PAM type: YTN; PAM sequence: TTT
acctctttgccctttcctat

SEQ ID NO: 196417 - DNA, 20 bp, Artificial Sequence
  Description of Artificial Sequence: Synthetic oligonucleotide
  Target: ATXN1; (-) strand; PAM type: YTN; PAM sequence: TTT
tacctctttgccctttccta

SEQ ID NO: 196418 - DNA, 20 bp, Artificial Sequence
  Description of Artificial Sequence: Synthetic oligonucleotide
  Target: ATXN1; (-) strand; PAM type: YTN; PAM sequence: CTT
ttacctctttgccctttcct

SEQ ID NO: 196419 - DNA, 20 bp, Artificial Sequence
  Description of Artificial Sequence: Synthetic oligonucleotide
  Target: ATXN1; (-) strand; PAM type: YTN; PAM sequence: TTC
ttttacctctttgccctttc

SEQ ID NO: 196420 - DNA, 20 bp, Artificial Sequence
  Description of Artificial Sequence: Synthetic oligonucleotide
  Target: ATXN1; (-) strand; PAM type: YTN; PAM sequence: TTT
cttttacctctttgcccttt

SEQ ID NO: 196421 - DNA, 20 bp, Artificial Sequence
  Description of Artificial Sequence: Synthetic oligonucleotide
  Target: ATXN1; (-) strand; PAM type: YTN; PAM sequence: TTA
cagggatttcttttacctct

SEQ ID NO: 196422 - DNA, 20 bp, Artificial Sequence
  Description of Artificial Sequence: Synthetic oligonucleotide
  Target: ATXN1; (-) strand; PAM type: YTN; PAM sequence: TTA
attacagggatttcttttac

SEQ ID NO: 196423 - DNA, 20 bp, Artificial Sequence
  Description of Artificial Sequence: Synthetic oligonucleotide
  Target: ATXN1; (-) strand; PAM type: YTN; PAM sequence: CTT
aattacagggatttctttta

SEQ ID NO: 196424 - DNA, 20 bp, Artificial Sequence
  Description of Artificial Sequence: Synthetic oligonucleotide
  Target: ATXN1; (-) strand; PAM type: YTN; PAM sequence: TTG
ccttaattacagggatttct

SEQ ID NO: 196425 - DNA, 20 bp, Artificial Sequence
  Description of Artificial Sequence: Synthetic oligonucleotide
  Target: ATXN1; (-) strand; PAM type: YTN; PAM sequence: TTT
gccttaattacagggatttc

SEQ ID NO: 196426 - DNA, 20 bp, Artificial Sequence
  Description of Artificial Sequence: Synthetic oligonucleotide
  Target: ATXN1; (-) strand; PAM type: YTN; PAM sequence: CTT
tgccttaattacagggattt

SEQ ID NO: 196427 - DNA, 20 bp, Artificial Sequence
  Description of Artificial Sequence: Synthetic oligonucleotide
  Target: ATXN1; (-) strand; PAM type: YTN; PAM sequence: TTG
gctttgccttaattacaggg

SEQ ID NO: 196428 - DNA, 20 bp, Artificial Sequence
  Description of Artificial Sequence: Synthetic oligonucleotide
  Target: ATXN1; (-) strand; PAM type: YTN; PAM sequence: CTG
aaagataggttggctttgcc

SEQ ID NO: 196429 - DNA, 20 bp, Artificial Sequence
  Description of Artificial Sequence: Synthetic oligonucleotide
  Target: ATXN1; (-) strand; PAM type: YTN; PAM sequence: CTG
tgatcctgaaagataggttg

SEQ ID NO: 196430 - DNA, 20 bp, Artificial Sequence
  Description of Artificial Sequence: Synthetic oligonucleotide
  Target: ATXN1; (-) strand; PAM type: YTN; PAM sequence: TTC
actgtgatcctgaaagatag

SEQ ID NO: 196431 - DNA, 20 bp, Artificial Sequence
  Description of Artificial Sequence: Synthetic oligonucleotide
  Target: ATXN1; (-) strand; PAM type: YTN; PAM sequence: TTT
cactgtgatcctgaaagata

SEQ ID NO: 196432 - DNA, 20 bp, Artificial Sequence
  Description of Artificial Sequence: Synthetic oligonucleotide
  Target: ATXN1; (-) strand; PAM type: YTN; PAM sequence: TTT
tcactgtgatcctgaaagat

SEQ ID NO: 196433 - DNA, 20 bp, Artificial Sequence
  Description of Artificial Sequence: Synthetic oligonucleotide
  Target: ATXN1; (-) strand; PAM type: YTN; PAM sequence: TTG
tgagttttcactgtgatcct

SEQ ID NO: 196434 - DNA, 20 bp, Artificial Sequence
  Description of Artificial Sequence: Synthetic oligonucleotide
  Target: ATXN1; (-) strand; PAM type: YTN; PAM sequence: CTG
gagattgtgagttttcactg

SEQ ID NO: 196435 - DNA, 20 bp, Artificial Sequence
  Description of Artificial Sequence: Synthetic oligonucleotide
  Target: ATXN1; (-) strand; PAM type: YTN; PAM sequence: CTC
ataactggagattgtgagtt

SEQ ID NO: 196436 - DNA, 20 bp, Artificial Sequence
  Description of Artificial Sequence: Synthetic oligonucleotide
  Target: ATXN1; (-) strand; PAM type: YTN; PAM sequence: TTA
ctcataactggagattgtga

SEQ ID NO: 196437 - DNA, 20 bp, Artificial Sequence
  Description of Artificial Sequence: Synthetic oligonucleotide
  Target: ATXN1; (-) strand; PAM type: YTN; PAM sequence: CTT
actcataactggagattgtg

SEQ ID NO: 196438 - DNA, 20 bp, Artificial Sequence
  Description of Artificial Sequence: Synthetic oligonucleotide
  Target: ATXN1; (-) strand; PAM type: YTN; PAM sequence: CTC
ttactcataactggagattg

SEQ ID NO: 196439 - DNA, 20 bp, Artificial Sequence
  Description of Artificial Sequence: Synthetic oligonucleotide
  Target: ATXN1; (-) strand; PAM type: YTN; PAM sequence: TTC
tcttactcataactggagat

SEQ ID NO: 196440 - DNA, 20 bp, Artificial Sequence
  Description of Artificial Sequence: Synthetic oligonucleotide
  Target: ATXN1; (-) strand; PAM type: YTN; PAM sequence: CTT
ctcttactcataactggaga

SEQ ID NO: 196441 - DNA, 20 bp, Artificial Sequence
  Description of Artificial Sequence: Synthetic oligonucleotide
  Target: ATXN1; (-) strand; PAM type: YTN; PAM sequence: TTA
gggaaagaagaagacttctc

SEQ ID NO: 196442 - DNA, 20 bp, Artificial Sequence
  Description of Artificial Sequence: Synthetic oligonucleotide
  Target: ATXN1; (-) strand; PAM type: YTN; PAM sequence: TTA
tatgcgtgacgaaggagaat

SEQ ID NO: 196443 - DNA, 20 bp, Artificial Sequence
  Description of Artificial Sequence: Synthetic oligonucleotide
  Target: ATXN1; (-) strand; PAM type: YTN; PAM sequence: CTA
aaagcagttatatgcgtgac

SEQ ID NO: 196444 - DNA, 20 bp, Artificial Sequence
  Description of Artificial Sequence: Synthetic oligonucleotide
  Target: ATXN1; (-) strand; PAM type: YTN; PAM sequence: TTC
aaacgagtcacctaaaagca

SEQ ID NO: 196445 - DNA, 20 bp, Artificial Sequence
  Description of Artificial Sequence: Synthetic oligonucleotide
  Target: ATXN1; (-) strand; PAM type: YTN; PAM sequence: TTT
caaacgagtcacctaaaagc

SEQ ID NO: 196446 - DNA, 20 bp, Artificial Sequence
  Description of Artificial Sequence: Synthetic oligonucleotide
  Target: ATXN1; (-) strand; PAM type: YTN; PAM sequence: TTA
catttcaaacgagtcaccta

SEQ ID NO: 196447 - DNA, 20 bp, Artificial Sequence
  Description of Artificial Sequence: Synthetic oligonucleotide
  Target: ATXN1; (-) strand; PAM type: YTN; PAM sequence: CTT
acatttcaaacgagtcacct

SEQ ID NO: 196448 - DNA, 20 bp, Artificial Sequence
  Description of Artificial Sequence: Synthetic oligonucleotide
  Target: ATXN1; (-) strand; PAM type: YTN; PAM sequence: CTC
agagcagcttacatttcaaa

SEQ ID NO: 196449 - DNA, 20 bp, Artificial Sequence
  Description of Artificial Sequence: Synthetic oligonucleotide
  Target: ATXN1; (-) strand; PAM type: YTN; PAM sequence: TTA
gactcagagcagcttacatt

SEQ ID NO: 196450 - DNA, 20 bp, Artificial Sequence
  Description of Artificial Sequence: Synthetic oligonucleotide
  Target: ATXN1; (-) strand; PAM type: YTN; PAM sequence: TTA
tgccgaattagactcagagc

SEQ ID NO: 196451 - DNA, 20 bp, Artificial Sequence
  Description of Artificial Sequence: Synthetic oligonucleotide
  Target: ATXN1; (-) strand; PAM type: YTN; PAM sequence: TTA
agtgttatgccgaattagac

SEQ ID NO: 196452 - DNA, 20 bp, Artificial Sequence
  Description of Artificial Sequence: Synthetic oligonucleotide
  Target: ATXN1; (-) strand; PAM type: YTN; PAM sequence: TTG
tgcatggtatatggtgttaa

SEQ ID NO: 196453 - DNA, 20 bp, Artificial Sequence
  Description of Artificial Sequence: Synthetic oligonucleotide
  Target: ATXN1; (-) strand; PAM type: YTN; PAM sequence: CTT
gtgcatggtatatggtgtta

SEQ ID NO: 196454 - DNA, 20 bp, Artificial Sequence
  Description of Artificial Sequence: Synthetic oligonucleotide
  Target: ATXN1; (-) strand; PAM type: YTN; PAM sequence: CTC
ttgtgcatggtatatggtgt

SEQ ID NO: 196455 - DNA, 20 bp, Artificial Sequence
  Description of Artificial Sequence: Synthetic oligonucleotide
  Target: ATXN1; (-) strand; PAM type: YTN; PAM sequence: TTC
catgaagtcacctcttgtgc

SEQ ID NO: 196456 - DNA, 20 bp, Artificial Sequence
  Description of Artificial Sequence: Synthetic oligonucleotide
  Target: ATXN1; (-) strand; PAM type: YTN; PAM sequence: TTT
ccatgaagtcacctcttgtg

SEQ ID NO: 196457 - DNA, 20 bp, Artificial Sequence
  Description of Artificial Sequence: Synthetic oligonucleotide
  Target: ATXN1; (-) strand; PAM type: YTN; PAM sequence: CTA
tgcaaatagggacagtttcc

SEQ ID NO: 196458 - DNA, 20 bp, Artificial Sequence
  Description of Artificial Sequence: Synthetic oligonucleotide
  Target: ATXN1; (-) strand; PAM type: YTN; PAM sequence: CTG
agtaatccagggaatagtgc

SEQ ID NO: 196459 - DNA, 20 bp, Artificial Sequence
  Description of Artificial Sequence: Synthetic oligonucleotide
  Target: ATXN1; (-) strand; PAM type: YTN; PAM sequence: TTG
caaggatgatacctgagtaa

SEQ ID NO: 196460 - DNA, 20 bp, Artificial Sequence
  Description of Artificial Sequence: Synthetic oligonucleotide
  Target: ATXN1; (-) strand; PAM type: YTN; PAM sequence: TTT
gcaaggatgatacctgagta

SEQ ID NO: 196461 - DNA, 20 bp, Artificial Sequence
  Description of Artificial Sequence: Synthetic oligonucleotide
  Target: ATXN1; (-) strand; PAM type: YTN; PAM sequence: TTT
tgcaaggatgatacctgagt

SEQ ID NO: 196462 - DNA, 20 bp, Artificial Sequence
  Description of Artificial Sequence: Synthetic oligonucleotide
  Target: ATXN1; (-) strand; PAM type: YTN; PAM sequence: CTT
ttgcaaggatgatacctgag

SEQ ID NO: 196463 - DNA, 20 bp, Artificial Sequence
  Description of Artificial Sequence: Synthetic oligonucleotide
  Target: ATXN1; (-) strand; PAM type: YTN; PAM sequence: TTG
acttttgcaaggatgatacc

SEQ ID NO: 196464 - DNA, 20 bp, Artificial Sequence
  Description of Artificial Sequence: Synthetic oligonucleotide
  Target: ATXN1; (-) strand; PAM type: YTN; PAM sequence: TTT
gacttttgcaaggatgatac

SEQ ID NO: 196465 - DNA, 20 bp, Artificial Sequence
  Description of Artificial Sequence: Synthetic oligonucleotide
  Target: ATXN1; (-) strand; PAM type: YTN; PAM sequence: CTG
tatcagtttgacttttgcaa

SEQ ID NO: 196466 - DNA, 20 bp, Artificial Sequence
  Description of Artificial Sequence: Synthetic oligonucleotide
  Target: ATXN1; (-) strand; PAM type: YTN; PAM sequence: TTG
tagtaggcaatgcaaccctg

SEQ ID NO: 196467 - DNA, 20 bp, Artificial Sequence
  Description of Artificial Sequence: Synthetic oligonucleotide
  Target: ATXN1; (-) strand; PAM type: YTN; PAM sequence: CTT
gtagtaggcaatgcaaccct

SEQ ID NO: 196468 - DNA, 20 bp, Artificial Sequence
  Description of Artificial Sequence: Synthetic oligonucleotide
  Target: ATXN1; (-) strand; PAM type: YTN; PAM sequence: CTG
cttgtagtaggcaatgcaac

SEQ ID NO: 196469 - DNA, 20 bp, Artificial Sequence
  Description of Artificial Sequence: Synthetic oligonucleotide
  Target: ATXN1; (-) strand; PAM type: YTN; PAM sequence: TTC
tgcttgtagtaggcaatgca

SEQ ID NO: 196470 - DNA, 20 bp, Artificial Sequence
  Description of Artificial Sequence: Synthetic oligonucleotide
  Target: ATXN1; (-) strand; PAM type: YTN; PAM sequence: TTA
ttctgcttgtagtaggcaat

SEQ ID NO: 196471 - DNA, 20 bp, Artificial Sequence
  Description of Artificial Sequence: Synthetic oligonucleotide
  Target: ATXN1; (-) strand; PAM type: YTN; PAM sequence: CTC
aacgttattctgcttgtagt

SEQ ID NO: 196472 - DNA, 20 bp, Artificial Sequence
  Description of Artificial Sequence: Synthetic oligonucleotide
  Target: ATXN1; (-) strand; PAM type: YTN; PAM sequence: CTG
agaaaccatgactcaacgtt

SEQ ID NO: 196473 - DNA, 20 bp, Artificial Sequence
  Description of Artificial Sequence: Synthetic oligonucleotide
  Target: ATXN1; (-) strand; PAM type: YTN; PAM sequence: TTC
agctgagaaaccatgactca

SEQ ID NO: 196474 - DNA, 20 bp, Artificial Sequence
  Description of Artificial Sequence: Synthetic oligonucleotide
  Target: ATXN1; (-) strand; PAM type: YTN; PAM sequence: TTT
cagctgagaaaccatgactc

SEQ ID NO: 196475 - DNA, 20 bp, Artificial Sequence
  Description of Artificial Sequence: Synthetic oligonucleotide
  Target: ATXN1; (-) strand; PAM type: YTN; PAM sequence: CTT
tcagctgagaaaccatgact

SEQ ID NO: 196476 - DNA, 20 bp, Artificial Sequence
  Description of Artificial Sequence: Synthetic oligonucleotide
  Target: ATXN1; (-) strand; PAM type: YTN; PAM sequence: TTC
tttcagctgagaaaccatga

SEQ ID NO: 196477 - DNA, 20 bp, Artificial Sequence
  Description of Artificial Sequence: Synthetic oligonucleotide
  Target: ATXN1; (-) strand; PAM type: YTN; PAM sequence: TTT
ctttcagctgagaaaccatg

SEQ ID NO: 196478 - DNA, 20 bp, Artificial Sequence
  Description of Artificial Sequence: Synthetic oligonucleotide
  Target: ATXN1; (-) strand; PAM type: YTN; PAM sequence: TTT
tctttcagctgagaaaccat

SEQ ID NO: 196479 - DNA, 20 bp, Artificial Sequence
  Description of Artificial Sequence: Synthetic oligonucleotide
  Target: ATXN1; (-) strand; PAM type: YTN; PAM sequence: TTA
ccaagaatataggaaaaaac

SEQ ID NO: 196480 - DNA, 20 bp, Artificial Sequence
  Description of Artificial Sequence: Synthetic oligonucleotide
  Target: ATXN1; (-) strand; PAM type: YTN; PAM sequence: CTT
accaagaatataggaaaaaa

SEQ ID NO: 196481 - DNA, 20 bp, Artificial Sequence
  Description of Artificial Sequence: Synthetic oligonucleotide
  Target: ATXN1; (-) strand; PAM type: YTN; PAM sequence: TTC
ttaccaagaatataggaaaa

SEQ ID NO: 196482 - DNA, 20 bp, Artificial Sequence
  Description of Artificial Sequence: Synthetic oligonucleotide
  Target: ATXN1; (-) strand; PAM type: YTN; PAM sequence: CTG
attcttaccaagaatatagg

SEQ ID NO: 196483 - DNA, 20 bp, Artificial Sequence
  Description of Artificial Sequence: Synthetic oligonucleotide
  Target: ATXN1; (-) strand; PAM type: YTN; PAM sequence: TTC
tgattcttaccaagaatata

SEQ ID NO: 196484 - DNA, 20 bp, Artificial Sequence
  Description of Artificial Sequence: Synthetic oligonucleotide
  Target: ATXN1; (-) strand; PAM type: YTN; PAM sequence: CTT
ctgattcttaccaagaatat

SEQ ID NO: 196485 - DNA, 20 bp, Artificial Sequence
  Description of Artificial Sequence: Synthetic oligonucleotide
  Target: ATXN1; (-) strand; PAM type: YTN; PAM sequence: TTG
gaggtatcttctgattctta

SEQ ID NO: 196486 - DNA, 20 bp, Artificial Sequence
  Description of Artificial Sequence: Synthetic oligonucleotide
  Target: ATXN1; (-) strand; PAM type: YTN; PAM sequence: CTT
ggaggtatcttctgattctt

SEQ ID NO: 196487 - DNA, 20 bp, Artificial Sequence
  Description of Artificial Sequence: Synthetic oligonucleotide
  Target: ATXN1; (-) strand; PAM type: YTN; PAM sequence: CTG
gcttggaggtatcttctgat

SEQ ID NO: 196488 - DNA, 20 bp, Artificial Sequence
  Description of Artificial Sequence: Synthetic oligonucleotide
  Target: ATXN1; (-) strand; PAM type: YTN; PAM sequence: TTG
ggctggcttggaggtatctt

SEQ ID NO: 196489 - DNA, 20 bp, Artificial Sequence
  Description of Artificial Sequence: Synthetic oligonucleotide
  Target: ATXN1; (-) strand; PAM type: YTN; PAM sequence: TTA
tggttgggctggcttggagg

SEQ ID NO: 196490 - DNA, 20 bp, Artificial Sequence
  Description of Artificial Sequence: Synthetic oligonucleotide
  Target: ATXN1; (-) strand; PAM type: YTN; PAM sequence: TTT
atggttgggctggcttggag

SEQ ID NO: 196491 - DNA, 20 bp, Artificial Sequence
  Description of Artificial Sequence: Synthetic oligonucleotide
  Target: ATXN1; (-) strand; PAM type: YTN; PAM sequence: CTG
aaggtagtcatcagtgtcat

SEQ ID NO: 196492 - DNA, 20 bp, Artificial Sequence
  Description of Artificial Sequence: Synthetic oligonucleotide
  Target: ATXN1; (-) strand; PAM type: YTN; PAM sequence: TTG
tcacctgaaggtagtcatca

SEQ ID NO: 196493 - DNA, 20 bp, Artificial Sequence
  Description of Artificial Sequence: Synthetic oligonucleotide
  Target: ATXN1; (-) strand; PAM type: YTN; PAM sequence: CTG
ttgtcacctgaaggtagtca

SEQ ID NO: 196494 - DNA, 20 bp, Artificial Sequence
  Description of Artificial Sequence: Synthetic oligonucleotide
  Target: ATXN1; (-) strand; PAM type: YTN; PAM sequence: TTG
gcagcatggggaaacctgtt

SEQ ID NO: 196495 - DNA, 20 bp, Artificial Sequence
  Description of Artificial Sequence: Synthetic oligonucleotide
  Target: ATXN1; (-) strand; PAM type: YTN; PAM sequence: TTT
ggcagcatggggaaacctgt

SEQ ID NO: 196496 - DNA, 20 bp, Artificial Sequence
  Description of Artificial Sequence: Synthetic oligonucleotide
  Target: ATXN1; (-) strand; PAM type: YTN; PAM sequence: TTT
tggcagcatggggaaacctg

SEQ ID NO: 196497 - DNA, 20 bp, Artificial Sequence
  Description of Artificial Sequence: Synthetic oligonucleotide
  Target: ATXN1; (-) strand; PAM type: YTN; PAM sequence: TTA
ttttggcagcatggggaaac

SEQ ID NO: 196498 - DNA, 20 bp, Artificial Sequence
  Description of Artificial Sequence: Synthetic oligonucleotide
  Target: ATXN1; (-) strand; PAM type: YTN; PAM sequence: TTT
attttggcagcatggggaaa

SEQ ID NO: 196499 - DNA, 20 bp, Artificial Sequence
  Description of Artificial Sequence: Synthetic oligonucleotide
  Target: ATXN1; (-) strand; PAM type: YTN; PAM sequence: CTT
tattttggcagcatggggaa

SEQ ID NO: 196500 - DNA, 20 bp, Artificial Sequence
  Description of Artificial Sequence: Synthetic oligonucleotide
  Target: ATXN1; (-) strand; PAM type: YTN; PAM sequence: CTA
ctttattttggcagcatggg

SEQ ID NO: 196501 - DNA, 20 bp, Artificial Sequence
  Description of Artificial Sequence: Synthetic oligonucleotide
  Target: ATXN1; (-) strand; PAM type: YTN; PAM sequence: TTC
tactttattttggcagcatg

SEQ ID NO: 196502 - DNA, 20 bp, Artificial Sequence
  Description of Artificial Sequence: Synthetic oligonucleotide
  Target: ATXN1; (-) strand; PAM type: YTN; PAM sequence: CTT
ctactttattttggcagcat

SEQ ID NO: 196503 - DNA, 20 bp, Artificial Sequence
  Description of Artificial Sequence: Synthetic oligonucleotide
  Target: ATXN1; (-) strand; PAM type: YTN; PAM sequence: TTA
cccagccttctactttattt

SEQ ID NO: 196504 - DNA, 20 bp, Artificial Sequence
  Description of Artificial Sequence: Synthetic oligonucleotide
  Target: ATXN1; (-) strand; PAM type: YTN; PAM sequence: CTA
aaccattacccagccttcta

SEQ ID NO: 196505 - DNA, 20 bp, Artificial Sequence
  Description of Artificial Sequence: Synthetic oligonucleotide
  Target: ATXN1; (-) strand; PAM type: YTN; PAM sequence: TTC
aaatgtactaaaccattacc

SEQ ID NO: 196506 - DNA, 20 bp, Artificial Sequence
  Description of Artificial Sequence: Synthetic oligonucleotide
  Target: ATXN1; (-) strand; PAM type: YTN; PAM sequence: TTG
gaaaagtgcatgattcaaat

SEQ ID NO: 196507 - DNA, 20 bp, Artificial Sequence
  Description of Artificial Sequence: Synthetic oligonucleotide
  Target: ATXN1; (-) strand; PAM type: YTN; PAM sequence: CTG
agttggaaaagtgcatgatt

SEQ ID NO: 196508 - DNA, 20 bp, Artificial Sequence
  Description of Artificial Sequence: Synthetic oligonucleotide
  Target: ATXN1; (-) strand; PAM type: YTN; PAM sequence: CTC
aataactgagttggaaaagt

SEQ ID NO: 196509 - DNA, 20 bp, Artificial Sequence
  Description of Artificial Sequence: Synthetic oligonucleotide
  Target: ATXN1; (-) strand; PAM type: YTN; PAM sequence: TTC
tcaataactgagttggaaaa

SEQ ID NO: 196510 - DNA, 20 bp, Artificial Sequence
  Description of Artificial Sequence: Synthetic oligonucleotide
  Target: ATXN1; (-) strand; PAM type: YTN; PAM sequence: CTA
atggccattctcaataactg

SEQ ID NO: 196511 - DNA, 20 bp, Artificial Sequence
  Description of Artificial Sequence: Synthetic oligonucleotide
  Target: ATXN1; (-) strand; PAM type: YTN; PAM sequence: CTC
taatggccattctcaataac

SEQ ID NO: 196512 - DNA, 20 bp, Artificial Sequence
  Description of Artificial Sequence: Synthetic oligonucleotide
  Target: ATXN1; (-) strand; PAM type: YTN; PAM sequence: TTG
ggaccctctaatggccattc

SEQ ID NO: 196513 - DNA, 20 bp, Artificial Sequence
  Description of Artificial Sequence: Synthetic oligonucleotide
  Target: ATXN1; (-) strand; PAM type: YTN; PAM sequence: TTT
gggaccctctaatggccatt

SEQ ID NO: 196514 - DNA, 20 bp, Artificial Sequence
  Description of Artificial Sequence: Synthetic oligonucleotide
  Target: ATXN1; (-) strand; PAM type: YTN; PAM sequence: TTA
tttgggaccctctaatggcc

SEQ ID NO: 196515 - DNA, 20 bp, Artificial Sequence
  Description of Artificial Sequence: Synthetic oligonucleotide
  Target: ATXN1; (-) strand; PAM type: YTN; PAM sequence: CTG
ggttatttgggaccctctaa

SEQ ID NO: 196516 - DNA, 20 bp, Artificial Sequence
  Description of Artificial Sequence: Synthetic oligonucleotide
  Target: ATXN1; (-) strand; PAM type: YTN; PAM sequence: TTA
actgggttatttgggaccct

SEQ ID NO: 196517 - DNA, 20 bp, Artificial Sequence
  Description of Artificial Sequence: Synthetic oligonucleotide
  Target: ATXN1; (-) strand; PAM type: YTN; PAM sequence: TTG
gttaactgggttatttggga

SEQ ID NO: 196518 - DNA, 20 bp, Artificial Sequence
  Description of Artificial Sequence: Synthetic oligonucleotide
  Target: ATXN1; (-) strand; PAM type: YTN; PAM sequence: TTT
ggttaactgggttatttggg

SEQ ID NO: 196519 - DNA, 20 bp, Artificial Sequence
  Description of Artificial Sequence: Synthetic oligonucleotide
  Target: ATXN1; (-) strand; PAM type: YTN; PAM sequence: TTT
tggttaactgggttatttgg

SEQ ID NO: 196520 - DNA, 20 bp, Artificial Sequence
  Description of Artificial Sequence: Synthetic oligonucleotide
  Target: ATXN1; (-) strand; PAM type: YTN; PAM sequence: TTT
ttggttaactgggttatttg

SEQ ID NO: 196521 - DNA, 20 bp, Artificial Sequence
  Description of Artificial Sequence: Synthetic oligonucleotide
  Target: ATXN1; (-) strand; PAM type: YTN; PAM sequence: TTT
tttggttaactgggttattt

SEQ ID NO: 196522 - DNA, 20 bp, Artificial Sequence
  Description of Artificial Sequence: Synthetic oligonucleotide
  Target: ATXN1; (-) strand; PAM type: YTN; PAM sequence: TTA
acggtcagaaaattttttgg

SEQ ID NO: 196523 - DNA, 20 bp, Artificial Sequence
  Description of Artificial Sequence: Synthetic oligonucleotide
  Target: ATXN1; (-) strand; PAM type: YTN; PAM sequence: CTT
aacggtcagaaaattttttg

SEQ ID NO: 196524 - DNA, 20 bp, Artificial Sequence
  Description of Artificial Sequence: Synthetic oligonucleotide
  Target: ATXN1; (-) strand; PAM type: YTN; PAM sequence: CTC
ttaacggtcagaaaattttt

SEQ ID NO: 196525 - DNA, 20 bp, Artificial Sequence
  Description of Artificial Sequence: Synthetic oligonucleotide
  Target: ATXN1; (-) strand; PAM type: YTN; PAM sequence: TTA
aaactcttaacggtcagaaa

SEQ ID NO: 196526 - DNA, 20 bp, Artificial Sequence
  Description of Artificial Sequence: Synthetic oligonucleotide
  Target: ATXN1; (-) strand; PAM type: YTN; PAM sequence: TTG
gttaaaactcttaacggtca

SEQ ID NO: 196527 - DNA, 20 bp, Artificial Sequence
  Description of Artificial Sequence: Synthetic oligonucleotide
  Target: ATXN1; (-) strand; PAM type: YTN; PAM sequence: CTG
catattggttaaaactctta

SEQ ID NO: 196528 - DNA, 20 bp, Artificial Sequence
  Description of Artificial Sequence: Synthetic oligonucleotide
  Target: ATXN1; (-) strand; PAM type: YTN; PAM sequence: TTA
ctgcatattggttaaaactc

SEQ ID NO: 196529 - DNA, 20 bp, Artificial Sequence
  Description of Artificial Sequence: Synthetic oligonucleotide
  Target: ATXN1; (-) strand; PAM type: YTN; PAM sequence: TTT
actgcatattggttaaaact

SEQ ID NO: 196530 - DNA, 20 bp, Artificial Sequence
  Description of Artificial Sequence: Synthetic oligonucleotide
  Target: ATXN1; (-) strand; PAM type: YTN; PAM sequence: TTT
tactgcatattggttaaaac

SEQ ID NO: 196531 - DNA, 20 bp, Artificial Sequence
  Description of Artificial Sequence: Synthetic oligonucleotide
  Target: ATXN1; (-) strand; PAM type: YTN; PAM sequence: CTG
cattttactgcatattggtt

SEQ ID NO: 196532 - DNA, 20 bp, Artificial Sequence
  Description of Artificial Sequence: Synthetic oligonucleotide
  Target: ATXN1; (-) strand; PAM type: YTN; PAM sequence: TTG
aaaactgcattttactgcat

SEQ ID NO: 196533 - DNA, 20 bp, Artificial Sequence
  Description of Artificial Sequence: Synthetic oligonucleotide
  Target: ATXN1; (-) strand; PAM type: YTN; PAM sequence: CTG
attgaaaactgcattttact

SEQ ID NO: 196534 - DNA, 20 bp, Artificial Sequence
  Description of Artificial Sequence: Synthetic oligonucleotide
  Target: ATXN1; (-) strand; PAM type: YTN; PAM sequence: TTA
cagtagagatgtgtgcccct

SEQ ID NO: 196535 - DNA, 20 bp, Artificial Sequence
  Description of Artificial Sequence: Synthetic oligonucleotide
  Target: ATXN1; (-) strand; PAM type: YTN; PAM sequence: CTG
tcaaaaaatggttacagtag

SEQ ID NO: 196536 - DNA, 20 bp, Artificial Sequence
  Description of Artificial Sequence: Synthetic oligonucleotide
  Target: ATXN1; (-) strand; PAM type: YTN; PAM sequence: CTA
acaaaactgtcaaaaaatgg

SEQ ID NO: 196537 - DNA, 20 bp, Artificial Sequence
  Description of Artificial Sequence: Synthetic oligonucleotide
  Target: ATXN1; (-) strand; PAM type: YTN; PAM sequence: CTC
taacaaaactgtcaaaaaat

SEQ ID NO: 196538 - DNA, 20 bp, Artificial Sequence
  Description of Artificial Sequence: Synthetic oligonucleotide
  Target: ATXN1; (-) strand; PAM type: YTN; PAM sequence: TTC
tctaacaaaactgtcaaaaa

SEQ ID NO: 196539 - DNA, 20 bp, Artificial Sequence
  Description of Artificial Sequence: Synthetic oligonucleotide
  Target: ATXN1; (-) strand; PAM type: YTN; PAM sequence: TTG
aattctctaacaaaactgtc

SEQ ID NO: 196540 - DNA, 20 bp, Artificial Sequence
  Description of Artificial Sequence: Synthetic oligonucleotide
  Target: ATXN1; (-) strand; PAM type: YTN; PAM sequence: TTT
gaattctctaacaaaactgt

SEQ ID NO: 196541 - DNA, 20 bp, Artificial Sequence
  Description of Artificial Sequence: Synthetic oligonucleotide
  Target: ATXN1; (-) strand; PAM type: YTN; PAM sequence: CTT
tgaattctctaacaaaactg

SEQ ID NO: 196542 - DNA, 20 bp, Artificial Sequence
  Description of Artificial Sequence: Synthetic oligonucleotide
  Target: ATXN1; (-) strand; PAM type: YTN; PAM sequence: TTG
gtgctttgaattctctaaca

SEQ ID NO: 196543 - DNA, 20 bp, Artificial Sequence
  Description of Artificial Sequence: Synthetic oligonucleotide
  Target: ATXN1; (-) strand; PAM type: YTN; PAM sequence: TTT
ggtgctttgaattctctaac

SEQ ID NO: 196544 - DNA, 20 bp, Artificial Sequence
  Description of Artificial Sequence: Synthetic oligonucleotide
  Target: ATXN1; (-) strand; PAM type: YTN; PAM sequence: TTA
tttggtgctttgaattctct

SEQ ID NO: 196545 - DNA, 20 bp, Artificial Sequence
  Description of Artificial Sequence: Synthetic oligonucleotide
  Target: ATXN1; (-) strand; PAM type: YTN; PAM sequence: TTT
atttggtgctttgaattctc

SEQ ID NO: 196546 - DNA, 20 bp, Artificial Sequence
  Description of Artificial Sequence: Synthetic oligonucleotide
  Target: ATXN1; (-) strand; PAM type: YTN; PAM sequence: TTT
tatttggtgctttgaattct

SEQ ID NO: 196547 - DNA, 20 bp, Artificial Sequence
  Description of Artificial Sequence: Synthetic oligonucleotide
  Target: ATXN1; (-) strand; PAM type: YTN; PAM sequence: TTT
ttatttggtgctttgaattc

SEQ ID NO: 196548 - DNA, 20 bp, Artificial Sequence
  Description of Artificial Sequence: Synthetic oligonucleotide
  Target: ATXN1; (-) strand; PAM type: YTN; PAM sequence: TTC
aggtacacatttttatttgg

SEQ ID NO: 196549 - DNA, 20 bp, Artificial Sequence
  Description of Artificial Sequence: Synthetic oligonucleotide
  Target: ATXN1; (-) strand; PAM type: YTN; PAM sequence: TTT
caggtacacatttttatttg

SEQ ID NO: 196550 - DNA, 20 bp, Artificial Sequence
  Description of Artificial Sequence: Synthetic oligonucleotide
  Target: ATXN1; (-) strand; PAM type: YTN; PAM sequence: TTT
tcaggtacacatttttattt

SEQ ID NO: 196551 - DNA, 20 bp, Artificial Sequence
  Description of Artificial Sequence: Synthetic oligonucleotide
  Target: ATXN1; (-) strand; PAM type: YTN; PAM sequence: TTT
ttcaggtacacatttttatt

SEQ ID NO: 196552 - DNA, 20 bp, Artificial Sequence
  Description of Artificial Sequence: Synthetic oligonucleotide
  Target: ATXN1; (-) strand; PAM type: YTN; PAM sequence: CTT
tttcaggtacacatttttat

SEQ ID NO: 196553 - DNA, 20 bp, Artificial Sequence
  Description of Artificial Sequence: Synthetic oligonucleotide
  Target: ATXN1; (-) strand; PAM type: YTN; PAM sequence: CTA
gtagtctttttcaggtacac

SEQ ID NO: 196554 - DNA, 20 bp, Artificial Sequence
  Description of Artificial Sequence: Synthetic oligonucleotide
  Target: ATXN1; (-) strand; PAM type: YTN; PAM sequence: CTC
tagtagtctttttcaggtac

SEQ ID NO: 196555 - DNA, 20 bp, Artificial Sequence
  Description of Artificial Sequence: Synthetic oligonucleotide
  Target: ATXN1; (-) strand; PAM type: YTN; PAM sequence: TTC
ctctagtagtctttttcagg

SEQ ID NO: 196556 - DNA, 20 bp, Artificial Sequence
  Description of Artificial Sequence: Synthetic oligonucleotide
  Target: ATXN1; (-) strand; PAM type: YTN; PAM sequence: TTT
cctctagtagtctttttcag

SEQ ID NO: 196557 - DNA, 20 bp, Artificial Sequence
  Description of Artificial Sequence: Synthetic oligonucleotide
  Target: ATXN1; (-) strand; PAM type: YTN; PAM sequence: TTT
tcctctagtagtctttttca

SEQ ID NO: 196558 - DNA, 20 bp, Artificial Sequence
  Description of Artificial Sequence: Synthetic oligonucleotide
  Target: ATXN1; (-) strand; PAM type: YTN; PAM sequence: TTT
ttcctctagtagtctttttc

SEQ ID NO: 196559 - DNA, 20 bp, Artificial Sequence
  Description of Artificial Sequence: Synthetic oligonucleotide
  Target: ATXN1; (-) strand; PAM type: YTN; PAM sequence: TTT
tttcctctagtagtcttttt

SEQ ID NO: 196560 - DNA, 20 bp, Artificial Sequence
  Description of Artificial Sequence: Synthetic oligonucleotide
  Target: ATXN1; (-) strand; PAM type: YTN; PAM sequence: TTT
ttttcctctagtagtctttt

SEQ ID NO: 196561 - DNA, 20 bp, Artificial Sequence
  Description of Artificial Sequence: Synthetic oligonucleotide
  Target: ATXN1; (-) strand; PAM type: YTN; PAM sequence: TTT
tttttcctctagtagtcttt

SEQ ID NO: 196562 - DNA, 20 bp, Artificial Sequence
  Description of Artificial Sequence: Synthetic oligonucleotide
  Target: ATXN1; (-) strand; PAM type: YTN; PAM sequence: TTT
ttttttcctctagtagtctt

SEQ ID NO: 196563 - DNA, 20 bp, Artificial Sequence
  Description of Artificial Sequence: Synthetic oligonucleotide
  Target: ATXN1; (-) strand; PAM type: YTN; PAM sequence: TTA
tttttttttcctctagtagt

SEQ ID NO: 196564 - DNA, 20 bp, Artificial Sequence
  Description of Artificial Sequence: Synthetic oligonucleotide
  Target: ATXN1; (-) strand; PAM type: YTN; PAM sequence: TTT
atttttttttcctctagtag

SEQ ID NO: 196565 - DNA, 20 bp, Artificial Sequence
  Description of Artificial Sequence: Synthetic oligonucleotide
  Target: ATXN1; (-) strand; PAM type: YTN; PAM sequence: CTG
aatttatttttttttcctct

SEQ ID NO: 196566 - DNA, 20 bp, Artificial Sequence
  Description of Artificial Sequence: Synthetic oligonucleotide
  Target: ATXN1; (-) strand; PAM type: YTN; PAM sequence: TTA
ccctgaatttattttttttt

SEQ ID NO: 196567 - DNA, 20 bp, Artificial Sequence
  Description of Artificial Sequence: Synthetic oligonucleotide
  Target: ATXN1; (-) strand; PAM type: YTN; PAM sequence: CTT
accctgaatttatttttttt

SEQ ID NO: 196568 - DNA, 20 bp, Artificial Sequence
  Description of Artificial Sequence: Synthetic oligonucleotide
  Target: ATXN1; (-) strand; PAM type: YTN; PAM sequence: CTA
gtatgtacccttaccctgaa

SEQ ID NO: 196569 - DNA, 20 bp, Artificial Sequence
  Description of Artificial Sequence: Synthetic oligonucleotide
  Target: ATXN1; (-) strand; PAM type: YTN; PAM sequence: CTA
aatatctagtatgtaccctt

SEQ ID NO: 196570 - DNA, 20 bp, Artificial Sequence
  Description of Artificial Sequence: Synthetic oligonucleotide
  Target: ATXN1; (-) strand; PAM type: YTN; PAM sequence: CTG
tctaaatatctagtatgtac

SEQ ID NO: 196571 - DNA, 20 bp, Artificial Sequence
  Description of Artificial Sequence: Synthetic oligonucleotide
  Target: ATXN1; (-) strand; PAM type: YTN; PAM sequence: TTC
agctgtctaaatatctagta

SEQ ID NO: 196572 - DNA, 20 bp, Artificial Sequence
  Description of Artificial Sequence: Synthetic oligonucleotide
  Target: ATXN1; (-) strand; PAM type: YTN; PAM sequence: CTT
cagctgtctaaatatctagt

SEQ ID NO: 196573 - DNA, 20 bp, Artificial Sequence
  Description of Artificial Sequence: Synthetic oligonucleotide
  Target: ATXN1; (-) strand; PAM type: YTN; PAM sequence: CTG
gcttcagctgtctaaatatc

SEQ ID NO: 196574 - DNA, 20 bp, Artificial Sequence
  Description of Artificial Sequence: Synthetic oligonucleotide
  Target: ATXN1; (-) strand; PAM type: YTN; PAM sequence: CTG
cacacaccactggcttcagc

SEQ ID NO: 196575 - DNA, 20 bp, Artificial Sequence
  Description of Artificial Sequence: Synthetic oligonucleotide
  Target: ATXN1; (-) strand; PAM type: YTN; PAM sequence: TTC
tgcacacaccactggcttca

SEQ ID NO: 196576 - DNA, 20 bp, Artificial Sequence
  Description of Artificial Sequence: Synthetic oligonucleotide
  Target: ATXN1; (-) strand; PAM type: YTN; PAM sequence: TTT
ctgcacacaccactggcttc

SEQ ID NO: 196577 - DNA, 20 bp, Artificial Sequence
  Description of Artificial Sequence: Synthetic oligonucleotide
  Target: ATXN1; (-) strand; PAM type: YTN; PAM sequence: TTA
aacatttctgcacacaccac

SEQ ID NO: 196578 - DNA, 20 bp, Artificial Sequence
  Description of Artificial Sequence: Synthetic oligonucleotide
  Target: ATXN1; (-) strand; PAM type: YTN; PAM sequence: TTA
ttaaacatttctgcacacac

SEQ ID NO: 196579 - DNA, 20 bp, Artificial Sequence
  Description of Artificial Sequence: Synthetic oligonucleotide
  Target: ATXN1; (-) strand; PAM type: YTN; PAM sequence: TTT
attaaacatttctgcacaca

SEQ ID NO: 196580 - DNA, 20 bp, Artificial Sequence
  Description of Artificial Sequence: Synthetic oligonucleotide
  Target: ATXN1; (-) strand; PAM type: YTN; PAM sequence: TTT
tattaaacatttctgcacac

SEQ ID NO: 196581 - DNA, 20 bp, Artificial Sequence
  Description of Artificial Sequence: Synthetic oligonucleotide
  Target: ATXN1; (-) strand; PAM type: YTN; PAM sequence: CTT
ttattaaacatttctgcaca

SEQ ID NO: 196582 - DNA, 20 bp, Artificial Sequence
  Description of Artificial Sequence: Synthetic oligonucleotide
  Target: ATXN1; (-) strand; PAM type: YTN; PAM sequence: CTC
ccacttttattaaacatttc

SEQ ID NO: 196583 - DNA, 20 bp, Artificial Sequence
  Description of Artificial Sequence: Synthetic oligonucleotide
  Target: ATXN1; (-) strand; PAM type: YTN; PAM sequence: CTC
ccctcccacttttattaaac

SEQ ID NO: 196584 - DNA, 20 bp, Artificial Sequence
  Description of Artificial Sequence: Synthetic oligonucleotide
  Target: ATXN1; (-) strand; PAM type: YTN; PAM sequence: CTC
tcccctcccacttttattaa

SEQ ID NO: 196585 - DNA, 20 bp, Artificial Sequence
  Description of Artificial Sequence: Synthetic oligonucleotide
  Target: ATXN1; (-) strand; PAM type: YTN; PAM sequence: CTC
tctcccctcccacttttatt

SEQ ID NO: 196586 - DNA, 20 bp, Artificial Sequence
  Description of Artificial Sequence: Synthetic oligonucleotide
  Target: ATXN1; (-) strand; PAM type: YTN; PAM sequence: CTA
cacatcaggggtcctctctc

SEQ ID NO: 196587 - DNA, 20 bp, Artificial Sequence
  Description of Artificial Sequence: Synthetic oligonucleotide
  Target: ATXN1; (-) strand; PAM type: YTN; PAM sequence: CTG
caaatgctacacatcagggg

SEQ ID NO: 196588 - DNA, 20 bp, Artificial Sequence
  Description of Artificial Sequence: Synthetic oligonucleotide
  Target: ATXN1; (-) strand; PAM type: YTN; PAM sequence: CTA
cagaagtctgcaaatgctac

SEQ ID NO: 196589 - DNA, 20 bp, Artificial Sequence
  Description of Artificial Sequence: Synthetic oligonucleotide
  Target: ATXN1; (-) strand; PAM type: YTN; PAM sequence: TTA
cactacagaagtctgcaaat

SEQ ID NO: 196590 - DNA, 20 bp, Artificial Sequence
  Description of Artificial Sequence: Synthetic oligonucleotide
  Target: ATXN1; (-) strand; PAM type: YTN; PAM sequence: TTT
acactacagaagtctgcaaa

SEQ ID NO: 196591 - DNA, 20 bp, Artificial Sequence
  Description of Artificial Sequence: Synthetic oligonucleotide
  Target: ATXN1; (-) strand; PAM type: YTN; PAM sequence: TTG
gccatggtgggagtgtttac

SEQ ID NO: 196592 - DNA, 20 bp, Artificial Sequence
  Description of Artificial Sequence: Synthetic oligonucleotide
  Target: ATXN1; (-) strand; PAM type: YTN; PAM sequence: TTG
aaattggccatggtgggagt

SEQ ID NO: 196593 - DNA, 20 bp, Artificial Sequence
  Description of Artificial Sequence: Synthetic oligonucleotide
  Target: ATXN1; (-) strand; PAM type: YTN; PAM sequence: CTT
gaaattggccatggtgggag

SEQ ID NO: 196594 - DNA, 20 bp, Artificial Sequence
  Description of Artificial Sequence: Synthetic oligonucleotide
  Target: ATXN1; (-) strand; PAM type: YTN; PAM sequence: TTA
ccttgaaattggccatggtg

SEQ ID NO: 196595 - DNA, 20 bp, Artificial Sequence
  Description of Artificial Sequence: Synthetic oligonucleotide
  Target: ATXN1; (-) strand; PAM type: YTN; PAM sequence: TTA
ttaccttgaaattggccatg

SEQ ID NO: 196596 - DNA, 20 bp, Artificial Sequence
  Description of Artificial Sequence: Synthetic oligonucleotide
  Target: ATXN1; (-) strand; PAM type: YTN; PAM sequence: TTG
acatcatgttattaccttga

SEQ ID NO: 196597 - DNA, 20 bp, Artificial Sequence
  Description of Artificial Sequence: Synthetic oligonucleotide
  Target: ATXN1; (-) strand; PAM type: YTN; PAM sequence: TTG
gggagcatgttgacatcatg

SEQ ID NO: 196598 - DNA, 20 bp, Artificial Sequence
  Description of Artificial Sequence: Synthetic oligonucleotide
  Target: ATXN1; (-) strand; PAM type: YTN; PAM sequence: TTT
ggggagcatgttgacatcat

SEQ ID NO: 196599 - DNA, 20 bp, Artificial Sequence
  Description of Artificial Sequence: Synthetic oligonucleotide
  Target: ATXN1; (-) strand; PAM type: YTN; PAM sequence: TTC
agaaatttggggagcatgtt

SEQ ID NO: 196600 - DNA, 20 bp, Artificial Sequence
  Description of Artificial Sequence: Synthetic oligonucleotide
  Target: ATXN1; (-) strand; PAM type: YTN; PAM sequence: TTA
aatgttcagaaatttgggga

SEQ ID NO: 196601 - DNA, 20 bp, Artificial Sequence
  Description of Artificial Sequence: Synthetic oligonucleotide
  Target: ATXN1; (-) strand; PAM type: YTN; PAM sequence: TTA
tgagccaagtgttaaatgtt

SEQ ID NO: 196602 - DNA, 20 bp, Artificial Sequence
  Description of Artificial Sequence: Synthetic oligonucleotide
  Target: ATXN1; (-) strand; PAM type: YTN; PAM sequence: TTT
atgagccaagtgttaaatgt

SEQ ID NO: 196603 - DNA, 20 bp, Artificial Sequence
  Description of Artificial Sequence: Synthetic oligonucleotide
  Target: ATXN1; (-) strand; PAM type: YTN; PAM sequence: TTT
tatgagccaagtgttaaatg

SEQ ID NO: 196604 - DNA, 20 bp, Artificial Sequence
  Description of Artificial Sequence: Synthetic oligonucleotide
  Target: ATXN1; (-) strand; PAM type: YTN; PAM sequence: CTT
ttatgagccaagtgttaaat

SEQ ID NO: 196605 - DNA, 20 bp, Artificial Sequence
  Description of Artificial Sequence: Synthetic oligonucleotide
  Target: ATXN1; (-) strand; PAM type: YTN; PAM sequence: TTG
cacttttatgagccaagtgt

SEQ ID NO: 196606 - DNA, 20 bp, Artificial Sequence
  Description of Artificial Sequence: Synthetic oligonucleotide
  Target: ATXN1; (-) strand; PAM type: YTN; PAM sequence: CTT
gcacttttatgagccaagtg

SEQ ID NO: 196607 - DNA, 20 bp, Artificial Sequence
  Description of Artificial Sequence: Synthetic oligonucleotide
  Target: ATXN1; (-) strand; PAM type: YTN; PAM sequence: TTG
gtgggatgaggaaatggacc

SEQ ID NO: 196608 - DNA, 20 bp, Artificial Sequence
  Description of Artificial Sequence: Synthetic oligonucleotide
  Target: ATXN1; (-) strand; PAM type: YTN; PAM sequence: CTT
ggtgggatgaggaaatggac

SEQ ID NO: 196609 - DNA, 20 bp, Artificial Sequence
  Description of Artificial Sequence: Synthetic oligonucleotide
  Target: ATXN1; (-) strand; PAM type: YTN; PAM sequence: CTG
atcttggtgggatgaggaaa

SEQ ID NO: 196610 - DNA, 20 bp, Artificial Sequence
  Description of Artificial Sequence: Synthetic oligonucleotide
  Target: ATXN1; (-) strand; PAM type: YTN; PAM sequence: TTA
ctgatcttggtgggatgagg

SEQ ID NO: 196611 - DNA, 20 bp, Artificial Sequence
  Description of Artificial Sequence: Synthetic oligonucleotide
  Target: ATXN1; (-) strand; PAM type: YTN; PAM sequence: TTT
actgatcttggtgggatgag

SEQ ID NO: 196612 - DNA, 20 bp, Artificial Sequence
  Description of Artificial Sequence: Synthetic oligonucleotide
  Target: ATXN1; (-) strand; PAM type: YTN; PAM sequence: TTA
ggtaggaagtagggtttact

SEQ ID NO: 196613 - DNA, 20 bp, Artificial Sequence
  Description of Artificial Sequence: Synthetic oligonucleotide
  Target: ATXN1; (-) strand; PAM type: YTN; PAM sequence: TTT
aggtaggaagtagggtttac

SEQ ID NO: 196614 - DNA, 20 bp, Artificial Sequence
  Description of Artificial Sequence: Synthetic oligonucleotide
  Target: ATXN1; (-) strand; PAM type: YTN; PAM sequence: TTT
taggtaggaagtagggttta

SEQ ID NO: 196615 - DNA, 20 bp, Artificial Sequence
  Description of Artificial Sequence: Synthetic oligonucleotide
  Target: ATXN1; (-) strand; PAM type: YTN; PAM sequence: TTA
ttttaggtaggaagtagggt

SEQ ID NO: 196616 - DNA, 20 bp, Artificial Sequence
  Description of Artificial Sequence: Synthetic oligonucleotide
  Target: ATXN1; (-) strand; PAM type: YTN; PAM sequence: TTT
attttaggtaggaagtaggg

SEQ ID NO: 196617 - DNA, 20 bp, Artificial Sequence
  Description of Artificial Sequence: Synthetic oligonucleotide
  Target: ATXN1; (-) strand; PAM type: YTN; PAM sequence: TTG
ggtttattttaggtaggaag

SEQ ID NO: 196618 - DNA, 20 bp, Artificial Sequence
  Description of Artificial Sequence: Synthetic oligonucleotide
  Target: ATXN1; (-) strand; PAM type: YTN; PAM sequence: CTT
gggtttattttaggtaggaa

SEQ ID NO: 196619 - DNA, 20 bp, Artificial Sequence
  Description of Artificial Sequence: Synthetic oligonucleotide
  Target: ATXN1; (-) strand; PAM type: YTN; PAM sequence: TTC
ttgggtttattttaggtagg

SEQ ID NO: 196620 - DNA, 20 bp, Artificial Sequence
  Description of Artificial Sequence: Synthetic oligonucleotide
  Target: ATXN1; (-) strand; PAM type: YTN; PAM sequence: CTT
cttgggtttattttaggtag

SEQ ID NO: 196621 - DNA, 20 bp, Artificial Sequence
  Description of Artificial Sequence: Synthetic oligonucleotide
  Target: ATXN1; (-) strand; PAM type: YTN; PAM sequence: TTG
cttcttgggtttattttagg

SEQ ID NO: 196622 - DNA, 20 bp, Artificial Sequence
  Description of Artificial Sequence: Synthetic oligonucleotide
  Target: ATXN1; (-) strand; PAM type: YTN; PAM sequence: TTT
gcttcttgggtttattttag

SEQ ID NO: 196623 - DNA, 20 bp, Artificial Sequence
  Description of Artificial Sequence: Synthetic oligonucleotide
  Target: ATXN1; (-) strand; PAM type: YTN; PAM sequence: CTT
tgcttcttgggtttatttta

SEQ ID NO: 196624 - DNA, 20 bp, Artificial Sequence
  Description of Artificial Sequence: Synthetic oligonucleotide
  Target: ATXN1; (-) strand; PAM type: YTN; PAM sequence: CTA
tggataagaagaaagccgaa

SEQ ID NO: 196625 - DNA, 20 bp, Artificial Sequence
  Description of Artificial Sequence: Synthetic oligonucleotide
  Target: ATXN1; (-) strand; PAM type: YTN; PAM sequence: TTA
aatatctatggataagaaga

SEQ ID NO: 196626 - DNA, 20 bp, Artificial Sequence
  Description of Artificial Sequence: Synthetic oligonucleotide
  Target: ATXN1; (-) strand; PAM type: YTN; PAM sequence: CTT
aaatatctatggataagaag

SEQ ID NO: 196627 - DNA, 20 bp, Artificial Sequence
  Description of Artificial Sequence: Synthetic oligonucleotide
  Target: ATXN1; (-) strand; PAM type: YTN; PAM sequence: CTC
ttaaatatctatggataaga

SEQ ID NO: 196628 - DNA, 20 bp, Artificial Sequence
  Description of Artificial Sequence: Synthetic oligonucleotide
  Target: ATXN1; (-) strand; PAM type: YTN; PAM sequence: CTA
gaagcaaagacatggaagtg

SEQ ID NO: 196629 - DNA, 20 bp, Artificial Sequence
  Description of Artificial Sequence: Synthetic oligonucleotide
  Target: ATXN1; (-) strand; PAM type: YTN; PAM sequence: TTC
cagatgaggaggctagaagc

SEQ ID NO: 196630 - DNA, 20 bp, Artificial Sequence
  Description of Artificial Sequence: Synthetic oligonucleotide
  Target: ATXN1; (-) strand; PAM type: YTN; PAM sequence: TTA
ttccagatgaggaggctaga

SEQ ID NO: 196631 - DNA, 20 bp, Artificial Sequence
  Description of Artificial Sequence: Synthetic oligonucleotide
  Target: ATXN1; (-) strand; PAM type: YTN; PAM sequence: TTT
attccagatgaggaggctag

SEQ ID NO: 196632 - DNA, 20 bp, Artificial Sequence
  Description of Artificial Sequence: Synthetic oligonucleotide
  Target: ATXN1; (-) strand; PAM type: YTN; PAM sequence: TTA
ggaaggtttattccagatga

SEQ ID NO: 196633 - DNA, 20 bp, Artificial Sequence
  Description of Artificial Sequence: Synthetic oligonucleotide
  Target: ATXN1; (-) strand; PAM type: YTN; PAM sequence: CTT
aggaaggtttattccagatg

SEQ ID NO: 196634 - DNA, 20 bp, Artificial Sequence
  Description of Artificial Sequence: Synthetic oligonucleotide
  Target: ATXN1; (-) strand; PAM type: YTN; PAM sequence: TTA
tacaagagcagacttaggaa

SEQ ID NO: 196635 - DNA, 20 bp, Artificial Sequence
  Description of Artificial Sequence: Synthetic oligonucleotide
  Target: ATXN1; (-) strand; PAM type: YTN; PAM sequence: TTT
atacaagagcagacttagga

SEQ ID NO: 196636 - DNA, 20 bp, Artificial Sequence
  Description of Artificial Sequence: Synthetic oligonucleotide
  Target: ATXN1; (-) strand; PAM type: YTN; PAM sequence: CTG
tttatacaagagcagactta

SEQ ID NO: 196637 - DNA, 20 bp, Artificial Sequence
  Description of Artificial Sequence: Synthetic oligonucleotide
  Target: ATXN1; (-) strand; PAM type: YTN; PAM sequence: TTC
aaagaaagctgtttatacaa

SEQ ID NO: 196638 - DNA, 20 bp, Artificial Sequence
  Description of Artificial Sequence: Synthetic oligonucleotide
  Target: ATXN1; (-) strand; PAM type: YTN; PAM sequence: CTA
agagcattcaaagaaagctg

SEQ ID NO: 196639 - DNA, 20 bp, Artificial Sequence
  Description of Artificial Sequence: Synthetic oligonucleotide
  Target: ATXN1; (-) strand; PAM type: YTN; PAM sequence: CTA
gcctaagagcattcaaagaa

SEQ ID NO: 196640 - DNA, 20 bp, Artificial Sequence
  Description of Artificial Sequence: Synthetic oligonucleotide
  Target: ATXN1; (-) strand; PAM type: YTN; PAM sequence: CTG
gtgcgacctagcctaagagc

SEQ ID NO: 196641 - DNA, 20 bp, Artificial Sequence
  Description of Artificial Sequence: Synthetic oligonucleotide
  Target: ATXN1; (-) strand; PAM type: YTN; PAM sequence: CTG
tagaaaatcagaatacagaa

SEQ ID NO: 196642 - DNA, 20 bp, Artificial Sequence
  Description of Artificial Sequence: Synthetic oligonucleotide
  Target: ATXN1; (-) strand; PAM type: YTN; PAM sequence: CTA
gaatcaaatgacaggacagt

SEQ ID NO: 196643 - DNA, 20 bp, Artificial Sequence
  Description of Artificial Sequence: Synthetic oligonucleotide
  Target: ATXN1; (-) strand; PAM type: YTN; PAM sequence: CTC
tagaatcaaatgacaggaca

SEQ ID NO: 196644 - DNA, 20 bp, Artificial Sequence
  Description of Artificial Sequence: Synthetic oligonucleotide
  Target: ATXN1; (-) strand; PAM type: YTN; PAM sequence: CTG
ccctctagaatcaaatgaca

SEQ ID NO: 196645 - DNA, 20 bp, Artificial Sequence
  Description of Artificial Sequence: Synthetic oligonucleotide
  Target: ATXN1; (-) strand; PAM type: YTN; PAM sequence: CTC
acagacccctgccctctaga

SEQ ID NO: 196646 - DNA, 20 bp, Artificial Sequence
  Description of Artificial Sequence: Synthetic oligonucleotide
  Target: ATXN1; (-) strand; PAM type: YTN; PAM sequence: CTG
ccctcacagacccctgccct

SEQ ID NO: 196647 - DNA, 20 bp, Artificial Sequence
  Description of Artificial Sequence: Synthetic oligonucleotide
  Target: ATXN1; (-) strand; PAM type: YTN; PAM sequence: CTG
tgggcagatgccctgccctc

SEQ ID NO: 196648 - DNA, 20 bp, Artificial Sequence
  Description of Artificial Sequence: Synthetic oligonucleotide
  Target: ATXN1; (-) strand; PAM type: YTN; PAM sequence: TTC
ctgtgggcagatgccctgcc

SEQ ID NO: 196649 - DNA, 20 bp, Artificial Sequence
  Description of Artificial Sequence: Synthetic oligonucleotide
  Target: ATXN1; (-) strand; PAM type: YTN; PAM sequence: TTA
ttcctgtgggcagatgccct

SEQ ID NO: 196650 - DNA, 20 bp, Artificial Sequence
  Description of Artificial Sequence: Synthetic oligonucleotide
  Target: ATXN1; (-) strand; PAM type: YTN; PAM sequence: CTT
attcctgtgggcagatgccc

SEQ ID NO: 196651 - DNA, 20 bp, Artificial Sequence
  Description of Artificial Sequence: Synthetic oligonucleotide
  Target: ATXN1; (-) strand; PAM type: YTN; PAM sequence: CTG
tgcttattcctgtgggcaga

SEQ ID NO: 196652 - DNA, 20 bp, Artificial Sequence
  Description of Artificial Sequence: Synthetic oligonucleotide
  Target: ATXN1; (-) strand; PAM type: YTN; PAM sequence: TTG
gtgctgtgcttattcctgtg

SEQ ID NO: 196653 - DNA, 20 bp, Artificial Sequence
  Description of Artificial Sequence: Synthetic oligonucleotide
  Target: ATXN1; (-) strand; PAM type: YTN; PAM sequence: CTT
ggtgctgtgcttattcctgt

SEQ ID NO: 196654 - DNA, 20 bp, Artificial Sequence
  Description of Artificial Sequence: Synthetic oligonucleotide
  Target: ATXN1; (-) strand; PAM type: YTN; PAM sequence: CTC
aatccaagtcagacttggtg

SEQ ID NO: 196655 - DNA, 20 bp, Artificial Sequence
  Description of Artificial Sequence: Synthetic oligonucleotide
  Target: ATXN1; (-) strand; PAM type: YTN; PAM sequence: TTC
agctcaatccaagtcagact

SEQ ID NO: 196656 - DNA, 20 bp, Artificial Sequence
  Description of Artificial Sequence: Synthetic oligonucleotide
  Target: ATXN1; (-) strand; PAM type: YTN; PAM sequence: TTA
ttcagctcaatccaagtcag

SEQ ID NO: 196657 - DNA, 20 bp, Artificial Sequence
  Description of Artificial Sequence: Synthetic oligonucleotide
  Target: ATXN1; (-) strand; PAM type: YTN; PAM sequence: TTT
attcagctcaatccaagtca

SEQ ID NO: 196658 - DNA, 20 bp, Artificial Sequence
  Description of Artificial Sequence: Synthetic oligonucleotide
  Target: ATXN1; (-) strand; PAM type: YTN; PAM sequence: TTC
atttattcagctcaatccaa

SEQ ID NO: 196659 - DNA, 20 bp, Artificial Sequence
  Description of Artificial Sequence: Synthetic oligonucleotide
  Target: ATXN1; (-) strand; PAM type: YTN; PAM sequence: TTT
catttattcagctcaatcca

SEQ ID NO: 196660 - DNA, 20 bp, Artificial Sequence
  Description of Artificial Sequence: Synthetic oligonucleotide
  Target: ATXN1; (-) strand; PAM type: YTN; PAM sequence: CTC
aacagatttcatttattcag

SEQ ID NO: 196661 - DNA, 20 bp, Artificial Sequence
  Description of Artificial Sequence: Synthetic oligonucleotide
  Target: ATXN1; (-) strand; PAM type: YTN; PAM sequence: CTA
gacagaaggcagcccagcca

SEQ ID NO: 196662 - DNA, 20 bp, Artificial Sequence
  Description of Artificial Sequence: Synthetic oligonucleotide
  Target: ATXN1; (-) strand; PAM type: YTN; PAM sequence: CTG
tggcagactagacagaaggc

SEQ ID NO: 196663 - DNA, 20 bp, Artificial Sequence
  Description of Artificial Sequence: Synthetic oligonucleotide
  Target: ATXN1; (-) strand; PAM type: YTN; PAM sequence: CTC
actgtggcagactagacaga

SEQ ID NO: 196664 - DNA, 20 bp, Artificial Sequence
  Description of Artificial Sequence: Synthetic oligonucleotide
  Target: ATXN1; (-) strand; PAM type: YTN; PAM sequence: CTA
gctcactgtggcagactaga

SEQ ID NO: 196665 - DNA, 20 bp, Artificial Sequence
  Description of Artificial Sequence: Synthetic oligonucleotide
  Target: ATXN1; (-) strand; PAM type: YTN; PAM sequence: TTC
aggaggagcctagctcactg

SEQ ID NO: 196666 - DNA, 20 bp, Artificial Sequence
  Description of Artificial Sequence: Synthetic oligonucleotide
  Target: ATXN1; (-) strand; PAM type: YTN; PAM sequence: CTT
caggaggagcctagctcact

SEQ ID NO: 196667 - DNA, 20 bp, Artificial Sequence
  Description of Artificial Sequence: Synthetic oligonucleotide
  Target: ATXN1; (-) strand; PAM type: YTN; PAM sequence: TTC
acttcaggaggagcctagct

SEQ ID NO: 196668 - DNA, 20 bp, Artificial Sequence
  Description of Artificial Sequence: Synthetic oligonucleotide
  Target: ATXN1; (-) strand; PAM type: YTN; PAM sequence: CTA
gttcacttcaggaggagcct

SEQ ID NO: 196669 - DNA, 20 bp, Artificial Sequence
  Description of Artificial Sequence: Synthetic oligonucleotide
  Target: ATXN1; (-) strand; PAM type: YTN; PAM sequence: CTG
atcctagttcacttcaggag

SEQ ID NO: 196670 - DNA, 20 bp, Artificial Sequence
  Description of Artificial Sequence: Synthetic oligonucleotide
  Target: ATXN1; (-) strand; PAM type: YTN; PAM sequence: CTC
actgatcctagttcacttca

SEQ ID NO: 196671 - DNA, 20 bp, Artificial Sequence
  Description of Artificial Sequence: Synthetic oligonucleotide
  Target: ATXN1; (-) strand; PAM type: YTN; PAM sequence: TTA
gtccctcactgatcctagtt

SEQ ID NO: 196672 - DNA, 20 bp, Artificial Sequence
  Description of Artificial Sequence: Synthetic oligonucleotide
  Target: ATXN1; (-) strand; PAM type: YTN; PAM sequence: TTT
agtccctcactgatcctagt

SEQ ID NO: 196673 - DNA, 20 bp, Artificial Sequence
  Description of Artificial Sequence: Synthetic oligonucleotide
  Target: ATXN1; (-) strand; PAM type: YTN; PAM sequence: CTT
tagtccctcactgatcctag

SEQ ID NO: 196674 - DNA, 20 bp, Artificial Sequence
  Description of Artificial Sequence: Synthetic oligonucleotide
  Target: ATXN1; (-) strand; PAM type: YTN; PAM sequence: TTG
actttagtccctcactgatc

SEQ ID NO: 196675 - DNA, 20 bp, Artificial Sequence
  Description of Artificial Sequence: Synthetic oligonucleotide
  Target: ATXN1; (-) strand; PAM type: YTN; PAM sequence: CTA
cagattgactttagtccctc

SEQ ID NO: 196676 - DNA, 20 bp, Artificial Sequence
  Description of Artificial Sequence: Synthetic oligonucleotide
  Target: ATXN1; (-) strand; PAM type: YTN; PAM sequence: TTC
atgctacagattgactttag

SEQ ID NO: 196677 - DNA, 20 bp, Artificial Sequence
  Description of Artificial Sequence: Synthetic oligonucleotide
  Target: ATXN1; (-) strand; PAM type: YTN; PAM sequence: CTT
catgctacagattgacttta

SEQ ID NO: 196678 - DNA, 20 bp, Artificial Sequence
  Description of Artificial Sequence: Synthetic oligonucleotide
  Target: ATXN1; (-) strand; PAM type: YTN; PAM sequence: CTG
tgaaatcttcatgctacaga

SEQ ID NO: 196679 - DNA, 20 bp, Artificial Sequence
  Description of Artificial Sequence: Synthetic oligonucleotide
  Target: ATXN1; (-) strand; PAM type: YTN; PAM sequence: TTG
gtgtgtgcagtagtgagtgc

SEQ ID NO: 196680 - DNA, 20 bp, Artificial Sequence
  Description of Artificial Sequence: Synthetic oligonucleotide
  Target: ATXN1; (-) strand; PAM type: YTN; PAM sequence: TTT
ggtgtgtgcagtagtgagtg

SEQ ID NO: 196681 - DNA, 20 bp, Artificial Sequence
  Description of Artificial Sequence: Synthetic oligonucleotide
  Target: ATXN1; (-) strand; PAM type: YTN; PAM sequence: TTG
tgggagtttggtgtgtgcag

SEQ ID NO: 196682 - DNA, 20 bp, Artificial Sequence
  Description of Artificial Sequence: Synthetic oligonucleotide
  Target: ATXN1; (-) strand; PAM type: YTN; PAM sequence: TTT
gtgggagtttggtgtgtgca

SEQ ID NO: 196683 - DNA, 20 bp, Artificial Sequence
  Description of Artificial Sequence: Synthetic oligonucleotide
  Target: ATXN1; (-) strand; PAM type: YTN; PAM sequence: TTT
tgtgggagtttggtgtgtgc

SEQ ID NO: 196684 - DNA, 20 bp, Artificial Sequence
  Description of Artificial Sequence: Synthetic oligonucleotide
  Target: ATXN1; (-) strand; PAM type: YTN; PAM sequence: CTT
ttgtgggagtttggtgtgtg

SEQ ID NO: 196685 - DNA, 20 bp, Artificial Sequence
  Description of Artificial Sequence: Synthetic oligonucleotide
  Target: ATXN1; (-) strand; PAM type: YTN; PAM sequence: TTC
cttttgtgggagtttggtgt

SEQ ID NO: 196686 - DNA, 20 bp, Artificial Sequence
  Description of Artificial Sequence: Synthetic oligonucleotide
  Target: ATXN1; (-) strand; PAM type: YTN; PAM sequence: CTT
ccttttgtgggagtttggtg

SEQ ID NO: 196687 - DNA, 20 bp, Artificial Sequence
  Description of Artificial Sequence: Synthetic oligonucleotide
  Target: ATXN1; (-) strand; PAM type: YTN; PAM sequence: CTC
ttccttttgtgggagtttgg

SEQ ID NO: 196688 - DNA, 20 bp, Artificial Sequence
  Description of Artificial Sequence: Synthetic oligonucleotide
  Target: ATXN1; (-) strand; PAM type: YTN; PAM sequence: CTC
cccctcttccttttgtggga

SEQ ID NO: 196689 - DNA, 20 bp, Artificial Sequence
  Description of Artificial Sequence: Synthetic oligonucleotide
  Target: ATXN1; (-) strand; PAM type: YTN; PAM sequence: TTA
gctccccctcttccttttgt

SEQ ID NO: 196690 - DNA, 20 bp, Artificial Sequence
  Description of Artificial Sequence: Synthetic oligonucleotide
  Target: ATXN1; (-) strand; PAM type: YTN; PAM sequence: TTA
tgcccaacacatattagctc

SEQ ID NO: 196691 - DNA, 20 bp, Artificial Sequence
  Description of Artificial Sequence: Synthetic oligonucleotide
  Target: ATXN1; (-) strand; PAM type: YTN; PAM sequence: TTT
atgcccaacacatattagct

SEQ ID NO: 196692 - DNA, 20 bp, Artificial Sequence
  Description of Artificial Sequence: Synthetic oligonucleotide
  Target: ATXN1; (-) strand; PAM type: YTN; PAM sequence: TTT
tatgcccaacacatattagc

SEQ ID NO: 196693 - DNA, 20 bp, Artificial Sequence
  Description of Artificial Sequence: Synthetic oligonucleotide
  Target: ATXN1; (-) strand; PAM type: YTN; PAM sequence: TTG
cagaaattttatgcccaaca

SEQ ID NO: 196694 - DNA, 20 bp, Artificial Sequence
  Description of Artificial Sequence: Synthetic oligonucleotide
  Target: ATXN1; (-) strand; PAM type: YTN; PAM sequence: CTT
gcagaaattttatgcccaac

SEQ ID NO: 196695 - DNA, 20 bp, Artificial Sequence
  Description of Artificial Sequence: Synthetic oligonucleotide
  Target: ATXN1; (-) strand; PAM type: YTN; PAM sequence: CTG
gggcttgcagaaattttatg

SEQ ID NO: 196696 - DNA, 20 bp, Artificial Sequence
  Description of Artificial Sequence: Synthetic oligonucleotide
  Target: ATXN1; (-) strand; PAM type: YTN; PAM sequence: CTG
ggtgctggggcttgcagaaa

SEQ ID NO: 196697 - DNA, 20 bp, Artificial Sequence
  Description of Artificial Sequence: Synthetic oligonucleotide
  Target: ATXN1; (-) strand; PAM type: YTN; PAM sequence: TTC
tgggtgctggggcttgcaga

SEQ ID NO: 196698 - DNA, 20 bp, Artificial Sequence
  Description of Artificial Sequence: Synthetic oligonucleotide
  Target: ATXN1; (-) strand; PAM type: YTN; PAM sequence: CTA
agttctgggtgctggggctt

SEQ ID NO: 196699 - DNA, 20 bp, Artificial Sequence
  Description of Artificial Sequence: Synthetic oligonucleotide
  Target: ATXN1; (-) strand; PAM type: YTN; PAM sequence: TTA
ggaactaagttctgggtgct

SEQ ID NO: 196700 - DNA, 20 bp, Artificial Sequence
  Description of Artificial Sequence: Synthetic oligonucleotide
  Target: ATXN1; (-) strand; PAM type: YTN; PAM sequence: TTG
gagaatggtgttaggaacta

SEQ ID NO: 196701 - DNA, 20 bp, Artificial Sequence
  Description of Artificial Sequence: Synthetic oligonucleotide
  Target: ATXN1; (-) strand; PAM type: YTN; PAM sequence: TTA
ttggagaatggtgttaggaa

SEQ ID NO: 196702 - DNA, 20 bp, Artificial Sequence
  Description of Artificial Sequence: Synthetic oligonucleotide
  Target: ATXN1; (-) strand; PAM type: YTN; PAM sequence: TTT
attggagaatggtgttagga

SEQ ID NO: 196703 - DNA, 20 bp, Artificial Sequence
  Description of Artificial Sequence: Synthetic oligonucleotide
  Target: ATXN1; (-) strand; PAM type: YTN; PAM sequence: TTT
tattggagaatggtgttagg

SEQ ID NO: 196704 - DNA, 20 bp, Artificial Sequence
  Description of Artificial Sequence: Synthetic oligonucleotide
  Target: ATXN1; (-) strand; PAM type: YTN; PAM sequence: TTG
ttttattggagaatggtgtt

SEQ ID NO: 196705 - DNA, 20 bp, Artificial Sequence
  Description of Artificial Sequence: Synthetic oligonucleotide
  Target: ATXN1; (-) strand; PAM type: YTN; PAM sequence: TTT
gttttattggagaatggtgt

SEQ ID NO: 196706 - DNA, 20 bp, Artificial Sequence
  Description of Artificial Sequence: Synthetic oligonucleotide
  Target: ATXN1; (-) strand; PAM type: YTN; PAM sequence: CTG
gtttgttttattggagaatg

SEQ ID NO: 196707 - DNA, 20 bp, Artificial Sequence
  Description of Artificial Sequence: Synthetic oligonucleotide
  Target: ATXN1; (-) strand; PAM type: YTN; PAM sequence: CTC
caaagacccctggtttgttt

SEQ ID NO: 196708 - DNA, 20 bp, Artificial Sequence
  Description of Artificial Sequence: Synthetic oligonucleotide
  Target: ATXN1; (-) strand; PAM type: YTN; PAM sequence: TTC
tccaaagacccctggtttgt

SEQ ID NO: 196709 - DNA, 20 bp, Artificial Sequence
  Description of Artificial Sequence: Synthetic oligonucleotide
  Target: ATXN1; (-) strand; PAM type: YTN; PAM sequence: TTT
ctccaaagacccctggtttg

SEQ ID NO: 196710 - DNA, 20 bp, Artificial Sequence
  Description of Artificial Sequence: Synthetic oligonucleotide
  Target: ATXN1; (-) strand; PAM type: YTN; PAM sequence: CTA
gaatcagccatttctccaaa

SEQ ID NO: 196711 - DNA, 20 bp, Artificial Sequence
  Description of Artificial Sequence: Synthetic oligonucleotide
  Target: ATXN1; (-) strand; PAM type: YTN; PAM sequence: CTG
tcacagtactagaatcagcc

SEQ ID NO: 196712 - DNA, 20 bp, Artificial Sequence
  Description of Artificial Sequence: Synthetic oligonucleotide
  Target: ATXN1; (-) strand; PAM type: YTN; PAM sequence: TTC
cctgtcacagtactagaatc

SEQ ID NO: 196713 - DNA, 20 bp, Artificial Sequence
  Description of Artificial Sequence: Synthetic oligonucleotide
  Target: ATXN1; (-) strand; PAM type: YTN; PAM sequence: TTG
gatattccctgtcacagtac

SEQ ID NO: 196714 - DNA, 20 bp, Artificial Sequence
  Description of Artificial Sequence: Synthetic oligonucleotide
  Target: ATXN1; (-) strand; PAM type: YTN; PAM sequence: CTT
ggatattccctgtcacagta

SEQ ID NO: 196715 - DNA, 20 bp, Artificial Sequence
  Description of Artificial Sequence: Synthetic oligonucleotide
  Target: ATXN1; (-) strand; PAM type: YTN; PAM sequence: CTC
atcttggatattccctgtca

SEQ ID NO: 196716 - DNA, 20 bp, Artificial Sequence
  Description of Artificial Sequence: Synthetic oligonucleotide
  Target: ATXN1; (-) strand; PAM type: YTN; PAM sequence: CTC
catgctcatcttggatattc

SEQ ID NO: 196717 - DNA, 20 bp, Artificial Sequence
  Description of Artificial Sequence: Synthetic oligonucleotide
  Target: ATXN1; (-) strand; PAM type: YTN; PAM sequence: CTA
caagatgctccatgctcatc

SEQ ID NO: 196718 - DNA, 20 bp, Artificial Sequence
  Description of Artificial Sequence: Synthetic oligonucleotide
  Target: ATXN1; (-) strand; PAM type: YTN; PAM sequence: CTG
atactacaagatgctccatg

SEQ ID NO: 196719 - DNA, 20 bp, Artificial Sequence
  Description of Artificial Sequence: Synthetic oligonucleotide
  Target: ATXN1; (-) strand; PAM type: YTN; PAM sequence: TTC
tgatactacaagatgctcca

SEQ ID NO: 196720 - DNA, 20 bp, Artificial Sequence
  Description of Artificial Sequence: Synthetic oligonucleotide
  Target: ATXN1; (-) strand; PAM type: YTN; PAM sequence: TTT
ctgatactacaagatgctcc

SEQ ID NO: 196721 - DNA, 20 bp, Artificial Sequence
  Description of Artificial Sequence: Synthetic oligonucleotide
  Target: ATXN1; (-) strand; PAM type: YTN; PAM sequence: CTT
tctgatactacaagatgctc

SEQ ID NO: 196722 - DNA, 20 bp, Artificial Sequence
  Description of Artificial Sequence: Synthetic oligonucleotide
  Target: ATXN1; (-) strand; PAM type: YTN; PAM sequence: TTC
ccactttctgatactacaag

SEQ ID NO: 196723 - DNA, 20 bp, Artificial Sequence
  Description of Artificial Sequence: Synthetic oligonucleotide
  Target: ATXN1; (-) strand; PAM type: YTN; PAM sequence: TTT
cccactttctgatactacaa

SEQ ID NO: 196724 - DNA, 20 bp, Artificial Sequence
  Description of Artificial Sequence: Synthetic oligonucleotide
  Target: ATXN1; (-) strand; PAM type: YTN; PAM sequence: TTT
tcccactttctgatactaca

SEQ ID NO: 196725 - DNA, 20 bp, Artificial Sequence
  Description of Artificial Sequence: Synthetic oligonucleotide
  Target: ATXN1; (-) strand; PAM type: YTN; PAM sequence: TTA
gcattttcccactttctgat

SEQ ID NO: 196726 - DNA, 20 bp, Artificial Sequence
  Description of Artificial Sequence: Synthetic oligonucleotide
  Target: ATXN1; (-) strand; PAM type: YTN; PAM sequence: TTT
agcattttcccactttctga

SEQ ID NO: 196727 - DNA, 20 bp, Artificial Sequence
  Description of Artificial Sequence: Synthetic oligonucleotide
  Target: ATXN1; (-) strand; PAM type: YTN; PAM sequence: CTA
tttagcattttcccactttc

SEQ ID NO: 196728 - DNA, 20 bp, Artificial Sequence
  Description of Artificial Sequence: Synthetic oligonucleotide
  Target: ATXN1; (-) strand; PAM type: YTN; PAM sequence: TTA
tctatttagcattttcccac

SEQ ID NO: 196729 - DNA, 20 bp, Artificial Sequence
  Description of Artificial Sequence: Synthetic oligonucleotide
  Target: ATXN1; (-) strand; PAM type: YTN; PAM sequence: TTT
atctatttagcattttccca

SEQ ID NO: 196730 - DNA, 20 bp, Artificial Sequence
  Description of Artificial Sequence: Synthetic oligonucleotide
  Target: ATXN1; (-) strand; PAM type: YTN; PAM sequence: TTG
atttatctatttagcatttt

SEQ ID NO: 196731 - DNA, 20 bp, Artificial Sequence
  Description of Artificial Sequence: Synthetic oligonucleotide
  Target: ATXN1; (-) strand; PAM type: YTN; PAM sequence: CTG
tggggtattgatttatctat

SEQ ID NO: 196732 - DNA, 20 bp, Artificial Sequence
  Description of Artificial Sequence: Synthetic oligonucleotide
  Target: ATXN1; (-) strand; PAM type: YTN; PAM sequence: TTA
tatgcccccatcactgtggg

SEQ ID NO: 196733 - DNA, 20 bp, Artificial Sequence
  Description of Artificial Sequence: Synthetic oligonucleotide
  Target: ATXN1; (-) strand; PAM type: YTN; PAM sequence: TTT
atatgcccccatcactgtgg

SEQ ID NO: 196734 - DNA, 20 bp, Artificial Sequence
  Description of Artificial Sequence: Synthetic oligonucleotide
  Target: ATXN1; (-) strand; PAM type: YTN; PAM sequence: TTT
tatatgcccccatcactgtg

SEQ ID NO: 196735 - DNA, 20 bp, Artificial Sequence
  Description of Artificial Sequence: Synthetic oligonucleotide
  Target: ATXN1; (-) strand; PAM type: YTN; PAM sequence: CTT
ttatatgcccccatcactgt

SEQ ID NO: 196736 - DNA, 20 bp, Artificial Sequence
  Description of Artificial Sequence: Synthetic oligonucleotide
  Target: ATXN1; (-) strand; PAM type: YTN; PAM sequence: TTG
tcccccttttatatgccccc

SEQ ID NO: 196737 - DNA, 20 bp, Artificial Sequence
  Description of Artificial Sequence: Synthetic oligonucleotide
  Target: ATXN1; (-) strand; PAM type: YTN; PAM sequence: CTT
gtcccccttttatatgcccc

SEQ ID NO: 196738 - DNA, 20 bp, Artificial Sequence
  Description of Artificial Sequence: Synthetic oligonucleotide
  Target: ATXN1; (-) strand; PAM type: YTN; PAM sequence: CTC
ttgtcccccttttatatgcc

SEQ ID NO: 196739 - DNA, 20 bp, Artificial Sequence
  Description of Artificial Sequence: Synthetic oligonucleotide
  Target: ATXN1; (-) strand; PAM type: YTN; PAM sequence: TTG
tctcttgtcccccttttata

SEQ ID NO: 196740 - DNA, 20 bp, Artificial Sequence
  Description of Artificial Sequence: Synthetic oligonucleotide
  Target: ATXN1; (-) strand; PAM type: YTN; PAM sequence: TTA
ggaatattgtctcttgtccc

SEQ ID NO: 196741 - DNA, 20 bp, Artificial Sequence
  Description of Artificial Sequence: Synthetic oligonucleotide
  Target: ATXN1; (-) strand; PAM type: YTN; PAM sequence: TTG
agaaatattaggaatattgt

SEQ ID NO: 196742 - DNA, 20 bp, Artificial Sequence
  Description of Artificial Sequence: Synthetic oligonucleotide
  Target: ATXN1; (-) strand; PAM type: YTN; PAM sequence: TTT
gagaaatattaggaatattg

SEQ ID NO: 196743 - DNA, 20 bp, Artificial Sequence
  Description of Artificial Sequence: Synthetic oligonucleotide
  Target: ATXN1; (-) strand; PAM type: YTN; PAM sequence: CTT
tgagaaatattaggaatatt

SEQ ID NO: 196744 - DNA, 20 bp, Artificial Sequence
  Description of Artificial Sequence: Synthetic oligonucleotide
  Target: ATXN1; (-) strand; PAM type: YTN; PAM sequence: CTC
tttgagaaatattaggaata

SEQ ID NO: 196745 - DNA, 20 bp, Artificial Sequence
  Description of Artificial Sequence: Synthetic oligonucleotide
  Target: ATXN1; (-) strand; PAM type: YTN; PAM sequence: TTG
gcagctctttgagaaatatt

SEQ ID NO: 196746 - DNA, 20 bp, Artificial Sequence
  Description of Artificial Sequence: Synthetic oligonucleotide
  Target: ATXN1; (-) strand; PAM type: YTN; PAM sequence: CTG
gccattggcagctctttgag

SEQ ID NO: 196747 - DNA, 20 bp, Artificial Sequence
  Description of Artificial Sequence: Synthetic oligonucleotide
  Target: ATXN1; (-) strand; PAM type: YTN; PAM sequence: TTC
tggccattggcagctctttg

SEQ ID NO: 196748 - DNA, 20 bp, Artificial Sequence
  Description of Artificial Sequence: Synthetic oligonucleotide
  Target: ATXN1; (-) strand; PAM type: YTN; PAM sequence: TTA
gttctggccattggcagctc

SEQ ID NO: 196749 - DNA, 20 bp, Artificial Sequence
  Description of Artificial Sequence: Synthetic oligonucleotide
  Target: ATXN1; (-) strand; PAM type: YTN; PAM sequence: TTT
agttctggccattggcagct

SEQ ID NO: 196750 - DNA, 20 bp, Artificial Sequence
  Description of Artificial Sequence: Synthetic oligonucleotide
  Target: ATXN1; (-) strand; PAM type: YTN; PAM sequence: TTT
tagttctggccattggcagc

SEQ ID NO: 196751 - DNA, 20 bp, Artificial Sequence
  Description of Artificial Sequence: Synthetic oligonucleotide
  Target: ATXN1; (-) strand; PAM type: YTN; PAM sequence: TTG
ttttagttctggccattggc

SEQ ID NO: 196752 - DNA, 20 bp, Artificial Sequence
  Description of Artificial Sequence: Synthetic oligonucleotide
  Target: ATXN1; (-) strand; PAM type: YTN; PAM sequence: CTG
gttgttttagttctggccat

SEQ ID NO: 196753 - DNA, 20 bp, Artificial Sequence
  Description of Artificial Sequence: Synthetic oligonucleotide
  Target: ATXN1; (-) strand; PAM type: YTN; PAM sequence: CTC
tggttgttttagttctggcc

SEQ ID NO: 196754 - DNA, 20 bp, Artificial Sequence
  Description of Artificial Sequence: Synthetic oligonucleotide
  Target: ATXN1; (-) strand; PAM type: YTN; PAM sequence: TTG
ctctggttgttttagttctg

SEQ ID NO: 196755 - DNA, 20 bp, Artificial Sequence
  Description of Artificial Sequence: Synthetic oligonucleotide
  Target: ATXN1; (-) strand; PAM type: YTN; PAM sequence: TTG
ttgctctggttgttttagtt

SEQ ID NO: 196756 - DNA, 20 bp, Artificial Sequence
  Description of Artificial Sequence: Synthetic oligonucleotide
  Target: ATXN1; (-) strand; PAM type: YTN; PAM sequence: TTT
gttgctctggttgttttagt

SEQ ID NO: 196757 - DNA, 20 bp, Artificial Sequence
  Description of Artificial Sequence: Synthetic oligonucleotide
  Target: ATXN1; (-) strand; PAM type: YTN; PAM sequence: TTT
tgttgctctggttgttttag

SEQ ID NO: 196758 - DNA, 20 bp, Artificial Sequence
  Description of Artificial Sequence: Synthetic oligonucleotide
  Target: ATXN1; (-) strand; PAM type: YTN; PAM sequence: TTA
ttttgttgctctggttgttt

SEQ ID NO: 196759 - DNA, 20 bp, Artificial Sequence
  Description of Artificial Sequence: Synthetic oligonucleotide
  Target: ATXN1; (-) strand; PAM type: YTN; PAM sequence: TTT
attttgttgctctggttgtt

SEQ ID NO: 196760 - DNA, 20 bp, Artificial Sequence
  Description of Artificial Sequence: Synthetic oligonucleotide
  Target: ATXN1; (-) strand; PAM type: YTN; PAM sequence: TTG
tttattttgttgctctggtt

SEQ ID NO: 196761 - DNA, 20 bp, Artificial Sequence
  Description of Artificial Sequence: Synthetic oligonucleotide
  Target: ATXN1; (-) strand; PAM type: YTN; PAM sequence: CTA
tgttgtttattttgttgctc

SEQ ID NO: 196762 - DNA, 20 bp, Artificial Sequence
  Description of Artificial Sequence: Synthetic oligonucleotide
  Target: ATXN1; (-) strand; PAM type: YTN; PAM sequence: CTA
atccagtactatgttgttta

SEQ ID NO: 196763 - DNA, 20 bp, Artificial Sequence
  Description of Artificial Sequence: Synthetic oligonucleotide
  Target: ATXN1; (-) strand; PAM type: YTN; PAM sequence: TTC
taatccagtactatgttgtt

SEQ ID NO: 196764 - DNA, 20 bp, Artificial Sequence
  Description of Artificial Sequence: Synthetic oligonucleotide
  Target: ATXN1; (-) strand; PAM type: YTN; PAM sequence: TTA
ggttctaatccagtactatg

SEQ ID NO: 196765 - DNA, 20 bp, Artificial Sequence
  Description of Artificial Sequence: Synthetic oligonucleotide
  Target: ATXN1; (-) strand; PAM type: YTN; PAM sequence: TTT
aggttctaatccagtactat

SEQ ID NO: 196766 - DNA, 20 bp, Artificial Sequence
  Description of Artificial Sequence: Synthetic oligonucleotide
  Target: ATXN1; (-) strand; PAM type: YTN; PAM sequence: CTT
taggttctaatccagtacta

SEQ ID NO: 196767 - DNA, 20 bp, Artificial Sequence
  Description of Artificial Sequence: Synthetic oligonucleotide
  Target: ATXN1; (-) strand; PAM type: YTN; PAM sequence: TTC
tttaggttctaatccagtac

SEQ ID NO: 196768 - DNA, 20 bp, Artificial Sequence
  Description of Artificial Sequence: Synthetic oligonucleotide
  Target: ATXN1; (-) strand; PAM type: YTN; PAM sequence: TTA
ttctttaggttctaatccag

SEQ ID NO: 196769 - DNA, 20 bp, Artificial Sequence
  Description of Artificial Sequence: Synthetic oligonucleotide
  Target: ATXN1; (-) strand; PAM type: YTN; PAM sequence: TTT
attctttaggttctaatcca

SEQ ID NO: 196770 - DNA, 20 bp, Artificial Sequence
  Description of Artificial Sequence: Synthetic oligonucleotide
  Target: ATXN1; (-) strand; PAM type: YTN; PAM sequence: TTT
tattctttaggttctaatcc

SEQ ID NO: 196771 - DNA, 20 bp, Artificial Sequence
  Description of Artificial Sequence: Synthetic oligonucleotide
  Target: ATXN1; (-) strand; PAM type: YTN; PAM sequence: TTA
ttttattctttaggttctaa

SEQ ID NO: 196772 - DNA, 20 bp, Artificial Sequence
  Description of Artificial Sequence: Synthetic oligonucleotide
  Target: ATXN1; (-) strand; PAM type: YTN; PAM sequence: TTT
attttattctttaggttcta

SEQ ID NO: 196773 - DNA, 20 bp, Artificial Sequence
  Description of Artificial Sequence: Synthetic oligonucleotide
  Target: ATXN1; (-) strand; PAM type: YTN; PAM sequence: CTC
atgggtgtttattttattct

SEQ ID NO: 196774 - DNA, 20 bp, Artificial Sequence
  Description of Artificial Sequence: Synthetic oligonucleotide
  Target: ATXN1; (-) strand; PAM type: YTN; PAM sequence: TTA
tatcaatatgaactcatggg

SEQ ID NO: 196775 - DNA, 20 bp, Artificial Sequence
  Description of Artificial Sequence: Synthetic oligonucleotide
  Target: ATXN1; (-) strand; PAM type: YTN; PAM sequence: TTT
atatcaatatgaactcatgg

SEQ ID NO: 196776 - DNA, 20 bp, Artificial Sequence
  Description of Artificial Sequence: Synthetic oligonucleotide
  Target: ATXN1; (-) strand; PAM type: YTN; PAM sequence: TTA
tttatatcaatatgaactca

SEQ ID NO: 196777 - DNA, 20 bp, Artificial Sequence
  Description of Artificial Sequence: Synthetic oligonucleotide
  Target: ATXN1; (-) strand; PAM type: YTN; PAM sequence: TTT
atttatatcaatatgaactc

SEQ ID NO: 196778 - DNA, 20 bp, Artificial Sequence
  Description of Artificial Sequence: Synthetic oligonucleotide
  Target: ATXN1; (-) strand; PAM type: YTN; PAM sequence: TTA
aaatttatttatatcaatat

SEQ ID NO: 196779 - DNA, 20 bp, Artificial Sequence
  Description of Artificial Sequence: Synthetic oligonucleotide
  Target: ATXN1; (-) strand; PAM type: YTN; PAM sequence: TTT
aaaatttatttatatcaata

SEQ ID NO: 196780 - DNA, 20 bp, Artificial Sequence
  Description of Artificial Sequence: Synthetic oligonucleotide
  Target: ATXN1; (-) strand; PAM type: YTN; PAM sequence: TTT
taaaatttatttatatcaat

SEQ ID NO: 196781 - DNA, 20 bp, Artificial Sequence
  Description of Artificial Sequence: Synthetic oligonucleotide
  Target: ATXN1; (-) strand; PAM type: YTN; PAM sequence: CTT
ttaaaatttatttatatcaa

SEQ ID NO: 196782 - DNA, 20 bp, Artificial Sequence
  Description of Artificial Sequence: Synthetic oligonucleotide
  Target: ATXN1; (-) strand; PAM type: YTN; PAM sequence: CTC
ttttaaaatttatttatatc

SEQ ID NO: 196783 - DNA, 20 bp, Artificial Sequence
  Description of Artificial Sequence: Synthetic oligonucleotide
  Target: ATXN1; (-) strand; PAM type: YTN; PAM sequence: TTC
ctcttttaaaatttatttat

SEQ ID NO: 196784 - DNA, 20 bp, Artificial Sequence
  Description of Artificial Sequence: Synthetic oligonucleotide
  Target: ATXN1; (-) strand; PAM type: YTN; PAM sequence: CTT
cctcttttaaaatttattta

SEQ ID NO: 196785 - DNA, 20 bp, Artificial Sequence
  Description of Artificial Sequence: Synthetic oligonucleotide
  Target: ATXN1; (-) strand; PAM type: YTN; PAM sequence: TTC
ttcctcttttaaaatttatt

SEQ ID NO: 196786 - DNA, 20 bp, Artificial Sequence
  Description of Artificial Sequence: Synthetic oligonucleotide
  Target: ATXN1; (-) strand; PAM type: YTN; PAM sequence: TTT
cttcctcttttaaaatttat

SEQ ID NO: 196787 - DNA, 20 bp, Artificial Sequence
  Description of Artificial Sequence: Synthetic oligonucleotide
  Target: ATXN1; (-) strand; PAM type: YTN; PAM sequence: TTT
tcttcctcttttaaaattta

SEQ ID NO: 196788 - DNA, 20 bp, Artificial Sequence
  Description of Artificial Sequence: Synthetic oligonucleotide
  Target: ATXN1; (-) strand; PAM type: YTN; PAM sequence: CTC
aagagatgcgtgttttcttc

SEQ ID NO: 196789 - DNA, 20 bp, Artificial Sequence
  Description of Artificial Sequence: Synthetic oligonucleotide
  Target: ATXN1; (-) strand; PAM type: YTN; PAM sequence: TTG
ctcaagagatgcgtgttttc

SEQ ID NO: 196790 - DNA, 20 bp, Artificial Sequence
  Description of Artificial Sequence: Synthetic oligonucleotide
  Target: ATXN1; (-) strand; PAM type: YTN; PAM sequence: TTT
gctcaagagatgcgtgtttt

SEQ ID NO: 196791 - DNA, 20 bp, Artificial Sequence
  Description of Artificial Sequence: Synthetic oligonucleotide
  Target: ATXN1; (-) strand; PAM type: YTN; PAM sequence: CTT
tgctcaagagatgcgtgttt

SEQ ID NO: 196792 - DNA, 20 bp, Artificial Sequence
  Description of Artificial Sequence: Synthetic oligonucleotide
  Target: ATXN1; (-) strand; PAM type: YTN; PAM sequence: CTC
ctttgctcaagagatgcgtg

SEQ ID NO: 196793 - DNA, 20 bp, Artificial Sequence
  Description of Artificial Sequence: Synthetic oligonucleotide
  Target: ATXN1; (-) strand; PAM type: YTN; PAM sequence: TTA
gaactcctttgctcaagaga

SEQ ID NO: 196794 - DNA, 20 bp, Artificial Sequence
  Description of Artificial Sequence: Synthetic oligonucleotide
  Target: ATXN1; (-) strand; PAM type: YTN; PAM sequence: TTT
agaactcctttgctcaagag

SEQ ID NO: 196795 - DNA, 20 bp, Artificial Sequence
  Description of Artificial Sequence: Synthetic oligonucleotide
  Target: ATXN1; (-) strand; PAM type: YTN; PAM sequence: TTA
tttagaactcctttgctcaa

SEQ ID NO: 196796 - DNA, 20 bp, Artificial Sequence
  Description of Artificial Sequence: Synthetic oligonucleotide
  Target: ATXN1; (-) strand; PAM type: YTN; PAM sequence: CTG
catgaattatttagaactcc

SEQ ID NO: 196797 - DNA, 20 bp, Artificial Sequence
  Description of Artificial Sequence: Synthetic oligonucleotide
  Target: ATXN1; (-) strand; PAM type: YTN; PAM sequence: TTA
caagggcagaacatctgcat

SEQ ID NO: 196798 - DNA, 20 bp, Artificial Sequence
  Description of Artificial Sequence: Synthetic oligonucleotide
  Target: ATXN1; (-) strand; PAM type: YTN; PAM sequence: TTT
acaagggcagaacatctgca

SEQ ID NO: 196799 - DNA, 20 bp, Artificial Sequence
  Description of Artificial Sequence: Synthetic oligonucleotide
  Target: ATXN1; (-) strand; PAM type: YTN; PAM sequence: CTT
tacaagggcagaacatctgc

SEQ ID NO: 196800 - DNA, 20 bp, Artificial Sequence
  Description of Artificial Sequence: Synthetic oligonucleotide
  Target: ATXN1; (-) strand; PAM type: YTN; PAM sequence: CTA
cctttacaagggcagaacat

SEQ ID NO: 196801 - DNA, 20 bp, Artificial Sequence
  Description of Artificial Sequence: Synthetic oligonucleotide
  Target: ATXN1; (-) strand; PAM type: YTN; PAM sequence: CTC
tacctttacaagggcagaac

SEQ ID NO: 196802 - DNA, 20 bp, Artificial Sequence
  Description of Artificial Sequence: Synthetic oligonucleotide
  Target: ATXN1; (-) strand; PAM type: YTN; PAM sequence: TTA
cgctctacctttacaagggc

SEQ ID NO: 196803 - DNA, 20 bp, Artificial Sequence
  Description of Artificial Sequence: Synthetic oligonucleotide
  Target: ATXN1; (-) strand; PAM type: YTN; PAM sequence: TTA
aggggtgggcagttacgctc

SEQ ID NO: 196804 - DNA, 20 bp, Artificial Sequence
  Description of Artificial Sequence: Synthetic oligonucleotide
  Target: ATXN1; (-) strand; PAM type: YTN; PAM sequence: CTT
aaggggtgggcagttacgct

SEQ ID NO: 196805 - DNA, 20 bp, Artificial Sequence
  Description of Artificial Sequence: Synthetic oligonucleotide
  Target: ATXN1; (-) strand; PAM type: YTN; PAM sequence: CTG
tgcacagcccacacttaagg

SEQ ID NO: 196806 - DNA, 20 bp, Artificial Sequence
  Description of Artificial Sequence: Synthetic oligonucleotide
  Target: ATXN1; (-) strand; PAM type: YTN; PAM sequence: TTG
gaaggaagtcactgtgcaca

SEQ ID NO: 196807 - DNA, 20 bp, Artificial Sequence
  Description of Artificial Sequence: Synthetic oligonucleotide
  Target: ATXN1; (-) strand; PAM type: YTN; PAM sequence: CTC
gttggaaggaagtcactgtg

SEQ ID NO: 196808 - DNA, 20 bp, Artificial Sequence
  Description of Artificial Sequence: Synthetic oligonucleotide
  Target: ATXN1; (-) strand; PAM type: YTN; PAM sequence: CTA
ctcgttggaaggaagtcact

SEQ ID NO: 196809 - DNA, 20 bp, Artificial Sequence
  Description of Artificial Sequence: Synthetic oligonucleotide
  Target: ATXN1; (-) strand; PAM type: YTN; PAM sequence: CTG
tactactcgttggaaggaag

SEQ ID NO: 196810 - DNA, 20 bp, Artificial Sequence
  Description of Artificial Sequence: Synthetic oligonucleotide
  Target: ATXN1; (-) strand; PAM type: YTN; PAM sequence: TTC
catactgtactactcgttgg

SEQ ID NO: 196811 - DNA, 20 bp, Artificial Sequence
  Description of Artificial Sequence: Synthetic oligonucleotide
  Target: ATXN1; (-) strand; PAM type: YTN; PAM sequence: TTT
ccatactgtactactcgttg

SEQ ID NO: 196812 - DNA, 20 bp, Artificial Sequence
  Description of Artificial Sequence: Synthetic oligonucleotide
  Target: ATXN1; (-) strand; PAM type: YTN; PAM sequence: TTT
tccatactgtactactcgtt

SEQ ID NO: 196813 - DNA, 20 bp, Artificial Sequence
  Description of Artificial Sequence: Synthetic oligonucleotide
  Target: ATXN1; (-) strand; PAM type: YTN; PAM sequence: CTT
ttccatactgtactactcgt

SEQ ID NO: 196814 - DNA, 20 bp, Artificial Sequence
  Description of Artificial Sequence: Synthetic oligonucleotide
  Target: ATXN1; (-) strand; PAM type: YTN; PAM sequence: CTC
acacacacccttttccatac

SEQ ID NO: 196815 - DNA, 20 bp, Artificial Sequence
  Description of Artificial Sequence: Synthetic oligonucleotide
  Target: ATXN1; (-) strand; PAM type: YTN; PAM sequence: TTG
tacacagacacactcacaca

SEQ ID NO: 196816 - DNA, 20 bp, Artificial Sequence
  Description of Artificial Sequence: Synthetic oligonucleotide
  Target: ATXN1; (-) strand; PAM type: YTN; PAM sequence: TTT
gtacacagacacactcacac

SEQ ID NO: 196817 - DNA, 20 bp, Artificial Sequence
  Description of Artificial Sequence: Synthetic oligonucleotide
  Target: ATXN1; (-) strand; PAM type: YTN; PAM sequence: CTT
tgtacacagacacactcaca

SEQ ID NO: 196818 - DNA, 20 bp, Artificial Sequence
  Description of Artificial Sequence: Synthetic oligonucleotide
  Target: ATXN1; (-) strand; PAM type: YTN; PAM sequence: CTC
tttgtacacagacacactca

SEQ ID NO: 196819 - DNA, 20 bp, Artificial Sequence
  Description of Artificial Sequence: Synthetic oligonucleotide
  Target: ATXN1; (-) strand; PAM type: YTN; PAM sequence: TTA
ctctttgtacacagacacac

SEQ ID NO: 196820 - DNA, 20 bp, Artificial Sequence
  Description of Artificial Sequence: Synthetic oligonucleotide
  Target: ATXN1; (-) strand; PAM type: YTN; PAM sequence: TTA
aagttactctttgtacacag

SEQ ID NO: 196821 - DNA, 20 bp, Artificial Sequence
  Description of Artificial Sequence: Synthetic oligonucleotide
  Target: ATXN1; (-) strand; PAM type: YTN; PAM sequence: TTT
aaagttactctttgtacaca

SEQ ID NO: 196822 - DNA, 20 bp, Artificial Sequence
  Description of Artificial Sequence: Synthetic oligonucleotide
  Target: ATXN1; (-) strand; PAM type: YTN; PAM sequence: CTT
taaagttactctttgtacac

SEQ ID NO: 196823 - DNA, 20 bp, Artificial Sequence
  Description of Artificial Sequence: Synthetic oligonucleotide
  Target: ATXN1; (-) strand; PAM type: YTN; PAM sequence: TTG
tcaactttaaagttactctt

SEQ ID NO: 196824 - DNA, 20 bp, Artificial Sequence
  Description of Artificial Sequence: Synthetic oligonucleotide
  Target: ATXN1; (-) strand; PAM type: YTN; PAM sequence: TTT
gtcaactttaaagttactct

SEQ ID NO: 196825 - DNA, 20 bp, Artificial Sequence
  Description of Artificial Sequence: Synthetic oligonucleotide
  Target: ATXN1; (-) strand; PAM type: YTN; PAM sequence: TTG
tgtcagggtttgtcaacttt

SEQ ID NO: 196826 - DNA, 20 bp, Artificial Sequence
  Description of Artificial Sequence: Synthetic oligonucleotide
  Target: ATXN1; (-) strand; PAM type: YTN; PAM sequence: CTC
agccgaggttgtgtcagggt

SEQ ID NO: 196827 - DNA, 20 bp, Artificial Sequence
  Description of Artificial Sequence: Synthetic oligonucleotide
  Target: ATXN1; (-) strand; PAM type: YTN; PAM sequence: TTG
atgacctcagccgaggttgt

SEQ ID NO: 196828 - DNA, 20 bp, Artificial Sequence
  Description of Artificial Sequence: Synthetic oligonucleotide
  Target: ATXN1; (-) strand; PAM type: YTN; PAM sequence: CTT
gatgacctcagccgaggttg

SEQ ID NO: 196829 - DNA, 20 bp, Artificial Sequence
  Description of Artificial Sequence: Synthetic oligonucleotide
  Target: ATXN1; (-) strand; PAM type: YTN; PAM sequence: TTG
atcttgatgacctcagccga

SEQ ID NO: 196830 - DNA, 20 bp, Artificial Sequence
  Description of Artificial Sequence: Synthetic oligonucleotide
  Target: ATXN1; (-) strand; PAM type: YTN; PAM sequence: CTG
ttgatcttgatgacctcagc

SEQ ID NO: 196831 - DNA, 20 bp, Artificial Sequence
  Description of Artificial Sequence: Synthetic oligonucleotide
  Target: ATXN1; (-) strand; PAM type: YTN; PAM sequence: CTA
tcatgggctgttgatcttga

SEQ ID NO: 196832 - DNA, 20 bp, Artificial Sequence
  Description of Artificial Sequence: Synthetic oligonucleotide
  Target: ATXN1; (-) strand; PAM type: YTN; PAM sequence: TTA
tcacatcatatgtgacctat

SEQ ID NO: 196833 - DNA, 20 bp, Artificial Sequence
  Description of Artificial Sequence: Synthetic oligonucleotide
  Target: ATXN1; (-) strand; PAM type: YTN; PAM sequence: TTT
atcacatcatatgtgaccta

SEQ ID NO: 196834 - DNA, 20 bp, Artificial Sequence
  Description of Artificial Sequence: Synthetic oligonucleotide
  Target: ATXN1; (-) strand; PAM type: YTN; PAM sequence: TTT
tatcacatcatatgtgacct

SEQ ID NO: 196835 - DNA, 20 bp, Artificial Sequence
  Description of Artificial Sequence: Synthetic oligonucleotide
  Target: ATXN1; (-) strand; PAM type: YTN; PAM sequence: CTT
ttatcacatcatatgtgacc

SEQ ID NO: 196836 - DNA, 20 bp, Artificial Sequence
  Description of Artificial Sequence: Synthetic oligonucleotide
  Target: ATXN1; (-) strand; PAM type: YTN; PAM sequence: TTG
tcacttttatcacatcatat

SEQ ID NO: 196837 - DNA, 20 bp, Artificial Sequence
  Description of Artificial Sequence: Synthetic oligonucleotide
  Target: ATXN1; (-) strand; PAM type: YTN; PAM sequence: TTG
gcagattgtcacttttatca

SEQ ID NO: 196838 - DNA, 20 bp, Artificial Sequence
  Description of Artificial Sequence: Synthetic oligonucleotide
  Target: ATXN1; (-) strand; PAM type: YTN; PAM sequence: TTA
aaattggcagattgtcactt

SEQ ID NO: 196839 - DNA, 20 bp, Artificial Sequence
  Description of Artificial Sequence: Synthetic oligonucleotide
  Target: ATXN1; (-) strand; PAM type: YTN; PAM sequence: CTT
aaaattggcagattgtcact

SEQ ID NO: 196840 - DNA, 20 bp, Artificial Sequence
  Description of Artificial Sequence: Synthetic oligonucleotide
  Target: ATXN1; (-) strand; PAM type: YTN; PAM sequence: CTC
cttaaaattggcagattgtc

SEQ ID NO: 196841 - DNA, 20 bp, Artificial Sequence
  Description of Artificial Sequence: Synthetic oligonucleotide
  Target: ATXN1; (-) strand; PAM type: YTN; PAM sequence: CTG
tactccttaaaattggcaga

SEQ ID NO: 196842 - DNA, 20 bp, Artificial Sequence
  Description of Artificial Sequence: Synthetic oligonucleotide
  Target: ATXN1; (-) strand; PAM type: YTN; PAM sequence: TTA
gtctgtactccttaaaattg

SEQ ID NO: 196843 - DNA, 20 bp, Artificial Sequence
  Description of Artificial Sequence: Synthetic oligonucleotide
  Target: ATXN1; (-) strand; PAM type: YTN; PAM sequence: TTG
agggacagtccacaaaatga

SEQ ID NO: 196844 - DNA, 20 bp, Artificial Sequence
  Description of Artificial Sequence: Synthetic oligonucleotide
  Target: ATXN1; (-) strand; PAM type: YTN; PAM sequence: CTG
gccagaaaaacccaaattga

SEQ ID NO: 196845 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaaccatgc

SEQ ID NO: 196846 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccaa

SEQ ID NO: 196847 - DNA, 20 bp, Artificial Sequence
  Description of Artificial Sequence: Synthetic oligonucleotide
  Target: ATXN1; (-) strand; PAM type: YTN; PAM sequence: TTG
gccccacaaagtgctgggat

SEQ ID NO: 196848 - DNA, 20 bp, Artificial Sequence
  Description of Artificial Sequence: Synthetic oligonucleotide
  Target: ATXN1; (-) strand; PAM type: YTN; PAM sequence: TTT
ggccccacaaagtgctggga

SEQ ID NO: 196849 - DNA, 20 bp, Artificial Sequence
  Description of Artificial Sequence: Synthetic oligonucleotide
  Target: ATXN1; (-) strand; PAM type: YTN; PAM sequence: CTT
tggccccacaaagtgctggg

SEQ ID NO: 196850 - DNA, 20 bp, Artificial Sequence
  Description of Artificial Sequence: Synthetic oligonucleotide
  Target: ATXN1; (-) strand; PAM type: YTN; PAM sequence: CTC
tttggccccacaaagtgctg

SEQ ID NO: 196851 - DNA, 20 bp, Artificial Sequence
  Description of Artificial Sequence: Synthetic oligonucleotide
  Target: ATXN1; (-) strand; PAM type: YTN; PAM sequence: CTC
aagtgatccaccctctttgg

SEQ ID NO: 196852 - DNA, 20 bp, Artificial Sequence
  Description of Artificial Sequence: Synthetic oligonucleotide
  Target: ATXN1; (-) strand; PAM type: YTN; PAM sequence: CTG
ggctcaagtgatccaccctc

SEQ ID NO: 196853 - DNA, 20 bp, Artificial Sequence
  Description of Artificial Sequence: Synthetic oligonucleotide
  Target: ATXN1; (-) strand; PAM type: YTN; PAM sequence: TTC
tgggctcaagtgatccaccc

SEQ ID NO: 196854 - DNA, 20 bp, Artificial Sequence
  Description of Artificial Sequence: Synthetic oligonucleotide
  Target: ATXN1; (-) strand; PAM type: YTN; PAM sequence: CTT
ctgggctcaagtgatccacc

SEQ ID NO: 196855 - DNA, 20 bp, Artificial Sequence
  Description of Artificial Sequence: Synthetic oligonucleotide
  Target: ATXN1; (-) strand; PAM type: YTN; PAM sequence: CTG
gtgtcaaacttctgggctca

SEQ ID NO: 196856 - DNA, 20 bp, Artificial Sequence
  Description of Artificial Sequence: Synthetic oligonucleotide
  Target: ATXN1; (-) strand; PAM type: YTN; PAM sequence: TTG
ccaggctggtgtcaaacttc

SEQ ID NO: 196857 - DNA, 20 bp, Artificial Sequence
  Description of Artificial Sequence: Synthetic oligonucleotide
  Target: ATXN1; (-) strand; PAM type: YTN; PAM sequence: TTT
gccaggctggtgtcaaactt

SEQ ID NO: 196858 - DNA, 20 bp, Artificial Sequence
  Description of Artificial Sequence: Synthetic oligonucleotide
  Target: ATXN1; (-) strand; PAM type: YTN; PAM sequence: TTT
tgccaggctggtgtcaaact

SEQ ID NO: 196859 - DNA, 20 bp, Artificial Sequence
  Description of Artificial Sequence: Synthetic oligonucleotide
  Target: ATXN1; (-) strand; PAM type: YTN; PAM sequence: TTG
gtagagtcagggttttgcca

SEQ ID NO: 196860 - DNA, 20 bp, Artificial Sequence
  Description of Artificial Sequence: Synthetic oligonucleotide
  Target: ATXN1; (-) strand; PAM type: YTN; PAM sequence: TTT
ggtagagtcagggttttgcc

SEQ ID NO: 196861 - DNA, 20 bp, Artificial Sequence
  Description of Artificial Sequence: Synthetic oligonucleotide
  Target: ATXN1; (-) strand; PAM type: YTN; PAM sequence: TTT
tggtagagtcagggttttgc

SEQ ID NO: 196862 - DNA, 20 bp, Artificial Sequence
  Description of Artificial Sequence: Synthetic oligonucleotide
  Target: ATXN1; (-) strand; PAM type: YTN; PAM sequence: TTT
ttggtagagtcagggttttg

SEQ ID NO: 196863 - DNA, 20 bp, Artificial Sequence
  Description of Artificial Sequence: Synthetic oligonucleotide
  Target: ATXN1; (-) strand; PAM type: YTN; PAM sequence: TTT
tttggtagagtcagggtttt

SEQ ID NO: 196864 - DNA, 20 bp, Artificial Sequence
  Description of Artificial Sequence: Synthetic oligonucleotide
  Target: ATXN1; (-) strand; PAM type: YTN; PAM sequence: TTT
ttttggtagagtcagggttt

SEQ ID NO: 196865 - DNA, 20 bp, Artificial Sequence
  Description of Artificial Sequence: Synthetic oligonucleotide
  Target: ATXN1; (-) strand; PAM type: YTN; PAM sequence: TTT
tttttggtagagtcagggtt

SEQ ID NO: 196866 - DNA, 20 bp, Artificial Sequence
  Description of Artificial Sequence: Synthetic oligonucleotide
  Target: ATXN1; (-) strand; PAM type: YTN; PAM sequence: TTT
ttttttggtagagtcagggt

SEQ ID NO: 196867 - DNA, 20 bp, Artificial Sequence
  Description of Artificial Sequence: Synthetic oligonucleotide
  Target: ATXN1; (-) strand; PAM type: YTN; PAM sequence: TTG
gtttttttttggtagagtca

SEQ ID NO: 196868 - DNA, 20 bp, Artificial Sequence
  Description of Artificial Sequence: Synthetic oligonucleotide
  Target: ATXN1; (-) strand; PAM type: YTN; PAM sequence: TTT
ggtttttttttggtagagtc

SEQ ID NO: 196869 - DNA, 20 bp, Artificial Sequence
  Description of Artificial Sequence: Synthetic oligonucleotide
  Target: ATXN1; (-) strand; PAM type: YTN; PAM sequence: TTT
tggtttttttttggtagagt

SEQ ID NO: 196870 - DNA, 20 bp, Artificial Sequence
  Description of Artificial Sequence: Synthetic oligonucleotide
  Target: ATXN1; (-) strand; PAM type: YTN; PAM sequence: TTT
ttggtttttttttggtagag

SEQ ID NO: 196871 - DNA, 20 bp, Artificial Sequence
  Description of Artificial Sequence: Synthetic oligonucleotide
  Target: ATXN1; (-) strand; PAM type: YTN; PAM sequence: TTG
gtttttggtttttttttggt

SEQ ID NO: 196872 - DNA, 20 bp, Artificial Sequence
  Description of Artificial Sequence: Synthetic oligonucleotide
  Target: ATXN1; (-) strand; PAM type: YTN; PAM sequence: TTT
ggtttttggtttttttttgg

SEQ ID NO: 196873 - DNA, 20 bp, Artificial Sequence
  Description of Artificial Sequence: Synthetic oligonucleotide
  Target: ATXN1; (-) strand; PAM type: YTN; PAM sequence: TTT
tggtttttggtttttttttg

SEQ ID NO: 196874 - DNA, 20 bp, Artificial Sequence
  Description of Artificial Sequence: Synthetic oligonucleotide
  Target: ATXN1; (-) strand; PAM type: YTN; PAM sequence: TTT
ttggtttttggttttttttt

SEQ ID NO: 196875 - DNA, 20 bp, Artificial Sequence
  Description of Artificial Sequence: Synthetic oligonucleotide
  Target: ATXN1; (-) strand; PAM type: YTN; PAM sequence: TTG
gtttttggtttttggttttt

SEQ ID NO: 196876 - DNA, 20 bp, Artificial Sequence
  Description of Artificial Sequence: Synthetic oligonucleotide
  Target: ATXN1; (-) strand; PAM type: YTN; PAM sequence: TTT
ggtttttggtttttggtttt

SEQ ID NO: 196877 - DNA, 20 bp, Artificial Sequence
  Description of Artificial Sequence: Synthetic oligonucleotide
  Target: ATXN1; (-) strand; PAM type: YTN; PAM sequence: CTA
atttggtttttggtttttgg

SEQ ID NO: 196878 - DNA, 20 bp, Artificial Sequence
  Description of Artificial Sequence: Synthetic oligonucleotide
  Target: ATXN1; (-) strand; PAM type: YTN; PAM sequence: CTA
ccacatccagctaatttggt

SEQ ID NO: 196879 - DNA, 20 bp, Artificial Sequence
  Description of Artificial Sequence: Synthetic oligonucleotide
  Target: ATXN1; (-) strand; PAM type: YTN; PAM sequence: CTA
caggcataggctaccacatc

SEQ ID NO: 196880 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcataggctac

SEQ ID NO: 196881 - DNA, 20 bp, Artificial Sequence
  Description of Artificial Sequence: Synthetic oligonucleotide
  Target: ATXN1; (-) strand; PAM type: YTN; PAM sequence: CTG
agtagctgggactacaggca

SEQ ID NO: 196882 - DNA, 20 bp, Artificial Sequence
  Description of Artificial Sequence: Synthetic oligonucleotide
  Target: ATXN1; (-) strand; PAM type: YTN; PAM sequence: TTA
gccccctgagtagctgggac

SEQ ID NO: 196883 - DNA, 20 bp, Artificial Sequence
  Description of Artificial Sequence: Synthetic oligonucleotide
  Target: ATXN1; (-) strand; PAM type: YTN; PAM sequence: CTT
agccccctgagtagctggga

SEQ ID NO: 196884 - DNA, 20 bp, Artificial Sequence
  Description of Artificial Sequence: Synthetic oligonucleotide
  Target: ATXN1; (-) strand; PAM type: YTN; PAM sequence: CTC
ccatcttagccccctgagta

SEQ ID NO: 196885 - DNA, 20 bp, Artificial Sequence
  Description of Artificial Sequence: Synthetic oligonucleotide
  Target: ATXN1; (-) strand; PAM type: YTN; PAM sequence: TTA
agcaatcctcccatcttagc

SEQ ID NO: 196886 - DNA, 20 bp, Artificial Sequence
  Description of Artificial Sequence: Synthetic oligonucleotide
  Target: ATXN1; (-) strand; PAM type: YTN; PAM sequence: CTT
aagcaatcctcccatcttag

SEQ ID NO: 196887 - DNA, 20 bp, Artificial Sequence
  Description of Artificial Sequence: Synthetic oligonucleotide
  Target: ATXN1; (-) strand; PAM type: YTN; PAM sequence: TTC
ggggcttaagcaatcctccc

SEQ ID NO: 196888 - DNA, 20 bp, Artificial Sequence
  Description of Artificial Sequence: Synthetic oligonucleotide
  Target: ATXN1; (-) strand; PAM type: YTN; PAM sequence: CTT
cggggcttaagcaatcctcc

SEQ ID NO: 196889 - DNA, 20 bp, Artificial Sequence
  Description of Artificial Sequence: Synthetic oligonucleotide
  Target: ATXN1; (-) strand; PAM type: YTN; PAM sequence: CTG
gaccttcggggcttaagcaa

SEQ ID NO: 196890 - DNA, 20 bp, Artificial Sequence
  Description of Artificial Sequence: Synthetic oligonucleotide
  Target: ATXN1; (-) strand; PAM type: YTN; PAM sequence: CTG
cagactggaccttcggggct

SEQ ID NO: 196891 - DNA, 20 bp, Artificial Sequence
  Description of Artificial Sequence: Synthetic oligonucleotide
  Target: ATXN1; (-) strand; PAM type: YTN; PAM sequence: CTC
actgcagactggaccttcgg

SEQ ID NO: 196892 - DNA, 20 bp, Artificial Sequence
  Description of Artificial Sequence: Synthetic oligonucleotide
  Target: ATXN1; (-) strand; PAM type: YTN; PAM sequence: CTC
agctcactgcagactggacc

SEQ ID NO: 196893 - DNA, 20 bp, Artificial Sequence
  Description of Artificial Sequence: Synthetic oligonucleotide
  Target: ATXN1; (-) strand; PAM type: YTN; PAM sequence: TTG
gagtgcagtggtacgatctc

SEQ ID NO: 196894 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggttggagtgcag

SEQ ID NO: 196895 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggttggagtgc

SEQ ID NO: 196896 - DNA, 20 bp, Artificial Sequence
  Description of Artificial Sequence: Synthetic oligonucleotide
  Target: ATXN1; (-) strand; PAM type: YTN; PAM sequence: CTC
actctgtcgcccaggttgga

SEQ ID NO: 196897 - DNA, 20 bp, Artificial Sequence
  Description of Artificial Sequence: Synthetic oligonucleotide
  Target: ATXN1; (-) strand; PAM type: YTN; PAM sequence: TTG
agacagggtctcactctgtc

SEQ ID NO: 196898 - DNA, 20 bp, Artificial Sequence
  Description of Artificial Sequence: Synthetic oligonucleotide
  Target: ATXN1; (-) strand; PAM type: YTN; PAM sequence: TTG
ttgagacagggtctcactct

SEQ ID NO: 196899 - DNA, 20 bp, Artificial Sequence
  Description of Artificial Sequence: Synthetic oligonucleotide
  Target: ATXN1; (-) strand; PAM type: YTN; PAM sequence: TTA
ttgttgagacagggtctcac

SEQ ID NO: 196900 - DNA, 20 bp, Artificial Sequence
  Description of Artificial Sequence: Synthetic oligonucleotide
  Target: ATXN1; (-) strand; PAM type: YTN; PAM sequence: TTA
ttattgttgagacagggtct

SEQ ID NO: 196901 - DNA, 20 bp, Artificial Sequence
  Description of Artificial Sequence: Synthetic oligonucleotide
  Target: ATXN1; (-) strand; PAM type: YTN; PAM sequence: TTA
ttattattgttgagacaggg

SEQ ID NO: 196902 - DNA, 20 bp, Artificial Sequence
  Description of Artificial Sequence: Synthetic oligonucleotide
  Target: ATXN1; (-) strand; PAM type: YTN; PAM sequence: TTA
ttattattattgttgagaca

SEQ ID NO: 196903 - DNA, 20 bp, Artificial Sequence
  Description of Artificial Sequence: Synthetic oligonucleotide
  Target: ATXN1; (-) strand; PAM type: YTN; PAM sequence: CTA
ttattattattattgttgag

SEQ ID NO: 196904 - DNA, 20 bp, Artificial Sequence
  Description of Artificial Sequence: Synthetic oligonucleotide
  Target: ATXN1; (-) strand; PAM type: YTN; PAM sequence: TTA
ctattattattattattgtt

SEQ ID NO: 196905 - DNA, 20 bp, Artificial Sequence
  Description of Artificial Sequence: Synthetic oligonucleotide
  Target: ATXN1; (-) strand; PAM type: YTN; PAM sequence: TTA
ttactattattattattatt

SEQ ID NO: 196906 - DNA, 20 bp, Artificial Sequence
  Description of Artificial Sequence: Synthetic oligonucleotide
  Target: ATXN1; (-) strand; PAM type: YTN; PAM sequence: TTA
ttattactattattattatt

SEQ ID NO: 196907 - DNA, 20 bp, Artificial Sequence
  Description of Artificial Sequence: Synthetic oligonucleotide
  Target: ATXN1; (-) strand; PAM type: YTN; PAM sequence: TTT
attattactattattattat

SEQ ID NO: 196908 - DNA, 20 bp, Artificial Sequence
  Description of Artificial Sequence: Synthetic oligonucleotide
  Target: ATXN1; (-) strand; PAM type: YTN; PAM sequence: TTT
tattattactattattatta

SEQ ID NO: 196909 - DNA, 20 bp, Artificial Sequence
  Description of Artificial Sequence: Synthetic oligonucleotide
  Target: ATXN1; (-) strand; PAM type: YTN; PAM sequence: TTA
ttttattattactattatta

SEQ ID NO: 196910 - DNA, 20 bp, Artificial Sequence
  Description of Artificial Sequence: Synthetic oligonucleotide
  Target: ATXN1; (-) strand; PAM type: YTN; PAM sequence: TTT
attttattattactattatt

SEQ ID NO: 196911 - DNA, 20 bp, Artificial Sequence
  Description of Artificial Sequence: Synthetic oligonucleotide
  Target: ATXN1; (-) strand; PAM type: YTN; PAM sequence: TTT
tattttattattactattat

SEQ ID NO: 196912 - DNA, 20 bp, Artificial Sequence
  Description of Artificial Sequence: Synthetic oligonucleotide
  Target: ATXN1; (-) strand; PAM type: YTN; PAM sequence: TTA
ttttattttattattactat

SEQ ID NO: 196913 - DNA, 20 bp, Artificial Sequence
  Description of Artificial Sequence: Synthetic oligonucleotide
  Target: ATXN1; (-) strand; PAM type: YTN; PAM sequence: TTT
attttattttattattacta

SEQ ID NO: 196914 - DNA, 20 bp, Artificial Sequence
  Description of Artificial Sequence: Synthetic oligonucleotide
  Target: ATXN1; (-) strand; PAM type: YTN; PAM sequence: TTT
tattttattttattattact

SEQ ID NO: 196915 - DNA, 20 bp, Artificial Sequence
  Description of Artificial Sequence: Synthetic oligonucleotide
  Target: ATXN1; (-) strand; PAM type: YTN; PAM sequence: TTA
ggtaaattttattttatttt

SEQ ID NO: 196916 - DNA, 20 bp, Artificial Sequence
  Description of Artificial Sequence: Synthetic oligonucleotide
  Target: ATXN1; (-) strand; PAM type: YTN; PAM sequence: TTT
aggtaaattttattttattt

SEQ ID NO: 196917 - DNA, 20 bp, Artificial Sequence
  Description of Artificial Sequence: Synthetic oligonucleotide
  Target: ATXN1; (-) strand; PAM type: YTN; PAM sequence: TTT
taggtaaattttattttatt

SEQ ID NO: 196918 - DNA, 20 bp, Artificial Sequence
  Description of Artificial Sequence: Synthetic oligonucleotide
  Target: ATXN1; (-) strand; PAM type: YTN; PAM sequence: CTT
ttaggtaaattttattttat

SEQ ID NO: 196919 - DNA, 20 bp, Artificial Sequence
  Description of Artificial Sequence: Synthetic oligonucleotide
  Target: ATXN1; (-) strand; PAM type: YTN; PAM sequence: TTG
cttttaggtaaattttattt

SEQ ID NO: 196920 - DNA, 20 bp, Artificial Sequence
  Description of Artificial Sequence: Synthetic oligonucleotide
  Target: ATXN1; (-) strand; PAM type: YTN; PAM sequence: CTT
gcttttaggtaaattttatt

SEQ ID NO: 196921 - DNA, 20 bp, Artificial Sequence
  Description of Artificial Sequence: Synthetic oligonucleotide
  Target: ATXN1; (-) strand; PAM type: YTN; PAM sequence: TTC
ttgcttttaggtaaatttta

SEQ ID NO: 196922 - DNA, 20 bp, Artificial Sequence
  Description of Artificial Sequence: Synthetic oligonucleotide
  Target: ATXN1; (-) strand; PAM type: YTN; PAM sequence: TTA
gttcttgcttttaggtaaat

SEQ ID NO: 196923 - DNA, 20 bp, Artificial Sequence
  Description of Artificial Sequence: Synthetic oligonucleotide
  Target: ATXN1; (-) strand; PAM type: YTN; PAM sequence: TTT
agttcttgcttttaggtaaa

SEQ ID NO: 196924 - DNA, 20 bp, Artificial Sequence
  Description of Artificial Sequence: Synthetic oligonucleotide
  Target: ATXN1; (-) strand; PAM type: YTN; PAM sequence: CTT
tagttcttgcttttaggtaa

SEQ ID NO: 196925 - DNA, 20 bp, Artificial Sequence
  Description of Artificial Sequence: Synthetic oligonucleotide
  Target: ATXN1; (-) strand; PAM type: YTN; PAM sequence: TTG
gctttagttcttgcttttag

SEQ ID NO: 196926 - DNA, 20 bp, Artificial Sequence
  Description of Artificial Sequence: Synthetic oligonucleotide
  Target: ATXN1; (-) strand; PAM type: YTN; PAM sequence: CTC
aatcaaaataaaatattggc

SEQ ID NO: 196927 - DNA, 20 bp, Artificial Sequence
  Description of Artificial Sequence: Synthetic oligonucleotide
  Target: ATXN1; (-) strand; PAM type: YTN; PAM sequence: TTA
ctcaatcaaaataaaatatt

SEQ ID NO: 196928 - DNA, 20 bp, Artificial Sequence
  Description of Artificial Sequence: Synthetic oligonucleotide
  Target: ATXN1; (-) strand; PAM type: YTN; PAM sequence: TTG
tgtatcattactcaatcaaa

SEQ ID NO: 196929 - DNA, 20 bp, Artificial Sequence
  Description of Artificial Sequence: Synthetic oligonucleotide
  Target: ATXN1; (-) strand; PAM type: YTN; PAM sequence: TTA
ttgtgtatcattactcaatc

SEQ ID NO: 196930 - DNA, 20 bp, Artificial Sequence
  Description of Artificial Sequence: Synthetic oligonucleotide
  Target: ATXN1; (-) strand; PAM type: YTN; PAM sequence: CTA
gttattgtgtatcattactc

SEQ ID NO: 196931 - DNA, 20 bp, Artificial Sequence
  Description of Artificial Sequence: Synthetic oligonucleotide
  Target: ATXN1; (-) strand; PAM type: YTN; PAM sequence: TTC
aagactagttattgtgtatc

SEQ ID NO: 196932 - DNA, 20 bp, Artificial Sequence
  Description of Artificial Sequence: Synthetic oligonucleotide
  Target: ATXN1; (-) strand; PAM type: YTN; PAM sequence: CTT
caagactagttattgtgtat

SEQ ID NO: 196933 - DNA, 20 bp, Artificial Sequence
  Description of Artificial Sequence: Synthetic oligonucleotide
  Target: ATXN1; (-) strand; PAM type: YTN; PAM sequence: TTG
atgcccttcaagactagtta

SEQ ID NO: 196934 - DNA, 20 bp, Artificial Sequence
  Description of Artificial Sequence: Synthetic oligonucleotide
  Target: ATXN1; (-) strand; PAM type: YTN; PAM sequence: TTA
gttgatgcccttcaagacta

SEQ ID NO: 196935 - DNA, 20 bp, Artificial Sequence
  Description of Artificial Sequence: Synthetic oligonucleotide
  Target: ATXN1; (-) strand; PAM type: YTN; PAM sequence: TTT
agttgatgcccttcaagact

SEQ ID NO: 196936 - DNA, 20 bp, Artificial Sequence
  Description of Artificial Sequence: Synthetic oligonucleotide
  Target: ATXN1; (-) strand; PAM type: YTN; PAM sequence: TTT
tagttgatgcccttcaagac

SEQ ID NO: 196937 - DNA, 20 bp, Artificial Sequence
  Description of Artificial Sequence: Synthetic oligonucleotide
  Target: ATXN1; (-) strand; PAM type: YTN; PAM sequence: CTG
cagtccatcatgttttagtt

SEQ ID NO: 196938 - DNA, 20 bp, Artificial Sequence
  Description of Artificial Sequence: Synthetic oligonucleotide
  Target: ATXN1; (-) strand; PAM type: YTN; PAM sequence: CTG
tccatcctgcagtccatcat

SEQ ID NO: 196939 - DNA, 20 bp, Artificial Sequence
  Description of Artificial Sequence: Synthetic oligonucleotide
  Target: ATXN1; (-) strand; PAM type: YTN; PAM sequence: TTG
tcaggtatcaagccatctgt

SEQ ID NO: 196940 - DNA, 20 bp, Artificial Sequence
  Description of Artificial Sequence: Synthetic oligonucleotide
  Target: ATXN1; (-) strand; PAM type: YTN; PAM sequence: TTT
gtcaggtatcaagccatctg

SEQ ID NO: 196941 - DNA, 20 bp, Artificial Sequence
  Description of Artificial Sequence: Synthetic oligonucleotide
  Target: ATXN1; (-) strand; PAM type: YTN; PAM sequence: CTT
tgtcaggtatcaagccatct

SEQ ID NO: 196942 - DNA, 20 bp, Artificial Sequence
  Description of Artificial Sequence: Synthetic oligonucleotide
  Target: ATXN1; (-) strand; PAM type: YTN; PAM sequence: TTG
ctttgtcaggtatcaagcca

SEQ ID NO: 196943 - DNA, 20 bp, Artificial Sequence
  Description of Artificial Sequence: Synthetic oligonucleotide
  Target: ATXN1; (-) strand; PAM type: YTN; PAM sequence: TTT
gctttgtcaggtatcaagcc

SEQ ID NO: 196944 - DNA, 20 bp, Artificial Sequence
  Description of Artificial Sequence: Synthetic oligonucleotide
  Target: ATXN1; (-) strand; PAM type: YTN; PAM sequence: CTA
tatttgctttgtcaggtatc

SEQ ID NO: 196945 - DNA, 20 bp, Artificial Sequence
  Description of Artificial Sequence: Synthetic oligonucleotide
  Target: ATXN1; (-) strand; PAM type: YTN; PAM sequence: TTG
ctatatttgctttgtcaggt

SEQ ID NO: 196946 - DNA, 20 bp, Artificial Sequence
  Description of Artificial Sequence: Synthetic oligonucleotide
  Target: ATXN1; (-) strand; PAM type: YTN; PAM sequence: TTT
gctatatttgctttgtcagg

SEQ ID NO: 196947 - DNA, 20 bp, Artificial Sequence
  Description of Artificial Sequence: Synthetic oligonucleotide
  Target: ATXN1; (-) strand; PAM type: YTN; PAM sequence: TTT
tgctatatttgctttgtcag

SEQ ID NO: 196948 - DNA, 20 bp, Artificial Sequence
  Description of Artificial Sequence: Synthetic oligonucleotide
  Target: ATXN1; (-) strand; PAM type: YTN; PAM sequence: TTG
caaataatattttgctatat

SEQ ID NO: 196949 - DNA, 20 bp, Artificial Sequence
  Description of Artificial Sequence: Synthetic oligonucleotide
  Target: ATXN1; (-) strand; PAM type: YTN; PAM sequence: TTT
gcaaataatattttgctata

SEQ ID NO: 196950 - DNA, 20 bp, Artificial Sequence
  Description of Artificial Sequence: Synthetic oligonucleotide
  Target: ATXN1; (-) strand; PAM type: YTN; PAM sequence: TTT
tgcaaataatattttgctat

SEQ ID NO: 196951 - DNA, 20 bp, Artificial Sequence
  Description of Artificial Sequence: Synthetic oligonucleotide
  Target: ATXN1; (-) strand; PAM type: YTN; PAM sequence: CTA
gattttgcaaataatatttt

SEQ ID NO: 196952 - DNA, 20 bp, Artificial Sequence
  Description of Artificial Sequence: Synthetic oligonucleotide
  Target: ATXN1; (-) strand; PAM type: YTN; PAM sequence: TTG
ccacctagattttgcaaata

SEQ ID NO: 196953 - DNA, 20 bp, Artificial Sequence
  Description of Artificial Sequence: Synthetic oligonucleotide
  Target: ATXN1; (-) strand; PAM type: YTN; PAM sequence: CTT
gccacctagattttgcaaat

SEQ ID NO: 196954 - DNA, 20 bp, Artificial Sequence
  Description of Artificial Sequence: Synthetic oligonucleotide
  Target: ATXN1; (-) strand; PAM type: YTN; PAM sequence: TTG
tacagtgaacacccataaac

SEQ ID NO: 196955 - DNA, 20 bp, Artificial Sequence
  Description of Artificial Sequence: Synthetic oligonucleotide
  Target: ATXN1; (-) strand; PAM type: YTN; PAM sequence: TTG
taagaattgtacagtgaaca

SEQ ID NO: 196956 - DNA, 20 bp, Artificial Sequence
  Description of Artificial Sequence: Synthetic oligonucleotide
  Target: ATXN1; (-) strand; PAM type: YTN; PAM sequence: TTG
caaacatacaagtaaattgt

SEQ ID NO: 196957 - DNA, 20 bp, Artificial Sequence
  Description of Artificial Sequence: Synthetic oligonucleotide
  Target: ATXN1; (-) strand; PAM type: YTN; PAM sequence: TTA
ggaaaaattgcaaacataca

SEQ ID NO: 196958 - DNA, 20 bp, Artificial Sequence
  Description of Artificial Sequence: Synthetic oligonucleotide
  Target: ATXN1; (-) strand; PAM type: YTN; PAM sequence: TTA
ttaggaaaaattgcaaacat

SEQ ID NO: 196959 - DNA, 20 bp, Artificial Sequence
  Description of Artificial Sequence: Synthetic oligonucleotide
  Target: ATXN1; (-) strand; PAM type: YTN; PAM sequence: TTT
attaggaaaaattgcaaaca

SEQ ID NO: 196960 - DNA, 20 bp, Artificial Sequence
  Description of Artificial Sequence: Synthetic oligonucleotide
  Target: ATXN1; (-) strand; PAM type: YTN; PAM sequence: TTT
tattaggaaaaattgcaaac

SEQ ID NO: 196961 - DNA, 20 bp, Artificial Sequence
  Description of Artificial Sequence: Synthetic oligonucleotide
  Target: ATXN1; (-) strand; PAM type: YTN; PAM sequence: TTC
cccccaacattttattagga

SEQ ID NO: 196962 - DNA, 20 bp, Artificial Sequence
  Description of Artificial Sequence: Synthetic oligonucleotide
  Target: ATXN1; (-) strand; PAM type: YTN; PAM sequence: TTT
ccccccaacattttattagg

SEQ ID NO: 196963 - DNA, 20 bp, Artificial Sequence
  Description of Artificial Sequence: Synthetic oligonucleotide
  Target: ATXN1; (-) strand; PAM type: YTN; PAM sequence: CTT
tccccccaacattttattag

SEQ ID NO: 196964 - DNA, 20 bp, Artificial Sequence
  Description of Artificial Sequence: Synthetic oligonucleotide
  Target: ATXN1; (-) strand; PAM type: YTN; PAM sequence: TTC
acgagagactttccccccaa

SEQ ID NO: 196965 - DNA, 20 bp, Artificial Sequence
  Description of Artificial Sequence: Synthetic oligonucleotide
  Target: ATXN1; (-) strand; PAM type: YTN; PAM sequence: TTG
ttcacgagagactttccccc

SEQ ID NO: 196966 - DNA, 20 bp, Artificial Sequence
  Description of Artificial Sequence: Synthetic oligonucleotide
  Target: ATXN1; (-) strand; PAM type: YTN; PAM sequence: CTG
ggcagagttgttcacgagag

SEQ ID NO: 196967 - DNA, 20 bp, Artificial Sequence
  Description of Artificial Sequence: Synthetic oligonucleotide
  Target: ATXN1; (-) strand; PAM type: YTN; PAM sequence: CTA
tgactgggcagagttgttca

SEQ ID NO: 196968 - DNA, 20 bp, Artificial Sequence
  Description of Artificial Sequence: Synthetic oligonucleotide
  Target: ATXN1; (-) strand; PAM type: YTN; PAM sequence: TTC
tatgactgggcagagttgtt

SEQ ID NO: 196969 - DNA, 20 bp, Artificial Sequence
  Description of Artificial Sequence: Synthetic oligonucleotide
  Target: ATXN1; (-) strand; PAM type: YTN; PAM sequence: CTT
ctatgactgggcagagttgt

SEQ ID NO: 196970 - DNA, 20 bp, Artificial Sequence
  Description of Artificial Sequence: Synthetic oligonucleotide
  Target: ATXN1; (-) strand; PAM type: YTN; PAM sequence: CTC
ttctatgactgggcagagtt

SEQ ID NO: 196971 - DNA, 20 bp, Artificial Sequence
  Description of Artificial Sequence: Synthetic oligonucleotide
  Target: ATXN1; (-) strand; PAM type: YTN; PAM sequence: CTG
ggaaactcttctatgactgg

SEQ ID NO: 196972 - DNA, 20 bp, Artificial Sequence
  Description of Artificial Sequence: Synthetic oligonucleotide
  Target: ATXN1; (-) strand; PAM type: YTN; PAM sequence: TTC
ctgggaaactcttctatgac

SEQ ID NO: 196973 - DNA, 20 bp, Artificial Sequence
  Description of Artificial Sequence: Synthetic oligonucleotide
  Target: ATXN1; (-) strand; PAM type: YTN; PAM sequence: TTT
cctgggaaactcttctatga

SEQ ID NO: 196974 - DNA, 20 bp, Artificial Sequence
  Description of Artificial Sequence: Synthetic oligonucleotide
  Target: ATXN1; (-) strand; PAM type: YTN; PAM sequence: CTT
tcctgggaaactcttctatg

SEQ ID NO: 196975 - DNA, 20 bp, Artificial Sequence
  Description of Artificial Sequence: Synthetic oligonucleotide
  Target: ATXN1; (-) strand; PAM type: YTN; PAM sequence: CTA
aataaatctttcctgggaaa

SEQ ID NO: 196976 - DNA, 20 bp, Artificial Sequence
  Description of Artificial Sequence: Synthetic oligonucleotide
  Target: ATXN1; (-) strand; PAM type: YTN; PAM sequence: TTG
ggctaaataaatctttcctg

SEQ ID NO: 196977 - DNA, 20 bp, Artificial Sequence
  Description of Artificial Sequence: Synthetic oligonucleotide
  Target: ATXN1; (-) strand; PAM type: YTN; PAM sequence: TTT
gggctaaataaatctttcct

SEQ ID NO: 196978 - DNA, 20 bp, Artificial Sequence
  Description of Artificial Sequence: Synthetic oligonucleotide
  Target: ATXN1; (-) strand; PAM type: YTN; PAM sequence: TTA
aatgagatgtcccccaaaag

SEQ ID NO: 196979 - DNA, 20 bp, Artificial Sequence
  Description of Artificial Sequence: Synthetic oligonucleotide
  Target: ATXN1; (-) strand; PAM type: YTN; PAM sequence: TTG
ttaaatgagatgtcccccaa

SEQ ID NO: 196980 - DNA, 20 bp, Artificial Sequence
  Description of Artificial Sequence: Synthetic oligonucleotide
  Target: ATXN1; (-) strand; PAM type: YTN; PAM sequence: TTT
gttaaatgagatgtccccca

SEQ ID NO: 196981 - DNA, 20 bp, Artificial Sequence
  Description of Artificial Sequence: Synthetic oligonucleotide
  Target: ATXN1; (-) strand; PAM type: YTN; PAM sequence: TTT
tgttaaatgagatgtccccc

SEQ ID NO: 196982 - DNA, 20 bp, Artificial Sequence
  Description of Artificial Sequence: Synthetic oligonucleotide
  Target: ATXN1; (-) strand; PAM type: YTN; PAM sequence: TTT
ttgttaaatgagatgtcccc

SEQ ID NO: 196983 - DNA, 20 bp, Artificial Sequence
  Description of Artificial Sequence: Synthetic oligonucleotide
  Target: ATXN1; (-) strand; PAM type: YTN; PAM sequence: CTA
atttttgttaaatgagatgt

SEQ ID NO: 196984 - DNA, 20 bp, Artificial Sequence
  Description of Artificial Sequence: Synthetic oligonucleotide
  Target: ATXN1; (-) strand; PAM type: YTN; PAM sequence: TTA
aaaggagaaatcagaagcct

SEQ ID NO: 196985 - DNA, 20 bp, Artificial Sequence
  Description of Artificial Sequence: Synthetic oligonucleotide
  Target: ATXN1; (-) strand; PAM type: YTN; PAM sequence: CTG
taaaagaggttaaaaggaga

SEQ ID NO: 196986 - DNA, 20 bp, Artificial Sequence
  Description of Artificial Sequence: Synthetic oligonucleotide
  Target: ATXN1; (-) strand; PAM type: YTN; PAM sequence: TTC
tgtaaaagaggttaaaagga

SEQ ID NO: 196987 - DNA, 20 bp, Artificial Sequence
  Description of Artificial Sequence: Synthetic oligonucleotide
  Target: ATXN1; (-) strand; PAM type: YTN; PAM sequence: TTT
ctgtaaaagaggttaaaagg

SEQ ID NO: 196988 - DNA, 20 bp, Artificial Sequence
  Description of Artificial Sequence: Synthetic oligonucleotide
  Target: ATXN1; (-) strand; PAM type: YTN; PAM sequence: TTT
tctgtaaaagaggttaaaag

SEQ ID NO: 196989 - DNA, 20 bp, Artificial Sequence
  Description of Artificial Sequence: Synthetic oligonucleotide
  Target: ATXN1; (-) strand; PAM type: YTN; PAM sequence: CTA
aggggggcagttttctgtaa

SEQ ID NO: 196990 - DNA, 20 bp, Artificial Sequence
  Description of Artificial Sequence: Synthetic oligonucleotide
  Target: ATXN1; (-) strand; PAM type: YTN; PAM sequence: CTG
ctaaggggggcagttttctg

SEQ ID NO: 196991 - DNA, 20 bp, Artificial Sequence
  Description of Artificial Sequence: Synthetic oligonucleotide
  Target: ATXN1; (-) strand; PAM type: YTN; PAM sequence: TTC
actgctaaggggggcagttt

SEQ ID NO: 196992 - DNA, 20 bp, Artificial Sequence
  Description of Artificial Sequence: Synthetic oligonucleotide
  Target: ATXN1; (-) strand; PAM type: YTN; PAM sequence: TTT
cactgctaaggggggcagtt

SEQ ID NO: 196993 - DNA, 20 bp, Artificial Sequence
  Description of Artificial Sequence: Synthetic oligonucleotide
  Target: ATXN1; (-) strand; PAM type: YTN; PAM sequence: CTT
tcactgctaaggggggcagt

SEQ ID NO: 196994 - DNA, 20 bp, Artificial Sequence
  Description of Artificial Sequence: Synthetic oligonucleotide
  Target: ATXN1; (-) strand; PAM type: YTN; PAM sequence: CTG
cctttcactgctaagggggg

SEQ ID NO: 196995 - DNA, 20 bp, Artificial Sequence
  Description of Artificial Sequence: Synthetic oligonucleotide
  Target: ATXN1; (-) strand; PAM type: YTN; PAM sequence: TTG
gcaaaagtgctgcctttcac

SEQ ID NO: 196996 - DNA, 20 bp, Artificial Sequence
  Description of Artificial Sequence: Synthetic oligonucleotide
  Target: ATXN1; (-) strand; PAM type: YTN; PAM sequence: TTG
caatagcacattggcaaaag

SEQ ID NO: 196997 - DNA, 20 bp, Artificial Sequence
  Description of Artificial Sequence: Synthetic oligonucleotide
  Target: ATXN1; (-) strand; PAM type: YTN; PAM sequence: TTG
cagtagcacattgcaatagc

SEQ ID NO: 196998 - DNA, 20 bp, Artificial Sequence
  Description of Artificial Sequence: Synthetic oligonucleotide
  Target: ATXN1; (-) strand; PAM type: YTN; PAM sequence: TTG
cacattgcagtagcacattg

SEQ ID NO: 196999 - DNA, 20 bp, Artificial Sequence
  Description of Artificial Sequence: Synthetic oligonucleotide
  Target: ATXN1; (-) strand; PAM type: YTN; PAM sequence: TTG
cattgcacattgcagtagca

SEQ ID NO: 197000 - DNA, 20 bp, Artificial Sequence
  Description of Artificial Sequence: Synthetic oligonucleotide
  Target: ATXN1; (-) strand; PAM type: YTN; PAM sequence: CTA
attgcattgcacattgcagt

SEQ ID NO: 197001 - DNA, 20 bp, Artificial Sequence
  Description of Artificial Sequence: Synthetic oligonucleotide
  Target: ATXN1; (-) strand; PAM type: YTN; PAM sequence: TTA
atagcctaattgcattgcac

SEQ ID NO: 197002 - DNA, 20 bp, Artificial Sequence
  Description of Artificial Sequence: Synthetic oligonucleotide
  Target: ATXN1; (-) strand; PAM type: YTN; PAM sequence: TTT
aatagcctaattgcattgca

SEQ ID NO: 197003 - DNA, 20 bp, Artificial Sequence
  Description of Artificial Sequence: Synthetic oligonucleotide
  Target: ATXN1; (-) strand; PAM type: YTN; PAM sequence: TTA
tttaatagcctaattgcatt

SEQ ID NO: 197004 - DNA, 20 bp, Artificial Sequence
  Description of Artificial Sequence: Synthetic oligonucleotide
  Target: ATXN1; (-) strand; PAM type: YTN; PAM sequence: CTA
ttatttaatagcctaattgc

SEQ ID NO: 197005 - DNA, 20 bp, Artificial Sequence
  Description of Artificial Sequence: Synthetic oligonucleotide
  Target: ATXN1; (-) strand; PAM type: YTN; PAM sequence: TTG
tctattatttaatagcctaa

SEQ ID NO: 197006 - DNA, 20 bp, Artificial Sequence
  Description of Artificial Sequence: Synthetic oligonucleotide
  Target: ATXN1; (-) strand; PAM type: YTN; PAM sequence: TTT
gtctattatttaatagccta

SEQ ID NO: 197007 - DNA, 20 bp, Artificial Sequence
  Description of Artificial Sequence: Synthetic oligonucleotide
  Target: ATXN1; (-) strand; PAM type: YTN; PAM sequence: TTT
tgtctattatttaatagcct

SEQ ID NO: 197008 - DNA, 20 bp, Artificial Sequence
  Description of Artificial Sequence: Synthetic oligonucleotide
  Target: ATXN1; (-) strand; PAM type: YTN; PAM sequence: CTT
ttgtctattatttaatagcc

SEQ ID NO: 197009 - DNA, 20 bp, Artificial Sequence
  Description of Artificial Sequence: Synthetic oligonucleotide
  Target: ATXN1; (-) strand; PAM type: YTN; PAM sequence: TTG
gccttttgtctattatttaa

SEQ ID NO: 197010 - DNA, 20 bp, Artificial Sequence
  Description of Artificial Sequence: Synthetic oligonucleotide
  Target: ATXN1; (-) strand; PAM type: YTN; PAM sequence: TTA
ataaacattggccttttgtc

SEQ ID NO: 197011 - DNA, 20 bp, Artificial Sequence
  Description of Artificial Sequence: Synthetic oligonucleotide
  Target: ATXN1; (-) strand; PAM type: YTN; PAM sequence: CTA
attaataaacattggccttt

SEQ ID NO: 197012 - DNA, 20 bp, Artificial Sequence
  Description of Artificial Sequence: Synthetic oligonucleotide
  Target: ATXN1; (-) strand; PAM type: YTN; PAM sequence: TTG
ctaattaataaacattggcc

SEQ ID NO: 197013 - DNA, 20 bp, Artificial Sequence
  Description of Artificial Sequence: Synthetic oligonucleotide
  Target: ATXN1; (-) strand; PAM type: YTN; PAM sequence: TTT
gctaattaataaacattggc

SEQ ID NO: 197014 - DNA, 20 bp, Artificial Sequence
  Description of Artificial Sequence: Synthetic oligonucleotide
  Target: ATXN1; (-) strand; PAM type: YTN; PAM sequence: TTT
tgctaattaataaacattgg

SEQ ID NO: 197015 - DNA, 20 bp, Artificial Sequence
  Description of Artificial Sequence: Synthetic oligonucleotide
  Target: ATXN1; (-) strand; PAM type: YTN; PAM sequence: TTT
ttgctaattaataaacattg

SEQ ID NO: 197016 - DNA, 20 bp, Artificial Sequence
  Description of Artificial Sequence: Synthetic oligonucleotide
  Target: ATXN1; (-) strand; PAM type: YTN; PAM sequence: CTT
tttgctaattaataaacatt

SEQ ID NO: 197017 - DNA, 20 bp, Artificial Sequence
  Description of Artificial Sequence: Synthetic oligonucleotide
  Target: ATXN1; (-) strand; PAM type: YTN; PAM sequence: CTA
tatggctttttgctaattaa

SEQ ID NO: 197018 - DNA, 20 bp, Artificial Sequence
  Description of Artificial Sequence: Synthetic oligonucleotide
  Target: ATXN1; (-) strand; PAM type: YTN; PAM sequence: CTC
atatcctatatggctttttg

SEQ ID NO: 197019 - DNA, 20 bp, Artificial Sequence
  Description of Artificial Sequence: Synthetic oligonucleotide
  Target: ATXN1; (-) strand; PAM type: YTN; PAM sequence: CTA
gagctcatatcctatatggc

SEQ ID NO: 197020 - DNA, 20 bp, Artificial Sequence
  Description of Artificial Sequence: Synthetic oligonucleotide
  Target: ATXN1; (-) strand; PAM type: YTN; PAM sequence: CTG
cagagtctagagctcatatc

SEQ ID NO: 197021 - DNA, 20 bp, Artificial Sequence
  Description of Artificial Sequence: Synthetic oligonucleotide
  Target: ATXN1; (-) strand; PAM type: YTN; PAM sequence: CTC
tgcagagtctagagctcata

SEQ ID NO: 197022 - DNA, 20 bp, Artificial Sequence
  Description of Artificial Sequence: Synthetic oligonucleotide
  Target: ATXN1; (-) strand; PAM type: YTN; PAM sequence: TTG
gagggtccatgtggaatata

SEQ ID NO: 197023 - DNA, 20 bp, Artificial Sequence
  Description of Artificial Sequence: Synthetic oligonucleotide
  Target: ATXN1; (-) strand; PAM type: YTN; PAM sequence: CTG
aaatccatccaagccacaaa

SEQ ID NO: 197024 - DNA, 20 bp, Artificial Sequence
  Description of Artificial Sequence: Synthetic oligonucleotide
  Target: ATXN1; (-) strand; PAM type: YTN; PAM sequence: TTG
accatgataagtaccagtgc

SEQ ID NO: 197025 - DNA, 20 bp, Artificial Sequence
  Description of Artificial Sequence: Synthetic oligonucleotide
  Target: ATXN1; (-) strand; PAM type: YTN; PAM sequence: TTT
gaccatgataagtaccagtg

SEQ ID NO: 197026 - DNA, 20 bp, Artificial Sequence
  Description of Artificial Sequence: Synthetic oligonucleotide
  Target: ATXN1; (-) strand; PAM type: YTN; PAM sequence: CTT
tgaccatgataagtaccagt

SEQ ID NO: 197027 - DNA, 20 bp, Artificial Sequence
  Description of Artificial Sequence: Synthetic oligonucleotide
  Target: ATXN1; (-) strand; PAM type: YTN; PAM sequence: CTA
gagcaataatgatgtatctt

SEQ ID NO: 197028 - DNA, 20 bp, Artificial Sequence
  Description of Artificial Sequence: Synthetic oligonucleotide
  Target: ATXN1; (-) strand; PAM type: YTN; PAM sequence: TTG
actagagcaataatgatgta

SEQ ID NO: 197029 - DNA, 20 bp, Artificial Sequence
  Description of Artificial Sequence: Synthetic oligonucleotide
  Target: ATXN1; (-) strand; PAM type: YTN; PAM sequence: TTA
atgaaaatgtgtattgacta

SEQ ID NO: 197030 - DNA, 20 bp, Artificial Sequence
  Description of Artificial Sequence: Synthetic oligonucleotide
  Target: ATXN1; (-) strand; PAM type: YTN; PAM sequence: TTT
aatgaaaatgtgtattgact

SEQ ID NO: 197031 - DNA, 20 bp, Artificial Sequence
  Description of Artificial Sequence: Synthetic oligonucleotide
  Target: ATXN1; (-) strand; PAM type: YTN; PAM sequence: CTA
tttaatgaaaatgtgtattg

SEQ ID NO: 197032 - DNA, 20 bp, Artificial Sequence
  Description of Artificial Sequence: Synthetic oligonucleotide
  Target: ATXN1; (-) strand; PAM type: YTN; PAM sequence: TTA
taaatgtgctatttaatgaa

SEQ ID NO: 197033 - DNA, 20 bp, Artificial Sequence
  Description of Artificial Sequence: Synthetic oligonucleotide
  Target: ATXN1; (-) strand; PAM type: YTN; PAM sequence: TTG
taaaataaatacatgtgtta

SEQ ID NO: 197034 - DNA, 20 bp, Artificial Sequence
  Description of Artificial Sequence: Synthetic oligonucleotide
  Target: ATXN1; (-) strand; PAM type: YTN; PAM sequence: TTA
tggaaattgtaaaataaata

SEQ ID NO: 197035 - DNA, 20 bp, Artificial Sequence
  Description of Artificial Sequence: Synthetic oligonucleotide
  Target: ATXN1; (-) strand; PAM type: YTN; PAM sequence: TTT
atggaaattgtaaaataaat

SEQ ID NO: 197036 - DNA, 20 bp, Artificial Sequence
  Description of Artificial Sequence: Synthetic oligonucleotide
  Target: ATXN1; (-) strand; PAM type: YTN; PAM sequence: TTG
aaggtagaatgagtaaataa

SEQ ID NO: 197037 - DNA, 20 bp, Artificial Sequence
  Description of Artificial Sequence: Synthetic oligonucleotide
  Target: ATXN1; (-) strand; PAM type: YTN; PAM sequence: CTA
aggccaagtaagagttgaag

SEQ ID NO: 197038 - DNA, 20 bp, Artificial Sequence
  Description of Artificial Sequence: Synthetic oligonucleotide
  Target: ATXN1; (-) strand; PAM type: YTN; PAM sequence: TTC
ctaaggccaagtaagagttg

SEQ ID NO: 197039 - DNA, 20 bp, Artificial Sequence
  Description of Artificial Sequence: Synthetic oligonucleotide
  Target: ATXN1; (-) strand; PAM type: YTN; PAM sequence: TTT
cctaaggccaagtaagagtt

SEQ ID NO: 197040 - DNA, 20 bp, Artificial Sequence
  Description of Artificial Sequence: Synthetic oligonucleotide
  Target: ATXN1; (-) strand; PAM type: YTN; PAM sequence: TTA
catttcctaaggccaagtaa

SEQ ID NO: 197041 - DNA, 20 bp, Artificial Sequence
  Description of Artificial Sequence: Synthetic oligonucleotide
  Target: ATXN1; (-) strand; PAM type: YTN; PAM sequence: TTT
acatttcctaaggccaagta

SEQ ID NO: 197042 - DNA, 20 bp, Artificial Sequence
  Description of Artificial Sequence: Synthetic oligonucleotide
  Target: ATXN1; (-) strand; PAM type: YTN; PAM sequence: TTT
tacatttcctaaggccaagt

SEQ ID NO: 197043 - DNA, 20 bp, Artificial Sequence
  Description of Artificial Sequence: Synthetic oligonucleotide
  Target: ATXN1; (-) strand; PAM type: YTN; PAM sequence: TTA
tcaaaaaaaaaaaaaagatt

SEQ ID NO: 197044 - DNA, 20 bp, Artificial Sequence
  Description of Artificial Sequence: Synthetic oligonucleotide
  Target: ATXN1; (-) strand; PAM type: YTN; PAM sequence: CTT
atcaaaaaaaaaaaaaagat

SEQ ID NO: 197045 - DNA, 20 bp, Artificial Sequence
  Description of Artificial Sequence: Synthetic oligonucleotide
  Target: ATXN1; (-) strand; PAM type: YTN; PAM sequence: CTC
ttatcaaaaaaaaaaaaaag

SEQ ID NO: 197046 - DNA, 20 bp, Artificial Sequence
  Description of Artificial Sequence: Synthetic oligonucleotide
  Target: ATXN1; (-) strand; PAM type: YTN; PAM sequence: TTC
aagaaaaacctcttatcaaa

SEQ ID NO: 197047 - DNA, 20 bp, Artificial Sequence
  Description of Artificial Sequence: Synthetic oligonucleotide
  Target: ATXN1; (-) strand; PAM type: YTN; PAM sequence: TTT
caagaaaaacctcttatcaa

SEQ ID NO: 197048 - DNA, 20 bp, Artificial Sequence
  Description of Artificial Sequence: Synthetic oligonucleotide
  Target: ATXN1; (-) strand; PAM type: YTN; PAM sequence: CTA
tttcaagaaaaacctcttat

SEQ ID NO: 197049 - DNA, 20 bp, Artificial Sequence
  Description of Artificial Sequence: Synthetic oligonucleotide
  Target: ATXN1; (-) strand; PAM type: YTN; PAM sequence: CTC
ctatttcaagaaaaacctct

SEQ ID NO: 197050 - DNA, 20 bp, Artificial Sequence
  Description of Artificial Sequence: Synthetic oligonucleotide
  Target: ATXN1; (-) strand; PAM type: YTN; PAM sequence: TTA
actcctatttcaagaaaaac

SEQ ID NO: 197051 - DNA, 20 bp, Artificial Sequence
  Description of Artificial Sequence: Synthetic oligonucleotide
  Target: ATXN1; (-) strand; PAM type: YTN; PAM sequence: TTA
attaactcctatttcaagaa

SEQ ID NO: 197052 - DNA, 20 bp, Artificial Sequence
  Description of Artificial Sequence: Synthetic oligonucleotide
  Target: ATXN1; (-) strand; PAM type: YTN; PAM sequence: TTT
aattaactcctatttcaaga

SEQ ID NO: 197053 - DNA, 20 bp, Artificial Sequence
  Description of Artificial Sequence: Synthetic oligonucleotide
  Target: ATXN1; (-) strand; PAM type: YTN; PAM sequence: TTT
taattaactcctatttcaag

SEQ ID NO: 197054 - DNA, 20 bp, Artificial Sequence
  Description of Artificial Sequence: Synthetic oligonucleotide
  Target: ATXN1; (-) strand; PAM type: YTN; PAM sequence: CTT
ttaattaactcctatttcaa

SEQ ID NO: 197055 - DNA, 20 bp, Artificial Sequence
  Description of Artificial Sequence: Synthetic oligonucleotide
  Target: ATXN1; (-) strand; PAM type: YTN; PAM sequence: TTA
aatcttttaattaactccta

SEQ ID NO: 197056 - DNA, 20 bp, Artificial Sequence
  Description of Artificial Sequence: Synthetic oligonucleotide
  Target: ATXN1; (-) strand; PAM type: YTN; PAM sequence: CTT
aaatcttttaattaactcct

SEQ ID NO: 197057 - DNA, 20 bp, Artificial Sequence
  Description of Artificial Sequence: Synthetic oligonucleotide
  Target: ATXN1; (-) strand; PAM type: YTN; PAM sequence: TTC
cttaaatcttttaattaact

SEQ ID NO: 197058 - DNA, 20 bp, Artificial Sequence
  Description of Artificial Sequence: Synthetic oligonucleotide
  Target: ATXN1; (-) strand; PAM type: YTN; PAM sequence: TTT
ccttaaatcttttaattaac

SEQ ID NO: 197059 - DNA, 20 bp, Artificial Sequence
  Description of Artificial Sequence: Synthetic oligonucleotide
  Target: ATXN1; (-) strand; PAM type: YTN; PAM sequence: TTT
tccttaaatcttttaattaa

SEQ ID NO: 197060 - DNA, 20 bp, Artificial Sequence
  Description of Artificial Sequence: Synthetic oligonucleotide
  Target: ATXN1; (-) strand; PAM type: YTN; PAM sequence: TTG
aatcacaagaggtacgtttt

SEQ ID NO: 197061 - DNA, 20 bp, Artificial Sequence
  Description of Artificial Sequence: Synthetic oligonucleotide
  Target: ATXN1; (-) strand; PAM type: YTN; PAM sequence: TTT
gaatcacaagaggtacgttt

SEQ ID NO: 197062 - DNA, 20 bp, Artificial Sequence
  Description of Artificial Sequence: Synthetic oligonucleotide
  Target: ATXN1; (-) strand; PAM type: YTN; PAM sequence: CTC
atgtttgaatcacaagaggt

SEQ ID NO: 197063 - DNA, 20 bp, Artificial Sequence
  Description of Artificial Sequence: Synthetic oligonucleotide
  Target: ATXN1; (-) strand; PAM type: YTN; PAM sequence: TTA
taaaagataataataatctc

SEQ ID NO: 197064 - DNA, 20 bp, Artificial Sequence
  Description of Artificial Sequence: Synthetic oligonucleotide
  Target: ATXN1; (-) strand; PAM type: YTN; PAM sequence: TTT
ataaaagataataataatct

SEQ ID NO: 197065 - DNA, 20 bp, Artificial Sequence
  Description of Artificial Sequence: Synthetic oligonucleotide
  Target: ATXN1; (-) strand; PAM type: YTN; PAM sequence: TTT
tataaaagataataataatc

SEQ ID NO: 197066 - DNA, 20 bp, Artificial Sequence
  Description of Artificial Sequence: Synthetic oligonucleotide
  Target: ATXN1; (-) strand; PAM type: YTN; PAM sequence: CTT
ttataaaagataataataat

SEQ ID NO: 197067 - DNA, 20 bp, Artificial Sequence
  Description of Artificial Sequence: Synthetic oligonucleotide
  Target: ATXN1; (-) strand; PAM type: YTN; PAM sequence: TTA
ccttttataaaagataataa

SEQ ID NO: 197068 - DNA, 20 bp, Artificial Sequence
  Description of Artificial Sequence: Synthetic oligonucleotide
  Target: ATXN1; (-) strand; PAM type: YTN; PAM sequence: TTT
accttttataaaagataata

SEQ ID NO: 197069 - DNA, 20 bp, Artificial Sequence
  Description of Artificial Sequence: Synthetic oligonucleotide
  Target: ATXN1; (-) strand; PAM type: YTN; PAM sequence: TTT
taccttttataaaagataat

SEQ ID NO: 197070 - DNA, 20 bp, Artificial Sequence
  Description of Artificial Sequence: Synthetic oligonucleotide
  Target: ATXN1; (-) strand; PAM type: YTN; PAM sequence: CTG
aaatagattttaccttttat

SEQ ID NO: 197071 - DNA, 20 bp, Artificial Sequence
  Description of Artificial Sequence: Synthetic oligonucleotide
  Target: ATXN1; (-) strand; PAM type: YTN; PAM sequence: CTC
tgaaatagattttacctttt

SEQ ID NO: 197072 - DNA, 20 bp, Artificial Sequence
  Description of Artificial Sequence: Synthetic oligonucleotide
  Target: ATXN1; (-) strand; PAM type: YTN; PAM sequence: TTA
aaatgctctgaaatagattt

SEQ ID NO: 197073 - DNA, 20 bp, Artificial Sequence
  Description of Artificial Sequence: Synthetic oligonucleotide
  Target: ATXN1; (-) strand; PAM type: YTN; PAM sequence: CTT
aaaatgctctgaaatagatt

SEQ ID NO: 197074 - DNA, 20 bp, Artificial Sequence
  Description of Artificial Sequence: Synthetic oligonucleotide
  Target: ATXN1; (-) strand; PAM type: YTN; PAM sequence: TTG
atgcacacttaaaatgctct

SEQ ID NO: 197075 - DNA, 20 bp, Artificial Sequence
  Description of Artificial Sequence: Synthetic oligonucleotide
  Target: ATXN1; (-) strand; PAM type: YTN; PAM sequence: TTC
agggacggttgatgcacact

SEQ ID NO: 197076 - DNA, 20 bp, Artificial Sequence
  Description of Artificial Sequence: Synthetic oligonucleotide
  Target: ATXN1; (-) strand; PAM type: YTN; PAM sequence: TTG
tcaagcatcggaattcaggg

SEQ ID NO: 197077 - DNA, 20 bp, Artificial Sequence
  Description of Artificial Sequence: Synthetic oligonucleotide
  Target: ATXN1; (-) strand; PAM type: YTN; PAM sequence: TTT
gtcaagcatcggaattcagg

SEQ ID NO: 197078 - DNA, 20 bp, Artificial Sequence
  Description of Artificial Sequence: Synthetic oligonucleotide
  Target: ATXN1; (-) strand; PAM type: YTN; PAM sequence: CTA
atgaatttgtcaagcatcgg

SEQ ID NO: 197079 - DNA, 20 bp, Artificial Sequence
  Description of Artificial Sequence: Synthetic oligonucleotide
  Target: ATXN1; (-) strand; PAM type: YTN; PAM sequence: TTG
ctaatgaatttgtcaagcat

SEQ ID NO: 197080 - DNA, 20 bp, Artificial Sequence
  Description of Artificial Sequence: Synthetic oligonucleotide
  Target: ATXN1; (-) strand; PAM type: YTN; PAM sequence: TTA
ttgctaatgaatttgtcaag

SEQ ID NO: 197081 - DNA, 20 bp, Artificial Sequence
  Description of Artificial Sequence: Synthetic oligonucleotide
  Target: ATXN1; (-) strand; PAM type: YTN; PAM sequence: TTG
ttattgctaatgaatttgtc

SEQ ID NO: 197082 - DNA, 20 bp, Artificial Sequence
  Description of Artificial Sequence: Synthetic oligonucleotide
  Target: ATXN1; (-) strand; PAM type: YTN; PAM sequence: TTT
gttattgctaatgaatttgt

SEQ ID NO: 197083 - DNA, 20 bp, Artificial Sequence
  Description of Artificial Sequence: Synthetic oligonucleotide
  Target: ATXN1; (-) strand; PAM type: YTN; PAM sequence: TTA
acatttgttattgctaatga

SEQ ID NO: 197084 - DNA, 20 bp, Artificial Sequence
  Description of Artificial Sequence: Synthetic oligonucleotide
  Target: ATXN1; (-) strand; PAM type: YTN; PAM sequence: TTT
aacatttgttattgctaatg

SEQ ID NO: 197085 - DNA, 20 bp, Artificial Sequence
  Description of Artificial Sequence: Synthetic oligonucleotide
  Target: ATXN1; (-) strand; PAM type: YTN; PAM sequence: CTA
gacaggtttaacatttgtta

SEQ ID NO: 197086 - DNA, 20 bp, Artificial Sequence
  Description of Artificial Sequence: Synthetic oligonucleotide
  Target: ATXN1; (-) strand; PAM type: YTN; PAM sequence: CTC
tagacaggtttaacatttgt

SEQ ID NO: 197087 - DNA, 20 bp, Artificial Sequence
  Description of Artificial Sequence: Synthetic oligonucleotide
  Target: ATXN1; (-) strand; PAM type: YTN; PAM sequence: CTG
cgtagaatagcaaggaaata

SEQ ID NO: 197088 - DNA, 20 bp, Artificial Sequence
  Description of Artificial Sequence: Synthetic oligonucleotide
  Target: ATXN1; (-) strand; PAM type: YTN; PAM sequence: TTG
ctgcgtagaatagcaaggaa

SEQ ID NO: 197089 - DNA, 20 bp, Artificial Sequence
  Description of Artificial Sequence: Synthetic oligonucleotide
  Target: ATXN1; (-) strand; PAM type: YTN; PAM sequence: TTT
gctgcgtagaatagcaagga

SEQ ID NO: 197090 - DNA, 20 bp, Artificial Sequence
  Description of Artificial Sequence: Synthetic oligonucleotide
  Target: ATXN1; (-) strand; PAM type: YTN; PAM sequence: TTG
atttgctgcgtagaatagca

SEQ ID NO: 197091 - DNA, 20 bp, Artificial Sequence
  Description of Artificial Sequence: Synthetic oligonucleotide
  Target: ATXN1; (-) strand; PAM type: YTN; PAM sequence: TTG
gcgaggccattgatttgctg

SEQ ID NO: 197092 - DNA, 20 bp, Artificial Sequence
  Description of Artificial Sequence: Synthetic oligonucleotide
  Target: ATXN1; (-) strand; PAM type: YTN; PAM sequence: CTG
tggcggttggcgaggccatt

SEQ ID NO: 197093 - DNA, 20 bp, Artificial Sequence
  Description of Artificial Sequence: Synthetic oligonucleotide
  Target: ATXN1; (-) strand; PAM type: YTN; PAM sequence: TTA
tcctgtggcggttggcgagg

SEQ ID NO: 197094 - DNA, 20 bp, Artificial Sequence
  Description of Artificial Sequence: Synthetic oligonucleotide
  Target: ATXN1; (-) strand; PAM type: YTN; PAM sequence: TTT
atcctgtggcggttggcgag

SEQ ID NO: 197095 - DNA, 20 bp, Artificial Sequence
  Description of Artificial Sequence: Synthetic oligonucleotide
  Target: ATXN1; (-) strand; PAM type: YTN; PAM sequence: TTT
tatcctgtggcggttggcga

SEQ ID NO: 197096 - DNA, 20 bp, Artificial Sequence
  Description of Artificial Sequence: Synthetic oligonucleotide
  Target: ATXN1; (-) strand; PAM type: YTN; PAM sequence: CTT
ttatcctgtggcggttggcg

SEQ ID NO: 197097 - DNA, 20 bp, Artificial Sequence
  Description of Artificial Sequence: Synthetic oligonucleotide
  Target: ATXN1; (-) strand; PAM type: YTN; PAM sequence: TTG
gcagaatacacacactttta

SEQ ID NO: 197098 - DNA, 20 bp, Artificial Sequence
  Description of Artificial Sequence: Synthetic oligonucleotide
  Target: ATXN1; (-) strand; PAM type: YTN; PAM sequence: CTG
tcggtggcatcacgttggca

SEQ ID NO: 197099 - DNA, 20 bp, Artificial Sequence
  Description of Artificial Sequence: Synthetic oligonucleotide
  Target: ATXN1; (-) strand; PAM type: YTN; PAM sequence: CTC
cctgtcggtggcatcacgtt

SEQ ID NO: 197100 - DNA, 20 bp, Artificial Sequence
  Description of Artificial Sequence: Synthetic oligonucleotide
  Target: ATXN1; (-) strand; PAM type: YTN; PAM sequence: CTC
tccctgtcggtggcatcacg

SEQ ID NO: 197101 - DNA, 20 bp, Artificial Sequence
  Description of Artificial Sequence: Synthetic oligonucleotide
  Target: ATXN1; (-) strand; PAM type: YTN; PAM sequence: TTG
gctctccctgtcggtggcat

SEQ ID NO: 197102 - DNA, 20 bp, Artificial Sequence
  Description of Artificial Sequence: Synthetic oligonucleotide
  Target: ATXN1; (-) strand; PAM type: YTN; PAM sequence: CTC
ggagggtgagcagagttggc

SEQ ID NO: 197103 - DNA, 20 bp, Artificial Sequence
  Description of Artificial Sequence: Synthetic oligonucleotide
  Target: ATXN1; (-) strand; PAM type: YTN; PAM sequence: TTC
tcggagggtgagcagagttg

SEQ ID NO: 197104 - DNA, 20 bp, Artificial Sequence
  Description of Artificial Sequence: Synthetic oligonucleotide
  Target: ATXN1; (-) strand; PAM type: YTN; PAM sequence: CTT
ctcggagggtgagcagagtt

SEQ ID NO: 197105 - DNA, 20 bp, Artificial Sequence
  Description of Artificial Sequence: Synthetic oligonucleotide
  Target: ATXN1; (-) strand; PAM type: YTN; PAM sequence: CTA
gagtccttctcggagggtga

SEQ ID NO: 197106 - DNA, 20 bp, Artificial Sequence
  Description of Artificial Sequence: Synthetic oligonucleotide
  Target: ATXN1; (-) strand; PAM type: YTN; PAM sequence: TTA
tgcactagagtccttctcgg

SEQ ID NO: 197107 - DNA, 20 bp, Artificial Sequence
  Description of Artificial Sequence: Synthetic oligonucleotide
  Target: ATXN1; (-) strand; PAM type: YTN; PAM sequence: CTT
atgcactagagtccttctcg

SEQ ID NO: 197108 - DNA, 20 bp, Artificial Sequence
  Description of Artificial Sequence: Synthetic oligonucleotide
  Target: ATXN1; (-) strand; PAM type: YTN; PAM sequence: TTA
catgcgtgagccaccgcgcc

SEQ ID NO: 197109 - DNA, 20 bp, Artificial Sequence
  Description of Artificial Sequence: Synthetic oligonucleotide
  Target: ATXN1; (-) strand; PAM type: YTN; PAM sequence: CTG
ggattacatgcgtgagccac

SEQ ID NO: 197110 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacat

SEQ ID NO: 197111 - DNA, 20 bp, Artificial Sequence
  Description of Artificial Sequence: Synthetic oligonucleotide
  Target: ATXN1; (-) strand; PAM type: YTN; PAM sequence: CTG
ccccagcctcccaaagtgct

SEQ ID NO: 197112 - DNA, 20 bp, Artificial Sequence
  Description of Artificial Sequence: Synthetic oligonucleotide
  Target: ATXN1; (-) strand; PAM type: YTN; PAM sequence: CTC
aggtgatccatctgccccag

SEQ ID NO: 197113 - DNA, 20 bp, Artificial Sequence
  Description of Artificial Sequence: Synthetic oligonucleotide
  Target: ATXN1; (-) strand; PAM type: YTN; PAM sequence: TTG
acctcaggtgatccatctgc

SEQ ID NO: 197114 - DNA, 20 bp, Artificial Sequence
  Description of Artificial Sequence: Synthetic oligonucleotide
  Target: ATXN1; (-) strand; PAM type: YTN; PAM sequence: CTT
gacctcaggtgatccatctg

SEQ ID NO: 197115 - DNA, 20 bp, Artificial Sequence
  Description of Artificial Sequence: Synthetic oligonucleotide
  Target: ATXN1; (-) strand; PAM type: YTN; PAM sequence: CTC
ttgacctcaggtgatccatc

SEQ ID NO: 197116 - DNA, 20 bp, Artificial Sequence
  Description of Artificial Sequence: Synthetic oligonucleotide
  Target: ATXN1; (-) strand; PAM type: YTN; PAM sequence: TTG
aactcttgacctcaggtgat

SEQ ID NO: 197117 - DNA, 20 bp, Artificial Sequence
  Description of Artificial Sequence: Synthetic oligonucleotide
  Target: ATXN1; (-) strand; PAM type: YTN; PAM sequence: CTT
gaactcttgacctcaggtga

SEQ ID NO: 197118 - DNA, 20 bp, Artificial Sequence
  Description of Artificial Sequence: Synthetic oligonucleotide
  Target: ATXN1; (-) strand; PAM type: YTN; PAM sequence: CTG
accaagcccatcttgaactc

SEQ ID NO: 197119 - DNA, 20 bp, Artificial Sequence
  Description of Artificial Sequence: Synthetic oligonucleotide
  Target: ATXN1; (-) strand; PAM type: YTN; PAM sequence: CTG
tgctgaccaagcccatcttg

SEQ ID NO: 197120 - DNA, 20 bp, Artificial Sequence
  Description of Artificial Sequence: Synthetic oligonucleotide
  Target: ATXN1; (-) strand; PAM type: YTN; PAM sequence: TTC
actgtgctgaccaagcccat

SEQ ID NO: 197121 - DNA, 20 bp, Artificial Sequence
  Description of Artificial Sequence: Synthetic oligonucleotide
  Target: ATXN1; (-) strand; PAM type: YTN; PAM sequence: TTT
cactgtgctgaccaagccca

SEQ ID NO: 197122 - DNA, 20 bp, Artificial Sequence
  Description of Artificial Sequence: Synthetic oligonucleotide
  Target: ATXN1; (-) strand; PAM type: YTN; PAM sequence: TTA
gtagtgacagtgtttcactg

SEQ ID NO: 197123 - DNA, 20 bp, Artificial Sequence
  Description of Artificial Sequence: Synthetic oligonucleotide
  Target: ATXN1; (-) strand; PAM type: YTN; PAM sequence: TTT
agtagtgacagtgtttcact

SEQ ID NO: 197124 - DNA, 20 bp, Artificial Sequence
  Description of Artificial Sequence: Synthetic oligonucleotide
  Target: ATXN1; (-) strand; PAM type: YTN; PAM sequence: TTT
tagtagtgacagtgtttcac

SEQ ID NO: 197125 - DNA, 20 bp, Artificial Sequence
  Description of Artificial Sequence: Synthetic oligonucleotide
  Target: ATXN1; (-) strand; PAM type: YTN; PAM sequence: TTT
ttagtagtgacagtgtttca

SEQ ID NO: 197126 - DNA, 20 bp, Artificial Sequence
  Description of Artificial Sequence: Synthetic oligonucleotide
  Target: ATXN1; (-) strand; PAM type: YTN; PAM sequence: CTT
tttagtagtgacagtgtttc

SEQ ID NO: 197127 - DNA, 20 bp, Artificial Sequence
  Description of Artificial Sequence: Synthetic oligonucleotide
  Target: ATXN1; (-) strand; PAM type: YTN; PAM sequence: TTG
cgtctttttagtagtgacag

SEQ ID NO: 197128 - DNA, 20 bp, Artificial Sequence
  Description of Artificial Sequence: Synthetic oligonucleotide
  Target: ATXN1; (-) strand; PAM type: YTN; PAM sequence: TTT
gcgtctttttagtagtgaca

SEQ ID NO: 197129 - DNA, 20 bp, Artificial Sequence
  Description of Artificial Sequence: Synthetic oligonucleotide
  Target: ATXN1; (-) strand; PAM type: YTN; PAM sequence: TTT
tgcgtctttttagtagtgac

SEQ ID NO: 197130 - DNA, 20 bp, Artificial Sequence
  Description of Artificial Sequence: Synthetic oligonucleotide
  Target: ATXN1; (-) strand; PAM type: YTN; PAM sequence: CTA
attttgcgtctttttagtag

SEQ ID NO: 197131 - DNA, 20 bp, Artificial Sequence
  Description of Artificial Sequence: Synthetic oligonucleotide
  Target: ATXN1; (-) strand; PAM type: YTN; PAM sequence: CTG
ccaccacgtccagctaattt

SEQ ID NO: 197132 - DNA, 20 bp, Artificial Sequence
  Description of Artificial Sequence: Synthetic oligonucleotide
  Target: ATXN1; (-) strand; PAM type: YTN; PAM sequence: TTA
caggcacctgccaccacgtc

SEQ ID NO: 197133 - DNA, 20 bp, Artificial Sequence
  Description of Artificial Sequence: Synthetic oligonucleotide
  Target: ATXN1; (-) strand; PAM type: YTN; PAM sequence: CTA
gcagggattacaggcacctg

SEQ ID NO: 197134 - DNA, 20 bp, Artificial Sequence
  Description of Artificial Sequence: Synthetic oligonucleotide
  Target: ATXN1; (-) strand; PAM type: YTN; PAM sequence: CTG
ccgactagcagggattacag

SEQ ID NO: 197135 - DNA, 20 bp, Artificial Sequence
  Description of Artificial Sequence: Synthetic oligonucleotide
  Target: ATXN1; (-) strand; PAM type: YTN; PAM sequence: CTG
ccccagcctgccgactagca

SEQ ID NO: 197136 - DNA, 20 bp, Artificial Sequence
  Description of Artificial Sequence: Synthetic oligonucleotide
  Target: ATXN1; (-) strand; PAM type: YTN; PAM sequence: CTC
ctgccccagcctgccgacta

SEQ ID NO: 197137 - DNA, 20 bp, Artificial Sequence
  Description of Artificial Sequence: Synthetic oligonucleotide
  Target: ATXN1; (-) strand; PAM type: YTN; PAM sequence: TTC
tcctgccccagcctgccgac

SEQ ID NO: 197138 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgccccag

SEQ ID NO: 197139 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgattctcctgc

SEQ ID NO: 197140 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcgattctcc

SEQ ID NO: 197141 - DNA, 20 bp, Artificial Sequence
  Description of Artificial Sequence: Synthetic oligonucleotide
  Target: ATXN1; (-) strand; PAM type: YTN; PAM sequence: CTA
cctcctgggttcaagcgatt

SEQ ID NO: 197142 - DNA, 20 bp, Artificial Sequence
  Description of Artificial Sequence: Synthetic oligonucleotide
  Target: ATXN1; (-) strand; PAM type: YTN; PAM sequence: CTC
tacctcctgggttcaagcga

SEQ ID NO: 197143 - DNA, 20 bp, Artificial Sequence
  Description of Artificial Sequence: Synthetic oligonucleotide
  Target: ATXN1; (-) strand; PAM type: YTN; PAM sequence: CTG
caacctctacctcctgggtt

SEQ ID NO: 197144 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctacctcctg

SEQ ID NO: 197145 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctctacc

SEQ ID NO: 197146 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcagtctc

SEQ ID NO: 197147 - DNA, 20 bp, Artificial Sequence
  Description of Artificial Sequence: Synthetic oligonucleotide
  Target: ATXN1; (-) strand; PAM type: YTN; PAM sequence: TTG
cccagactggagtgcagtgg

SEQ ID NO: 197148 - DNA, 20 bp, Artificial Sequence
  Description of Artificial Sequence: Synthetic oligonucleotide
  Target: ATXN1; (-) strand; PAM type: YTN; PAM sequence: TTG
ttgcccagactggagtgcag

SEQ ID NO: 197149 - DNA, 20 bp, Artificial Sequence
  Description of Artificial Sequence: Synthetic oligonucleotide
  Target: ATXN1; (-) strand; PAM type: YTN; PAM sequence: CTT
gttgcccagactggagtgca

SEQ ID NO: 197150 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccagactggagtg

SEQ ID NO: 197151 - DNA, 20 bp, Artificial Sequence
  Description of Artificial Sequence: Synthetic oligonucleotide
  Target: ATXN1; (-) strand; PAM type: YTN; PAM sequence: TTC
actcttgttgcccagactgg

SEQ ID NO: 197152 - DNA, 20 bp, Artificial Sequence
  Description of Artificial Sequence: Synthetic oligonucleotide
  Target: ATXN1; (-) strand; PAM type: YTN; PAM sequence: TTT
cactcttgttgcccagactg

SEQ ID NO: 197153 - DNA, 20 bp, Artificial Sequence
  Description of Artificial Sequence: Synthetic oligonucleotide
  Target: ATXN1; (-) strand; PAM type: YTN; PAM sequence: TTG
agacagagtttcactcttgt

SEQ ID NO: 197154 - DNA, 20 bp, Artificial Sequence
  Description of Artificial Sequence: Synthetic oligonucleotide
  Target: ATXN1; (-) strand; PAM type: YTN; PAM sequence: TTT
gagacagagtttcactcttg

SEQ ID NO: 197155 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtttcactctt

SEQ ID NO: 197156 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtttcactct

SEQ ID NO: 197157 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtttcactc

SEQ ID NO: 197158 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtttcact

SEQ ID NO: 197159 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtttcac

SEQ ID NO: 197160 - DNA, 20 bp, Artificial Sequence
  Description of Artificial Sequence: Synthetic oligonucleotide
  Target: ATXN1; (-) strand; PAM type: YTN; PAM sequence: CTT
ttttttgagacagagtttca

SEQ ID NO: 197161 - DNA, 20 bp, Artificial Sequence
  Description of Artificial Sequence: Synthetic oligonucleotide
  Target: ATXN1; (-) strand; PAM type: YTN; PAM sequence: TTC
ttttttttgagacagagttt

SEQ ID NO: 197162 - DNA, 20 bp, Artificial Sequence
  Description of Artificial Sequence: Synthetic oligonucleotide
  Target: ATXN1; (-) strand; PAM type: YTN; PAM sequence: TTT
cttttttttgagacagagtt

SEQ ID NO: 197163 - DNA, 20 bp, Artificial Sequence
  Description of Artificial Sequence: Synthetic oligonucleotide
  Target: ATXN1; (-) strand; PAM type: YTN; PAM sequence: TTT
tcttttttttgagacagagt

SEQ ID NO: 197164 - DNA, 20 bp, Artificial Sequence
  Description of Artificial Sequence: Synthetic oligonucleotide
  Target: ATXN1; (-) strand; PAM type: YTN; PAM sequence: TTT
ttcttttttttgagacagag

SEQ ID NO: 197165 - DNA, 20 bp, Artificial Sequence
  Description of Artificial Sequence: Synthetic oligonucleotide
  Target: ATXN1; (-) strand; PAM type: YTN; PAM sequence: TTT
tttcttttttttgagacaga

SEQ ID NO: 197166 - DNA, 20 bp, Artificial Sequence
  Description of Artificial Sequence: Synthetic oligonucleotide
  Target: ATXN1; (-) strand; PAM type: YTN; PAM sequence: TTT
ttttcttttttttgagacag

SEQ ID NO: 197167 - DNA, 20 bp, Artificial Sequence
  Description of Artificial Sequence: Synthetic oligonucleotide
  Target: ATXN1; (-) strand; PAM type: YTN; PAM sequence: CTT
tttttcttttttttgagaca

SEQ ID NO: 197168 - DNA, 20 bp, Artificial Sequence
  Description of Artificial Sequence: Synthetic oligonucleotide
  Target: ATXN1; (-) strand; PAM type: YTN; PAM sequence: TTC
tttttttcttttttttgaga

SEQ ID NO: 197169 - DNA, 20 bp, Artificial Sequence
  Description of Artificial Sequence: Synthetic oligonucleotide
  Target: ATXN1; (-) strand; PAM type: YTN; PAM sequence: TTT
ctttttttcttttttttgag

SEQ ID NO: 197170 - DNA, 20 bp, Artificial Sequence
  Description of Artificial Sequence: Synthetic oligonucleotide
  Target: ATXN1; (-) strand; PAM type: YTN; PAM sequence: TTT
tctttttttcttttttttga

SEQ ID NO: 197171 - DNA, 20 bp, Artificial Sequence
  Description of Artificial Sequence: Synthetic oligonucleotide
  Target: ATXN1; (-) strand; PAM type: YTN; PAM sequence: TTT
ttctttttttcttttttttg

SEQ ID NO: 197172 - DNA, 20 bp, Artificial Sequence
  Description of Artificial Sequence: Synthetic oligonucleotide
  Target: ATXN1; (-) strand; PAM type: YTN; PAM sequence: TTT
tttctttttttctttttttt

SEQ ID NO: 197173 - DNA, 20 bp, Artificial Sequence
  Description of Artificial Sequence: Synthetic oligonucleotide
  Target: ATXN1; (-) strand; PAM type: YTN; PAM sequence: TTT
ttttctttttttcttttttt

SEQ ID NO: 197174 - DNA, 20 bp, Artificial Sequence
  Description of Artificial Sequence: Synthetic oligonucleotide
  Target: ATXN1; (-) strand; PAM type: YTN; PAM sequence: CTT
tttttctttttttctttttt

SEQ ID NO: 197175 - DNA, 20 bp, Artificial Sequence
  Description of Artificial Sequence: Synthetic oligonucleotide
  Target: ATXN1; (-) strand; PAM type: YTN; PAM sequence: TTC
tttttttctttttttctttt

SEQ ID NO: 197176 - DNA, 20 bp, Artificial Sequence
  Description of Artificial Sequence: Synthetic oligonucleotide
  Target: ATXN1; (-) strand; PAM type: YTN; PAM sequence: TTT
ctttttttctttttttcttt

SEQ ID NO: 197177 - DNA, 20 bp, Artificial Sequence
  Description of Artificial Sequence: Synthetic oligonucleotide
  Target: ATXN1; (-) strand; PAM type: YTN; PAM sequence: TTT
tctttttttctttttttctt

SEQ ID NO: 197178 - DNA, 20 bp, Artificial Sequence
  Description of Artificial Sequence: Synthetic oligonucleotide
  Target: ATXN1; (-) strand; PAM type: YTN; PAM sequence: TTT
ttctttttttctttttttct

SEQ ID NO: 197179 - DNA, 20 bp, Artificial Sequence
  Description of Artificial Sequence: Synthetic oligonucleotide
  Target: ATXN1; (-) strand; PAM type: YTN; PAM sequence: TTT
tttctttttttctttttttc

SEQ ID NO: 197180 - DNA, 20 bp, Artificial Sequence
  Description of Artificial Sequence: Synthetic oligonucleotide
  Target: ATXN1; (-) strand; PAM type: YTN; PAM sequence: TTT
ttttctttttttcttttttt

SEQ ID NO: 197181 - DNA, 20 bp, Artificial Sequence
  Description of Artificial Sequence: Synthetic oligonucleotide
  Target: ATXN1; (-) strand; PAM type: YTN; PAM sequence: TTT
tttttctttttttctttttt

SEQ ID NO: 197182 - DNA, 20 bp, Artificial Sequence
  Description of Artificial Sequence: Synthetic oligonucleotide
  Target: ATXN1; (-) strand; PAM type: YTN; PAM sequence: TTT
ttttttctttttttcttttt

SEQ ID NO: 197183 - DNA, 20 bp, Artificial Sequence
  Description of Artificial Sequence: Synthetic oligonucleotide
  Target: ATXN1; (-) strand; PAM type: YTN; PAM sequence: TTT
tttttttctttttttctttt

SEQ ID NO: 197184 - DNA, 20 bp, Artificial Sequence
  Description of Artificial Sequence: Synthetic oligonucleotide
  Target: ATXN1; (-) strand; PAM type: YTN; PAM sequence: TTT
ttttttttctttttttcttt

SEQ ID NO: 197185 - DNA, 20 bp, Artificial Sequence
  Description of Artificial Sequence: Synthetic oligonucleotide
  Target: ATXN1; (-) strand; PAM type: YTN; PAM sequence: CTT
tttttttttctttttttctt

SEQ ID NO: 197186 - DNA, 20 bp, Artificial Sequence
  Description of Artificial Sequence: Synthetic oligonucleotide
  Target: ATXN1; (-) strand; PAM type: YTN; PAM sequence: TTC
tttttttttttctttttttc

SEQ ID NO: 197187 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttcttttttt

SEQ ID NO: 197188 - DNA, 20 bp, Artificial Sequence
  Description of Artificial Sequence: Synthetic oligonucleotide
  Target: ATXN1; (-) strand; PAM type: YTN; PAM sequence: TTA
gaacatcatttctttttttt

SEQ ID NO: 197189 - DNA, 20 bp, Artificial Sequence
  Description of Artificial Sequence: Synthetic oligonucleotide
  Target: ATXN1; (-) strand; PAM type: YTN; PAM sequence: TTC
agttagaacatcatttcttt

SEQ ID NO: 197190 - DNA, 20 bp, Artificial Sequence
  Description of Artificial Sequence: Synthetic oligonucleotide
  Target: ATXN1; (-) strand; PAM type: YTN; PAM sequence: TTT
cagttagaacatcatttctt

SEQ ID NO: 197191 - DNA, 20 bp, Artificial Sequence
  Description of Artificial Sequence: Synthetic oligonucleotide
  Target: ATXN1; (-) strand; PAM type: YTN; PAM sequence: TTG
tatttcagttagaacatcat

SEQ ID NO: 197192 - DNA, 20 bp, Artificial Sequence
  Description of Artificial Sequence: Synthetic oligonucleotide
  Target: ATXN1; (-) strand; PAM type: YTN; PAM sequence: CTG
tatcatggttgtatttcagt

SEQ ID NO: 197193 - DNA, 20 bp, Artificial Sequence
  Description of Artificial Sequence: Synthetic oligonucleotide
  Target: ATXN1; (-) strand; PAM type: YTN; PAM sequence: TTG
cctgtatcatggttgtattt

SEQ ID NO: 197194 - DNA, 20 bp, Artificial Sequence
  Description of Artificial Sequence: Synthetic oligonucleotide
  Target: ATXN1; (-) strand; PAM type: YTN; PAM sequence: TTT
gcctgtatcatggttgtatt

SEQ ID NO: 197195 - DNA, 20 bp, Artificial Sequence
  Description of Artificial Sequence: Synthetic oligonucleotide
  Target: ATXN1; (-) strand; PAM type: YTN; PAM sequence: TTT
tgcctgtatcatggttgtat

SEQ ID NO: 197196 - DNA, 20 bp, Artificial Sequence
  Description of Artificial Sequence: Synthetic oligonucleotide
  Target: ATXN1; (-) strand; PAM type: YTN; PAM sequence: TTT
ttgcctgtatcatggttgta

SEQ ID NO: 197197 - DNA, 20 bp, Artificial Sequence
  Description of Artificial Sequence: Synthetic oligonucleotide
  Target: ATXN1; (-) strand; PAM type: YTN; PAM sequence: CTG
tttttgcctgtatcatggtt

SEQ ID NO: 197198 - DNA, 20 bp, Artificial Sequence
  Description of Artificial Sequence: Synthetic oligonucleotide
  Target: ATXN1; (-) strand; PAM type: YTN; PAM sequence: TTC
caaatcgaagtctgtttttg

SEQ ID NO: 197199 - DNA, 20 bp, Artificial Sequence
  Description of Artificial Sequence: Synthetic oligonucleotide
  Target: ATXN1; (-) strand; PAM type: YTN; PAM sequence: CTT
ccaaatcgaagtctgttttt

SEQ ID NO: 197200 - DNA, 20 bp, Artificial Sequence
  Description of Artificial Sequence: Synthetic oligonucleotide
  Target: ATXN1; (-) strand; PAM type: YTN; PAM sequence: TTA
gcttccaaatcgaagtctgt

SEQ ID NO: 197201 - DNA, 20 bp, Artificial Sequence
  Description of Artificial Sequence: Synthetic oligonucleotide
  Target: ATXN1; (-) strand; PAM type: YTN; PAM sequence: TTT
agcttccaaatcgaagtctg

SEQ ID NO: 197202 - DNA, 20 bp, Artificial Sequence
  Description of Artificial Sequence: Synthetic oligonucleotide
  Target: ATXN1; (-) strand; PAM type: YTN; PAM sequence: TTT
tagcttccaaatcgaagtct

SEQ ID NO: 197203 - DNA, 20 bp, Artificial Sequence
  Description of Artificial Sequence: Synthetic oligonucleotide
  Target: ATXN1; (-) strand; PAM type: YTN; PAM sequence: TTT
ttagcttccaaatcgaagtc

SEQ ID NO: 197204 - DNA, 20 bp, Artificial Sequence
  Description of Artificial Sequence: Synthetic oligonucleotide
  Target: ATXN1; (-) strand; PAM type: YTN; PAM sequence: TTT
tttagcttccaaatcgaagt

SEQ ID NO: 197205 - DNA, 20 bp, Artificial Sequence
  Description of Artificial Sequence: Synthetic oligonucleotide
  Target: ATXN1; (-) strand; PAM type: YTN; PAM sequence: CTT
ttttagcttccaaatcgaag

SEQ ID NO: 197206 - DNA, 20 bp, Artificial Sequence
  Description of Artificial Sequence: Synthetic oligonucleotide
  Target: ATXN1; (-) strand; PAM type: YTN; PAM sequence: CTG
gccaagacaccttttttagc

SEQ ID NO: 197207 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccaccgcacc

SEQ ID NO: 197208 - DNA, 20 bp, Artificial Sequence
  Description of Artificial Sequence: Synthetic oligonucleotide
  Target: ATXN1; (-) strand; PAM type: YTN; PAM sequence: CTG
gtattacaggtgtgagccac

SEQ ID NO: 197209 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctggtattacag

SEQ ID NO: 197210 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctggtat

SEQ ID NO: 197211 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggta

SEQ ID NO: 197212 - DNA, 20 bp, Artificial Sequence
  Description of Artificial Sequence: Synthetic oligonucleotide
  Target: ATXN1; (-) strand; PAM type: YTN; PAM sequence: CTC
aggtgatccgcccaccttgg

SEQ ID NO: 197213 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccgcccac

SEQ ID NO: 197214 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccgcc

SEQ ID NO: 197215 - DNA, 20 bp, Artificial Sequence
  Description of Artificial Sequence: Synthetic oligonucleotide
  Target: ATXN1; (-) strand; PAM type: YTN; PAM sequence: CTC
aaactcctgacctcaggtga

SEQ ID NO: 197216 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctgacctca

SEQ ID NO: 197217 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtatcacca

SEQ ID NO: 197218 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtatcacc

SEQ ID NO: 197219 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtatcac

SEQ ID NO: 197220 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtatca

SEQ ID NO: 197221 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 197222 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 197223 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 197224 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 197225 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 197226 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 197227 - DNA, 20 bp, Artificial Sequence
  Description of Artificial Sequence: Synthetic oligonucleotide
  Target: ATXN1; (-) strand; PAM type: YTN; PAM sequence: CTG
ccaccatgcctggctaattt

SEQ ID NO: 197228 - DNA, 20 bp, Artificial Sequence
  Description of Artificial Sequence: Synthetic oligonucleotide
  Target: ATXN1; (-) strand; PAM type: YTN; PAM sequence: TTA
caggcatctgccaccatgcc

SEQ ID NO: 197229 - DNA, 20 bp, Artificial Sequence
  Description of Artificial Sequence: Synthetic oligonucleotide
  Target: ATXN1; (-) strand; PAM type: YTN; PAM sequence: CTG
agattacaggcatctgccac

SEQ ID NO: 197230 - DNA, 20 bp, Artificial Sequence
  Description of Artificial Sequence: Synthetic oligonucleotide
  Target: ATXN1; (-) strand; PAM type: YTN; PAM sequence: CTC
ccaagtagctgagattacag

SEQ ID NO: 197231 - DNA, 20 bp, Artificial Sequence
  Description of Artificial Sequence: Synthetic oligonucleotide
  Target: ATXN1; (-) strand; PAM type: YTN; PAM sequence: TTG
acctcccaagtagctgagat

SEQ ID NO: 197232 - DNA, 20 bp, Artificial Sequence
  Description of Artificial Sequence: Synthetic oligonucleotide
  Target: ATXN1; (-) strand; PAM type: YTN; PAM sequence: TTT
gacctcccaagtagctgaga

SEQ ID NO: 197233 - DNA, 20 bp, Artificial Sequence
  Description of Artificial Sequence: Synthetic oligonucleotide
  Target: ATXN1; (-) strand; PAM type: YTN; PAM sequence: CTT
tgacctcccaagtagctgag

SEQ ID NO: 197234 - DNA, 20 bp, Artificial Sequence
  Description of Artificial Sequence: Synthetic oligonucleotide
  Target: ATXN1; (-) strand; PAM type: YTN; PAM sequence: CTG
ctttgacctcccaagtagct

SEQ ID NO: 197235 - DNA, 20 bp, Artificial Sequence
  Description of Artificial Sequence: Synthetic oligonucleotide
  Target: ATXN1; (-) strand; PAM type: YTN; PAM sequence: CTC
ctgctttgacctcccaagta

SEQ ID NO: 197236 - DNA, 20 bp, Artificial Sequence
  Description of Artificial Sequence: Synthetic oligonucleotide
  Target: ATXN1; (-) strand; PAM type: YTN; PAM sequence: TTC
tcctgctttgacctcccaag

SEQ ID NO: 197237 - DNA, 20 bp, Artificial Sequence
  Description of Artificial Sequence: Synthetic oligonucleotide
  Target: ATXN1; (-) strand; PAM type: YTN; PAM sequence: TTA
agtgattctcctgctttgac

SEQ ID NO: 197238 - DNA, 20 bp, Artificial Sequence
  Description of Artificial Sequence: Synthetic oligonucleotide
  Target: ATXN1; (-) strand; PAM type: YTN; PAM sequence: TTT
aagtgattctcctgctttga

SEQ ID NO: 197239 - DNA, 20 bp, Artificial Sequence
  Description of Artificial Sequence: Synthetic oligonucleotide
  Target: ATXN1; (-) strand; PAM type: YTN; PAM sequence: CTG
ggtttaagtgattctcctgc

SEQ ID NO: 197240 - DNA, 20 bp, Artificial Sequence
  Description of Artificial Sequence: Synthetic oligonucleotide
  Target: ATXN1; (-) strand; PAM type: YTN; PAM sequence: CTG
acctgggtttaagtgattct

SEQ ID NO: 197241 - DNA, 20 bp, Artificial Sequence
  Description of Artificial Sequence: Synthetic oligonucleotide
  Target: ATXN1; (-) strand; PAM type: YTN; PAM sequence: TTG
ccagcaagctgacctgggtt

SEQ ID NO: 197242 - DNA, 20 bp, Artificial Sequence
  Description of Artificial Sequence: Synthetic oligonucleotide
  Target: ATXN1; (-) strand; PAM type: YTN; PAM sequence: CTG
ggaagttgccagcaagctga

SEQ ID NO: 197243 - DNA, 20 bp, Artificial Sequence
  Description of Artificial Sequence: Synthetic oligonucleotide
  Target: ATXN1; (-) strand; PAM type: YTN; PAM sequence: CTA
atctgggaagttgccagcaa

SEQ ID NO: 197244 - DNA, 20 bp, Artificial Sequence
  Description of Artificial Sequence: Synthetic oligonucleotide
  Target: ATXN1; (-) strand; PAM type: YTN; PAM sequence: TTC
atcaagtgcactaatctggg

SEQ ID NO: 197245 - DNA, 20 bp, Artificial Sequence
  Description of Artificial Sequence: Synthetic oligonucleotide
  Target: ATXN1; (-) strand; PAM type: YTN; PAM sequence: TTT
catcaagtgcactaatctgg

SEQ ID NO: 197246 - DNA, 20 bp, Artificial Sequence
  Description of Artificial Sequence: Synthetic oligonucleotide
  Target: ATXN1; (-) strand; PAM type: YTN; PAM sequence: TTA
caaggggtttcatcaagtgc

SEQ ID NO: 197247 - DNA, 20 bp, Artificial Sequence
  Description of Artificial Sequence: Synthetic oligonucleotide
  Target: ATXN1; (-) strand; PAM type: YTN; PAM sequence: TTA
ttacaaggggtttcatcaag

SEQ ID NO: 197248 - DNA, 20 bp, Artificial Sequence
  Description of Artificial Sequence: Synthetic oligonucleotide
  Target: ATXN1; (-) strand; PAM type: YTN; PAM sequence: TTA
attattacaaggggtttcat

SEQ ID NO: 197249 - DNA, 20 bp, Artificial Sequence
  Description of Artificial Sequence: Synthetic oligonucleotide
  Target: ATXN1; (-) strand; PAM type: YTN; PAM sequence: TTT
aattattacaaggggtttca

SEQ ID NO: 197250 - DNA, 20 bp, Artificial Sequence
  Description of Artificial Sequence: Synthetic oligonucleotide
  Target: ATXN1; (-) strand; PAM type: YTN; PAM sequence: TTG
tgccggtggaaggaatttaa

SEQ ID NO: 197251 - DNA, 20 bp, Artificial Sequence
  Description of Artificial Sequence: Synthetic oligonucleotide
  Target: ATXN1; (-) strand; PAM type: YTN; PAM sequence: CTT
gtgccggtggaaggaattta

SEQ ID NO: 197252 - DNA, 20 bp, Artificial Sequence
  Description of Artificial Sequence: Synthetic oligonucleotide
  Target: ATXN1; (-) strand; PAM type: YTN; PAM sequence: TTC
ttgtgccggtggaaggaatt

SEQ ID NO: 197253 - DNA, 20 bp, Artificial Sequence
  Description of Artificial Sequence: Synthetic oligonucleotide
  Target: ATXN1; (-) strand; PAM type: YTN; PAM sequence: TTT
cttgtgccggtggaaggaat

SEQ ID NO: 197254 - DNA, 20 bp, Artificial Sequence
  Description of Artificial Sequence: Synthetic oligonucleotide
  Target: ATXN1; (-) strand; PAM type: YTN; PAM sequence: TTC
agtggacatatttcttgtgc

SEQ ID NO: 197255 - DNA, 20 bp, Artificial Sequence
  Description of Artificial Sequence: Synthetic oligonucleotide
  Target: ATXN1; (-) strand; PAM type: YTN; PAM sequence: TTT
cagtggacatatttcttgtg

SEQ ID NO: 197256 - DNA, 20 bp, Artificial Sequence
  Description of Artificial Sequence: Synthetic oligonucleotide
  Target: ATXN1; (-) strand; PAM type: YTN; PAM sequence: TTT
tcagtggacatatttcttgt

SEQ ID NO: 197257 - DNA, 20 bp, Artificial Sequence
  Description of Artificial Sequence: Synthetic oligonucleotide
  Target: ATXN1; (-) strand; PAM type: YTN; PAM sequence: CTA
ttttcagtggacatatttct

SEQ ID NO: 197258 - DNA, 20 bp, Artificial Sequence
  Description of Artificial Sequence: Synthetic oligonucleotide
  Target: ATXN1; (-) strand; PAM type: YTN; PAM sequence: TTC
ctattttcagtggacatatt

SEQ ID NO: 197259 - DNA, 20 bp, Artificial Sequence
  Description of Artificial Sequence: Synthetic oligonucleotide
  Target: ATXN1; (-) strand; PAM type: YTN; PAM sequence: TTG
agggcaaagagagaaaggaa

SEQ ID NO: 197260 - DNA, 20 bp, Artificial Sequence
  Description of Artificial Sequence: Synthetic oligonucleotide
  Target: ATXN1; (-) strand; PAM type: YTN; PAM sequence: CTT
gagggcaaagagagaaagga

SEQ ID NO: 197261 - DNA, 20 bp, Artificial Sequence
  Description of Artificial Sequence: Synthetic oligonucleotide
  Target: ATXN1; (-) strand; PAM type: YTN; PAM sequence: CTG
ggtggtgaaggtcttgaggg

SEQ ID NO: 197262 - DNA, 20 bp, Artificial Sequence
  Description of Artificial Sequence: Synthetic oligonucleotide
  Target: ATXN1; (-) strand; PAM type: YTN; PAM sequence: CTG
tcctgggtggtgaaggtctt

SEQ ID NO: 197263 - DNA, 20 bp, Artificial Sequence
  Description of Artificial Sequence: Synthetic oligonucleotide
  Target: ATXN1; (-) strand; PAM type: YTN; PAM sequence: CTC
actgtcctgggtggtgaagg

SEQ ID NO: 197264 - DNA, 20 bp, Artificial Sequence
  Description of Artificial Sequence: Synthetic oligonucleotide
  Target: ATXN1; (-) strand; PAM type: YTN; PAM sequence: CTC
tcactgtcctgggtggtgaa

SEQ ID NO: 197265 - DNA, 20 bp, Artificial Sequence
  Description of Artificial Sequence: Synthetic oligonucleotide
  Target: ATXN1; (-) strand; PAM type: YTN; PAM sequence: TTA
tagcctctcactgtcctggg

SEQ ID NO: 197266 - DNA, 20 bp, Artificial Sequence
  Description of Artificial Sequence: Synthetic oligonucleotide
  Target: ATXN1; (-) strand; PAM type: YTN; PAM sequence: CTT
atagcctctcactgtcctgg

SEQ ID NO: 197267 - DNA, 20 bp, Artificial Sequence
  Description of Artificial Sequence: Synthetic oligonucleotide
  Target: ATXN1; (-) strand; PAM type: YTN; PAM sequence: TTA
acacttatagcctctcactg

SEQ ID NO: 197268 - DNA, 20 bp, Artificial Sequence
  Description of Artificial Sequence: Synthetic oligonucleotide
  Target: ATXN1; (-) strand; PAM type: YTN; PAM sequence: CTT
aacacttatagcctctcact

SEQ ID NO: 197269 - DNA, 20 bp, Artificial Sequence
  Description of Artificial Sequence: Synthetic oligonucleotide
  Target: ATXN1; (-) strand; PAM type: YTN; PAM sequence: CTG
ccccggtgcccttaacactt

SEQ ID NO: 197270 - DNA, 20 bp, Artificial Sequence
  Description of Artificial Sequence: Synthetic oligonucleotide
  Target: ATXN1; (-) strand; PAM type: YTN; PAM sequence: CTC
tgccccggtgcccttaacac

SEQ ID NO: 197271 - DNA, 20 bp, Artificial Sequence
  Description of Artificial Sequence: Synthetic oligonucleotide
  Target: ATXN1; (-) strand; PAM type: YTN; PAM sequence: TTG
gctctgccccggtgccctta

SEQ ID NO: 197272 - DNA, 20 bp, Artificial Sequence
  Description of Artificial Sequence: Synthetic oligonucleotide
  Target: ATXN1; (-) strand; PAM type: YTN; PAM sequence: TTA
aacccagatattggctctgc

SEQ ID NO: 197273 - DNA, 20 bp, Artificial Sequence
  Description of Artificial Sequence: Synthetic oligonucleotide
  Target: ATXN1; (-) strand; PAM type: YTN; PAM sequence: TTT
aaacccagatattggctctg

SEQ ID NO: 197274 - DNA, 20 bp, Artificial Sequence
  Description of Artificial Sequence: Synthetic oligonucleotide
  Target: ATXN1; (-) strand; PAM type: YTN; PAM sequence: TTG
cccaaggtcatttaaaccca

SEQ ID NO: 197275 - DNA, 20 bp, Artificial Sequence
  Description of Artificial Sequence: Synthetic oligonucleotide
  Target: ATXN1; (-) strand; PAM type: YTN; PAM sequence: TTT
gcccaaggtcatttaaaccc

SEQ ID NO: 197276 - DNA, 20 bp, Artificial Sequence
  Description of Artificial Sequence: Synthetic oligonucleotide
  Target: ATXN1; (-) strand; PAM type: YTN; PAM sequence: TTA
agtgatttgcccaaggtcat

SEQ ID NO: 197277 - DNA, 20 bp, Artificial Sequence
  Description of Artificial Sequence: Synthetic oligonucleotide
  Target: ATXN1; (-) strand; PAM type: YTN; PAM sequence: CTG
aaaacagtgaggttaagtga

SEQ ID NO: 197278 - DNA, 20 bp, Artificial Sequence
  Description of Artificial Sequence: Synthetic oligonucleotide
  Target: ATXN1; (-) strand; PAM type: YTN; PAM sequence: TTA
tatctgaaaacagtgaggtt

SEQ ID NO: 197279 - DNA, 20 bp, Artificial Sequence
  Description of Artificial Sequence: Synthetic oligonucleotide
  Target: ATXN1; (-) strand; PAM type: YTN; PAM sequence: TTT
atatctgaaaacagtgaggt

SEQ ID NO: 197280 - DNA, 20 bp, Artificial Sequence
  Description of Artificial Sequence: Synthetic oligonucleotide
  Target: ATXN1; (-) strand; PAM type: YTN; PAM sequence: TTT
tatatctgaaaacagtgagg

SEQ ID NO: 197281 - DNA, 20 bp, Artificial Sequence
  Description of Artificial Sequence: Synthetic oligonucleotide
  Target: ATXN1; (-) strand; PAM type: YTN; PAM sequence: TTA
tgtaaattttatatctgaaa

SEQ ID NO: 197282 - DNA, 20 bp, Artificial Sequence
  Description of Artificial Sequence: Synthetic oligonucleotide
  Target: ATXN1; (-) strand; PAM type: YTN; PAM sequence: TTG
ttatgtaaattttatatctg

SEQ ID NO: 197283 - DNA, 20 bp, Artificial Sequence
  Description of Artificial Sequence: Synthetic oligonucleotide
  Target: ATXN1; (-) strand; PAM type: YTN; PAM sequence: TTT
gttatgtaaattttatatct

SEQ ID NO: 197284 - DNA, 20 bp, Artificial Sequence
  Description of Artificial Sequence: Synthetic oligonucleotide
  Target: ATXN1; (-) strand; PAM type: YTN; PAM sequence: TTT
tgttatgtaaattttatatc

SEQ ID NO: 197285 - DNA, 20 bp, Artificial Sequence
  Description of Artificial Sequence: Synthetic oligonucleotide
  Target: ATXN1; (-) strand; PAM type: YTN; PAM sequence: CTT
ttgttatgtaaattttatat

SEQ ID NO: 197286 - DNA, 20 bp, Artificial Sequence
  Description of Artificial Sequence: Synthetic oligonucleotide
  Target: ATXN1; (-) strand; PAM type: YTN; PAM sequence: CTC
acaacttttgttatgtaaat

SEQ ID NO: 197287 - DNA, 20 bp, Artificial Sequence
  Description of Artificial Sequence: Synthetic oligonucleotide
  Target: ATXN1; (-) strand; PAM type: YTN; PAM sequence: TTA
atcctcacaacttttgttat

SEQ ID NO: 197288 - DNA, 20 bp, Artificial Sequence
  Description of Artificial Sequence: Synthetic oligonucleotide
  Target: ATXN1; (-) strand; PAM type: YTN; PAM sequence: TTT
aatcctcacaacttttgtta

SEQ ID NO: 197289 - DNA, 20 bp, Artificial Sequence
  Description of Artificial Sequence: Synthetic oligonucleotide
  Target: ATXN1; (-) strand; PAM type: YTN; PAM sequence: CTT
taatcctcacaacttttgtt

SEQ ID NO: 197290 - DNA, 20 bp, Artificial Sequence
  Description of Artificial Sequence: Synthetic oligonucleotide
  Target: ATXN1; (-) strand; PAM type: YTN; PAM sequence: TTA
accctttaatcctcacaact

SEQ ID NO: 197291 - DNA, 20 bp, Artificial Sequence
  Description of Artificial Sequence: Synthetic oligonucleotide
  Target: ATXN1; (-) strand; PAM type: YTN; PAM sequence: CTA
tattaaccctttaatcctca

SEQ ID NO: 197292 - DNA, 20 bp, Artificial Sequence
  Description of Artificial Sequence: Synthetic oligonucleotide
  Target: ATXN1; (-) strand; PAM type: YTN; PAM sequence: TTG
tgctatattaaccctttaat

SEQ ID NO: 197293 - DNA, 20 bp, Artificial Sequence
  Description of Artificial Sequence: Synthetic oligonucleotide
  Target: ATXN1; (-) strand; PAM type: YTN; PAM sequence: TTT
gtgctatattaaccctttaa

SEQ ID NO: 197294 - DNA, 20 bp, Artificial Sequence
  Description of Artificial Sequence: Synthetic oligonucleotide
  Target: ATXN1; (-) strand; PAM type: YTN; PAM sequence: CTT
tgtgctatattaacccttta

SEQ ID NO: 197295 - DNA, 20 bp, Artificial Sequence
  Description of Artificial Sequence: Synthetic oligonucleotide
  Target: ATXN1; (-) strand; PAM type: YTN; PAM sequence: CTA
agtgctttgtgctatattaa

SEQ ID NO: 197296 - DNA, 20 bp, Artificial Sequence
  Description of Artificial Sequence: Synthetic oligonucleotide
  Target: ATXN1; (-) strand; PAM type: YTN; PAM sequence: CTC
taagtgctttgtgctatatt

SEQ ID NO: 197297 - DNA, 20 bp, Artificial Sequence
  Description of Artificial Sequence: Synthetic oligonucleotide
  Target: ATXN1; (-) strand; PAM type: YTN; PAM sequence: CTG
ctctaagtgctttgtgctat

SEQ ID NO: 197298 - DNA, 20 bp, Artificial Sequence
  Description of Artificial Sequence: Synthetic oligonucleotide
  Target: ATXN1; (-) strand; PAM type: YTN; PAM sequence: CTA
taatactgctctaagtgctt

SEQ ID NO: 197299 - DNA, 20 bp, Artificial Sequence
  Description of Artificial Sequence: Synthetic oligonucleotide
  Target: ATXN1; (-) strand; PAM type: YTN; PAM sequence: TTG
gtcaataaaagcaaacacct

SEQ ID NO: 197300 - DNA, 20 bp, Artificial Sequence
  Description of Artificial Sequence: Synthetic oligonucleotide
  Target: ATXN1; (-) strand; PAM type: YTN; PAM sequence: TTG
tatgttggtcaataaaagca

SEQ ID NO: 197301 - DNA, 20 bp, Artificial Sequence
  Description of Artificial Sequence: Synthetic oligonucleotide
  Target: ATXN1; (-) strand; PAM type: YTN; PAM sequence: TTT
gtatgttggtcaataaaagc

SEQ ID NO: 197302 - DNA, 20 bp, Artificial Sequence
  Description of Artificial Sequence: Synthetic oligonucleotide
  Target: ATXN1; (-) strand; PAM type: YTN; PAM sequence: CTT
tgtatgttggtcaataaaag

SEQ ID NO: 197303 - DNA, 20 bp, Artificial Sequence
  Description of Artificial Sequence: Synthetic oligonucleotide
  Target: ATXN1; (-) strand; PAM type: YTN; PAM sequence: CTC
tttgtatgttggtcaataaa

SEQ ID NO: 197304 - DNA, 20 bp, Artificial Sequence
  Description of Artificial Sequence: Synthetic oligonucleotide
  Target: ATXN1; (-) strand; PAM type: YTN; PAM sequence: TTG
aataacagtcagctctttgt

SEQ ID NO: 197305 - DNA, 20 bp, Artificial Sequence
  Description of Artificial Sequence: Synthetic oligonucleotide
  Target: ATXN1; (-) strand; PAM type: YTN; PAM sequence: TTG
gaatcattgaataacagtca

SEQ ID NO: 197306 - DNA, 20 bp, Artificial Sequence
  Description of Artificial Sequence: Synthetic oligonucleotide
  Target: ATXN1; (-) strand; PAM type: YTN; PAM sequence: TTT
ggaatcattgaataacagtc

SEQ ID NO: 197307 - DNA, 20 bp, Artificial Sequence
  Description of Artificial Sequence: Synthetic oligonucleotide
  Target: ATXN1; (-) strand; PAM type: YTN; PAM sequence: TTT
tggaatcattgaataacagt

SEQ ID NO: 197308 - DNA, 20 bp, Artificial Sequence
  Description of Artificial Sequence: Synthetic oligonucleotide
  Target: ATXN1; (-) strand; PAM type: YTN; PAM sequence: TTA
ttttggaatcattgaataac

SEQ ID NO: 197309 - DNA, 20 bp, Artificial Sequence
  Description of Artificial Sequence: Synthetic oligonucleotide
  Target: ATXN1; (-) strand; PAM type: YTN; PAM sequence: TTA
aaaaaataaaaagaacaatt

SEQ ID NO: 197310 - DNA, 20 bp, Artificial Sequence
  Description of Artificial Sequence: Synthetic oligonucleotide
  Target: ATXN1; (-) strand; PAM type: YTN; PAM sequence: TTA
aaaacaaaaaaaagattaaa

SEQ ID NO: 197311 - DNA, 20 bp, Artificial Sequence
  Description of Artificial Sequence: Synthetic oligonucleotide
  Target: ATXN1; (-) strand; PAM type: YTN; PAM sequence: TTA
aagtataattaaaaacaaaa

SEQ ID NO: 197312 - DNA, 20 bp, Artificial Sequence
  Description of Artificial Sequence: Synthetic oligonucleotide
  Target: ATXN1; (-) strand; PAM type: YTN; PAM sequence: CTT
aaagtataattaaaaacaaa

SEQ ID NO: 197313 - DNA, 20 bp, Artificial Sequence
  Description of Artificial Sequence: Synthetic oligonucleotide
  Target: ATXN1; (-) strand; PAM type: YTN; PAM sequence: CTA
aaacttaaagtataattaaa

SEQ ID NO: 197314 - DNA, 20 bp, Artificial Sequence
  Description of Artificial Sequence: Synthetic oligonucleotide
  Target: ATXN1; (-) strand; PAM type: YTN; PAM sequence: TTG
tgcacatgtaccctaaaact

SEQ ID NO: 197315 - DNA, 20 bp, Artificial Sequence
  Description of Artificial Sequence: Synthetic oligonucleotide
  Target: ATXN1; (-) strand; PAM type: YTN; PAM sequence: CTG
catgttgtgcacatgtaccc

SEQ ID NO: 197316 - DNA, 20 bp, Artificial Sequence
  Description of Artificial Sequence: Synthetic oligonucleotide
  Target: ATXN1; (-) strand; PAM type: YTN; PAM sequence: CTA
tacatatgtaacaaacctgc

SEQ ID NO: 197317 - DNA, 20 bp, Artificial Sequence
  Description of Artificial Sequence: Synthetic oligonucleotide
  Target: ATXN1; (-) strand; PAM type: YTN; PAM sequence: CTG
gcacatctatacatatgtaa

SEQ ID NO: 197318 - DNA, 20 bp, Artificial Sequence
  Description of Artificial Sequence: Synthetic oligonucleotide
  Target: ATXN1; (-) strand; PAM type: YTN; PAM sequence: TTA
atgggtgcagcacgccaacc

SEQ ID NO: 197319 - DNA, 20 bp, Artificial Sequence
  Description of Artificial Sequence: Synthetic oligonucleotide
  Target: ATXN1; (-) strand; PAM type: YTN; PAM sequence: TTA
aatgacaagttaatgggtgc

SEQ ID NO: 197320 - DNA, 20 bp, Artificial Sequence
  Description of Artificial Sequence: Synthetic oligonucleotide
  Target: ATXN1; (-) strand; PAM type: YTN; PAM sequence: CTA
atgttaaatgacaagttaat

SEQ ID NO: 197321 - DNA, 20 bp, Artificial Sequence
  Description of Artificial Sequence: Synthetic oligonucleotide
  Target: ATXN1; (-) strand; PAM type: YTN; PAM sequence: TTA
ggagatatacctaatgttaa

SEQ ID NO: 197322 - DNA, 20 bp, Artificial Sequence
  Description of Artificial Sequence: Synthetic oligonucleotide
  Target: ATXN1; (-) strand; PAM type: YTN; PAM sequence: TTG
tggggtggggggagggggga

SEQ ID NO: 197323 - DNA, 20 bp, Artificial Sequence
  Description of Artificial Sequence: Synthetic oligonucleotide
  Target: ATXN1; (-) strand; PAM type: YTN; PAM sequence: CTG
ttgtggggtggggggagggg

SEQ ID NO: 197324 - DNA, 20 bp, Artificial Sequence
  Description of Artificial Sequence: Synthetic oligonucleotide
  Target: ATXN1; (-) strand; PAM type: YTN; PAM sequence: TTG
aacaatgagaacacatggac

SEQ ID NO: 197325 - DNA, 20 bp, Artificial Sequence
  Description of Artificial Sequence: Synthetic oligonucleotide
  Target: ATXN1; (-) strand; PAM type: YTN; PAM sequence: CTC
ataggtgggaattgaacaat

SEQ ID NO: 197326 - DNA, 20 bp, Artificial Sequence
  Description of Artificial Sequence: Synthetic oligonucleotide
  Target: ATXN1; (-) strand; PAM type: YTN; PAM sequence: CTC
actcataggtgggaattgaa

SEQ ID NO: 197327 - DNA, 20 bp, Artificial Sequence
  Description of Artificial Sequence: Synthetic oligonucleotide
  Target: ATXN1; (-) strand; PAM type: YTN; PAM sequence: TTC
tcactcataggtgggaattg

SEQ ID NO: 197328 - DNA, 20 bp, Artificial Sequence
  Description of Artificial Sequence: Synthetic oligonucleotide
  Target: ATXN1; (-) strand; PAM type: YTN; PAM sequence: CTC
aatcgcaaggacaaaaaacc

SEQ ID NO: 197329 - DNA, 20 bp, Artificial Sequence
  Description of Artificial Sequence: Synthetic oligonucleotide
  Target: ATXN1; (-) strand; PAM type: YTN; PAM sequence: CTA
tctcaatcgcaaggacaaaa

SEQ ID NO: 197330 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcgagactatc

SEQ ID NO: 197331 - DNA, 20 bp, Artificial Sequence
  Description of Artificial Sequence: Synthetic oligonucleotide
  Target: ATXN1; (-) strand; PAM type: YTN; PAM sequence: CTC
catcctgggtgacagagcga

SEQ ID NO: 197332 - DNA, 20 bp, Artificial Sequence
  Description of Artificial Sequence: Synthetic oligonucleotide
  Target: ATXN1; (-) strand; PAM type: YTN; PAM sequence: TTG
cactccatcctgggtgacag

SEQ ID NO: 197333 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatagtgcc

SEQ ID NO: 197334 - DNA, 20 bp, Artificial Sequence
  Description of Artificial Sequence: Synthetic oligonucleotide
  Target: ATXN1; (-) strand; PAM type: YTN; PAM sequence: CTG
ggaggcgtaggttgcagtga

SEQ ID NO: 197335 - DNA, 20 bp, Artificial Sequence
  Description of Artificial Sequence: Synthetic oligonucleotide
  Target: ATXN1; (-) strand; PAM type: YTN; PAM sequence: TTG
aacctgggaggcgtaggttg

SEQ ID NO: 197336 - DNA, 20 bp, Artificial Sequence
  Description of Artificial Sequence: Synthetic oligonucleotide
  Target: ATXN1; (-) strand; PAM type: YTN; PAM sequence: CTT
gaacctgggaggcgtaggtt

SEQ ID NO: 197337 - DNA, 20 bp, Artificial Sequence
  Description of Artificial Sequence: Synthetic oligonucleotide
  Target: ATXN1; (-) strand; PAM type: YTN; PAM sequence: TTG
cttgaacctgggaggcgtag

SEQ ID NO: 197338 - DNA, 20 bp, Artificial Sequence
  Description of Artificial Sequence: Synthetic oligonucleotide
  Target: ATXN1; (-) strand; PAM type: YTN; PAM sequence: CTG
aggcgagaggattgcttgaa

SEQ ID NO: 197339 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcgagaggat

SEQ ID NO: 197340 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcgagagga

SEQ ID NO: 197341 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcgaga

SEQ ID NO: 197342 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggag

SEQ ID NO: 197343 - DNA, 20 bp, Artificial Sequence
  Description of Artificial Sequence: Synthetic oligonucleotide
  Target: ATXN1; (-) strand; PAM type: YTN; PAM sequence: CTC
atgcctgtagtcccagctac

SEQ ID NO: 197344 - DNA, 20 bp, Artificial Sequence
  Description of Artificial Sequence: Synthetic oligonucleotide
  Target: ATXN1; (-) strand; PAM type: YTN; PAM sequence: TTA
gccaggtgtggtggctcatg

SEQ ID NO: 197345 - DNA, 20 bp, Artificial Sequence
  Description of Artificial Sequence: Synthetic oligonucleotide
  Target: ATXN1; (-) strand; PAM type: YTN; PAM sequence: CTG
aaaaaacaagaattagccag

SEQ ID NO: 197346 - DNA, 20 bp, Artificial Sequence
  Description of Artificial Sequence: Synthetic oligonucleotide
  Target: ATXN1; (-) strand; PAM type: YTN; PAM sequence: CTA
ctgaaaaaacaagaattagc

SEQ ID NO: 197347 - DNA, 20 bp, Artificial Sequence
  Description of Artificial Sequence: Synthetic oligonucleotide
  Target: ATXN1; (-) strand; PAM type: YTN; PAM sequence: CTC
tactgaaaaaacaagaatta

SEQ ID NO: 197348 - DNA, 20 bp, Artificial Sequence
  Description of Artificial Sequence: Synthetic oligonucleotide
  Target: ATXN1; (-) strand; PAM type: YTN; PAM sequence: CTG
tctctactgaaaaaacaaga

SEQ ID NO: 197349 - DNA, 20 bp, Artificial Sequence
  Description of Artificial Sequence: Synthetic oligonucleotide
  Target: ATXN1; (-) strand; PAM type: YTN; PAM sequence: CTG
gacaacatggtgaaaccctg

SEQ ID NO: 197350 - DNA, 20 bp, Artificial Sequence
  Description of Artificial Sequence: Synthetic oligonucleotide
  Target: ATXN1; (-) strand; PAM type: YTN; PAM sequence: TTC
gagaccatcctggacaacat

SEQ ID NO: 197351 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacca

SEQ ID NO: 197352 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcaggtggat

SEQ ID NO: 197353 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcaggtgga

SEQ ID NO: 197354 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcaggtgg

SEQ ID NO: 197355 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 197356 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatcccagcact

SEQ ID NO: 197357 - DNA, 20 bp, Artificial Sequence
  Description of Artificial Sequence: Synthetic oligonucleotide
  Target: ATXN1; (-) strand; PAM type: YTN; PAM sequence: CTG
ggcgcagtgactcatgcctg

SEQ ID NO: 197358 - DNA, 20 bp, Artificial Sequence
  Description of Artificial Sequence: Synthetic oligonucleotide
  Target: ATXN1; (-) strand; PAM type: YTN; PAM sequence: TTG
ggctgggcgcagtgactcat

SEQ ID NO: 197359 - DNA, 20 bp, Artificial Sequence
  Description of Artificial Sequence: Synthetic oligonucleotide
  Target: ATXN1; (-) strand; PAM type: YTN; PAM sequence: TTT
gggctgggcgcagtgactca

SEQ ID NO: 197360 - DNA, 20 bp, Artificial Sequence
  Description of Artificial Sequence: Synthetic oligonucleotide
  Target: ATXN1; (-) strand; PAM type: YTN; PAM sequence: TTT
tgggctgggcgcagtgactc

SEQ ID NO: 197361 - DNA, 20 bp, Artificial Sequence
  Description of Artificial Sequence: Synthetic oligonucleotide
  Target: ATXN1; (-) strand; PAM type: YTN; PAM sequence: TTA
ttttgggctgggcgcagtga

SEQ ID NO: 197362 - DNA, 20 bp, Artificial Sequence
  Description of Artificial Sequence: Synthetic oligonucleotide
  Target: ATXN1; (-) strand; PAM type: YTN; PAM sequence: TTA
gaatagttattttgggctgg

SEQ ID NO: 197363 - DNA, 20 bp, Artificial Sequence
  Description of Artificial Sequence: Synthetic oligonucleotide
  Target: ATXN1; (-) strand; PAM type: YTN; PAM sequence: TTG
gcaggtgaaggatagtgggg

SEQ ID NO: 197364 - DNA, 20 bp, Artificial Sequence
  Description of Artificial Sequence: Synthetic oligonucleotide
  Target: ATXN1; (-) strand; PAM type: YTN; PAM sequence: TTA
gagtgggttggcaggtgaag

SEQ ID NO: 197365 - DNA, 20 bp, Artificial Sequence
  Description of Artificial Sequence: Synthetic oligonucleotide
  Target: ATXN1; (-) strand; PAM type: YTN; PAM sequence: CTT
agagtgggttggcaggtgaa

SEQ ID NO: 197366 - DNA, 20 bp, Artificial Sequence
  Description of Artificial Sequence: Synthetic oligonucleotide
  Target: ATXN1; (-) strand; PAM type: YTN; PAM sequence: CTA
aatgaacagacttagagtgg

SEQ ID NO: 197367 - DNA, 20 bp, Artificial Sequence
  Description of Artificial Sequence: Synthetic oligonucleotide
  Target: ATXN1; (-) strand; PAM type: YTN; PAM sequence: CTG
catgggaatgggtagaagtc

SEQ ID NO: 197368 - DNA, 20 bp, Artificial Sequence
  Description of Artificial Sequence: Synthetic oligonucleotide
  Target: ATXN1; (-) strand; PAM type: YTN; PAM sequence: TTC
tgcatgggaatgggtagaag

SEQ ID NO: 197369 - DNA, 20 bp, Artificial Sequence
  Description of Artificial Sequence: Synthetic oligonucleotide
  Target: ATXN1; (-) strand; PAM type: YTN; PAM sequence: TTT
ctgcatgggaatgggtagaa

SEQ ID NO: 197370 - DNA, 20 bp, Artificial Sequence
  Description of Artificial Sequence: Synthetic oligonucleotide
  Target: ATXN1; (-) strand; PAM type: YTN; PAM sequence: CTT
tctgcatgggaatgggtaga

SEQ ID NO: 197371 - DNA, 20 bp, Artificial Sequence
  Description of Artificial Sequence: Synthetic oligonucleotide
  Target: ATXN1; (-) strand; PAM type: YTN; PAM sequence: CTG
gtcctttctgcatgggaatg

SEQ ID NO: 197372 - DNA, 20 bp, Artificial Sequence
  Description of Artificial Sequence: Synthetic oligonucleotide
  Target: ATXN1; (-) strand; PAM type: YTN; PAM sequence: CTG
aactggtcctttctgcatgg

SEQ ID NO: 197373 - DNA, 20 bp, Artificial Sequence
  Description of Artificial Sequence: Synthetic oligonucleotide
  Target: ATXN1; (-) strand; PAM type: YTN; PAM sequence: TTG
ctgaactggtcctttctgca

SEQ ID NO: 197374 - DNA, 20 bp, Artificial Sequence
  Description of Artificial Sequence: Synthetic oligonucleotide
  Target: ATXN1; (-) strand; PAM type: YTN; PAM sequence: CTG
ttgctgaactggtcctttct

SEQ ID NO: 197375 - DNA, 20 bp, Artificial Sequence
  Description of Artificial Sequence: Synthetic oligonucleotide
  Target: ATXN1; (-) strand; PAM type: YTN; PAM sequence: CTG
ctgttgctgaactggtcctt

SEQ ID NO: 197376 - DNA, 20 bp, Artificial Sequence
  Description of Artificial Sequence: Synthetic oligonucleotide
  Target: ATXN1; (-) strand; PAM type: YTN; PAM sequence: CTG
ccagcatccctgctgttgct

SEQ ID NO: 197377 - DNA, 20 bp, Artificial Sequence
  Description of Artificial Sequence: Synthetic oligonucleotide
  Target: ATXN1; (-) strand; PAM type: YTN; PAM sequence: CTA
cctgccagcatccctgctgt

SEQ ID NO: 197378 - DNA, 20 bp, Artificial Sequence
  Description of Artificial Sequence: Synthetic oligonucleotide
  Target: ATXN1; (-) strand; PAM type: YTN; PAM sequence: CTA
aaacctacctgccagcatcc

SEQ ID NO: 197379 - DNA, 20 bp, Artificial Sequence
  Description of Artificial Sequence: Synthetic oligonucleotide
  Target: ATXN1; (-) strand; PAM type: YTN; PAM sequence: TTC
taaaacctacctgccagcat

SEQ ID NO: 197380 - DNA, 20 bp, Artificial Sequence
  Description of Artificial Sequence: Synthetic oligonucleotide
  Target: ATXN1; (-) strand; PAM type: YTN; PAM sequence: TTT
ctaaaacctacctgccagca

SEQ ID NO: 197381 - DNA, 20 bp, Artificial Sequence
  Description of Artificial Sequence: Synthetic oligonucleotide
  Target: ATXN1; (-) strand; PAM type: YTN; PAM sequence: TTA
agagtttctaaaacctacct

SEQ ID NO: 197382 - DNA, 20 bp, Artificial Sequence
  Description of Artificial Sequence: Synthetic oligonucleotide
  Target: ATXN1; (-) strand; PAM type: YTN; PAM sequence: CTG
tgattaagagtttctaaaac

SEQ ID NO: 197383 - DNA, 20 bp, Artificial Sequence
  Description of Artificial Sequence: Synthetic oligonucleotide
  Target: ATXN1; (-) strand; PAM type: YTN; PAM sequence: TTA
gccctgtgattaagagtttc

SEQ ID NO: 197384 - DNA, 20 bp, Artificial Sequence
  Description of Artificial Sequence: Synthetic oligonucleotide
  Target: ATXN1; (-) strand; PAM type: YTN; PAM sequence: CTG
gatcaacacattagccctgt

SEQ ID NO: 197385 - DNA, 20 bp, Artificial Sequence
  Description of Artificial Sequence: Synthetic oligonucleotide
  Target: ATXN1; (-) strand; PAM type: YTN; PAM sequence: TTA
agctggatcaacacattagc

SEQ ID NO: 197386 - DNA, 20 bp, Artificial Sequence
  Description of Artificial Sequence: Synthetic oligonucleotide
  Target: ATXN1; (-) strand; PAM type: YTN; PAM sequence: TTT
aagctggatcaacacattag

SEQ ID NO: 197387 - DNA, 20 bp, Artificial Sequence
  Description of Artificial Sequence: Synthetic oligonucleotide
  Target: ATXN1; (-) strand; PAM type: YTN; PAM sequence: CTA
tacatttaagctggatcaac

SEQ ID NO: 197388 - DNA, 20 bp, Artificial Sequence
  Description of Artificial Sequence: Synthetic oligonucleotide
  Target: ATXN1; (-) strand; PAM type: YTN; PAM sequence: TTA
gctatacatttaagctggat

SEQ ID NO: 197389 - DNA, 20 bp, Artificial Sequence
  Description of Artificial Sequence: Synthetic oligonucleotide
  Target: ATXN1; (-) strand; PAM type: YTN; PAM sequence: TTA
taaaatgaaaagtggaatga

SEQ ID NO: 197390 - DNA, 20 bp, Artificial Sequence
  Description of Artificial Sequence: Synthetic oligonucleotide
  Target: ATXN1; (-) strand; PAM type: YTN; PAM sequence: TTG
ttataaaatgaaaagtggaa

SEQ ID NO: 197391 - DNA, 20 bp, Artificial Sequence
  Description of Artificial Sequence: Synthetic oligonucleotide
  Target: ATXN1; (-) strand; PAM type: YTN; PAM sequence: CTT
gttataaaatgaaaagtgga

SEQ ID NO: 197392 - DNA, 20 bp, Artificial Sequence
  Description of Artificial Sequence: Synthetic oligonucleotide
  Target: ATXN1; (-) strand; PAM type: YTN; PAM sequence: CTG
catgcaaaaaaacccttgtt

SEQ ID NO: 197393 - DNA, 20 bp, Artificial Sequence
  Description of Artificial Sequence: Synthetic oligonucleotide
  Target: ATXN1; (-) strand; PAM type: YTN; PAM sequence: TTG
atacaagagaagagagaaag

SEQ ID NO: 197394 - DNA, 20 bp, Artificial Sequence
  Description of Artificial Sequence: Synthetic oligonucleotide
  Target: ATXN1; (-) strand; PAM type: YTN; PAM sequence: CTT
gatacaagagaagagagaaa

SEQ ID NO: 197395 - DNA, 20 bp, Artificial Sequence
  Description of Artificial Sequence: Synthetic oligonucleotide
  Target: ATXN1; (-) strand; PAM type: YTN; PAM sequence: CTG
aagatgaaaagatgcttgat

SEQ ID NO: 197396 - DNA, 20 bp, Artificial Sequence
  Description of Artificial Sequence: Synthetic oligonucleotide
  Target: ATXN1; (-) strand; PAM type: YTN; PAM sequence: TTC
agcagtggggtgggacagag

SEQ ID NO: 197397 - DNA, 20 bp, Artificial Sequence
  Description of Artificial Sequence: Synthetic oligonucleotide
  Target: ATXN1; (-) strand; PAM type: YTN; PAM sequence: TTA
aaaaattcagcagtggggtg

SEQ ID NO: 197398 - DNA, 20 bp, Artificial Sequence
  Description of Artificial Sequence: Synthetic oligonucleotide
  Target: ATXN1; (-) strand; PAM type: YTN; PAM sequence: TTT
aaaaaattcagcagtggggt

SEQ ID NO: 197399 - DNA, 20 bp, Artificial Sequence
  Description of Artificial Sequence: Synthetic oligonucleotide
  Target: ATXN1; (-) strand; PAM type: YTN; PAM sequence: TTT
taaaaaattcagcagtgggg

SEQ ID NO: 197400 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaattcagcagtggg

SEQ ID NO: 197401 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaattcagcagtgg

SEQ ID NO: 197402 - DNA, 20 bp, Artificial Sequence
  Description of Artificial Sequence: Synthetic oligonucleotide
  Target: ATXN1; (-) strand; PAM type: YTN; PAM sequence: CTT
ttttaaaaaattcagcagtg

SEQ ID NO: 197403 - DNA, 20 bp, Artificial Sequence
  Description of Artificial Sequence: Synthetic oligonucleotide
  Target: ATXN1; (-) strand; PAM type: YTN; PAM sequence: TTC
ttttttaaaaaattcagcag

SEQ ID NO: 197404 - DNA, 20 bp, Artificial Sequence
  Description of Artificial Sequence: Synthetic oligonucleotide
  Target: ATXN1; (-) strand; PAM type: YTN; PAM sequence: TTT
cttttttaaaaaattcagca

SEQ ID NO: 197405 - DNA, 20 bp, Artificial Sequence
  Description of Artificial Sequence: Synthetic oligonucleotide
  Target: ATXN1; (-) strand; PAM type: YTN; PAM sequence: TTT
tcttttttaaaaaattcagc

SEQ ID NO: 197406 - DNA, 20 bp, Artificial Sequence
  Description of Artificial Sequence: Synthetic oligonucleotide
  Target: ATXN1; (-) strand; PAM type: YTN; PAM sequence: TTT
ttcttttttaaaaaattcag

SEQ ID NO: 197407 - DNA, 20 bp, Artificial Sequence
  Description of Artificial Sequence: Synthetic oligonucleotide
  Target: ATXN1; (-) strand; PAM type: YTN; PAM sequence: TTT
tttcttttttaaaaaattca

SEQ ID NO: 197408 - DNA, 20 bp, Artificial Sequence
  Description of Artificial Sequence: Synthetic oligonucleotide
  Target: ATXN1; (-) strand; PAM type: YTN; PAM sequence: CTT
ttttcttttttaaaaaattc

SEQ ID NO: 197409 - DNA, 20 bp, Artificial Sequence
  Description of Artificial Sequence: Synthetic oligonucleotide
  Target: ATXN1; (-) strand; PAM type: YTN; PAM sequence: TTC
ttttttcttttttaaaaaat

SEQ ID NO: 197410 - DNA, 20 bp, Artificial Sequence
  Description of Artificial Sequence: Synthetic oligonucleotide
  Target: ATXN1; (-) strand; PAM type: YTN; PAM sequence: TTT
cttttttcttttttaaaaaa

SEQ ID NO: 197411 - DNA, 20 bp, Artificial Sequence
  Description of Artificial Sequence: Synthetic oligonucleotide
  Target: ATXN1; (-) strand; PAM type: YTN; PAM sequence: CTG
ggtttcttttttctttttta

SEQ ID NO: 197412 - DNA, 20 bp, Artificial Sequence
  Description of Artificial Sequence: Synthetic oligonucleotide
  Target: ATXN1; (-) strand; PAM type: YTN; PAM sequence: TTG
gctgggtttcttttttcttt

SEQ ID NO: 197413 - DNA, 20 bp, Artificial Sequence
  Description of Artificial Sequence: Synthetic oligonucleotide
  Target: ATXN1; (-) strand; PAM type: YTN; PAM sequence: CTA
gttggctgggtttctttttt

SEQ ID NO: 197414 - DNA, 20 bp, Artificial Sequence
  Description of Artificial Sequence: Synthetic oligonucleotide
  Target: ATXN1; (-) strand; PAM type: YTN; PAM sequence: CTG
agctagttggctgggtttct

SEQ ID NO: 197415 - DNA, 20 bp, Artificial Sequence
  Description of Artificial Sequence: Synthetic oligonucleotide
  Target: ATXN1; (-) strand; PAM type: YTN; PAM sequence: CTC
tgagctagttggctgggttt

SEQ ID NO: 197416 - DNA, 20 bp, Artificial Sequence
  Description of Artificial Sequence: Synthetic oligonucleotide
  Target: ATXN1; (-) strand; PAM type: YTN; PAM sequence: TTC
agagcaaaatacataggcct

SEQ ID NO: 197417 - DNA, 20 bp, Artificial Sequence
  Description of Artificial Sequence: Synthetic oligonucleotide
  Target: ATXN1; (-) strand; PAM type: YTN; PAM sequence: CTG
tgtataatatcgtcagtgtg

SEQ ID NO: 197418 - DNA, 20 bp, Artificial Sequence
  Description of Artificial Sequence: Synthetic oligonucleotide
  Target: ATXN1; (-) strand; PAM type: YTN; PAM sequence: CTG
ccatgactgtgtataatatc

SEQ ID NO: 197419 - DNA, 20 bp, Artificial Sequence
  Description of Artificial Sequence: Synthetic oligonucleotide
  Target: ATXN1; (-) strand; PAM type: YTN; PAM sequence: TTC
catgaccgtgtataatacag

SEQ ID NO: 197420 - DNA, 20 bp, Artificial Sequence
  Description of Artificial Sequence: Synthetic oligonucleotide
  Target: ATXN1; (-) strand; PAM type: YTN; PAM sequence: CTT
ccatgaccgtgtataataca

SEQ ID NO: 197421 - DNA, 20 bp, Artificial Sequence
  Description of Artificial Sequence: Synthetic oligonucleotide
  Target: ATXN1; (-) strand; PAM type: YTN; PAM sequence: CTC
cataacttccatgaccgtgt

SEQ ID NO: 197422 - DNA, 20 bp, Artificial Sequence
  Description of Artificial Sequence: Synthetic oligonucleotide
  Target: ATXN1; (-) strand; PAM type: YTN; PAM sequence: TTC
tccataacttccatgaccgt

SEQ ID NO: 197423 - DNA, 20 bp, Artificial Sequence
  Description of Artificial Sequence: Synthetic oligonucleotide
  Target: ATXN1; (-) strand; PAM type: YTN; PAM sequence: TTC
caattctccataacttccat

SEQ ID NO: 197424 - DNA, 20 bp, Artificial Sequence
  Description of Artificial Sequence: Synthetic oligonucleotide
  Target: ATXN1; (-) strand; PAM type: YTN; PAM sequence: TTA
gattccaattctccataact

SEQ ID NO: 197425 - DNA, 20 bp, Artificial Sequence
  Description of Artificial Sequence: Synthetic oligonucleotide
  Target: ATXN1; (-) strand; PAM type: YTN; PAM sequence: TTC
attagattccaattctccat

SEQ ID NO: 197426 - DNA, 20 bp, Artificial Sequence
  Description of Artificial Sequence: Synthetic oligonucleotide
  Target: ATXN1; (-) strand; PAM type: YTN; PAM sequence: TTT
cattagattccaattctcca

SEQ ID NO: 197427 - DNA, 20 bp, Artificial Sequence
  Description of Artificial Sequence: Synthetic oligonucleotide
  Target: ATXN1; (-) strand; PAM type: YTN; PAM sequence: TTT
tcattagattccaattctcc

SEQ ID NO: 197428 - DNA, 20 bp, Artificial Sequence
  Description of Artificial Sequence: Synthetic oligonucleotide
  Target: ATXN1; (-) strand; PAM type: YTN; PAM sequence: CTT
ttcattagattccaattctc

SEQ ID NO: 197429 - DNA, 20 bp, Artificial Sequence
  Description of Artificial Sequence: Synthetic oligonucleotide
  Target: ATXN1; (-) strand; PAM type: YTN; PAM sequence: CTC
ttttcattagattccaattc

SEQ ID NO: 197430 - DNA, 20 bp, Artificial Sequence
  Description of Artificial Sequence: Synthetic oligonucleotide
  Target: ATXN1; (-) strand; PAM type: YTN; PAM sequence: TTA
tctcttttcattagattcca

SEQ ID NO: 197431 - DNA, 20 bp, Artificial Sequence
  Description of Artificial Sequence: Synthetic oligonucleotide
  Target: ATXN1; (-) strand; PAM type: YTN; PAM sequence: CTT
atctcttttcattagattcc

SEQ ID NO: 197432 - DNA, 20 bp, Artificial Sequence
  Description of Artificial Sequence: Synthetic oligonucleotide
  Target: ATXN1; (-) strand; PAM type: YTN; PAM sequence: CTC
ttatctcttttcattagatt

SEQ ID NO: 197433 - DNA, 20 bp, Artificial Sequence
  Description of Artificial Sequence: Synthetic oligonucleotide
  Target: ATXN1; (-) strand; PAM type: YTN; PAM sequence: CTC
tcttatctcttttcattaga

SEQ ID NO: 197434 - DNA, 20 bp, Artificial Sequence
  Description of Artificial Sequence: Synthetic oligonucleotide
  Target: ATXN1; (-) strand; PAM type: YTN; PAM sequence: CTC
ctctcttatctcttttcatt

SEQ ID NO: 197435 - DNA, 20 bp, Artificial Sequence
  Description of Artificial Sequence: Synthetic oligonucleotide
  Target: ATXN1; (-) strand; PAM type: YTN; PAM sequence: CTG
ctcctctcttatctcttttc

SEQ ID NO: 197436 - DNA, 20 bp, Artificial Sequence
  Description of Artificial Sequence: Synthetic oligonucleotide
  Target: ATXN1; (-) strand; PAM type: YTN; PAM sequence: CTC
tgctcctctcttatctcttt

SEQ ID NO: 197437 - DNA, 20 bp, Artificial Sequence
  Description of Artificial Sequence: Synthetic oligonucleotide
  Target: ATXN1; (-) strand; PAM type: YTN; PAM sequence: CTC
tctgctcctctcttatctct

SEQ ID NO: 197438 - DNA, 20 bp, Artificial Sequence
  Description of Artificial Sequence: Synthetic oligonucleotide
  Target: ATXN1; (-) strand; PAM type: YTN; PAM sequence: TTA
tctctctgctcctctcttat

SEQ ID NO: 197439 - DNA, 20 bp, Artificial Sequence
  Description of Artificial Sequence: Synthetic oligonucleotide
  Target: ATXN1; (-) strand; PAM type: YTN; PAM sequence: TTT
atctctctgctcctctctta

SEQ ID NO: 197440 - DNA, 20 bp, Artificial Sequence
  Description of Artificial Sequence: Synthetic oligonucleotide
  Target: ATXN1; (-) strand; PAM type: YTN; PAM sequence: CTT
tatctctctgctcctctctt

SEQ ID NO: 197441 - DNA, 20 bp, Artificial Sequence
  Description of Artificial Sequence: Synthetic oligonucleotide
  Target: ATXN1; (-) strand; PAM type: YTN; PAM sequence: TTC
ctttatctctctgctcctct

SEQ ID NO: 197442 - DNA, 20 bp, Artificial Sequence
  Description of Artificial Sequence: Synthetic oligonucleotide
  Target: ATXN1; (-) strand; PAM type: YTN; PAM sequence: TTC
aagggttcctttatctctct

SEQ ID NO: 197443 - DNA, 20 bp, Artificial Sequence
  Description of Artificial Sequence: Synthetic oligonucleotide
  Target: ATXN1; (-) strand; PAM type: YTN; PAM sequence: TTT
caagggttcctttatctctc

SEQ ID NO: 197444 - DNA, 20 bp, Artificial Sequence
  Description of Artificial Sequence: Synthetic oligonucleotide
  Target: ATXN1; (-) strand; PAM type: YTN; PAM sequence: TTT
tcaagggttcctttatctct

SEQ ID NO: 197445 - DNA, 20 bp, Artificial Sequence
  Description of Artificial Sequence: Synthetic oligonucleotide
  Target: ATXN1; (-) strand; PAM type: YTN; PAM sequence: CTG
attttcaagggttcctttat

SEQ ID NO: 197446 - DNA, 20 bp, Artificial Sequence
  Description of Artificial Sequence: Synthetic oligonucleotide
  Target: ATXN1; (-) strand; PAM type: YTN; PAM sequence: TTG
gggctgattttcaagggttc

SEQ ID NO: 197447 - DNA, 20 bp, Artificial Sequence
  Description of Artificial Sequence: Synthetic oligonucleotide
  Target: ATXN1; (-) strand; PAM type: YTN; PAM sequence: CTG
ggtgagatattggggctgat

SEQ ID NO: 197448 - DNA, 20 bp, Artificial Sequence
  Description of Artificial Sequence: Synthetic oligonucleotide
  Target: ATXN1; (-) strand; PAM type: YTN; PAM sequence: CTG
aggccacccatatctgggtg

SEQ ID NO: 197449 - DNA, 20 bp, Artificial Sequence
  Description of Artificial Sequence: Synthetic oligonucleotide
  Target: ATXN1; (-) strand; PAM type: YTN; PAM sequence: CTC
tgaggccacccatatctggg

SEQ ID NO: 197450 - DNA, 20 bp, Artificial Sequence
  Description of Artificial Sequence: Synthetic oligonucleotide
  Target: ATXN1; (-) strand; PAM type: YTN; PAM sequence: CTA
tatcaataagctctgaggcc

SEQ ID NO: 197451 - DNA, 20 bp, Artificial Sequence
  Description of Artificial Sequence: Synthetic oligonucleotide
  Target: ATXN1; (-) strand; PAM type: YTN; PAM sequence: TTG
gtgagagacacagtctatat

SEQ ID NO: 197452 - DNA, 20 bp, Artificial Sequence
  Description of Artificial Sequence: Synthetic oligonucleotide
  Target: ATXN1; (-) strand; PAM type: YTN; PAM sequence: TTT
ggtgagagacacagtctata

SEQ ID NO: 197453 - DNA, 20 bp, Artificial Sequence
  Description of Artificial Sequence: Synthetic oligonucleotide
  Target: ATXN1; (-) strand; PAM type: YTN; PAM sequence: CTT
tggtgagagacacagtctat

SEQ ID NO: 197454 - DNA, 20 bp, Artificial Sequence
  Description of Artificial Sequence: Synthetic oligonucleotide
  Target: ATXN1; (-) strand; PAM type: YTN; PAM sequence: TTA
aagaaatgatggcaagcaaa

SEQ ID NO: 197455 - DNA, 20 bp, Artificial Sequence
  Description of Artificial Sequence: Synthetic oligonucleotide
  Target: ATXN1; (-) strand; PAM type: YTN; PAM sequence: TTT
aaagaaatgatggcaagcaa

SEQ ID NO: 197456 - DNA, 20 bp, Artificial Sequence
  Description of Artificial Sequence: Synthetic oligonucleotide
  Target: ATXN1; (-) strand; PAM type: YTN; PAM sequence: TTT
taaagaaatgatggcaagca

SEQ ID NO: 197457 - DNA, 20 bp, Artificial Sequence
  Description of Artificial Sequence: Synthetic oligonucleotide
  Target: ATXN1; (-) strand; PAM type: YTN; PAM sequence: CTA
atagttttaaagaaatgatg

SEQ ID NO: 197458 - DNA, 20 bp, Artificial Sequence
  Description of Artificial Sequence: Synthetic oligonucleotide
  Target: ATXN1; (-) strand; PAM type: YTN; PAM sequence: TTA
aaggtaaatcggtgtgagag

SEQ ID NO: 197459 - DNA, 20 bp, Artificial Sequence
  Description of Artificial Sequence: Synthetic oligonucleotide
  Target: ATXN1; (-) strand; PAM type: YTN; PAM sequence: TTT
aaaggtaaatcggtgtgaga

SEQ ID NO: 197460 - DNA, 20 bp, Artificial Sequence
  Description of Artificial Sequence: Synthetic oligonucleotide
  Target: ATXN1; (-) strand; PAM type: YTN; PAM sequence: TTG
tttaaaggtaaatcggtgtg

SEQ ID NO: 197461 - DNA, 20 bp, Artificial Sequence
  Description of Artificial Sequence: Synthetic oligonucleotide
  Target: ATXN1; (-) strand; PAM type: YTN; PAM sequence: CTT
gtttaaaggtaaatcggtgt

SEQ ID NO: 197462 - DNA, 20 bp, Artificial Sequence
  Description of Artificial Sequence: Synthetic oligonucleotide
  Target: ATXN1; (-) strand; PAM type: YTN; PAM sequence: TTA
tagaatgtccttgtttaaag

SEQ ID NO: 197463 - DNA, 20 bp, Artificial Sequence
  Description of Artificial Sequence: Synthetic oligonucleotide
  Target: ATXN1; (-) strand; PAM type: YTN; PAM sequence: CTG
gttatagaatgtccttgttt

SEQ ID NO: 197464 - DNA, 20 bp, Artificial Sequence
  Description of Artificial Sequence: Synthetic oligonucleotide
  Target: ATXN1; (-) strand; PAM type: YTN; PAM sequence: CTA
agccacagaggtggatccct

SEQ ID NO: 197465 - DNA, 20 bp, Artificial Sequence
  Description of Artificial Sequence: Synthetic oligonucleotide
  Target: ATXN1; (-) strand; PAM type: YTN; PAM sequence: CTG
atccgatgactaagccacag

SEQ ID NO: 197466 - DNA, 20 bp, Artificial Sequence
  Description of Artificial Sequence: Synthetic oligonucleotide
  Target: ATXN1; (-) strand; PAM type: YTN; PAM sequence: TTG
aggctgatccgatgactaag

SEQ ID NO: 197467 - DNA, 20 bp, Artificial Sequence
  Description of Artificial Sequence: Synthetic oligonucleotide
  Target: ATXN1; (-) strand; PAM type: YTN; PAM sequence: CTT
gaggctgatccgatgactaa

SEQ ID NO: 197468 - DNA, 20 bp, Artificial Sequence
  Description of Artificial Sequence: Synthetic oligonucleotide
  Target: ATXN1; (-) strand; PAM type: YTN; PAM sequence: CTA
gtcggtgaccttgaggctga

SEQ ID NO: 197469 - DNA, 20 bp, Artificial Sequence
  Description of Artificial Sequence: Synthetic oligonucleotide
  Target: ATXN1; (-) strand; PAM type: YTN; PAM sequence: CTC
tagtcggtgaccttgaggct

SEQ ID NO: 197470 - DNA, 20 bp, Artificial Sequence
  Description of Artificial Sequence: Synthetic oligonucleotide
  Target: ATXN1; (-) strand; PAM type: YTN; PAM sequence: TTA
ctctagtcggtgaccttgag

SEQ ID NO: 197471 - DNA, 20 bp, Artificial Sequence
  Description of Artificial Sequence: Synthetic oligonucleotide
  Target: ATXN1; (-) strand; PAM type: YTN; PAM sequence: TTG
tcatcaggttactctagtcg

SEQ ID NO: 197472 - DNA, 20 bp, Artificial Sequence
  Description of Artificial Sequence: Synthetic oligonucleotide
  Target: ATXN1; (-) strand; PAM type: YTN; PAM sequence: CTA
tagtgggtgaatgaggtaat

SEQ ID NO: 197473 - DNA, 20 bp, Artificial Sequence
  Description of Artificial Sequence: Synthetic oligonucleotide
  Target: ATXN1; (-) strand; PAM type: YTN; PAM sequence: TTC
tatagtgggtgaatgaggta

SEQ ID NO: 197474 - DNA, 20 bp, Artificial Sequence
  Description of Artificial Sequence: Synthetic oligonucleotide
  Target: ATXN1; (-) strand; PAM type: YTN; PAM sequence: CTG
ttctatagtgggtgaatgag

SEQ ID NO: 197475 - DNA, 20 bp, Artificial Sequence
  Description of Artificial Sequence: Synthetic oligonucleotide
  Target: ATXN1; (-) strand; PAM type: YTN; PAM sequence: TTG
atcggtgatagaactgttct

SEQ ID NO: 197476 - DNA, 20 bp, Artificial Sequence
  Description of Artificial Sequence: Synthetic oligonucleotide
  Target: ATXN1; (-) strand; PAM type: YTN; PAM sequence: CTG
tattgatcggtgatagaact

SEQ ID NO: 197477 - DNA, 20 bp, Artificial Sequence
  Description of Artificial Sequence: Synthetic oligonucleotide
  Target: ATXN1; (-) strand; PAM type: YTN; PAM sequence: TTG
tgcagaggtgtcctgtattg

SEQ ID NO: 197478 - DNA, 20 bp, Artificial Sequence
  Description of Artificial Sequence: Synthetic oligonucleotide
  Target: ATXN1; (-) strand; PAM type: YTN; PAM sequence: TTG
atgttgtgcagaggtgtcct

SEQ ID NO: 197479 - DNA, 20 bp, Artificial Sequence
  Description of Artificial Sequence: Synthetic oligonucleotide
  Target: ATXN1; (-) strand; PAM type: YTN; PAM sequence: TTG
ttgatgttgtgcagaggtgt

SEQ ID NO: 197480 - DNA, 20 bp, Artificial Sequence
  Description of Artificial Sequence: Synthetic oligonucleotide
  Target: ATXN1; (-) strand; PAM type: YTN; PAM sequence: TTT
gttgatgttgtgcagaggtg

SEQ ID NO: 197481 - DNA, 20 bp, Artificial Sequence
  Description of Artificial Sequence: Synthetic oligonucleotide
  Target: ATXN1; (-) strand; PAM type: YTN; PAM sequence: CTT
tgttgatgttgtgcagaggt

SEQ ID NO: 197482 - DNA, 20 bp, Artificial Sequence
  Description of Artificial Sequence: Synthetic oligonucleotide
  Target: ATXN1; (-) strand; PAM type: YTN; PAM sequence: TTG
agaaggctttgttgatgttg

SEQ ID NO: 197483 - DNA, 20 bp, Artificial Sequence
  Description of Artificial Sequence: Synthetic oligonucleotide
  Target: ATXN1; (-) strand; PAM type: YTN; PAM sequence: CTT
gagaaggctttgttgatgtt

SEQ ID NO: 197484 - DNA, 20 bp, Artificial Sequence
  Description of Artificial Sequence: Synthetic oligonucleotide
  Target: ATXN1; (-) strand; PAM type: YTN; PAM sequence: CTG
atgcatgcagggtgccccct

SEQ ID NO: 197485 - DNA, 20 bp, Artificial Sequence
  Description of Artificial Sequence: Synthetic oligonucleotide
  Target: ATXN1; (-) strand; PAM type: YTN; PAM sequence: TTC
tgatgcatgcagggtgcccc

SEQ ID NO: 197486 - DNA, 20 bp, Artificial Sequence
  Description of Artificial Sequence: Synthetic oligonucleotide
  Target: ATXN1; (-) strand; PAM type: YTN; PAM sequence: TTT
ctgatgcatgcagggtgccc

SEQ ID NO: 197487 - DNA, 20 bp, Artificial Sequence
  Description of Artificial Sequence: Synthetic oligonucleotide
  Target: ATXN1; (-) strand; PAM type: YTN; PAM sequence: TTG
tttctgatgcatgcagggtg

SEQ ID NO: 197488 - DNA, 20 bp, Artificial Sequence
  Description of Artificial Sequence: Synthetic oligonucleotide
  Target: ATXN1; (-) strand; PAM type: YTN; PAM sequence: TTT
gtttctgatgcatgcagggt

SEQ ID NO: 197489 - DNA, 20 bp, Artificial Sequence
  Description of Artificial Sequence: Synthetic oligonucleotide
  Target: ATXN1; (-) strand; PAM type: YTN; PAM sequence: CTA
agggtgtaatttgtttctga

SEQ ID NO: 197490 - DNA, 20 bp, Artificial Sequence
  Description of Artificial Sequence: Synthetic oligonucleotide
  Target: ATXN1; (-) strand; PAM type: YTN; PAM sequence: CTC
taagggtgtaatttgtttct

SEQ ID NO: 197491 - DNA, 20 bp, Artificial Sequence
  Description of Artificial Sequence: Synthetic oligonucleotide
  Target: ATXN1; (-) strand; PAM type: YTN; PAM sequence: CTG
cctctaagggtgtaatttgt

SEQ ID NO: 197492 - DNA, 20 bp, Artificial Sequence
  Description of Artificial Sequence: Synthetic oligonucleotide
  Target: ATXN1; (-) strand; PAM type: YTN; PAM sequence: TTC
ggtgtgtcatctgcctctaa

SEQ ID NO: 197493 - DNA, 20 bp, Artificial Sequence
  Description of Artificial Sequence: Synthetic oligonucleotide
  Target: ATXN1; (-) strand; PAM type: YTN; PAM sequence: CTT
cggtgtgtcatctgcctcta

SEQ ID NO: 197494 - DNA, 20 bp, Artificial Sequence
  Description of Artificial Sequence: Synthetic oligonucleotide
  Target: ATXN1; (-) strand; PAM type: YTN; PAM sequence: CTG
ccttcggtgtgtcatctgcc

SEQ ID NO: 197495 - DNA, 20 bp, Artificial Sequence
  Description of Artificial Sequence: Synthetic oligonucleotide
  Target: ATXN1; (-) strand; PAM type: YTN; PAM sequence: TTC
tgccttcggtgtgtcatctg

SEQ ID NO: 197496 - DNA, 20 bp, Artificial Sequence
  Description of Artificial Sequence: Synthetic oligonucleotide
  Target: ATXN1; (-) strand; PAM type: YTN; PAM sequence: TTT
ctgccttcggtgtgtcatct

SEQ ID NO: 197497 - DNA, 20 bp, Artificial Sequence
  Description of Artificial Sequence: Synthetic oligonucleotide
  Target: ATXN1; (-) strand; PAM type: YTN; PAM sequence: CTT
tctgccttcggtgtgtcatc

SEQ ID NO: 197498 - DNA, 20 bp, Artificial Sequence
  Description of Artificial Sequence: Synthetic oligonucleotide
  Target: ATXN1; (-) strand; PAM type: YTN; PAM sequence: TTG
cagagaggatctttctgcct

SEQ ID NO: 197499 - DNA, 20 bp, Artificial Sequence
  Description of Artificial Sequence: Synthetic oligonucleotide
  Target: ATXN1; (-) strand; PAM type: YTN; PAM sequence: TTT
gcagagaggatctttctgcc

SEQ ID NO: 197500 - DNA, 20 bp, Artificial Sequence
  Description of Artificial Sequence: Synthetic oligonucleotide
  Target: ATXN1; (-) strand; PAM type: YTN; PAM sequence: CTT
tgcagagaggatctttctgc

SEQ ID NO: 197501 - DNA, 20 bp, Artificial Sequence
  Description of Artificial Sequence: Synthetic oligonucleotide
  Target: ATXN1; (-) strand; PAM type: YTN; PAM sequence: TTG
ctttgcagagaggatctttc

SEQ ID NO: 197502 - DNA, 20 bp, Artificial Sequence
  Description of Artificial Sequence: Synthetic oligonucleotide
  Target: ATXN1; (-) strand; PAM type: YTN; PAM sequence: TTT
gctttgcagagaggatcttt

SEQ ID NO: 197503 - DNA, 20 bp, Artificial Sequence
  Description of Artificial Sequence: Synthetic oligonucleotide
  Target: ATXN1; (-) strand; PAM type: YTN; PAM sequence: CTT
tgctttgcagagaggatctt

SEQ ID NO: 197504 - DNA, 20 bp, Artificial Sequence
  Description of Artificial Sequence: Synthetic oligonucleotide
  Target: ATXN1; (-) strand; PAM type: YTN; PAM sequence: TTA
aacaaaggctttgctttgca

SEQ ID NO: 197505 - DNA, 20 bp, Artificial Sequence
  Description of Artificial Sequence: Synthetic oligonucleotide
  Target: ATXN1; (-) strand; PAM type: YTN; PAM sequence: CTT
aaacaaaggctttgctttgc

SEQ ID NO: 197506 - DNA, 20 bp, Artificial Sequence
  Description of Artificial Sequence: Synthetic oligonucleotide
  Target: ATXN1; (-) strand; PAM type: YTN; PAM sequence: CTC
agacttaaacaaaggctttg

SEQ ID NO: 197507 - DNA, 20 bp, Artificial Sequence
  Description of Artificial Sequence: Synthetic oligonucleotide
  Target: ATXN1; (-) strand; PAM type: YTN; PAM sequence: CTC
tcagacttaaacaaaggctt

SEQ ID NO: 197508 - DNA, 20 bp, Artificial Sequence
  Description of Artificial Sequence: Synthetic oligonucleotide
  Target: ATXN1; (-) strand; PAM type: YTN; PAM sequence: CTC
ctctcagacttaaacaaagg

SEQ ID NO: 197509 - DNA, 20 bp, Artificial Sequence
  Description of Artificial Sequence: Synthetic oligonucleotide
  Target: ATXN1; (-) strand; PAM type: YTN; PAM sequence: TTG
gcactcctctcagacttaaa

SEQ ID NO: 197510 - DNA, 20 bp, Artificial Sequence
  Description of Artificial Sequence: Synthetic oligonucleotide
  Target: ATXN1; (-) strand; PAM type: YTN; PAM sequence: TTG
gattggcactcctctcagac

SEQ ID NO: 197511 - DNA, 20 bp, Artificial Sequence
  Description of Artificial Sequence: Synthetic oligonucleotide
  Target: ATXN1; (-) strand; PAM type: YTN; PAM sequence: TTG
aggttggattggcactcctc

SEQ ID NO: 197512 - DNA, 20 bp, Artificial Sequence
  Description of Artificial Sequence: Synthetic oligonucleotide
  Target: ATXN1; (-) strand; PAM type: YTN; PAM sequence: TTT
gaggttggattggcactcct

SEQ ID NO: 197513 - DNA, 20 bp, Artificial Sequence
  Description of Artificial Sequence: Synthetic oligonucleotide
  Target: ATXN1; (-) strand; PAM type: YTN; PAM sequence: TTT
tgaggttggattggcactcc

SEQ ID NO: 197514 - DNA, 20 bp, Artificial Sequence
  Description of Artificial Sequence: Synthetic oligonucleotide
  Target: ATXN1; (-) strand; PAM type: YTN; PAM sequence: TTT
ttgaggttggattggcactc

SEQ ID NO: 197515 - DNA, 20 bp, Artificial Sequence
  Description of Artificial Sequence: Synthetic oligonucleotide
  Target: ATXN1; (-) strand; PAM type: YTN; PAM sequence: TTT
tttgaggttggattggcact

SEQ ID NO: 197516 - DNA, 20 bp, Artificial Sequence
  Description of Artificial Sequence: Synthetic oligonucleotide
  Target: ATXN1; (-) strand; PAM type: YTN; PAM sequence: TTT
ttttgaggttggattggcac

SEQ ID NO: 197517 - DNA, 20 bp, Artificial Sequence
  Description of Artificial Sequence: Synthetic oligonucleotide
  Target: ATXN1; (-) strand; PAM type: YTN; PAM sequence: CTT
tttttgaggttggattggca

SEQ ID NO: 197518 - DNA, 20 bp, Artificial Sequence
  Description of Artificial Sequence: Synthetic oligonucleotide
  Target: ATXN1; (-) strand; PAM type: YTN; PAM sequence: CTC
ctttttttgaggttggattg

SEQ ID NO: 197519 - DNA, 20 bp, Artificial Sequence
  Description of Artificial Sequence: Synthetic oligonucleotide
  Target: ATXN1; (-) strand; PAM type: YTN; PAM sequence: TTC
tcctttttttgaggttggat

SEQ ID NO: 197520 - DNA, 20 bp, Artificial Sequence
  Description of Artificial Sequence: Synthetic oligonucleotide
  Target: ATXN1; (-) strand; PAM type: YTN; PAM sequence: TTT
ctcctttttttgaggttgga

SEQ ID NO: 197521 - DNA, 20 bp, Artificial Sequence
  Description of Artificial Sequence: Synthetic oligonucleotide
  Target: ATXN1; (-) strand; PAM type: YTN; PAM sequence: TTT
tctcctttttttgaggttgg

SEQ ID NO: 197522 - DNA, 20 bp, Artificial Sequence
  Description of Artificial Sequence: Synthetic oligonucleotide
  Target: ATXN1; (-) strand; PAM type: YTN; PAM sequence: CTT
ttctcctttttttgaggttg

SEQ ID NO: 197523 - DNA, 20 bp, Artificial Sequence
  Description of Artificial Sequence: Synthetic oligonucleotide
  Target: ATXN1; (-) strand; PAM type: YTN; PAM sequence: CTC
cttttctcctttttttgagg

SEQ ID NO: 197524 - DNA, 20 bp, Artificial Sequence
  Description of Artificial Sequence: Synthetic oligonucleotide
  Target: ATXN1; (-) strand; PAM type: YTN; PAM sequence: CTC
tccttttctcctttttttga

SEQ ID NO: 197525 - DNA, 20 bp, Artificial Sequence
  Description of Artificial Sequence: Synthetic oligonucleotide
  Target: ATXN1; (-) strand; PAM type: YTN; PAM sequence: TTC
ctctccttttctcctttttt

SEQ ID NO: 197526 - DNA, 20 bp, Artificial Sequence
  Description of Artificial Sequence: Synthetic oligonucleotide
  Target: ATXN1; (-) strand; PAM type: YTN; PAM sequence: TTT
cctctccttttctccttttt

SEQ ID NO: 197527 - DNA, 20 bp, Artificial Sequence
  Description of Artificial Sequence: Synthetic oligonucleotide
  Target: ATXN1; (-) strand; PAM type: YTN; PAM sequence: CTT
tcctctccttttctcctttt

SEQ ID NO: 197528 - DNA, 20 bp, Artificial Sequence
  Description of Artificial Sequence: Synthetic oligonucleotide
  Target: ATXN1; (-) strand; PAM type: YTN; PAM sequence: CTC
tttcctctccttttctcctt

SEQ ID NO: 197529 - DNA, 20 bp, Artificial Sequence
  Description of Artificial Sequence: Synthetic oligonucleotide
  Target: ATXN1; (-) strand; PAM type: YTN; PAM sequence: CTG
tggcatggatcctctttcct

SEQ ID NO: 197530 - DNA, 20 bp, Artificial Sequence
  Description of Artificial Sequence: Synthetic oligonucleotide
  Target: ATXN1; (-) strand; PAM type: YTN; PAM sequence: TTC
tgtggcatggatcctctttc

SEQ ID NO: 197531 - DNA, 20 bp, Artificial Sequence
  Description of Artificial Sequence: Synthetic oligonucleotide
  Target: ATXN1; (-) strand; PAM type: YTN; PAM sequence: TTT
ctgtggcatggatcctcttt

SEQ ID NO: 197532 - DNA, 20 bp, Artificial Sequence
  Description of Artificial Sequence: Synthetic oligonucleotide
  Target: ATXN1; (-) strand; PAM type: YTN; PAM sequence: CTG
tttctgtggcatggatcctc

SEQ ID NO: 197533 - DNA, 20 bp, Artificial Sequence
  Description of Artificial Sequence: Synthetic oligonucleotide
  Target: ATXN1; (-) strand; PAM type: YTN; PAM sequence: CTC
tgtttctgtggcatggatcc

SEQ ID NO: 197534 - DNA, 20 bp, Artificial Sequence
  Description of Artificial Sequence: Synthetic oligonucleotide
  Target: ATXN1; (-) strand; PAM type: YTN; PAM sequence: TTC
cgaacagtactctgtttctg

SEQ ID NO: 197535 - DNA, 20 bp, Artificial Sequence
  Description of Artificial Sequence: Synthetic oligonucleotide
  Target: ATXN1; (-) strand; PAM type: YTN; PAM sequence: TTC
gagcggaaaggcaagggaaa

SEQ ID NO: 197536 - DNA, 20 bp, Artificial Sequence
  Description of Artificial Sequence: Synthetic oligonucleotide
  Target: ATXN1; (-) strand; PAM type: YTN; PAM sequence: TTC
cccagaagatgcatcccgtg

SEQ ID NO: 197537 - DNA, 20 bp, Artificial Sequence
  Description of Artificial Sequence: Synthetic oligonucleotide
  Target: ATXN1; (-) strand; PAM type: YTN; PAM sequence: CTT
ccccagaagatgcatcccgt

SEQ ID NO: 197538 - DNA, 20 bp, Artificial Sequence
  Description of Artificial Sequence: Synthetic oligonucleotide
  Target: ATXN1; (-) strand; PAM type: YTN; PAM sequence: CTC
ttccccagaagatgcatccc

SEQ ID NO: 197539 - DNA, 20 bp, Artificial Sequence
  Description of Artificial Sequence: Synthetic oligonucleotide
  Target: ATXN1; (-) strand; PAM type: YTN; PAM sequence: TTC
tcttccccagaagatgcatc

SEQ ID NO: 197540 - DNA, 20 bp, Artificial Sequence
  Description of Artificial Sequence: Synthetic oligonucleotide
  Target: ATXN1; (-) strand; PAM type: YTN; PAM sequence: TTT
ctcttccccagaagatgcat

SEQ ID NO: 197541 - DNA, 20 bp, Artificial Sequence
  Description of Artificial Sequence: Synthetic oligonucleotide
  Target: ATXN1; (-) strand; PAM type: YTN; PAM sequence: TTT
tctcttccccagaagatgca

SEQ ID NO: 197542 - DNA, 20 bp, Artificial Sequence
  Description of Artificial Sequence: Synthetic oligonucleotide
  Target: ATXN1; (-) strand; PAM type: YTN; PAM sequence: TTC
cagttttctcttccccagaa

SEQ ID NO: 197543 - DNA, 20 bp, Artificial Sequence
  Description of Artificial Sequence: Synthetic oligonucleotide
  Target: ATXN1; (-) strand; PAM type: YTN; PAM sequence: CTT
ccagttttctcttccccaga

SEQ ID NO: 197544 - DNA, 20 bp, Artificial Sequence
  Description of Artificial Sequence: Synthetic oligonucleotide
  Target: ATXN1; (-) strand; PAM type: YTN; PAM sequence: TTG
cacttccagttttctcttcc

SEQ ID NO: 197545 - DNA, 20 bp, Artificial Sequence
  Description of Artificial Sequence: Synthetic oligonucleotide
  Target: ATXN1; (-) strand; PAM type: YTN; PAM sequence: CTG
tcattgcacttccagttttc

SEQ ID NO: 197546 - DNA, 20 bp, Artificial Sequence
  Description of Artificial Sequence: Synthetic oligonucleotide
  Target: ATXN1; (-) strand; PAM type: YTN; PAM sequence: TTG
cagtcccctgtcattgcact

SEQ ID NO: 197547 - DNA, 20 bp, Artificial Sequence
  Description of Artificial Sequence: Synthetic oligonucleotide
  Target: ATXN1; (-) strand; PAM type: YTN; PAM sequence: CTC
agcattgcagtcccctgtca

SEQ ID NO: 197548 - DNA, 20 bp, Artificial Sequence
  Description of Artificial Sequence: Synthetic oligonucleotide
  Target: ATXN1; (-) strand; PAM type: YTN; PAM sequence: TTC
tcagcattgcagtcccctgt

SEQ ID NO: 197549 - DNA, 20 bp, Artificial Sequence
  Description of Artificial Sequence: Synthetic oligonucleotide
  Target: ATXN1; (-) strand; PAM type: YTN; PAM sequence: TTG
attctcagcattgcagtccc

SEQ ID NO: 197550 - DNA, 20 bp, Artificial Sequence
  Description of Artificial Sequence: Synthetic oligonucleotide
  Target: ATXN1; (-) strand; PAM type: YTN; PAM sequence: CTT
gattctcagcattgcagtcc

SEQ ID NO: 197551 - DNA, 20 bp, Artificial Sequence
  Description of Artificial Sequence: Synthetic oligonucleotide
  Target: ATXN1; (-) strand; PAM type: YTN; PAM sequence: TTC
ttgattctcagcattgcagt

SEQ ID NO: 197552 - DNA, 20 bp, Artificial Sequence
  Description of Artificial Sequence: Synthetic oligonucleotide
  Target: ATXN1; (-) strand; PAM type: YTN; PAM sequence: TTT
cttgattctcagcattgcag

SEQ ID NO: 197553 - DNA, 20 bp, Artificial Sequence
  Description of Artificial Sequence: Synthetic oligonucleotide
  Target: ATXN1; (-) strand; PAM type: YTN; PAM sequence: CTG
tttcttgattctcagcattg

SEQ ID NO: 197554 - DNA, 20 bp, Artificial Sequence
  Description of Artificial Sequence: Synthetic oligonucleotide
  Target: ATXN1; (-) strand; PAM type: YTN; PAM sequence: TTC
tgtttcttgattctcagcat

SEQ ID NO: 197555 - DNA, 20 bp, Artificial Sequence
  Description of Artificial Sequence: Synthetic oligonucleotide
  Target: ATXN1; (-) strand; PAM type: YTN; PAM sequence: CTG
tgaaattctgtttcttgatt

SEQ ID NO: 197556 - DNA, 20 bp, Artificial Sequence
  Description of Artificial Sequence: Synthetic oligonucleotide
  Target: ATXN1; (-) strand; PAM type: YTN; PAM sequence: TTC
accaatgcactgtgaaattc

SEQ ID NO: 197557 - DNA, 20 bp, Artificial Sequence
  Description of Artificial Sequence: Synthetic oligonucleotide
  Target: ATXN1; (-) strand; PAM type: YTN; PAM sequence: TTT
caccaatgcactgtgaaatt

SEQ ID NO: 197558 - DNA, 20 bp, Artificial Sequence
  Description of Artificial Sequence: Synthetic oligonucleotide
  Target: ATXN1; (-) strand; PAM type: YTN; PAM sequence: TTG
gtgatttcaccaatgcactg

SEQ ID NO: 197559 - DNA, 20 bp, Artificial Sequence
  Description of Artificial Sequence: Synthetic oligonucleotide
  Target: ATXN1; (-) strand; PAM type: YTN; PAM sequence: TTA
ttggtgatttcaccaatgca

SEQ ID NO: 197560 - DNA, 20 bp, Artificial Sequence
  Description of Artificial Sequence: Synthetic oligonucleotide
  Target: ATXN1; (-) strand; PAM type: YTN; PAM sequence: TTA
ttattggtgatttcaccaat

SEQ ID NO: 197561 - DNA, 20 bp, Artificial Sequence
  Description of Artificial Sequence: Synthetic oligonucleotide
  Target: ATXN1; (-) strand; PAM type: YTN; PAM sequence: TTT
attattggtgatttcaccaa

SEQ ID NO: 197562 - DNA, 20 bp, Artificial Sequence
  Description of Artificial Sequence: Synthetic oligonucleotide
  Target: ATXN1; (-) strand; PAM type: YTN; PAM sequence: CTA
taatgtttattattggtgat

SEQ ID NO: 197563 - DNA, 20 bp, Artificial Sequence
  Description of Artificial Sequence: Synthetic oligonucleotide
  Target: ATXN1; (-) strand; PAM type: YTN; PAM sequence: CTC
tataatgtttattattggtg

SEQ ID NO: 197564 - DNA, 20 bp, Artificial Sequence
  Description of Artificial Sequence: Synthetic oligonucleotide
  Target: ATXN1; (-) strand; PAM type: YTN; PAM sequence: CTG
acacagagtaagcactctat

SEQ ID NO: 197565 - DNA, 20 bp, Artificial Sequence
  Description of Artificial Sequence: Synthetic oligonucleotide
  Target: ATXN1; (-) strand; PAM type: YTN; PAM sequence: TTA
agagactgacacagagtaag

SEQ ID NO: 197566 - DNA, 20 bp, Artificial Sequence
  Description of Artificial Sequence: Synthetic oligonucleotide
  Target: ATXN1; (-) strand; PAM type: YTN; PAM sequence: TTA
taataataattaagagactg

SEQ ID NO: 197567 - DNA, 20 bp, Artificial Sequence
  Description of Artificial Sequence: Synthetic oligonucleotide
  Target: ATXN1; (-) strand; PAM type: YTN; PAM sequence: CTC
caaaaataattataataata

SEQ ID NO: 197568 - DNA, 20 bp, Artificial Sequence
  Description of Artificial Sequence: Synthetic oligonucleotide
  Target: ATXN1; (-) strand; PAM type: YTN; PAM sequence: TTC
cgtctccaaaaataattata

SEQ ID NO: 197569 - DNA, 20 bp, Artificial Sequence
  Description of Artificial Sequence: Synthetic oligonucleotide
  Target: ATXN1; (-) strand; PAM type: YTN; PAM sequence: CTG
gtgacagaacaagattccgt

SEQ ID NO: 197570 - DNA, 20 bp, Artificial Sequence
  Description of Artificial Sequence: Synthetic oligonucleotide
  Target: ATXN1; (-) strand; PAM type: YTN; PAM sequence: CTC
cagcctggtgacagaacaag

SEQ ID NO: 197571 - DNA, 20 bp, Artificial Sequence
  Description of Artificial Sequence: Synthetic oligonucleotide
  Target: ATXN1; (-) strand; PAM type: YTN; PAM sequence: CTG
cactccagcctggtgacaga

SEQ ID NO: 197572 - DNA, 20 bp, Artificial Sequence
  Description of Artificial Sequence: Synthetic oligonucleotide
  Target: ATXN1; (-) strand; PAM type: YTN; PAM sequence: CTA
ctgcactccagcctggtgac

SEQ ID NO: 197573 - DNA, 20 bp, Artificial Sequence
  Description of Artificial Sequence: Synthetic oligonucleotide
  Target: ATXN1; (-) strand; PAM type: YTN; PAM sequence: TTG
agccgagatcatgctactgc

SEQ ID NO: 197574 - DNA, 20 bp, Artificial Sequence
  Description of Artificial Sequence: Synthetic oligonucleotide
  Target: ATXN1; (-) strand; PAM type: YTN; PAM sequence: TTG
cattgagccgagatcatgct

SEQ ID NO: 197575 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggcggaggttg

SEQ ID NO: 197576 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggcggaggtt

SEQ ID NO: 197577 - DNA, 20 bp, Artificial Sequence
  Description of Artificial Sequence: Synthetic oligonucleotide
  Target: ATXN1; (-) strand; PAM type: YTN; PAM sequence: CTG
aggcaggggaatcacttgaa

SEQ ID NO: 197578 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggggaat

SEQ ID NO: 197579 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggggaa

SEQ ID NO: 197580 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcaggg

SEQ ID NO: 197581 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggag

SEQ ID NO: 197582 - DNA, 20 bp, Artificial Sequence
  Description of Artificial Sequence: Synthetic oligonucleotide
  Target: ATXN1; (-) strand; PAM type: YTN; PAM sequence: TTA
gccaggcgtggtggcacgcg

SEQ ID NO: 197583 - DNA, 20 bp, Artificial Sequence
  Description of Artificial Sequence: Synthetic oligonucleotide
  Target: ATXN1; (-) strand; PAM type: YTN; PAM sequence: CTA
aaaatataaaaaattagcca

SEQ ID NO: 197584 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatataaaaaattag

SEQ ID NO: 197585 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatataaaaaatt

SEQ ID NO: 197586 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaacccgt

SEQ ID NO: 197587 - DNA, 20 bp, Artificial Sequence
  Description of Artificial Sequence: Synthetic oligonucleotide
  Target: ATXN1; (-) strand; PAM type: YTN; PAM sequence: TTC
gagaccatcctggccaacat

SEQ ID NO: 197588 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacca

SEQ ID NO: 197589 - DNA, 20 bp, Artificial Sequence
  Description of Artificial Sequence: Synthetic oligonucleotide
  Target: ATXN1; (-) strand; PAM type: YTN; PAM sequence: CTG
aggtgggtggatcacctgag

SEQ ID NO: 197590 - DNA, 20 bp, Artificial Sequence
  Description of Artificial Sequence: Synthetic oligonucleotide
  Target: ATXN1; (-) strand; PAM type: YTN; PAM sequence: CTG
ggaggctgaggtgggtggat

SEQ ID NO: 197591 - DNA, 20 bp, Artificial Sequence
  Description of Artificial Sequence: Synthetic oligonucleotide
  Target: ATXN1; (-) strand; PAM type: YTN; PAM sequence: CTC
tgggaggctgaggtgggtgg

SEQ ID NO: 197592 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactctgggag

SEQ ID NO: 197593 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatcccagcact

SEQ ID NO: 197594 - DNA, 20 bp, Artificial Sequence
  Description of Artificial Sequence: Synthetic oligonucleotide
  Target: ATXN1; (-) strand; PAM type: YTN; PAM sequence: TTC
cgggcgcagtggctcatgcc

SEQ ID NO: 197595 - DNA, 20 bp, Artificial Sequence
  Description of Artificial Sequence: Synthetic oligonucleotide
  Target: ATXN1; (-) strand; PAM type: YTN; PAM sequence: CTG
aatcagttccgggcgcagtg

SEQ ID NO: 197596 - DNA, 20 bp, Artificial Sequence
  Description of Artificial Sequence: Synthetic oligonucleotide
  Target: ATXN1; (-) strand; PAM type: YTN; PAM sequence: TTG
ggagagctgaatcagttccg

SEQ ID NO: 197597 - DNA, 20 bp, Artificial Sequence
  Description of Artificial Sequence: Synthetic oligonucleotide
  Target: ATXN1; (-) strand; PAM type: YTN; PAM sequence: CTG
ttgggagagctgaatcagtt

SEQ ID NO: 197598 - DNA, 20 bp, Artificial Sequence
  Description of Artificial Sequence: Synthetic oligonucleotide
  Target: ATXN1; (-) strand; PAM type: YTN; PAM sequence: CTG
ggctgttgggagagctgaat

SEQ ID NO: 197599 - DNA, 20 bp, Artificial Sequence
  Description of Artificial Sequence: Synthetic oligonucleotide
  Target: ATXN1; (-) strand; PAM type: YTN; PAM sequence: CTC
actgggctgttgggagagct

SEQ ID NO: 197600 - DNA, 20 bp, Artificial Sequence
  Description of Artificial Sequence: Synthetic oligonucleotide
  Target: ATXN1; (-) strand; PAM type: YTN; PAM sequence: CTC
atctcactgggctgttggga

SEQ ID NO: 197601 - DNA, 20 bp, Artificial Sequence
  Description of Artificial Sequence: Synthetic oligonucleotide
  Target: ATXN1; (-) strand; PAM type: YTN; PAM sequence: CTG
tacaatgggaataataatag

SEQ ID NO: 197602 - DNA, 20 bp, Artificial Sequence
  Description of Artificial Sequence: Synthetic oligonucleotide
  Target: ATXN1; (-) strand; PAM type: YTN; PAM sequence: CTC
caatctgtacaatgggaata

SEQ ID NO: 197603 - DNA, 20 bp, Artificial Sequence
  Description of Artificial Sequence: Synthetic oligonucleotide
  Target: ATXN1; (-) strand; PAM type: YTN; PAM sequence: CTC
agtactccaatctgtacaat

SEQ ID NO: 197604 - DNA, 20 bp, Artificial Sequence
  Description of Artificial Sequence: Synthetic oligonucleotide
  Target: ATXN1; (-) strand; PAM type: YTN; PAM sequence: TTG
tgcctcagtactccaatctg

SEQ ID NO: 197605 - DNA, 20 bp, Artificial Sequence
  Description of Artificial Sequence: Synthetic oligonucleotide
  Target: ATXN1; (-) strand; PAM type: YTN; PAM sequence: CTT
gtgcctcagtactccaatct

SEQ ID NO: 197606 - DNA, 20 bp, Artificial Sequence
  Description of Artificial Sequence: Synthetic oligonucleotide
  Target: ATXN1; (-) strand; PAM type: YTN; PAM sequence: CTC
ttgtgcctcagtactccaat

SEQ ID NO: 197607 - DNA, 20 bp, Artificial Sequence
  Description of Artificial Sequence: Synthetic oligonucleotide
  Target: ATXN1; (-) strand; PAM type: YTN; PAM sequence: CTA
ccctcttgtgcctcagtact

SEQ ID NO: 197608 - DNA, 20 bp, Artificial Sequence
  Description of Artificial Sequence: Synthetic oligonucleotide
  Target: ATXN1; (-) strand; PAM type: YTN; PAM sequence: TTA
cctaccctcttgtgcctcag

SEQ ID NO: 197609 - DNA, 20 bp, Artificial Sequence
  Description of Artificial Sequence: Synthetic oligonucleotide
  Target: ATXN1; (-) strand; PAM type: YTN; PAM sequence: TTT
acctaccctcttgtgcctca

SEQ ID NO: 197610 - DNA, 20 bp, Artificial Sequence
  Description of Artificial Sequence: Synthetic oligonucleotide
  Target: ATXN1; (-) strand; PAM type: YTN; PAM sequence: CTT
tacctaccctcttgtgcctc

SEQ ID NO: 197611 - DNA, 20 bp, Artificial Sequence
  Description of Artificial Sequence: Synthetic oligonucleotide
  Target: ATXN1; (-) strand; PAM type: YTN; PAM sequence: TTC
aggcactttacctaccctct

SEQ ID NO: 197612 - DNA, 20 bp, Artificial Sequence
  Description of Artificial Sequence: Synthetic oligonucleotide
  Target: ATXN1; (-) strand; PAM type: YTN; PAM sequence: CTT
caggcactttacctaccctc

SEQ ID NO: 197613 - DNA, 20 bp, Artificial Sequence
  Description of Artificial Sequence: Synthetic oligonucleotide
  Target: ATXN1; (-) strand; PAM type: YTN; PAM sequence: TTA
tcagtgtgacttcaggcact

SEQ ID NO: 197614 - DNA, 20 bp, Artificial Sequence
  Description of Artificial Sequence: Synthetic oligonucleotide
  Target: ATXN1; (-) strand; PAM type: YTN; PAM sequence: TTT
atcagtgtgacttcaggcac

SEQ ID NO: 197615 - DNA, 20 bp, Artificial Sequence
  Description of Artificial Sequence: Synthetic oligonucleotide
  Target: ATXN1; (-) strand; PAM type: YTN; PAM sequence: CTG
cagccatttatcagtgtgac

SEQ ID NO: 197616 - DNA, 20 bp, Artificial Sequence
  Description of Artificial Sequence: Synthetic oligonucleotide
  Target: ATXN1; (-) strand; PAM type: YTN; PAM sequence: TTG
aatcccaactgcagccattt

SEQ ID NO: 197617 - DNA, 20 bp, Artificial Sequence
  Description of Artificial Sequence: Synthetic oligonucleotide
  Target: ATXN1; (-) strand; PAM type: YTN; PAM sequence: TTT
gaatcccaactgcagccatt

SEQ ID NO: 197618 - DNA, 20 bp, Artificial Sequence
  Description of Artificial Sequence: Synthetic oligonucleotide
  Target: ATXN1; (-) strand; PAM type: YTN; PAM sequence: CTT
tgaatcccaactgcagccat

SEQ ID NO: 197619 - DNA, 20 bp, Artificial Sequence
  Description of Artificial Sequence: Synthetic oligonucleotide
  Target: ATXN1; (-) strand; PAM type: YTN; PAM sequence: TTG
gctttgaatcccaactgcag

SEQ ID NO: 197620 - DNA, 20 bp, Artificial Sequence
  Description of Artificial Sequence: Synthetic oligonucleotide
  Target: ATXN1; (-) strand; PAM type: YTN; PAM sequence: CTT
ggctttgaatcccaactgca

SEQ ID NO: 197621 - DNA, 20 bp, Artificial Sequence
  Description of Artificial Sequence: Synthetic oligonucleotide
  Target: ATXN1; (-) strand; PAM type: YTN; PAM sequence: CTC
cttggctttgaatcccaact

SEQ ID NO: 197622 - DNA, 20 bp, Artificial Sequence
  Description of Artificial Sequence: Synthetic oligonucleotide
  Target: ATXN1; (-) strand; PAM type: YTN; PAM sequence: CTA
actccttggctttgaatccc

SEQ ID NO: 197623 - DNA, 20 bp, Artificial Sequence
  Description of Artificial Sequence: Synthetic oligonucleotide
  Target: ATXN1; (-) strand; PAM type: YTN; PAM sequence: CTA
gagcctaactccttggcttt

SEQ ID NO: 197624 - DNA, 20 bp, Artificial Sequence
  Description of Artificial Sequence: Synthetic oligonucleotide
  Target: ATXN1; (-) strand; PAM type: YTN; PAM sequence: CTC
tagagcctaactccttggct

SEQ ID NO: 197625 - DNA, 20 bp, Artificial Sequence
  Description of Artificial Sequence: Synthetic oligonucleotide
  Target: ATXN1; (-) strand; PAM type: YTN; PAM sequence: TTA
atatagtgactctagagcct

SEQ ID NO: 197626 - DNA, 20 bp, Artificial Sequence
  Description of Artificial Sequence: Synthetic oligonucleotide
  Target: ATXN1; (-) strand; PAM type: YTN; PAM sequence: TTT
aatatagtgactctagagcc

SEQ ID NO: 197627 - DNA, 20 bp, Artificial Sequence
  Description of Artificial Sequence: Synthetic oligonucleotide
  Target: ATXN1; (-) strand; PAM type: YTN; PAM sequence: TTA
accaggcagtttaatatagt

SEQ ID NO: 197628 - DNA, 20 bp, Artificial Sequence
  Description of Artificial Sequence: Synthetic oligonucleotide
  Target: ATXN1; (-) strand; PAM type: YTN; PAM sequence: CTT
aaccaggcagtttaatatag

SEQ ID NO: 197629 - DNA, 20 bp, Artificial Sequence
  Description of Artificial Sequence: Synthetic oligonucleotide
  Target: ATXN1; (-) strand; PAM type: YTN; PAM sequence: TTC
ttaaccaggcagtttaatat

SEQ ID NO: 197630 - DNA, 20 bp, Artificial Sequence
  Description of Artificial Sequence: Synthetic oligonucleotide
  Target: ATXN1; (-) strand; PAM type: YTN; PAM sequence: CTG
ttcttaaccaggcagtttaa

SEQ ID NO: 197631 - DNA, 20 bp, Artificial Sequence
  Description of Artificial Sequence: Synthetic oligonucleotide
  Target: ATXN1; (-) strand; PAM type: YTN; PAM sequence: TTG
ctgttcttaaccaggcagtt

SEQ ID NO: 197632 - DNA, 20 bp, Artificial Sequence
  Description of Artificial Sequence: Synthetic oligonucleotide
  Target: ATXN1; (-) strand; PAM type: YTN; PAM sequence: TTA
tgtaatattgctgttcttaa

SEQ ID NO: 197633 - DNA, 20 bp, Artificial Sequence
  Description of Artificial Sequence: Synthetic oligonucleotide
  Target: ATXN1; (-) strand; PAM type: YTN; PAM sequence: CTA
acattatgtaatattgctgt

SEQ ID NO: 197634 - DNA, 20 bp, Artificial Sequence
  Description of Artificial Sequence: Synthetic oligonucleotide
  Target: ATXN1; (-) strand; PAM type: YTN; PAM sequence: CTG
taaaacacaacacaaaccta

SEQ ID NO: 197635 - DNA, 20 bp, Artificial Sequence
  Description of Artificial Sequence: Synthetic oligonucleotide
  Target: ATXN1; (-) strand; PAM type: YTN; PAM sequence: TTG
taaactgtaaaacacaacac

SEQ ID NO: 197636 - DNA, 20 bp, Artificial Sequence
  Description of Artificial Sequence: Synthetic oligonucleotide
  Target: ATXN1; (-) strand; PAM type: YTN; PAM sequence: TTT
gtaaactgtaaaacacaaca

SEQ ID NO: 197637 - DNA, 20 bp, Artificial Sequence
  Description of Artificial Sequence: Synthetic oligonucleotide
  Target: ATXN1; (-) strand; PAM type: YTN; PAM sequence: TTT
tgtaaactgtaaaacacaac

SEQ ID NO: 197638 - DNA, 20 bp, Artificial Sequence
  Description of Artificial Sequence: Synthetic oligonucleotide
  Target: ATXN1; (-) strand; PAM type: YTN; PAM sequence: TTC
caagcagagggaaaaagcat

SEQ ID NO: 197639 - DNA, 20 bp, Artificial Sequence
  Description of Artificial Sequence: Synthetic oligonucleotide
  Target: ATXN1; (-) strand; PAM type: YTN; PAM sequence: CTC
ataagtaaatacatgagaca

SEQ ID NO: 197640 - DNA, 20 bp, Artificial Sequence
  Description of Artificial Sequence: Synthetic oligonucleotide
  Target: ATXN1; (-) strand; PAM type: YTN; PAM sequence: TTG
ggagaggaactcataagtaa

SEQ ID NO: 197641 - DNA, 20 bp, Artificial Sequence
  Description of Artificial Sequence: Synthetic oligonucleotide
  Target: ATXN1; (-) strand; PAM type: YTN; PAM sequence: CTG
ttgggagaggaactcataag

SEQ ID NO: 197642 - DNA, 20 bp, Artificial Sequence
  Description of Artificial Sequence: Synthetic oligonucleotide
  Target: ATXN1; (-) strand; PAM type: YTN; PAM sequence: CTC
tgttgggagaggaactcata

SEQ ID NO: 197643 - DNA, 20 bp, Artificial Sequence
  Description of Artificial Sequence: Synthetic oligonucleotide
  Target: ATXN1; (-) strand; PAM type: YTN; PAM sequence: TTC
agtagaaggctctgttggga

SEQ ID NO: 197644 - DNA, 20 bp, Artificial Sequence
  Description of Artificial Sequence: Synthetic oligonucleotide
  Target: ATXN1; (-) strand; PAM type: YTN; PAM sequence: TTT
cagtagaaggctctgttggg

SEQ ID NO: 197645 - DNA, 20 bp, Artificial Sequence
  Description of Artificial Sequence: Synthetic oligonucleotide
  Target: ATXN1; (-) strand; PAM type: YTN; PAM sequence: CTT
tcagtagaaggctctgttgg

SEQ ID NO: 197646 - DNA, 20 bp, Artificial Sequence
  Description of Artificial Sequence: Synthetic oligonucleotide
  Target: ATXN1; (-) strand; PAM type: YTN; PAM sequence: TTG
aacacctttcagtagaaggc

SEQ ID NO: 197647 - DNA, 20 bp, Artificial Sequence
  Description of Artificial Sequence: Synthetic oligonucleotide
  Target: ATXN1; (-) strand; PAM type: YTN; PAM sequence: CTA
tgaacacggtattgaacacc

SEQ ID NO: 197648 - DNA, 20 bp, Artificial Sequence
  Description of Artificial Sequence: Synthetic oligonucleotide
  Target: ATXN1; (-) strand; PAM type: YTN; PAM sequence: CTC
tatgaacacggtattgaaca

SEQ ID NO: 197649 - DNA, 20 bp, Artificial Sequence
  Description of Artificial Sequence: Synthetic oligonucleotide
  Target: ATXN1; (-) strand; PAM type: YTN; PAM sequence: TTC
actctatgaacacggtattg

SEQ ID NO: 197650 - DNA, 20 bp, Artificial Sequence
  Description of Artificial Sequence: Synthetic oligonucleotide
  Target: ATXN1; (-) strand; PAM type: YTN; PAM sequence: CTT
cactctatgaacacggtatt

SEQ ID NO: 197651 - DNA, 20 bp, Artificial Sequence
  Description of Artificial Sequence: Synthetic oligonucleotide
  Target: ATXN1; (-) strand; PAM type: YTN; PAM sequence: TTC
ataccttcactctatgaaca

SEQ ID NO: 197652 - DNA, 20 bp, Artificial Sequence
  Description of Artificial Sequence: Synthetic oligonucleotide
  Target: ATXN1; (-) strand; PAM type: YTN; PAM sequence: TTA
ttcataccttcactctatga

SEQ ID NO: 197653 - DNA, 20 bp, Artificial Sequence
  Description of Artificial Sequence: Synthetic oligonucleotide
  Target: ATXN1; (-) strand; PAM type: YTN; PAM sequence: TTA
gagtcagttattcatacctt

SEQ ID NO: 197654 - DNA, 20 bp, Artificial Sequence
  Description of Artificial Sequence: Synthetic oligonucleotide
  Target: ATXN1; (-) strand; PAM type: YTN; PAM sequence: TTA
attagagtcagttattcata

SEQ ID NO: 197655 - DNA, 20 bp, Artificial Sequence
  Description of Artificial Sequence: Synthetic oligonucleotide
  Target: ATXN1; (-) strand; PAM type: YTN; PAM sequence: TTA
aggattaattagagtcagtt

SEQ ID NO: 197656 - DNA, 20 bp, Artificial Sequence
  Description of Artificial Sequence: Synthetic oligonucleotide
  Target: ATXN1; (-) strand; PAM type: YTN; PAM sequence: TTT
aaggattaattagagtcagt

SEQ ID NO: 197657 - DNA, 20 bp, Artificial Sequence
  Description of Artificial Sequence: Synthetic oligonucleotide
  Target: ATXN1; (-) strand; PAM type: YTN; PAM sequence: CTC
ccacagcaatttaaggatta

SEQ ID NO: 197658 - DNA, 20 bp, Artificial Sequence
  Description of Artificial Sequence: Synthetic oligonucleotide
  Target: ATXN1; (-) strand; PAM type: YTN; PAM sequence: CTG
tctcccacagcaatttaagg

SEQ ID NO: 197659 - DNA, 20 bp, Artificial Sequence
  Description of Artificial Sequence: Synthetic oligonucleotide
  Target: ATXN1; (-) strand; PAM type: YTN; PAM sequence: CTC
agcctgtctcccacagcaat

SEQ ID NO: 197660 - DNA, 20 bp, Artificial Sequence
  Description of Artificial Sequence: Synthetic oligonucleotide
  Target: ATXN1; (-) strand; PAM type: YTN; PAM sequence: TTC
tcagcctgtctcccacagca

SEQ ID NO: 197661 - DNA, 20 bp, Artificial Sequence
  Description of Artificial Sequence: Synthetic oligonucleotide
  Target: ATXN1; (-) strand; PAM type: YTN; PAM sequence: TTA
gtcatatattctcagcctgt

SEQ ID NO: 197662 - DNA, 20 bp, Artificial Sequence
  Description of Artificial Sequence: Synthetic oligonucleotide
  Target: ATXN1; (-) strand; PAM type: YTN; PAM sequence: TTT
agtcatatattctcagcctg

SEQ ID NO: 197663 - DNA, 20 bp, Artificial Sequence
  Description of Artificial Sequence: Synthetic oligonucleotide
  Target: ATXN1; (-) strand; PAM type: YTN; PAM sequence: TTC
aaaacaagtttagtcatata

SEQ ID NO: 197664 - DNA, 20 bp, Artificial Sequence
  Description of Artificial Sequence: Synthetic oligonucleotide
  Target: ATXN1; (-) strand; PAM type: YTN; PAM sequence: TTT
caaaacaagtttagtcatat

SEQ ID NO: 197665 - DNA, 20 bp, Artificial Sequence
  Description of Artificial Sequence: Synthetic oligonucleotide
  Target: ATXN1; (-) strand; PAM type: YTN; PAM sequence: TTA
tttcaaaacaagtttagtca

SEQ ID NO: 197666 - DNA, 20 bp, Artificial Sequence
  Description of Artificial Sequence: Synthetic oligonucleotide
  Target: ATXN1; (-) strand; PAM type: YTN; PAM sequence: CTT
atttcaaaacaagtttagtc

SEQ ID NO: 197667 - DNA, 20 bp, Artificial Sequence
  Description of Artificial Sequence: Synthetic oligonucleotide
  Target: ATXN1; (-) strand; PAM type: YTN; PAM sequence: TTC
cttatttcaaaacaagttta

SEQ ID NO: 197668 - DNA, 20 bp, Artificial Sequence
  Description of Artificial Sequence: Synthetic oligonucleotide
  Target: ATXN1; (-) strand; PAM type: YTN; PAM sequence: TTT
ccttatttcaaaacaagttt

SEQ ID NO: 197669 - DNA, 20 bp, Artificial Sequence
  Description of Artificial Sequence: Synthetic oligonucleotide
  Target: ATXN1; (-) strand; PAM type: YTN; PAM sequence: TTT
tccttatttcaaaacaagtt

SEQ ID NO: 197670 - DNA, 20 bp, Artificial Sequence
  Description of Artificial Sequence: Synthetic oligonucleotide
  Target: ATXN1; (-) strand; PAM type: YTN; PAM sequence: CTC
attttccttatttcaaaaca

SEQ ID NO: 197671 - DNA, 20 bp, Artificial Sequence
  Description of Artificial Sequence: Synthetic oligonucleotide
  Target: ATXN1; (-) strand; PAM type: YTN; PAM sequence: TTC
ccaaacctcattttccttat

SEQ ID NO: 197672 - DNA, 20 bp, Artificial Sequence
  Description of Artificial Sequence: Synthetic oligonucleotide
  Target: ATXN1; (-) strand; PAM type: YTN; PAM sequence: TTT
cccaaacctcattttcctta

SEQ ID NO: 197673 - DNA, 20 bp, Artificial Sequence
  Description of Artificial Sequence: Synthetic oligonucleotide
  Target: ATXN1; (-) strand; PAM type: YTN; PAM sequence: TTT
tcccaaacctcattttcctt

SEQ ID NO: 197674 - DNA, 20 bp, Artificial Sequence
  Description of Artificial Sequence: Synthetic oligonucleotide
  Target: ATXN1; (-) strand; PAM type: YTN; PAM sequence: TTG
attttcccaaacctcatttt

SEQ ID NO: 197675 - DNA, 20 bp, Artificial Sequence
  Description of Artificial Sequence: Synthetic oligonucleotide
  Target: ATXN1; (-) strand; PAM type: YTN; PAM sequence: TTT
gattttcccaaacctcattt

SEQ ID NO: 197676 - DNA, 20 bp, Artificial Sequence
  Description of Artificial Sequence: Synthetic oligonucleotide
  Target: ATXN1; (-) strand; PAM type: YTN; PAM sequence: TTA
gacaagtcatttgattttcc

SEQ ID NO: 197677 - DNA, 20 bp, Artificial Sequence
  Description of Artificial Sequence: Synthetic oligonucleotide
  Target: ATXN1; (-) strand; PAM type: YTN; PAM sequence: CTT
agacaagtcatttgattttc

SEQ ID NO: 197678 - DNA, 20 bp, Artificial Sequence
  Description of Artificial Sequence: Synthetic oligonucleotide
  Target: ATXN1; (-) strand; PAM type: YTN; PAM sequence: TTC
aaagcaatatgaccttagac

SEQ ID NO: 197679 - DNA, 20 bp, Artificial Sequence
  Description of Artificial Sequence: Synthetic oligonucleotide
  Target: ATXN1; (-) strand; PAM type: YTN; PAM sequence: CTC
atattcaaagcaatatgacc

SEQ ID NO: 197680 - DNA, 20 bp, Artificial Sequence
  Description of Artificial Sequence: Synthetic oligonucleotide
  Target: ATXN1; (-) strand; PAM type: YTN; PAM sequence: TTA
cgatgagctcatattcaaag

SEQ ID NO: 197681 - DNA, 20 bp, Artificial Sequence
  Description of Artificial Sequence: Synthetic oligonucleotide
  Target: ATXN1; (-) strand; PAM type: YTN; PAM sequence: TTA
gttacgatgagctcatattc

SEQ ID NO: 197682 - DNA, 20 bp, Artificial Sequence
  Description of Artificial Sequence: Synthetic oligonucleotide
  Target: ATXN1; (-) strand; PAM type: YTN; PAM sequence: TTT
agttacgatgagctcatatt

SEQ ID NO: 197683 - DNA, 20 bp, Artificial Sequence
  Description of Artificial Sequence: Synthetic oligonucleotide
  Target: ATXN1; (-) strand; PAM type: YTN; PAM sequence: CTG
gtttagttacgatgagctca

SEQ ID NO: 197684 - DNA, 20 bp, Artificial Sequence
  Description of Artificial Sequence: Synthetic oligonucleotide
  Target: ATXN1; (-) strand; PAM type: YTN; PAM sequence: TTA
aaccactggtttagttacga

SEQ ID NO: 197685 - DNA, 20 bp, Artificial Sequence
  Description of Artificial Sequence: Synthetic oligonucleotide
  Target: ATXN1; (-) strand; PAM type: YTN; PAM sequence: TTT
aaaccactggtttagttacg

SEQ ID NO: 197686 - DNA, 20 bp, Artificial Sequence
  Description of Artificial Sequence: Synthetic oligonucleotide
  Target: ATXN1; (-) strand; PAM type: YTN; PAM sequence: TTT
taaaccactggtttagttac

SEQ ID NO: 197687 - DNA, 20 bp, Artificial Sequence
  Description of Artificial Sequence: Synthetic oligonucleotide
  Target: ATXN1; (-) strand; PAM type: YTN; PAM sequence: TTT
ttaaaccactggtttagtta

SEQ ID NO: 197688 - DNA, 20 bp, Artificial Sequence
  Description of Artificial Sequence: Synthetic oligonucleotide
  Target: ATXN1; (-) strand; PAM type: YTN; PAM sequence: TTT
tttaaaccactggtttagtt

SEQ ID NO: 197689 - DNA, 20 bp, Artificial Sequence
  Description of Artificial Sequence: Synthetic oligonucleotide
  Target: ATXN1; (-) strand; PAM type: YTN; PAM sequence: TTT
ttttaaaccactggtttagt

SEQ ID NO: 197690 - DNA, 20 bp, Artificial Sequence
  Description of Artificial Sequence: Synthetic oligonucleotide
  Target: ATXN1; (-) strand; PAM type: YTN; PAM sequence: TTT
tttttaaaccactggtttag

SEQ ID NO: 197691 - DNA, 20 bp, Artificial Sequence
  Description of Artificial Sequence: Synthetic oligonucleotide
  Target: ATXN1; (-) strand; PAM type: YTN; PAM sequence: TTA
aaaaaaattttttttaaacc

SEQ ID NO: 197692 - DNA, 20 bp, Artificial Sequence
  Description of Artificial Sequence: Synthetic oligonucleotide
  Target: ATXN1; (-) strand; PAM type: YTN; PAM sequence: CTG
tggttaaaaaaaattttttt

SEQ ID NO: 197693 - DNA, 20 bp, Artificial Sequence
  Description of Artificial Sequence: Synthetic oligonucleotide
  Target: ATXN1; (-) strand; PAM type: YTN; PAM sequence: TTA
gaaaggtcctgtggttaaaa

SEQ ID NO: 197694 - DNA, 20 bp, Artificial Sequence
  Description of Artificial Sequence: Synthetic oligonucleotide
  Target: ATXN1; (-) strand; PAM type: YTN; PAM sequence: CTT
agaaaggtcctgtggttaaa

SEQ ID NO: 197695 - DNA, 20 bp, Artificial Sequence
  Description of Artificial Sequence: Synthetic oligonucleotide
  Target: ATXN1; (-) strand; PAM type: YTN; PAM sequence: TTC
ttagaaaggtcctgtggtta

SEQ ID NO: 197696 - DNA, 20 bp, Artificial Sequence
  Description of Artificial Sequence: Synthetic oligonucleotide
  Target: ATXN1; (-) strand; PAM type: YTN; PAM sequence: TTT
cttagaaaggtcctgtggtt

SEQ ID NO: 197697 - DNA, 20 bp, Artificial Sequence
  Description of Artificial Sequence: Synthetic oligonucleotide
  Target: ATXN1; (-) strand; PAM type: YTN; PAM sequence: TTT
tcttagaaaggtcctgtggt

SEQ ID NO: 197698 - DNA, 20 bp, Artificial Sequence
  Description of Artificial Sequence: Synthetic oligonucleotide
  Target: ATXN1; (-) strand; PAM type: YTN; PAM sequence: CTA
tgtaaaatagttttcttaga

SEQ ID NO: 197699 - DNA, 20 bp, Artificial Sequence
  Description of Artificial Sequence: Synthetic oligonucleotide
  Target: ATXN1; (-) strand; PAM type: YTN; PAM sequence: CTG
aggctatgtaaaatagtttt

SEQ ID NO: 197700 - DNA, 20 bp, Artificial Sequence
  Description of Artificial Sequence: Synthetic oligonucleotide
  Target: ATXN1; (-) strand; PAM type: YTN; PAM sequence: TTC
tgaggctatgtaaaatagtt

SEQ ID NO: 197701 - DNA, 20 bp, Artificial Sequence
  Description of Artificial Sequence: Synthetic oligonucleotide
  Target: ATXN1; (-) strand; PAM type: YTN; PAM sequence: CTG
tgatattctgaggctatgta

SEQ ID NO: 197702 - DNA, 20 bp, Artificial Sequence
  Description of Artificial Sequence: Synthetic oligonucleotide
  Target: ATXN1; (-) strand; PAM type: YTN; PAM sequence: CTC
tgtgatattctgaggctatg

SEQ ID NO: 197703 - DNA, 20 bp, Artificial Sequence
  Description of Artificial Sequence: Synthetic oligonucleotide
  Target: ATXN1; (-) strand; PAM type: YTN; PAM sequence: TTC
agctctgtgatattctgagg

SEQ ID NO: 197704 - DNA, 20 bp, Artificial Sequence
  Description of Artificial Sequence: Synthetic oligonucleotide
  Target: ATXN1; (-) strand; PAM type: YTN; PAM sequence: CTT
cagctctgtgatattctgag

SEQ ID NO: 197705 - DNA, 20 bp, Artificial Sequence
  Description of Artificial Sequence: Synthetic oligonucleotide
  Target: ATXN1; (-) strand; PAM type: YTN; PAM sequence: CTC
cttcagctctgtgatattct

SEQ ID NO: 197706 - DNA, 20 bp, Artificial Sequence
  Description of Artificial Sequence: Synthetic oligonucleotide
  Target: ATXN1; (-) strand; PAM type: YTN; PAM sequence: TTC
tccttcagctctgtgatatt

SEQ ID NO: 197707 - DNA, 20 bp, Artificial Sequence
  Description of Artificial Sequence: Synthetic oligonucleotide
  Target: ATXN1; (-) strand; PAM type: YTN; PAM sequence: CTT
ctccttcagctctgtgatat

SEQ ID NO: 197708 - DNA, 20 bp, Artificial Sequence
  Description of Artificial Sequence: Synthetic oligonucleotide
  Target: ATXN1; (-) strand; PAM type: YTN; PAM sequence: TTG
accggggcagcggggcagct

SEQ ID NO: 197709 - DNA, 20 bp, Artificial Sequence
  Description of Artificial Sequence: Synthetic oligonucleotide
  Target: ATXN1; (-) strand; PAM type: YTN; PAM sequence: CTA
ttgaccggggcagcggggca

SEQ ID NO: 197710 - DNA, 20 bp, Artificial Sequence
  Description of Artificial Sequence: Synthetic oligonucleotide
  Target: ATXN1; (-) strand; PAM type: YTN; PAM sequence: CTC
tattgaccggggcagcgggg

SEQ ID NO: 197711 - DNA, 20 bp, Artificial Sequence
  Description of Artificial Sequence: Synthetic oligonucleotide
  Target: ATXN1; (-) strand; PAM type: YTN; PAM sequence: CTC
agcctctattgaccggggca

SEQ ID NO: 197712 - DNA, 20 bp, Artificial Sequence
  Description of Artificial Sequence: Synthetic oligonucleotide
  Target: ATXN1; (-) strand; PAM type: YTN; PAM sequence: CTG
ccctcagcctctattgaccg

SEQ ID NO: 197713 - DNA, 20 bp, Artificial Sequence
  Description of Artificial Sequence: Synthetic oligonucleotide
  Target: ATXN1; (-) strand; PAM type: YTN; PAM sequence: CTG
tgggctgccctcagcctcta

SEQ ID NO: 197714 - DNA, 20 bp, Artificial Sequence
  Description of Artificial Sequence: Synthetic oligonucleotide
  Target: ATXN1; (-) strand; PAM type: YTN; PAM sequence: TTG
aggctgtgggctgccctcag

SEQ ID NO: 197715 - DNA, 20 bp, Artificial Sequence
  Description of Artificial Sequence: Synthetic oligonucleotide
  Target: ATXN1; (-) strand; PAM type: YTN; PAM sequence: TTT
gaggctgtgggctgccctca

SEQ ID NO: 197716 - DNA, 20 bp, Artificial Sequence
  Description of Artificial Sequence: Synthetic oligonucleotide
  Target: ATXN1; (-) strand; PAM type: YTN; PAM sequence: CTT
tgaggctgtgggctgccctc

SEQ ID NO: 197717 - DNA, 20 bp, Artificial Sequence
  Description of Artificial Sequence: Synthetic oligonucleotide
  Target: ATXN1; (-) strand; PAM type: YTN; PAM sequence: CTC
cccataaactttgaggctgt

SEQ ID NO: 197718 - DNA, 20 bp, Artificial Sequence
  Description of Artificial Sequence: Synthetic oligonucleotide
  Target: ATXN1; (-) strand; PAM type: YTN; PAM sequence: CTG
caaagccccagaggctcccc

SEQ ID NO: 197719 - DNA, 20 bp, Artificial Sequence
  Description of Artificial Sequence: Synthetic oligonucleotide
  Target: ATXN1; (-) strand; PAM type: YTN; PAM sequence: TTC
tgcaaagccccagaggctcc

SEQ ID NO: 197720 - DNA, 20 bp, Artificial Sequence
  Description of Artificial Sequence: Synthetic oligonucleotide
  Target: ATXN1; (-) strand; PAM type: YTN; PAM sequence: CTG
cattctgcaaagccccagag

SEQ ID NO: 197721 - DNA, 20 bp, Artificial Sequence
  Description of Artificial Sequence: Synthetic oligonucleotide
  Target: ATXN1; (-) strand; PAM type: YTN; PAM sequence: TTG
cgtggtgcagtagtgagtcc

SEQ ID NO: 197722 - DNA, 20 bp, Artificial Sequence
  Description of Artificial Sequence: Synthetic oligonucleotide
  Target: ATXN1; (-) strand; PAM type: YTN; PAM sequence: CTA
gtagtgttgcgtggtgcagt

SEQ ID NO: 197723 - DNA, 20 bp, Artificial Sequence
  Description of Artificial Sequence: Synthetic oligonucleotide
  Target: ATXN1; (-) strand; PAM type: YTN; PAM sequence: CTG
ggtcaggtgtcctagtagtg

SEQ ID NO: 197724 - DNA, 20 bp, Artificial Sequence
  Description of Artificial Sequence: Synthetic oligonucleotide
  Target: ATXN1; (-) strand; PAM type: YTN; PAM sequence: TTC
agggctgggtcaggtgtcct

SEQ ID NO: 197725 - DNA, 20 bp, Artificial Sequence
  Description of Artificial Sequence: Synthetic oligonucleotide
  Target: ATXN1; (-) strand; PAM type: YTN; PAM sequence: TTT
cagggctgggtcaggtgtcc

SEQ ID NO: 197726 - DNA, 20 bp, Artificial Sequence
  Description of Artificial Sequence: Synthetic oligonucleotide
  Target: ATXN1; (-) strand; PAM type: YTN; PAM sequence: CTC
aaagtttcagggctgggtca

SEQ ID NO: 197727 - DNA, 20 bp, Artificial Sequence
  Description of Artificial Sequence: Synthetic oligonucleotide
  Target: ATXN1; (-) strand; PAM type: YTN; PAM sequence: CTC
tcaaagtttcagggctgggt

SEQ ID NO: 197728 - DNA, 20 bp, Artificial Sequence
  Description of Artificial Sequence: Synthetic oligonucleotide
  Target: ATXN1; (-) strand; PAM type: YTN; PAM sequence: CTC
tctcaaagtttcagggctgg

SEQ ID NO: 197729 - DNA, 20 bp, Artificial Sequence
  Description of Artificial Sequence: Synthetic oligonucleotide
  Target: ATXN1; (-) strand; PAM type: YTN; PAM sequence: TTG
gtcaccctctctcaaagttt

SEQ ID NO: 197730 - DNA, 20 bp, Artificial Sequence
  Description of Artificial Sequence: Synthetic oligonucleotide
  Target: ATXN1; (-) strand; PAM type: YTN; PAM sequence: TTG
aaggtgtggttggtcaccct

SEQ ID NO: 197731 - DNA, 20 bp, Artificial Sequence
  Description of Artificial Sequence: Synthetic oligonucleotide
  Target: ATXN1; (-) strand; PAM type: YTN; PAM sequence: CTT
gaaggtgtggttggtcaccc

SEQ ID NO: 197732 - DNA, 20 bp, Artificial Sequence
  Description of Artificial Sequence: Synthetic oligonucleotide
  Target: ATXN1; (-) strand; PAM type: YTN; PAM sequence: TTC
ccccatgggtcagagtcgta

SEQ ID NO: 197733 - DNA, 20 bp, Artificial Sequence
  Description of Artificial Sequence: Synthetic oligonucleotide
  Target: ATXN1; (-) strand; PAM type: YTN; PAM sequence: CTT
cccccatgggtcagagtcgt

SEQ ID NO: 197734 - DNA, 20 bp, Artificial Sequence
  Description of Artificial Sequence: Synthetic oligonucleotide
  Target: ATXN1; (-) strand; PAM type: YTN; PAM sequence: CTG
ccttcccccatgggtcagag

SEQ ID NO: 197735 - DNA, 20 bp, Artificial Sequence
  Description of Artificial Sequence: Synthetic oligonucleotide
  Target: ATXN1; (-) strand; PAM type: YTN; PAM sequence: CTC
tgccttcccccatgggtcag

SEQ ID NO: 197736 - DNA, 20 bp, Artificial Sequence
  Description of Artificial Sequence: Synthetic oligonucleotide
  Target: ATXN1; (-) strand; PAM type: YTN; PAM sequence: TTA
atcctctgccttcccccatg

SEQ ID NO: 197737 - DNA, 20 bp, Artificial Sequence
  Description of Artificial Sequence: Synthetic oligonucleotide
  Target: ATXN1; (-) strand; PAM type: YTN; PAM sequence: CTT
aatcctctgccttcccccat

SEQ ID NO: 197738 - DNA, 20 bp, Artificial Sequence
  Description of Artificial Sequence: Synthetic oligonucleotide
  Target: ATXN1; (-) strand; PAM type: YTN; PAM sequence: CTG
gggtggaaggagaaagaatc

SEQ ID NO: 197739 - DNA, 20 bp, Artificial Sequence
  Description of Artificial Sequence: Synthetic oligonucleotide
  Target: ATXN1; (-) strand; PAM type: YTN; PAM sequence: CTG
ctggggtggaaggagaaaga

SEQ ID NO: 197740 - DNA, 20 bp, Artificial Sequence
  Description of Artificial Sequence: Synthetic oligonucleotide
  Target: ATXN1; (-) strand; PAM type: YTN; PAM sequence: CTC
tgctggggtggaaggagaaa

SEQ ID NO: 197741 - DNA, 20 bp, Artificial Sequence
  Description of Artificial Sequence: Synthetic oligonucleotide
  Target: ATXN1; (-) strand; PAM type: YTN; PAM sequence: CTA
agaacaggtccctctgctgg

SEQ ID NO: 197742 - DNA, 20 bp, Artificial Sequence
  Description of Artificial Sequence: Synthetic oligonucleotide
  Target: ATXN1; (-) strand; PAM type: YTN; PAM sequence: CTG
ggaagctaagaacaggtccc

SEQ ID NO: 197743 - DNA, 20 bp, Artificial Sequence
  Description of Artificial Sequence: Synthetic oligonucleotide
  Target: ATXN1; (-) strand; PAM type: YTN; PAM sequence: CTC
aagctgggaagctaagaaca

SEQ ID NO: 197744 - DNA, 20 bp, Artificial Sequence
  Description of Artificial Sequence: Synthetic oligonucleotide
  Target: ATXN1; (-) strand; PAM type: YTN; PAM sequence: CTC
caaagaaagaaacagaaaga

SEQ ID NO: 197745 - DNA, 20 bp, Artificial Sequence
  Description of Artificial Sequence: Synthetic oligonucleotide
  Target: ATXN1; (-) strand; PAM type: YTN; PAM sequence: CTG
aaaaaggaacaaatacagaa

SEQ ID NO: 197746 - DNA, 20 bp, Artificial Sequence
  Description of Artificial Sequence: Synthetic oligonucleotide
  Target: ATXN1; (-) strand; PAM type: YTN; PAM sequence: CTC
gggactgaaaaaggaacaaa

SEQ ID NO: 197747 - DNA, 20 bp, Artificial Sequence
  Description of Artificial Sequence: Synthetic oligonucleotide
  Target: ATXN1; (-) strand; PAM type: YTN; PAM sequence: TTC
cagtgatcagccctcgggac

SEQ ID NO: 197748 - DNA, 20 bp, Artificial Sequence
  Description of Artificial Sequence: Synthetic oligonucleotide
  Target: ATXN1; (-) strand; PAM type: YTN; PAM sequence: TTT
ccagtgatcagccctcggga

SEQ ID NO: 197749 - DNA, 20 bp, Artificial Sequence
  Description of Artificial Sequence: Synthetic oligonucleotide
  Target: ATXN1; (-) strand; PAM type: YTN; PAM sequence: CTG
tttccagtgatcagccctcg

SEQ ID NO: 197750 - DNA, 20 bp, Artificial Sequence
  Description of Artificial Sequence: Synthetic oligonucleotide
  Target: ATXN1; (-) strand; PAM type: YTN; PAM sequence: TTG
ccctgtttccagtgatcagc

SEQ ID NO: 197751 - DNA, 20 bp, Artificial Sequence
  Description of Artificial Sequence: Synthetic oligonucleotide
  Target: ATXN1; (-) strand; PAM type: YTN; PAM sequence: CTG
gtgatgaaaaaccaggtcac

SEQ ID NO: 197752 - DNA, 20 bp, Artificial Sequence
  Description of Artificial Sequence: Synthetic oligonucleotide
  Target: ATXN1; (-) strand; PAM type: YTN; PAM sequence: CTG
gctggtgatgaaaaaccagg

SEQ ID NO: 197753 - DNA, 20 bp, Artificial Sequence
  Description of Artificial Sequence: Synthetic oligonucleotide
  Target: ATXN1; (-) strand; PAM type: YTN; PAM sequence: CTG
ccctggctggtgatgaaaaa

SEQ ID NO: 197754 - DNA, 20 bp, Artificial Sequence
  Description of Artificial Sequence: Synthetic oligonucleotide
  Target: ATXN1; (-) strand; PAM type: YTN; PAM sequence: TTC
tgccctggctggtgatgaaa

SEQ ID NO: 197755 - DNA, 20 bp, Artificial Sequence
  Description of Artificial Sequence: Synthetic oligonucleotide
  Target: ATXN1; (-) strand; PAM type: YTN; PAM sequence: CTT
ctgccctggctggtgatgaa

SEQ ID NO: 197756 - DNA, 20 bp, Artificial Sequence
  Description of Artificial Sequence: Synthetic oligonucleotide
  Target: ATXN1; (-) strand; PAM type: YTN; PAM sequence: TTC
ttctgccctggctggtgatg

SEQ ID NO: 197757 - DNA, 20 bp, Artificial Sequence
  Description of Artificial Sequence: Synthetic oligonucleotide
  Target: ATXN1; (-) strand; PAM type: YTN; PAM sequence: CTT
cttctgccctggctggtgat

SEQ ID NO: 197758 - DNA, 20 bp, Artificial Sequence
  Description of Artificial Sequence: Synthetic oligonucleotide
  Target: ATXN1; (-) strand; PAM type: YTN; PAM sequence: TTG
acttcttctgccctggctgg

SEQ ID NO: 197759 - DNA, 20 bp, Artificial Sequence
  Description of Artificial Sequence: Synthetic oligonucleotide
  Target: ATXN1; (-) strand; PAM type: YTN; PAM sequence: TTT
gacttcttctgccctggctg

SEQ ID NO: 197760 - DNA, 20 bp, Artificial Sequence
  Description of Artificial Sequence: Synthetic oligonucleotide
  Target: ATXN1; (-) strand; PAM type: YTN; PAM sequence: CTT
tgacttcttctgccctggct

SEQ ID NO: 197761 - DNA, 20 bp, Artificial Sequence
  Description of Artificial Sequence: Synthetic oligonucleotide
  Target: ATXN1; (-) strand; PAM type: YTN; PAM sequence: TTG
agcacactttgacttcttct

SEQ ID NO: 197762 - DNA, 20 bp, Artificial Sequence
  Description of Artificial Sequence: Synthetic oligonucleotide
  Target: ATXN1; (-) strand; PAM type: YTN; PAM sequence: CTT
gagcacactttgacttcttc

SEQ ID NO: 197763 - DNA, 20 bp, Artificial Sequence
  Description of Artificial Sequence: Synthetic oligonucleotide
  Target: ATXN1; (-) strand; PAM type: YTN; PAM sequence: CTA
gggagcagcgtgcaaagccc

SEQ ID NO: 197764 - DNA, 20 bp, Artificial Sequence
  Description of Artificial Sequence: Synthetic oligonucleotide
  Target: ATXN1; (-) strand; PAM type: YTN; PAM sequence: TTC
tagggagcagcgtgcaaagc

SEQ ID NO: 197765 - DNA, 20 bp, Artificial Sequence
  Description of Artificial Sequence: Synthetic oligonucleotide
  Target: ATXN1; (-) strand; PAM type: YTN; PAM sequence: CTC
aaaggcgtccagttctaggg

SEQ ID NO: 197766 - DNA, 20 bp, Artificial Sequence
  Description of Artificial Sequence: Synthetic oligonucleotide
  Target: ATXN1; (-) strand; PAM type: YTN; PAM sequence: TTC
tcaaaggcgtccagttctag

SEQ ID NO: 197767 - DNA, 20 bp, Artificial Sequence
  Description of Artificial Sequence: Synthetic oligonucleotide
  Target: ATXN1; (-) strand; PAM type: YTN; PAM sequence: TTT
ctcaaaggcgtccagttcta

SEQ ID NO: 197768 - DNA, 20 bp, Artificial Sequence
  Description of Artificial Sequence: Synthetic oligonucleotide
  Target: ATXN1; (-) strand; PAM type: YTN; PAM sequence: CTG
gaagaatcccagatttctca

SEQ ID NO: 197769 - DNA, 20 bp, Artificial Sequence
  Description of Artificial Sequence: Synthetic oligonucleotide
  Target: ATXN1; (-) strand; PAM type: YTN; PAM sequence: CTG
ccgcctggaagaatcccaga

SEQ ID NO: 197770 - DNA, 20 bp, Artificial Sequence
  Description of Artificial Sequence: Synthetic oligonucleotide
  Target: ATXN1; (-) strand; PAM type: YTN; PAM sequence: CTG
tggaatgaagtctgccgcct

SEQ ID NO: 197771 - DNA, 20 bp, Artificial Sequence
  Description of Artificial Sequence: Synthetic oligonucleotide
  Target: ATXN1; (-) strand; PAM type: YTN; PAM sequence: TTC
caccactgtggaatgaagtc

SEQ ID NO: 197772 - DNA, 20 bp, Artificial Sequence
  Description of Artificial Sequence: Synthetic oligonucleotide
  Target: ATXN1; (-) strand; PAM type: YTN; PAM sequence: TTT
ccaccactgtggaatgaagt

SEQ ID NO: 197773 - DNA, 20 bp, Artificial Sequence
  Description of Artificial Sequence: Synthetic oligonucleotide
  Target: ATXN1; (-) strand; PAM type: YTN; PAM sequence: TTT
tccaccactgtggaatgaag

SEQ ID NO: 197774 - DNA, 20 bp, Artificial Sequence
  Description of Artificial Sequence: Synthetic oligonucleotide
  Target: ATXN1; (-) strand; PAM type: YTN; PAM sequence: CTT
ttccaccactgtggaatgaa

SEQ ID NO: 197775 - DNA, 20 bp, Artificial Sequence
  Description of Artificial Sequence: Synthetic oligonucleotide
  Target: ATXN1; (-) strand; PAM type: YTN; PAM sequence: CTG
gccagcttttccaccactgt

SEQ ID NO: 197776 - DNA, 20 bp, Artificial Sequence
  Description of Artificial Sequence: Synthetic oligonucleotide
  Target: ATXN1; (-) strand; PAM type: YTN; PAM sequence: CTC
cctggccagcttttccacca

SEQ ID NO: 197777 - DNA, 20 bp, Artificial Sequence
  Description of Artificial Sequence: Synthetic oligonucleotide
  Target: ATXN1; (-) strand; PAM type: YTN; PAM sequence: CTC
tccctggccagcttttccac

SEQ ID NO: 197778 - DNA, 20 bp, Artificial Sequence
  Description of Artificial Sequence: Synthetic oligonucleotide
  Target: ATXN1; (-) strand; PAM type: YTN; PAM sequence: CTC
tctccctggccagcttttcc

SEQ ID NO: 197779 - DNA, 20 bp, Artificial Sequence
  Description of Artificial Sequence: Synthetic oligonucleotide
  Target: ATXN1; (-) strand; PAM type: YTN; PAM sequence: CTC
tctctccctggccagctttt

SEQ ID NO: 197780 - DNA, 20 bp, Artificial Sequence
  Description of Artificial Sequence: Synthetic oligonucleotide
  Target: ATXN1; (-) strand; PAM type: YTN; PAM sequence: TTG
ctctctctccctggccagct

SEQ ID NO: 197781 - DNA, 20 bp, Artificial Sequence
  Description of Artificial Sequence: Synthetic oligonucleotide
  Target: ATXN1; (-) strand; PAM type: YTN; PAM sequence: TTG
caaaattgctctctctccct

SEQ ID NO: 197782 - DNA, 20 bp, Artificial Sequence
  Description of Artificial Sequence: Synthetic oligonucleotide
  Target: ATXN1; (-) strand; PAM type: YTN; PAM sequence: CTT
gcaaaattgctctctctccc

SEQ ID NO: 197783 - DNA, 20 bp, Artificial Sequence
  Description of Artificial Sequence: Synthetic oligonucleotide
  Target: ATXN1; (-) strand; PAM type: YTN; PAM sequence: CTG
tgccttgcaaaattgctctc

SEQ ID NO: 197784 - DNA, 20 bp, Artificial Sequence
  Description of Artificial Sequence: Synthetic oligonucleotide
  Target: ATXN1; (-) strand; PAM type: YTN; PAM sequence: TTG
gcggtgtcaggatacaggtc

SEQ ID NO: 197785 - DNA, 20 bp, Artificial Sequence
  Description of Artificial Sequence: Synthetic oligonucleotide
  Target: ATXN1; (-) strand; PAM type: YTN; PAM sequence: TTT
ggcggtgtcaggatacaggt

SEQ ID NO: 197786 - DNA, 20 bp, Artificial Sequence
  Description of Artificial Sequence: Synthetic oligonucleotide
  Target: ATXN1; (-) strand; PAM type: YTN; PAM sequence: CTG
atttggcggtgtcaggatac

SEQ ID NO: 197787 - DNA, 20 bp, Artificial Sequence
  Description of Artificial Sequence: Synthetic oligonucleotide
  Target: ATXN1; (-) strand; PAM type: YTN; PAM sequence: CTC
tgatttggcggtgtcaggat

SEQ ID NO: 197788 - DNA, 20 bp, Artificial Sequence
  Description of Artificial Sequence: Synthetic oligonucleotide
  Target: ATXN1; (-) strand; PAM type: YTN; PAM sequence: CTC
ctctgatttggcggtgtcag

SEQ ID NO: 197789 - DNA, 20 bp, Artificial Sequence
  Description of Artificial Sequence: Synthetic oligonucleotide
  Target: ATXN1; (-) strand; PAM type: YTN; PAM sequence: CTG
cctcctctgatttggcggtg

SEQ ID NO: 197790 - DNA, 20 bp, Artificial Sequence
  Description of Artificial Sequence: Synthetic oligonucleotide
  Target: ATXN1; (-) strand; PAM type: YTN; PAM sequence: TTC
tgcctcctctgatttggcgg

SEQ ID NO: 197791 - DNA, 20 bp, Artificial Sequence
  Description of Artificial Sequence: Synthetic oligonucleotide
  Target: ATXN1; (-) strand; PAM type: YTN; PAM sequence: TTT
ctgcctcctctgatttggcg

SEQ ID NO: 197792 - DNA, 20 bp, Artificial Sequence
  Description of Artificial Sequence: Synthetic oligonucleotide
  Target: ATXN1; (-) strand; PAM type: YTN; PAM sequence: CTT
tctgcctcctctgatttggc

SEQ ID NO: 197793 - DNA, 20 bp, Artificial Sequence
  Description of Artificial Sequence: Synthetic oligonucleotide
  Target: ATXN1; (-) strand; PAM type: YTN; PAM sequence: CTC
agggctttctgcctcctctg

SEQ ID NO: 197794 - DNA, 20 bp, Artificial Sequence
  Description of Artificial Sequence: Synthetic oligonucleotide
  Target: ATXN1; (-) strand; PAM type: YTN; PAM sequence: CTG
taacactcagggctttctgc

SEQ ID NO: 197795 - DNA, 20 bp, Artificial Sequence
  Description of Artificial Sequence: Synthetic oligonucleotide
  Target: ATXN1; (-) strand; PAM type: YTN; PAM sequence: TTC
tgtaacactcagggctttct

SEQ ID NO: 197796 - DNA, 20 bp, Artificial Sequence
  Description of Artificial Sequence: Synthetic oligonucleotide
  Target: ATXN1; (-) strand; PAM type: YTN; PAM sequence: CTC
agacgttctgtaacactcag

SEQ ID NO: 197797 - DNA, 20 bp, Artificial Sequence
  Description of Artificial Sequence: Synthetic oligonucleotide
  Target: ATXN1; (-) strand; PAM type: YTN; PAM sequence: CTA
gctcagacgttctgtaacac

SEQ ID NO: 197798 - DNA, 20 bp, Artificial Sequence
  Description of Artificial Sequence: Synthetic oligonucleotide
  Target: ATXN1; (-) strand; PAM type: YTN; PAM sequence: CTC
tagctcagacgttctgtaac

SEQ ID NO: 197799 - DNA, 20 bp, Artificial Sequence
  Description of Artificial Sequence: Synthetic oligonucleotide
  Target: ATXN1; (-) strand; PAM type: YTN; PAM sequence: CTC
ctctagctcagacgttctgt

SEQ ID NO: 197800 - DNA, 20 bp, Artificial Sequence
  Description of Artificial Sequence: Synthetic oligonucleotide
  Target: ATXN1; (-) strand; PAM type: YTN; PAM sequence: TTA
gaggcctcctctagctcaga

SEQ ID NO: 197801 - DNA, 20 bp, Artificial Sequence
  Description of Artificial Sequence: Synthetic oligonucleotide
  Target: ATXN1; (-) strand; PAM type: YTN; PAM sequence: CTT
agaggcctcctctagctcag

SEQ ID NO: 197802 - DNA, 20 bp, Artificial Sequence
  Description of Artificial Sequence: Synthetic oligonucleotide
  Target: ATXN1; (-) strand; PAM type: YTN; PAM sequence: CTC
ttagaggcctcctctagctc

SEQ ID NO: 197803 - DNA, 20 bp, Artificial Sequence
  Description of Artificial Sequence: Synthetic oligonucleotide
  Target: ATXN1; (-) strand; PAM type: YTN; PAM sequence: CTG
aaagctcttagaggcctcct

SEQ ID NO: 197804 - DNA, 20 bp, Artificial Sequence
  Description of Artificial Sequence: Synthetic oligonucleotide
  Target: ATXN1; (-) strand; PAM type: YTN; PAM sequence: CTG
gactgaaagctcttagaggc

SEQ ID NO: 197805 - DNA, 20 bp, Artificial Sequence
  Description of Artificial Sequence: Synthetic oligonucleotide
  Target: ATXN1; (-) strand; PAM type: YTN; PAM sequence: TTA
aatgaggagactggactgaa

SEQ ID NO: 197806 - DNA, 20 bp, Artificial Sequence
  Description of Artificial Sequence: Synthetic oligonucleotide
  Target: ATXN1; (-) strand; PAM type: YTN; PAM sequence: TTC
attaaatgaggagactggac

SEQ ID NO: 197807 - DNA, 20 bp, Artificial Sequence
  Description of Artificial Sequence: Synthetic oligonucleotide
  Target: ATXN1; (-) strand; PAM type: YTN; PAM sequence: TTC
cgtgttcattaaatgaggag

SEQ ID NO: 197808 - DNA, 20 bp, Artificial Sequence
  Description of Artificial Sequence: Synthetic oligonucleotide
  Target: ATXN1; (-) strand; PAM type: YTN; PAM sequence: TTT
ccgtgttcattaaatgagga

SEQ ID NO: 197809 - DNA, 20 bp, Artificial Sequence
  Description of Artificial Sequence: Synthetic oligonucleotide
  Target: ATXN1; (-) strand; PAM type: YTN; PAM sequence: TTA
gcaggatacaatttccgtgt

SEQ ID NO: 197810 - DNA, 20 bp, Artificial Sequence
  Description of Artificial Sequence: Synthetic oligonucleotide
  Target: ATXN1; (-) strand; PAM type: YTN; PAM sequence: TTA
cgttagcaggatacaatttc

SEQ ID NO: 197811 - DNA, 20 bp, Artificial Sequence
  Description of Artificial Sequence: Synthetic oligonucleotide
  Target: ATXN1; (-) strand; PAM type: YTN; PAM sequence: TTT
acgttagcaggatacaattt

SEQ ID NO: 197812 - DNA, 20 bp, Artificial Sequence
  Description of Artificial Sequence: Synthetic oligonucleotide
  Target: ATXN1; (-) strand; PAM type: YTN; PAM sequence: CTT
tacgttagcaggatacaatt

SEQ ID NO: 197813 - DNA, 20 bp, Artificial Sequence
  Description of Artificial Sequence: Synthetic oligonucleotide
  Target: ATXN1; (-) strand; PAM type: YTN; PAM sequence: TTG
accaagtcactttacgttag

SEQ ID NO: 197814 - DNA, 20 bp, Artificial Sequence
  Description of Artificial Sequence: Synthetic oligonucleotide
  Target: ATXN1; (-) strand; PAM type: YTN; PAM sequence: TTT
gaccaagtcactttacgtta

SEQ ID NO: 197815 - DNA, 20 bp, Artificial Sequence
  Description of Artificial Sequence: Synthetic oligonucleotide
  Target: ATXN1; (-) strand; PAM type: YTN; PAM sequence: CTT
tgaccaagtcactttacgtt

SEQ ID NO: 197816 - DNA, 20 bp, Artificial Sequence
  Description of Artificial Sequence: Synthetic oligonucleotide
  Target: ATXN1; (-) strand; PAM type: YTN; PAM sequence: CTG
cgtagctttgaccaagtcac

SEQ ID NO: 197817 - DNA, 20 bp, Artificial Sequence
  Description of Artificial Sequence: Synthetic oligonucleotide
  Target: ATXN1; (-) strand; PAM type: YTN; PAM sequence: TTG
tgccactgcgtagctttgac

SEQ ID NO: 197818 - DNA, 20 bp, Artificial Sequence
  Description of Artificial Sequence: Synthetic oligonucleotide
  Target: ATXN1; (-) strand; PAM type: YTN; PAM sequence: TTA
gttgtgccactgcgtagctt

SEQ ID NO: 197819 - DNA, 20 bp, Artificial Sequence
  Description of Artificial Sequence: Synthetic oligonucleotide
  Target: ATXN1; (-) strand; PAM type: YTN; PAM sequence: TTT
agttgtgccactgcgtagct

SEQ ID NO: 197820 - DNA, 20 bp, Artificial Sequence
  Description of Artificial Sequence: Synthetic oligonucleotide
  Target: ATXN1; (-) strand; PAM type: YTN; PAM sequence: TTT
tagttgtgccactgcgtagc

SEQ ID NO: 197821 - DNA, 20 bp, Artificial Sequence
  Description of Artificial Sequence: Synthetic oligonucleotide
  Target: ATXN1; (-) strand; PAM type: YTN; PAM sequence: CTG
agttttagttgtgccactgc

SEQ ID NO: 197822 - DNA, 20 bp, Artificial Sequence
  Description of Artificial Sequence: Synthetic oligonucleotide
  Target: ATXN1; (-) strand; PAM type: YTN; PAM sequence: CTC
aggggcaagatgtcagaaat

SEQ ID NO: 197823 - DNA, 20 bp, Artificial Sequence
  Description of Artificial Sequence: Synthetic oligonucleotide
  Target: ATXN1; (-) strand; PAM type: YTN; PAM sequence: TTG
ggtgctcaggggcaagatgt

SEQ ID NO: 197824 - DNA, 20 bp, Artificial Sequence
  Description of Artificial Sequence: Synthetic oligonucleotide
  Target: ATXN1; (-) strand; PAM type: YTN; PAM sequence: TTT
gggtgctcaggggcaagatg

SEQ ID NO: 197825 - DNA, 20 bp, Artificial Sequence
  Description of Artificial Sequence: Synthetic oligonucleotide
  Target: ATXN1; (-) strand; PAM type: YTN; PAM sequence: TTT
tgggtgctcaggggcaagat

SEQ ID NO: 197826 - DNA, 20 bp, Artificial Sequence
  Description of Artificial Sequence: Synthetic oligonucleotide
  Target: ATXN1; (-) strand; PAM type: YTN; PAM sequence: TTG
agttttgggtgctcaggggc

SEQ ID NO: 197827 - DNA, 20 bp, Artificial Sequence
  Description of Artificial Sequence: Synthetic oligonucleotide
  Target: ATXN1; (-) strand; PAM type: YTN; PAM sequence: TTT
gagttttgggtgctcagggg

SEQ ID NO: 197828 - DNA, 20 bp, Artificial Sequence
  Description of Artificial Sequence: Synthetic oligonucleotide
  Target: ATXN1; (-) strand; PAM type: YTN; PAM sequence: CTT
tgagttttgggtgctcaggg

SEQ ID NO: 197829 - DNA, 20 bp, Artificial Sequence
  Description of Artificial Sequence: Synthetic oligonucleotide
  Target: ATXN1; (-) strand; PAM type: YTN; PAM sequence: CTG
tcctttgagttttgggtgct

SEQ ID NO: 197830 - DNA, 20 bp, Artificial Sequence
  Description of Artificial Sequence: Synthetic oligonucleotide
  Target: ATXN1; (-) strand; PAM type: YTN; PAM sequence: TTC
tgtcctttgagttttgggtg

SEQ ID NO: 197831 - DNA, 20 bp, Artificial Sequence
  Description of Artificial Sequence: Synthetic oligonucleotide
  Target: ATXN1; (-) strand; PAM type: YTN; PAM sequence: TTT
ctgtcctttgagttttgggt

SEQ ID NO: 197832 - DNA, 20 bp, Artificial Sequence
  Description of Artificial Sequence: Synthetic oligonucleotide
  Target: ATXN1; (-) strand; PAM type: YTN; PAM sequence: CTT
tctgtcctttgagttttggg

SEQ ID NO: 197833 - DNA, 20 bp, Artificial Sequence
  Description of Artificial Sequence: Synthetic oligonucleotide
  Target: ATXN1; (-) strand; PAM type: YTN; PAM sequence: TTG
tactttctgtcctttgagtt

SEQ ID NO: 197834 - DNA, 20 bp, Artificial Sequence
  Description of Artificial Sequence: Synthetic oligonucleotide
  Target: ATXN1; (-) strand; PAM type: YTN; PAM sequence: TTC
acattgtactttctgtcctt

SEQ ID NO: 197835 - DNA, 20 bp, Artificial Sequence
  Description of Artificial Sequence: Synthetic oligonucleotide
  Target: ATXN1; (-) strand; PAM type: YTN; PAM sequence: CTG
tagttcacattgtactttct

SEQ ID NO: 197836 - DNA, 20 bp, Artificial Sequence
  Description of Artificial Sequence: Synthetic oligonucleotide
  Target: ATXN1; (-) strand; PAM type: YTN; PAM sequence: TTC
tgtagttcacattgtacttt

SEQ ID NO: 197837 - DNA, 20 bp, Artificial Sequence
  Description of Artificial Sequence: Synthetic oligonucleotide
  Target: ATXN1; (-) strand; PAM type: YTN; PAM sequence: CTT
ctgtagttcacattgtactt

SEQ ID NO: 197838 - DNA, 20 bp, Artificial Sequence
  Description of Artificial Sequence: Synthetic oligonucleotide
  Target: ATXN1; (-) strand; PAM type: YTN; PAM sequence: TTA
cttctgtagttcacattgta

SEQ ID NO: 197839 - DNA, 20 bp, Artificial Sequence
  Description of Artificial Sequence: Synthetic oligonucleotide
  Target: ATXN1; (-) strand; PAM type: YTN; PAM sequence: TTG
gttacttctgtagttcacat

SEQ ID NO: 197840 - DNA, 20 bp, Artificial Sequence
  Description of Artificial Sequence: Synthetic oligonucleotide
  Target: ATXN1; (-) strand; PAM type: YTN; PAM sequence: TTT
ggttacttctgtagttcaca

SEQ ID NO: 197841 - DNA, 20 bp, Artificial Sequence
  Description of Artificial Sequence: Synthetic oligonucleotide
  Target: ATXN1; (-) strand; PAM type: YTN; PAM sequence: CTT
tggttacttctgtagttcac

SEQ ID NO: 197842 - DNA, 20 bp, Artificial Sequence
  Description of Artificial Sequence: Synthetic oligonucleotide
  Target: ATXN1; (-) strand; PAM type: YTN; PAM sequence: TTG
acatcaccagaaagtccttt

SEQ ID NO: 197843 - DNA, 20 bp, Artificial Sequence
  Description of Artificial Sequence: Synthetic oligonucleotide
  Target: ATXN1; (-) strand; PAM type: YTN; PAM sequence: TTT
gacatcaccagaaagtcctt

SEQ ID NO: 197844 - DNA, 20 bp, Artificial Sequence
  Description of Artificial Sequence: Synthetic oligonucleotide
  Target: ATXN1; (-) strand; PAM type: YTN; PAM sequence: TTG
catcatttgacatcaccaga

SEQ ID NO: 197845 - DNA, 20 bp, Artificial Sequence
  Description of Artificial Sequence: Synthetic oligonucleotide
  Target: ATXN1; (-) strand; PAM type: YTN; PAM sequence: CTT
gcatcatttgacatcaccag

SEQ ID NO: 197846 - DNA, 20 bp, Artificial Sequence
  Description of Artificial Sequence: Synthetic oligonucleotide
  Target: ATXN1; (-) strand; PAM type: YTN; PAM sequence: CTG
tcttgcatcatttgacatca

SEQ ID NO: 197847 - DNA, 20 bp, Artificial Sequence
  Description of Artificial Sequence: Synthetic oligonucleotide
  Target: ATXN1; (-) strand; PAM type: YTN; PAM sequence: TTG
ctgtcttgcatcatttgaca

SEQ ID NO: 197848 - DNA, 20 bp, Artificial Sequence
  Description of Artificial Sequence: Synthetic oligonucleotide
  Target: ATXN1; (-) strand; PAM type: YTN; PAM sequence: TTT
gctgtcttgcatcatttgac

SEQ ID NO: 197849 - DNA, 20 bp, Artificial Sequence
  Description of Artificial Sequence: Synthetic oligonucleotide
  Target: ATXN1; (-) strand; PAM type: YTN; PAM sequence: TTT
tgctgtcttgcatcatttga

SEQ ID NO: 197850 - DNA, 20 bp, Artificial Sequence
  Description of Artificial Sequence: Synthetic oligonucleotide
  Target: ATXN1; (-) strand; PAM type: YTN; PAM sequence: TTG
agcattttgctgtcttgcat

SEQ ID NO: 197851 - DNA, 20 bp, Artificial Sequence
  Description of Artificial Sequence: Synthetic oligonucleotide
  Target: ATXN1; (-) strand; PAM type: YTN; PAM sequence: CTT
gagcattttgctgtcttgca

SEQ ID NO: 197852 - DNA, 20 bp, Artificial Sequence
  Description of Artificial Sequence: Synthetic oligonucleotide
  Target: ATXN1; (-) strand; PAM type: YTN; PAM sequence: TTC
ccaacttgagcattttgctg

SEQ ID NO: 197853 - DNA, 20 bp, Artificial Sequence
  Description of Artificial Sequence: Synthetic oligonucleotide
  Target: ATXN1; (-) strand; PAM type: YTN; PAM sequence: TTA
ttcccaacttgagcattttg

SEQ ID NO: 197854 - DNA, 20 bp, Artificial Sequence
  Description of Artificial Sequence: Synthetic oligonucleotide
  Target: ATXN1; (-) strand; PAM type: YTN; PAM sequence: TTT
attcccaacttgagcatttt

SEQ ID NO: 197855 - DNA, 20 bp, Artificial Sequence
  Description of Artificial Sequence: Synthetic oligonucleotide
  Target: ATXN1; (-) strand; PAM type: YTN; PAM sequence: CTA
tcaatttattcccaacttga

SEQ ID NO: 197856 - DNA, 20 bp, Artificial Sequence
  Description of Artificial Sequence: Synthetic oligonucleotide
  Target: ATXN1; (-) strand; PAM type: YTN; PAM sequence: TTA
atagatacacctatcaattt

SEQ ID NO: 197857 - DNA, 20 bp, Artificial Sequence
  Description of Artificial Sequence: Synthetic oligonucleotide
  Target: ATXN1; (-) strand; PAM type: YTN; PAM sequence: TTT
aatagatacacctatcaatt

SEQ ID NO: 197858 - DNA, 20 bp, Artificial Sequence
  Description of Artificial Sequence: Synthetic oligonucleotide
  Target: ATXN1; (-) strand; PAM type: YTN; PAM sequence: TTT
taatagatacacctatcaat

SEQ ID NO: 197859 - DNA, 20 bp, Artificial Sequence
  Description of Artificial Sequence: Synthetic oligonucleotide
  Target: ATXN1; (-) strand; PAM type: YTN; PAM sequence: TTA
agagatggttttaatagata

SEQ ID NO: 197860 - DNA, 20 bp, Artificial Sequence
  Description of Artificial Sequence: Synthetic oligonucleotide
  Target: ATXN1; (-) strand; PAM type: YTN; PAM sequence: CTT
aagagatggttttaatagat

SEQ ID NO: 197861 - DNA, 20 bp, Artificial Sequence
  Description of Artificial Sequence: Synthetic oligonucleotide
  Target: ATXN1; (-) strand; PAM type: YTN; PAM sequence: TTC
ccccagaaggccttaagaga

SEQ ID NO: 197862 - DNA, 20 bp, Artificial Sequence
  Description of Artificial Sequence: Synthetic oligonucleotide
  Target: ATXN1; (-) strand; PAM type: YTN; PAM sequence: TTT
cccccagaaggccttaagag

SEQ ID NO: 197863 - DNA, 20 bp, Artificial Sequence
  Description of Artificial Sequence: Synthetic oligonucleotide
  Target: ATXN1; (-) strand; PAM type: YTN; PAM sequence: TTT
tcccccagaaggccttaaga

SEQ ID NO: 197864 - DNA, 20 bp, Artificial Sequence
  Description of Artificial Sequence: Synthetic oligonucleotide
  Target: ATXN1; (-) strand; PAM type: YTN; PAM sequence: TTG
gtggtggcgttttcccccag

SEQ ID NO: 197865 - DNA, 20 bp, Artificial Sequence
  Description of Artificial Sequence: Synthetic oligonucleotide
  Target: ATXN1; (-) strand; PAM type: YTN; PAM sequence: CTT
ggtggtggcgttttccccca

SEQ ID NO: 197866 - DNA, 20 bp, Artificial Sequence
  Description of Artificial Sequence: Synthetic oligonucleotide
  Target: ATXN1; (-) strand; PAM type: YTN; PAM sequence: TTC
ttggtggtggcgttttcccc

SEQ ID NO: 197867 - DNA, 20 bp, Artificial Sequence
  Description of Artificial Sequence: Synthetic oligonucleotide
  Target: ATXN1; (-) strand; PAM type: YTN; PAM sequence: TTC
aagtaattcttggtggtggc

SEQ ID NO: 197868 - DNA, 20 bp, Artificial Sequence
  Description of Artificial Sequence: Synthetic oligonucleotide
  Target: ATXN1; (-) strand; PAM type: YTN; PAM sequence: CTT
caagtaattcttggtggtgg

SEQ ID NO: 197869 - DNA, 20 bp, Artificial Sequence
  Description of Artificial Sequence: Synthetic oligonucleotide
  Target: ATXN1; (-) strand; PAM type: YTN; PAM sequence: TTG
acaagccttcaagtaattct

SEQ ID NO: 197870 - DNA, 20 bp, Artificial Sequence
  Description of Artificial Sequence: Synthetic oligonucleotide
  Target: ATXN1; (-) strand; PAM type: YTN; PAM sequence: CTT
gacaagccttcaagtaattc

SEQ ID NO: 197871 - DNA, 20 bp, Artificial Sequence
  Description of Artificial Sequence: Synthetic oligonucleotide
  Target: ATXN1; (-) strand; PAM type: YTN; PAM sequence: TTA
aagcacttgacaagccttca

SEQ ID NO: 197872 - DNA, 20 bp, Artificial Sequence
  Description of Artificial Sequence: Synthetic oligonucleotide
  Target: ATXN1; (-) strand; PAM type: YTN; PAM sequence: CTT
aaagcacttgacaagccttc

SEQ ID NO: 197873 - DNA, 20 bp, Artificial Sequence
  Description of Artificial Sequence: Synthetic oligonucleotide
  Target: ATXN1; (-) strand; PAM type: YTN; PAM sequence: TTA
tagcgccttaaagcacttga

SEQ ID NO: 197874 - DNA, 20 bp, Artificial Sequence
  Description of Artificial Sequence: Synthetic oligonucleotide
  Target: ATXN1; (-) strand; PAM type: YTN; PAM sequence: CTT
atagcgccttaaagcacttg

SEQ ID NO: 197875 - DNA, 20 bp, Artificial Sequence
  Description of Artificial Sequence: Synthetic oligonucleotide
  Target: ATXN1; (-) strand; PAM type: YTN; PAM sequence: TTG
ccttatagcgccttaaagca

SEQ ID NO: 197876 - DNA, 20 bp, Artificial Sequence
  Description of Artificial Sequence: Synthetic oligonucleotide
  Target: ATXN1; (-) strand; PAM type: YTN; PAM sequence: CTT
gccttatagcgccttaaagc

SEQ ID NO: 197877 - DNA, 20 bp, Artificial Sequence
  Description of Artificial Sequence: Synthetic oligonucleotide
  Target: ATXN1; (-) strand; PAM type: YTN; PAM sequence: TTG
catcttgccttatagcgcct

SEQ ID NO: 197878 - DNA, 20 bp, Artificial Sequence
  Description of Artificial Sequence: Synthetic oligonucleotide
  Target: ATXN1; (-) strand; PAM type: YTN; PAM sequence: CTC
agtgttgcatcttgccttat

SEQ ID NO: 197879 - DNA, 20 bp, Artificial Sequence
  Description of Artificial Sequence: Synthetic oligonucleotide
  Target: ATXN1; (-) strand; PAM type: YTN; PAM sequence: CTC
tcagtgttgcatcttgcctt

SEQ ID NO: 197880 - DNA, 20 bp, Artificial Sequence
  Description of Artificial Sequence: Synthetic oligonucleotide
  Target: ATXN1; (-) strand; PAM type: YTN; PAM sequence: TTA
atgtctctcagtgttgcatc

SEQ ID NO: 197881 - DNA, 20 bp, Artificial Sequence
  Description of Artificial Sequence: Synthetic oligonucleotide
  Target: ATXN1; (-) strand; PAM type: YTN; PAM sequence: TTT
aatgtctctcagtgttgcat

SEQ ID NO: 197882 - DNA, 20 bp, Artificial Sequence
  Description of Artificial Sequence: Synthetic oligonucleotide
  Target: ATXN1; (-) strand; PAM type: YTN; PAM sequence: TTT
taatgtctctcagtgttgca

SEQ ID NO: 197883 - DNA, 20 bp, Artificial Sequence
  Description of Artificial Sequence: Synthetic oligonucleotide
  Target: ATXN1; (-) strand; PAM type: YTN; PAM sequence: TTT
ttaatgtctctcagtgttgc

SEQ ID NO: 197884 - DNA, 20 bp, Artificial Sequence
  Description of Artificial Sequence: Synthetic oligonucleotide
  Target: ATXN1; (-) strand; PAM type: YTN; PAM sequence: TTT
tttaatgtctctcagtgttg

SEQ ID NO: 197885 - DNA, 20 bp, Artificial Sequence
  Description of Artificial Sequence: Synthetic oligonucleotide
  Target: ATXN1; (-) strand; PAM type: YTN; PAM sequence: TTT
ttttaatgtctctcagtgtt

SEQ ID NO: 197886 - DNA, 20 bp, Artificial Sequence
  Description of Artificial Sequence: Synthetic oligonucleotide
  Target: ATXN1; (-) strand; PAM type: YTN; PAM sequence: CTT
tttttaatgtctctcagtgt

SEQ ID NO: 197887 - DNA, 20 bp, Artificial Sequence
  Description of Artificial Sequence: Synthetic oligonucleotide
  Target: ATXN1; (-) strand; PAM type: YTN; PAM sequence: TTA
tctttttttaatgtctctca

SEQ ID NO: 197888 - DNA, 20 bp, Artificial Sequence
  Description of Artificial Sequence: Synthetic oligonucleotide
  Target: ATXN1; (-) strand; PAM type: YTN; PAM sequence: CTC
aggcagtggggaaaaggtta

SEQ ID NO: 197889 - DNA, 20 bp, Artificial Sequence
  Description of Artificial Sequence: Synthetic oligonucleotide
  Target: ATXN1; (-) strand; PAM type: YTN; PAM sequence: CTC
aagagcaactcaggcagtgg

SEQ ID NO: 197890 - DNA, 20 bp, Artificial Sequence
  Description of Artificial Sequence: Synthetic oligonucleotide
  Target: ATXN1; (-) strand; PAM type: YTN; PAM sequence: CTA
ggcactcaagagcaactcag

SEQ ID NO: 197891 - DNA, 20 bp, Artificial Sequence
  Description of Artificial Sequence: Synthetic oligonucleotide
  Target: ATXN1; (-) strand; PAM type: YTN; PAM sequence: TTC
acccactaggcactcaagag

SEQ ID NO: 197892 - DNA, 20 bp, Artificial Sequence
  Description of Artificial Sequence: Synthetic oligonucleotide
  Target: ATXN1; (-) strand; PAM type: YTN; PAM sequence: CTG
ttcacccactaggcactcaa

SEQ ID NO: 197893 - DNA, 20 bp, Artificial Sequence
  Description of Artificial Sequence: Synthetic oligonucleotide
  Target: ATXN1; (-) strand; PAM type: YTN; PAM sequence: CTC
tgttcacccactaggcactc

SEQ ID NO: 197894 - DNA, 20 bp, Artificial Sequence
  Description of Artificial Sequence: Synthetic oligonucleotide
  Target: ATXN1; (-) strand; PAM type: YTN; PAM sequence: CTC
ctctgttcacccactaggca

SEQ ID NO: 197895 - DNA, 20 bp, Artificial Sequence
  Description of Artificial Sequence: Synthetic oligonucleotide
  Target: ATXN1; (-) strand; PAM type: YTN; PAM sequence: CTC
cctcctctgttcacccacta

SEQ ID NO: 197896 - DNA, 20 bp, Artificial Sequence
  Description of Artificial Sequence: Synthetic oligonucleotide
  Target: ATXN1; (-) strand; PAM type: YTN; PAM sequence: TTC
tccctcctctgttcacccac

SEQ ID NO: 197897 - DNA, 20 bp, Artificial Sequence
  Description of Artificial Sequence: Synthetic oligonucleotide
  Target: ATXN1; (-) strand; PAM type: YTN; PAM sequence: CTT
ctccctcctctgttcaccca

SEQ ID NO: 197898 - DNA, 20 bp, Artificial Sequence
  Description of Artificial Sequence: Synthetic oligonucleotide
  Target: ATXN1; (-) strand; PAM type: YTN; PAM sequence: CTG
ggcgcttctccctcctctgt

SEQ ID NO: 197899 - DNA, 20 bp, Artificial Sequence
  Description of Artificial Sequence: Synthetic oligonucleotide
  Target: ATXN1; (-) strand; PAM type: YTN; PAM sequence: TTG
gaagcctgggcgcttctccc

SEQ ID NO: 197900 - DNA, 20 bp, Artificial Sequence
  Description of Artificial Sequence: Synthetic oligonucleotide
  Target: ATXN1; (-) strand; PAM type: YTN; PAM sequence: CTG
tgcagagaacccattggaag

SEQ ID NO: 197901 - DNA, 20 bp, Artificial Sequence
  Description of Artificial Sequence: Synthetic oligonucleotide
  Target: ATXN1; (-) strand; PAM type: YTN; PAM sequence: CTA
atgaccgtgtggctgtgcag

SEQ ID NO: 197902 - DNA, 20 bp, Artificial Sequence
  Description of Artificial Sequence: Synthetic oligonucleotide
  Target: ATXN1; (-) strand; PAM type: YTN; PAM sequence: TTG
tggatgctaatgaccgtgtg

SEQ ID NO: 197903 - DNA, 20 bp, Artificial Sequence
  Description of Artificial Sequence: Synthetic oligonucleotide
  Target: ATXN1; (-) strand; PAM type: YTN; PAM sequence: CTG
gagtgaatgcagattgtgga

SEQ ID NO: 197904 - DNA, 20 bp, Artificial Sequence
  Description of Artificial Sequence: Synthetic oligonucleotide
  Target: ATXN1; (-) strand; PAM type: YTN; PAM sequence: CTC
atctggagtgaatgcagatt

SEQ ID NO: 197905 - DNA, 20 bp, Artificial Sequence
  Description of Artificial Sequence: Synthetic oligonucleotide
  Target: ATXN1; (-) strand; PAM type: YTN; PAM sequence: TTA
aggaatgaataaataggatg

SEQ ID NO: 197906 - DNA, 20 bp, Artificial Sequence
  Description of Artificial Sequence: Synthetic oligonucleotide
  Target: ATXN1; (-) strand; PAM type: YTN; PAM sequence: TTA
tattaaggaatgaataaata

SEQ ID NO: 197907 - DNA, 20 bp, Artificial Sequence
  Description of Artificial Sequence: Synthetic oligonucleotide
  Target: ATXN1; (-) strand; PAM type: YTN; PAM sequence: TTT
atattaaggaatgaataaat

SEQ ID NO: 197908 - DNA, 20 bp, Artificial Sequence
  Description of Artificial Sequence: Synthetic oligonucleotide
  Target: ATXN1; (-) strand; PAM type: YTN; PAM sequence: TTA
gatttatattaaggaatgaa

SEQ ID NO: 197909 - DNA, 20 bp, Artificial Sequence
  Description of Artificial Sequence: Synthetic oligonucleotide
  Target: ATXN1; (-) strand; PAM type: YTN; PAM sequence: TTT
agatttatattaaggaatga

SEQ ID NO: 197910 - DNA, 20 bp, Artificial Sequence
  Description of Artificial Sequence: Synthetic oligonucleotide
  Target: ATXN1; (-) strand; PAM type: YTN; PAM sequence: TTG
aagagcgcaatttagattta

SEQ ID NO: 197911 - DNA, 20 bp, Artificial Sequence
  Description of Artificial Sequence: Synthetic oligonucleotide
  Target: ATXN1; (-) strand; PAM type: YTN; PAM sequence: TTT
gaagagcgcaatttagattt

SEQ ID NO: 197912 - DNA, 20 bp, Artificial Sequence
  Description of Artificial Sequence: Synthetic oligonucleotide
  Target: ATXN1; (-) strand; PAM type: YTN; PAM sequence: CTA
tttgaagagcgcaatttaga

SEQ ID NO: 197913 - DNA, 20 bp, Artificial Sequence
  Description of Artificial Sequence: Synthetic oligonucleotide
  Target: ATXN1; (-) strand; PAM type: YTN; PAM sequence: CTG
ctatttgaagagcgcaattt

SEQ ID NO: 197914 - DNA, 20 bp, Artificial Sequence
  Description of Artificial Sequence: Synthetic oligonucleotide
  Target: ATXN1; (-) strand; PAM type: YTN; PAM sequence: CTC
tgctatttgaagagcgcaat

SEQ ID NO: 197915 - DNA, 20 bp, Artificial Sequence
  Description of Artificial Sequence: Synthetic oligonucleotide
  Target: ATXN1; (-) strand; PAM type: YTN; PAM sequence: CTC
tctgctatttgaagagcgca

SEQ ID NO: 197916 - DNA, 20 bp, Artificial Sequence
  Description of Artificial Sequence: Synthetic oligonucleotide
  Target: ATXN1; (-) strand; PAM type: YTN; PAM sequence: CTG
aagcatagtgctctctgcta

SEQ ID NO: 197917 - DNA, 20 bp, Artificial Sequence
  Description of Artificial Sequence: Synthetic oligonucleotide
  Target: ATXN1; (-) strand; PAM type: YTN; PAM sequence: TTA
ctgaagcatagtgctctctg

SEQ ID NO: 197918 - DNA, 20 bp, Artificial Sequence
  Description of Artificial Sequence: Synthetic oligonucleotide
  Target: ATXN1; (-) strand; PAM type: YTN; PAM sequence: CTT
actgaagcatagtgctctct

SEQ ID NO: 197919 - DNA, 20 bp, Artificial Sequence
  Description of Artificial Sequence: Synthetic oligonucleotide
  Target: ATXN1; (-) strand; PAM type: YTN; PAM sequence: TTC
cccttactgaagcatagtgc

SEQ ID NO: 197920 - DNA, 20 bp, Artificial Sequence
  Description of Artificial Sequence: Synthetic oligonucleotide
  Target: ATXN1; (-) strand; PAM type: YTN; PAM sequence: TTT
ccccttactgaagcatagtg

SEQ ID NO: 197921 - DNA, 20 bp, Artificial Sequence
  Description of Artificial Sequence: Synthetic oligonucleotide
  Target: ATXN1; (-) strand; PAM type: YTN; PAM sequence: CTT
tccccttactgaagcatagt

SEQ ID NO: 197922 - DNA, 20 bp, Artificial Sequence
  Description of Artificial Sequence: Synthetic oligonucleotide
  Target: ATXN1; (-) strand; PAM type: YTN; PAM sequence: CTC
tttccccttactgaagcata

SEQ ID NO: 197923 - DNA, 20 bp, Artificial Sequence
  Description of Artificial Sequence: Synthetic oligonucleotide
  Target: ATXN1; (-) strand; PAM type: YTN; PAM sequence: TTC
tctttccccttactgaagca

SEQ ID NO: 197924 - DNA, 20 bp, Artificial Sequence
  Description of Artificial Sequence: Synthetic oligonucleotide
  Target: ATXN1; (-) strand; PAM type: YTN; PAM sequence: TTT
ctctttccccttactgaagc

SEQ ID NO: 197925 - DNA, 20 bp, Artificial Sequence
  Description of Artificial Sequence: Synthetic oligonucleotide
  Target: ATXN1; (-) strand; PAM type: YTN; PAM sequence: TTA
atgtgatcgtttctctttcc

SEQ ID NO: 197926 - DNA, 20 bp, Artificial Sequence
  Description of Artificial Sequence: Synthetic oligonucleotide
  Target: ATXN1; (-) strand; PAM type: YTN; PAM sequence: CTT
aatgtgatcgtttctctttc

SEQ ID NO: 197927 - DNA, 20 bp, Artificial Sequence
  Description of Artificial Sequence: Synthetic oligonucleotide
  Target: ATXN1; (-) strand; PAM type: YTN; PAM sequence: CTC
ttaatgtgatcgtttctctt

SEQ ID NO: 197928 - DNA, 20 bp, Artificial Sequence
  Description of Artificial Sequence: Synthetic oligonucleotide
  Target: ATXN1; (-) strand; PAM type: YTN; PAM sequence: CTG
tcaagaccaaagtaacatag

SEQ ID NO: 197929 - DNA, 20 bp, Artificial Sequence
  Description of Artificial Sequence: Synthetic oligonucleotide
  Target: ATXN1; (-) strand; PAM type: YTN; PAM sequence: TTA
aggctgtcaagaccaaagta

SEQ ID NO: 197930 - DNA, 20 bp, Artificial Sequence
  Description of Artificial Sequence: Synthetic oligonucleotide
  Target: ATXN1; (-) strand; PAM type: YTN; PAM sequence: CTG
tgtgaattaaggctgtcaag

SEQ ID NO: 197931 - DNA, 20 bp, Artificial Sequence
  Description of Artificial Sequence: Synthetic oligonucleotide
  Target: ATXN1; (-) strand; PAM type: YTN; PAM sequence: CTC
cgggagcactgtgtgaatta

SEQ ID NO: 197932 - DNA, 20 bp, Artificial Sequence
  Description of Artificial Sequence: Synthetic oligonucleotide
  Target: ATXN1; (-) strand; PAM type: YTN; PAM sequence: TTG
ggacgagccagggaagggct

SEQ ID NO: 197933 - DNA, 20 bp, Artificial Sequence
  Description of Artificial Sequence: Synthetic oligonucleotide
  Target: ATXN1; (-) strand; PAM type: YTN; PAM sequence: CTT
gggacgagccagggaagggc

SEQ ID NO: 197934 - DNA, 20 bp, Artificial Sequence
  Description of Artificial Sequence: Synthetic oligonucleotide
  Target: ATXN1; (-) strand; PAM type: YTN; PAM sequence: CTG
atccttgggacgagccaggg

SEQ ID NO: 197935 - DNA, 20 bp, Artificial Sequence
  Description of Artificial Sequence: Synthetic oligonucleotide
  Target: ATXN1; (-) strand; PAM type: YTN; PAM sequence: TTG
ctgatccttgggacgagcca

SEQ ID NO: 197936 - DNA, 20 bp, Artificial Sequence
  Description of Artificial Sequence: Synthetic oligonucleotide
  Target: ATXN1; (-) strand; PAM type: YTN; PAM sequence: TTT
gctgatccttgggacgagcc

SEQ ID NO: 197937 - DNA, 20 bp, Artificial Sequence
  Description of Artificial Sequence: Synthetic oligonucleotide
  Target: ATXN1; (-) strand; PAM type: YTN; PAM sequence: CTA
agatagccgtgtgtttgctg

SEQ ID NO: 197938 - DNA, 20 bp, Artificial Sequence
  Description of Artificial Sequence: Synthetic oligonucleotide
  Target: ATXN1; (-) strand; PAM type: YTN; PAM sequence: CTA
gagagagccccagtgtgaaa

SEQ ID NO: 197939 - DNA, 20 bp, Artificial Sequence
  Description of Artificial Sequence: Synthetic oligonucleotide
  Target: ATXN1; (-) strand; PAM type: YTN; PAM sequence: CTC
tagagagagccccagtgtga

SEQ ID NO: 197940 - DNA, 20 bp, Artificial Sequence
  Description of Artificial Sequence: Synthetic oligonucleotide
  Target: ATXN1; (-) strand; PAM type: YTN; PAM sequence: TTC
cctctagagagagccccagt

SEQ ID NO: 197941 - DNA, 20 bp, Artificial Sequence
  Description of Artificial Sequence: Synthetic oligonucleotide
  Target: ATXN1; (-) strand; PAM type: YTN; PAM sequence: TTT
ccctctagagagagccccag

SEQ ID NO: 197942 - DNA, 20 bp, Artificial Sequence
  Description of Artificial Sequence: Synthetic oligonucleotide
  Target: ATXN1; (-) strand; PAM type: YTN; PAM sequence: CTT
tccctctagagagagcccca

SEQ ID NO: 197943 - DNA, 20 bp, Artificial Sequence
  Description of Artificial Sequence: Synthetic oligonucleotide
  Target: ATXN1; (-) strand; PAM type: YTN; PAM sequence: CTA
catactttccctctagagag

SEQ ID NO: 197944 - DNA, 20 bp, Artificial Sequence
  Description of Artificial Sequence: Synthetic oligonucleotide
  Target: ATXN1; (-) strand; PAM type: YTN; PAM sequence: TTG
ggaatgtggaaagctacata

SEQ ID NO: 197945 - DNA, 20 bp, Artificial Sequence
  Description of Artificial Sequence: Synthetic oligonucleotide
  Target: ATXN1; (-) strand; PAM type: YTN; PAM sequence: CTC
ccaagtagttgggaatgtgg

SEQ ID NO: 197946 - DNA, 20 bp, Artificial Sequence
  Description of Artificial Sequence: Synthetic oligonucleotide
  Target: ATXN1; (-) strand; PAM type: YTN; PAM sequence: TTG
ggctcccaagtagttgggaa

SEQ ID NO: 197947 - DNA, 20 bp, Artificial Sequence
  Description of Artificial Sequence: Synthetic oligonucleotide
  Target: ATXN1; (-) strand; PAM type: YTN; PAM sequence: CTT
gggctcccaagtagttggga

SEQ ID NO: 197948 - DNA, 20 bp, Artificial Sequence
  Description of Artificial Sequence: Synthetic oligonucleotide
  Target: ATXN1; (-) strand; PAM type: YTN; PAM sequence: CTG
caaacaccttgggctcccaa

SEQ ID NO: 197949 - DNA, 20 bp, Artificial Sequence
  Description of Artificial Sequence: Synthetic oligonucleotide
  Target: ATXN1; (-) strand; PAM type: YTN; PAM sequence: CTG
ctgcaaacaccttgggctcc

SEQ ID NO: 197950 - DNA, 20 bp, Artificial Sequence
  Description of Artificial Sequence: Synthetic oligonucleotide
  Target: ATXN1; (-) strand; PAM type: YTN; PAM sequence: TTG
gctgctgcaaacaccttggg

SEQ ID NO: 197951 - DNA, 20 bp, Artificial Sequence
  Description of Artificial Sequence: Synthetic oligonucleotide
  Target: ATXN1; (-) strand; PAM type: YTN; PAM sequence: TTT
ggctgctgcaaacaccttgg

SEQ ID NO: 197952 - DNA, 20 bp, Artificial Sequence
  Description of Artificial Sequence: Synthetic oligonucleotide
  Target: ATXN1; (-) strand; PAM type: YTN; PAM sequence: TTG
tatttggctgctgcaaacac

SEQ ID NO: 197953 - DNA, 20 bp, Artificial Sequence
  Description of Artificial Sequence: Synthetic oligonucleotide
  Target: ATXN1; (-) strand; PAM type: YTN; PAM sequence: TTA
gttgtatttggctgctgcaa

SEQ ID NO: 197954 - DNA, 20 bp, Artificial Sequence
  Description of Artificial Sequence: Synthetic oligonucleotide
  Target: ATXN1; (-) strand; PAM type: YTN; PAM sequence: CTC
gttagttgtatttggctgct

SEQ ID NO: 197955 - DNA, 20 bp, Artificial Sequence
  Description of Artificial Sequence: Synthetic oligonucleotide
  Target: ATXN1; (-) strand; PAM type: YTN; PAM sequence: CTA
ctcgttagttgtatttggct

SEQ ID NO: 197956 - DNA, 20 bp, Artificial Sequence
  Description of Artificial Sequence: Synthetic oligonucleotide
  Target: ATXN1; (-) strand; PAM type: YTN; PAM sequence: TTC
ctactcgttagttgtatttg

SEQ ID NO: 197957 - DNA, 20 bp, Artificial Sequence
  Description of Artificial Sequence: Synthetic oligonucleotide
  Target: ATXN1; (-) strand; PAM type: YTN; PAM sequence: TTT
cctactcgttagttgtattt

SEQ ID NO: 197958 - DNA, 20 bp, Artificial Sequence
  Description of Artificial Sequence: Synthetic oligonucleotide
  Target: ATXN1; (-) strand; PAM type: YTN; PAM sequence: TTT
tcctactcgttagttgtatt

SEQ ID NO: 197959 - DNA, 20 bp, Artificial Sequence
  Description of Artificial Sequence: Synthetic oligonucleotide
  Target: ATXN1; (-) strand; PAM type: YTN; PAM sequence: TTT
ttcctactcgttagttgtat

SEQ ID NO: 197960 - DNA, 20 bp, Artificial Sequence
  Description of Artificial Sequence: Synthetic oligonucleotide
  Target: ATXN1; (-) strand; PAM type: YTN; PAM sequence: CTT
tttcctactcgttagttgta

SEQ ID NO: 197961 - DNA, 20 bp, Artificial Sequence
  Description of Artificial Sequence: Synthetic oligonucleotide
  Target: ATXN1; (-) strand; PAM type: YTN; PAM sequence: TTA
gtgtctttttcctactcgtt

SEQ ID NO: 197962 - DNA, 20 bp, Artificial Sequence
  Description of Artificial Sequence: Synthetic oligonucleotide
  Target: ATXN1; (-) strand; PAM type: YTN; PAM sequence: CTT
agtgtctttttcctactcgt

SEQ ID NO: 197963 - DNA, 20 bp, Artificial Sequence
  Description of Artificial Sequence: Synthetic oligonucleotide
  Target: ATXN1; (-) strand; PAM type: YTN; PAM sequence: TTC
ttagtgtctttttcctactc

SEQ ID NO: 197964 - DNA, 20 bp, Artificial Sequence
  Description of Artificial Sequence: Synthetic oligonucleotide
  Target: ATXN1; (-) strand; PAM type: YTN; PAM sequence: TTT
cttagtgtctttttcctact

SEQ ID NO: 197965 - DNA, 20 bp, Artificial Sequence
  Description of Artificial Sequence: Synthetic oligonucleotide
  Target: ATXN1; (-) strand; PAM type: YTN; PAM sequence: TTG
tggcatttcttagtgtcttt

SEQ ID NO: 197966 - DNA, 20 bp, Artificial Sequence
  Description of Artificial Sequence: Synthetic oligonucleotide
  Target: ATXN1; (-) strand; PAM type: YTN; PAM sequence: TTG
aatgtgtcagacacaattgt

SEQ ID NO: 197967 - DNA, 20 bp, Artificial Sequence
  Description of Artificial Sequence: Synthetic oligonucleotide
  Target: ATXN1; (-) strand; PAM type: YTN; PAM sequence: TTT
gaatgtgtcagacacaattg

SEQ ID NO: 197968 - DNA, 20 bp, Artificial Sequence
  Description of Artificial Sequence: Synthetic oligonucleotide
  Target: ATXN1; (-) strand; PAM type: YTN; PAM sequence: TTT
tgaatgtgtcagacacaatt

SEQ ID NO: 197969 - DNA, 20 bp, Artificial Sequence
  Description of Artificial Sequence: Synthetic oligonucleotide
  Target: ATXN1; (-) strand; PAM type: YTN; PAM sequence: CTT
ttgaatgtgtcagacacaat

SEQ ID NO: 197970 - DNA, 20 bp, Artificial Sequence
  Description of Artificial Sequence: Synthetic oligonucleotide
  Target: ATXN1; (-) strand; PAM type: YTN; PAM sequence: CTG
tcttttgaatgtgtcagaca

SEQ ID NO: 197971 - DNA, 20 bp, Artificial Sequence
  Description of Artificial Sequence: Synthetic oligonucleotide
  Target: ATXN1; (-) strand; PAM type: YTN; PAM sequence: CTC
catggatgggaggacaactg

SEQ ID NO: 197972 - DNA, 20 bp, Artificial Sequence
  Description of Artificial Sequence: Synthetic oligonucleotide
  Target: ATXN1; (-) strand; PAM type: YTN; PAM sequence: TTG
gaacagatcctccatggatg

SEQ ID NO: 197973 - DNA, 20 bp, Artificial Sequence
  Description of Artificial Sequence: Synthetic oligonucleotide
  Target: ATXN1; (-) strand; PAM type: YTN; PAM sequence: CTT
ggaacagatcctccatggat

SEQ ID NO: 197974 - DNA, 20 bp, Artificial Sequence
  Description of Artificial Sequence: Synthetic oligonucleotide
  Target: ATXN1; (-) strand; PAM type: YTN; PAM sequence: CTG
gggtcttggaacagatcctc

SEQ ID NO: 197975 - DNA, 20 bp, Artificial Sequence
  Description of Artificial Sequence: Synthetic oligonucleotide
  Target: ATXN1; (-) strand; PAM type: YTN; PAM sequence: TTA
ggcgtccactggggtcttgg

SEQ ID NO: 197976 - DNA, 20 bp, Artificial Sequence
  Description of Artificial Sequence: Synthetic oligonucleotide
  Target: ATXN1; (-) strand; PAM type: YTN; PAM sequence: TTT
aggcgtccactggggtcttg

SEQ ID NO: 197977 - DNA, 20 bp, Artificial Sequence
  Description of Artificial Sequence: Synthetic oligonucleotide
  Target: ATXN1; (-) strand; PAM type: YTN; PAM sequence: TTT
taggcgtccactggggtctt

SEQ ID NO: 197978 - DNA, 20 bp, Artificial Sequence
  Description of Artificial Sequence: Synthetic oligonucleotide
  Target: ATXN1; (-) strand; PAM type: YTN; PAM sequence: TTC
atggttttaggcgtccactg

SEQ ID NO: 197979 - DNA, 20 bp, Artificial Sequence
  Description of Artificial Sequence: Synthetic oligonucleotide
  Target: ATXN1; (-) strand; PAM type: YTN; PAM sequence: CTA
ttcatggttttaggcgtcca

SEQ ID NO: 197980 - DNA, 20 bp, Artificial Sequence
  Description of Artificial Sequence: Synthetic oligonucleotide
  Target: ATXN1; (-) strand; PAM type: YTN; PAM sequence: CTA
tcatgggtgtatatgtatag

SEQ ID NO: 197981 - DNA, 20 bp, Artificial Sequence
  Description of Artificial Sequence: Synthetic oligonucleotide
  Target: ATXN1; (-) strand; PAM type: YTN; PAM sequence: CTC
tatcatgggtgtatatgtat

SEQ ID NO: 197982 - DNA, 20 bp, Artificial Sequence
  Description of Artificial Sequence: Synthetic oligonucleotide
  Target: ATXN1; (-) strand; PAM type: YTN; PAM sequence: TTA
aactctatcatgggtgtata

SEQ ID NO: 197983 - DNA, 20 bp, Artificial Sequence
  Description of Artificial Sequence: Synthetic oligonucleotide
  Target: ATXN1; (-) strand; PAM type: YTN; PAM sequence: TTA
taaattaaactctatcatgg

SEQ ID NO: 197984 - DNA, 20 bp, Artificial Sequence
  Description of Artificial Sequence: Synthetic oligonucleotide
  Target: ATXN1; (-) strand; PAM type: YTN; PAM sequence: TTT
ataaattaaactctatcatg

SEQ ID NO: 197985 - DNA, 20 bp, Artificial Sequence
  Description of Artificial Sequence: Synthetic oligonucleotide
  Target: ATXN1; (-) strand; PAM type: YTN; PAM sequence: TTA
tttataaattaaactctatc

SEQ ID NO: 197986 - DNA, 20 bp, Artificial Sequence
  Description of Artificial Sequence: Synthetic oligonucleotide
  Target: ATXN1; (-) strand; PAM type: YTN; PAM sequence: CTT
atttataaattaaactctat

SEQ ID NO: 197987 - DNA, 20 bp, Artificial Sequence
  Description of Artificial Sequence: Synthetic oligonucleotide
  Target: ATXN1; (-) strand; PAM type: YTN; PAM sequence: CTG
tgacttatttataaattaaa

SEQ ID NO: 197988 - DNA, 20 bp, Artificial Sequence
  Description of Artificial Sequence: Synthetic oligonucleotide
  Target: ATXN1; (-) strand; PAM type: YTN; PAM sequence: TTA
ctgtgacttatttataaatt

SEQ ID NO: 197989 - DNA, 20 bp, Artificial Sequence
  Description of Artificial Sequence: Synthetic oligonucleotide
  Target: ATXN1; (-) strand; PAM type: YTN; PAM sequence: CTT
actgtgacttatttataaat

SEQ ID NO: 197990 - DNA, 20 bp, Artificial Sequence
  Description of Artificial Sequence: Synthetic oligonucleotide
  Target: ATXN1; (-) strand; PAM type: YTN; PAM sequence: CTC
ttactgtgacttatttataa

SEQ ID NO: 197991 - DNA, 20 bp, Artificial Sequence
  Description of Artificial Sequence: Synthetic oligonucleotide
  Target: ATXN1; (-) strand; PAM type: YTN; PAM sequence: TTA
atctcttactgtgacttatt

SEQ ID NO: 197992 - DNA, 20 bp, Artificial Sequence
  Description of Artificial Sequence: Synthetic oligonucleotide
  Target: ATXN1; (-) strand; PAM type: YTN; PAM sequence: TTG
ttaatctcttactgtgactt

SEQ ID NO: 197993 - DNA, 20 bp, Artificial Sequence
  Description of Artificial Sequence: Synthetic oligonucleotide
  Target: ATXN1; (-) strand; PAM type: YTN; PAM sequence: TTG
ttgttaatctcttactgtga

SEQ ID NO: 197994 - DNA, 20 bp, Artificial Sequence
  Description of Artificial Sequence: Synthetic oligonucleotide
  Target: ATXN1; (-) strand; PAM type: YTN; PAM sequence: TTT
gttgttaatctcttactgtg

SEQ ID NO: 197995 - DNA, 20 bp, Artificial Sequence
  Description of Artificial Sequence: Synthetic oligonucleotide
  Target: ATXN1; (-) strand; PAM type: YTN; PAM sequence: TTT
tgttgttaatctcttactgt

SEQ ID NO: 197996 - DNA, 20 bp, Artificial Sequence
  Description of Artificial Sequence: Synthetic oligonucleotide
  Target: ATXN1; (-) strand; PAM type: YTN; PAM sequence: TTT
ttgttgttaatctcttactg

SEQ ID NO: 197997 - DNA, 20 bp, Artificial Sequence
  Description of Artificial Sequence: Synthetic oligonucleotide
  Target: ATXN1; (-) strand; PAM type: YTN; PAM sequence: TTA
gtttttgttgttaatctctt

SEQ ID NO: 197998 - DNA, 20 bp, Artificial Sequence
  Description of Artificial Sequence: Synthetic oligonucleotide
  Target: ATXN1; (-) strand; PAM type: YTN; PAM sequence: TTA
ttagtttttgttgttaatct

SEQ ID NO: 197999 - DNA, 20 bp, Artificial Sequence
  Description of Artificial Sequence: Synthetic oligonucleotide
  Target: ATXN1; (-) strand; PAM type: YTN; PAM sequence: TTA
ttattagtttttgttgttaa

SEQ ID NO: 198000 - DNA, 20 bp, Artificial Sequence
  Description of Artificial Sequence: Synthetic oligonucleotide
  Target: ATXN1; (-) strand; PAM type: YTN; PAM sequence: TTT
attattagtttttgttgtta

SEQ ID NO: 198001 - DNA, 20 bp, Artificial Sequence
  Description of Artificial Sequence: Synthetic oligonucleotide
  Target: ATXN1; (-) strand; PAM type: YTN; PAM sequence: TTT
tattattagtttttgttgtt

SEQ ID NO: 198002 - DNA, 20 bp, Artificial Sequence
  Description of Artificial Sequence: Synthetic oligonucleotide
  Target: ATXN1; (-) strand; PAM type: YTN; PAM sequence: CTA
ttttattattagtttttgtt

SEQ ID NO: 198003 - DNA, 20 bp, Artificial Sequence
  Description of Artificial Sequence: Synthetic oligonucleotide
  Target: ATXN1; (-) strand; PAM type: YTN; PAM sequence: TTC
tattttattattagtttttg

SEQ ID NO: 198004 - DNA, 20 bp, Artificial Sequence
  Description of Artificial Sequence: Synthetic oligonucleotide
  Target: ATXN1; (-) strand; PAM type: YTN; PAM sequence: TTG
ttctattttattattagttt

SEQ ID NO: 198005 - DNA, 20 bp, Artificial Sequence
  Description of Artificial Sequence: Synthetic oligonucleotide
  Target: ATXN1; (-) strand; PAM type: YTN; PAM sequence: TTA
tgattgttctattttattat

SEQ ID NO: 198006 - DNA, 20 bp, Artificial Sequence
  Description of Artificial Sequence: Synthetic oligonucleotide
  Target: ATXN1; (-) strand; PAM type: YTN; PAM sequence: TTA
gtacagtataatgttatgat

SEQ ID NO: 198007 - DNA, 20 bp, Artificial Sequence
  Description of Artificial Sequence: Synthetic oligonucleotide
  Target: ATXN1; (-) strand; PAM type: YTN; PAM sequence: TTT
agtacagtataatgttatga

SEQ ID NO: 198008 - DNA, 20 bp, Artificial Sequence
  Description of Artificial Sequence: Synthetic oligonucleotide
  Target: ATXN1; (-) strand; PAM type: YTN; PAM sequence: TTT
tagtacagtataatgttatg

SEQ ID NO: 198009 - DNA, 20 bp, Artificial Sequence
  Description of Artificial Sequence: Synthetic oligonucleotide
  Target: ATXN1; (-) strand; PAM type: YTN; PAM sequence: CTT
ttagtacagtataatgttat

SEQ ID NO: 198010 - DNA, 20 bp, Artificial Sequence
  Description of Artificial Sequence: Synthetic oligonucleotide
  Target: ATXN1; (-) strand; PAM type: YTN; PAM sequence: TTC
acataacttttagtacagta

SEQ ID NO: 198011 - DNA, 20 bp, Artificial Sequence
  Description of Artificial Sequence: Synthetic oligonucleotide
  Target: ATXN1; (-) strand; PAM type: YTN; PAM sequence: TTG
agagagagagagagacacca

SEQ ID NO: 198012 - DNA, 20 bp, Artificial Sequence
  Description of Artificial Sequence: Synthetic oligonucleotide
  Target: ATXN1; (-) strand; PAM type: YTN; PAM sequence: TTT
gagagagagagagagacacc

SEQ ID NO: 198013 - DNA, 20 bp, Artificial Sequence
  Description of Artificial Sequence: Synthetic oligonucleotide
  Target: ATXN1; (-) strand; PAM type: YTN; PAM sequence: TTT
tgagagagagagagagacac

SEQ ID NO: 198014 - DNA, 20 bp, Artificial Sequence
  Description of Artificial Sequence: Synthetic oligonucleotide
  Target: ATXN1; (-) strand; PAM type: YTN; PAM sequence: TTA
cccacagtcaagcgtggtac

SEQ ID NO: 198015 - DNA, 20 bp, Artificial Sequence
  Description of Artificial Sequence: Synthetic oligonucleotide
  Target: ATXN1; (-) strand; PAM type: YTN; PAM sequence: TTC
aattacccacagtcaagcgt

SEQ ID NO: 198016 - DNA, 20 bp, Artificial Sequence
  Description of Artificial Sequence: Synthetic oligonucleotide
  Target: ATXN1; (-) strand; PAM type: YTN; PAM sequence: TTT
caattacccacagtcaagcg

SEQ ID NO: 198017 - DNA, 20 bp, Artificial Sequence
  Description of Artificial Sequence: Synthetic oligonucleotide
  Target: ATXN1; (-) strand; PAM type: YTN; PAM sequence: CTG
tttcaattacccacagtcaa

SEQ ID NO: 198018 - DNA, 20 bp, Artificial Sequence
  Description of Artificial Sequence: Synthetic oligonucleotide
  Target: ATXN1; (-) strand; PAM type: YTN; PAM sequence: CTG
ctgtttcaattacccacagt

SEQ ID NO: 198019 - DNA, 20 bp, Artificial Sequence
  Description of Artificial Sequence: Synthetic oligonucleotide
  Target: ATXN1; (-) strand; PAM type: YTN; PAM sequence: TTC
tgctgtttcaattacccaca

SEQ ID NO: 198020 - DNA, 20 bp, Artificial Sequence
  Description of Artificial Sequence: Synthetic oligonucleotide
  Target: ATXN1; (-) strand; PAM type: YTN; PAM sequence: TTT
ctgctgtttcaattacccac

SEQ ID NO: 198021 - DNA, 20 bp, Artificial Sequence
  Description of Artificial Sequence: Synthetic oligonucleotide
  Target: ATXN1; (-) strand; PAM type: YTN; PAM sequence: TTT
tctgctgtttcaattaccca

SEQ ID NO: 198022 - DNA, 20 bp, Artificial Sequence
  Description of Artificial Sequence: Synthetic oligonucleotide
  Target: ATXN1; (-) strand; PAM type: YTN; PAM sequence: TTC
ggtgtcattttctgctgttt

SEQ ID NO: 198023 - DNA, 20 bp, Artificial Sequence
  Description of Artificial Sequence: Synthetic oligonucleotide
  Target: ATXN1; (-) strand; PAM type: YTN; PAM sequence: CTT
cggtgtcattttctgctgtt

SEQ ID NO: 198024 - DNA, 20 bp, Artificial Sequence
  Description of Artificial Sequence: Synthetic oligonucleotide
  Target: ATXN1; (-) strand; PAM type: YTN; PAM sequence: TTC
cccccaccccccatcttcgg

SEQ ID NO: 198025 - DNA, 20 bp, Artificial Sequence
  Description of Artificial Sequence: Synthetic oligonucleotide
  Target: ATXN1; (-) strand; PAM type: YTN; PAM sequence: TTG
atacagtagttccccccacc

SEQ ID NO: 198026 - DNA, 20 bp, Artificial Sequence
  Description of Artificial Sequence: Synthetic oligonucleotide
  Target: ATXN1; (-) strand; PAM type: YTN; PAM sequence: TTA
tccaggttgatacagtagtt

SEQ ID NO: 198027 - DNA, 20 bp, Artificial Sequence
  Description of Artificial Sequence: Synthetic oligonucleotide
  Target: ATXN1; (-) strand; PAM type: YTN; PAM sequence: CTT
atccaggttgatacagtagt

SEQ ID NO: 198028 - DNA, 20 bp, Artificial Sequence
  Description of Artificial Sequence: Synthetic oligonucleotide
  Target: ATXN1; (-) strand; PAM type: YTN; PAM sequence: CTG
tgaacttatccaggttgata

SEQ ID NO: 198029 - DNA, 20 bp, Artificial Sequence
  Description of Artificial Sequence: Synthetic oligonucleotide
  Target: ATXN1; (-) strand; PAM type: YTN; PAM sequence: TTC
cctgtgaacttatccaggtt

SEQ ID NO: 198030 - DNA, 20 bp, Artificial Sequence
  Description of Artificial Sequence: Synthetic oligonucleotide
  Target: ATXN1; (-) strand; PAM type: YTN; PAM sequence: TTC
cgttccctgtgaacttatcc

SEQ ID NO: 198031 - DNA, 20 bp, Artificial Sequence
  Description of Artificial Sequence: Synthetic oligonucleotide
  Target: ATXN1; (-) strand; PAM type: YTN; PAM sequence: CTG
gaaagaatgtgttccgttcc

SEQ ID NO: 198032 - DNA, 20 bp, Artificial Sequence
  Description of Artificial Sequence: Synthetic oligonucleotide
  Target: ATXN1; (-) strand; PAM type: YTN; PAM sequence: TTC
tggaaagaatgtgttccgtt

SEQ ID NO: 198033 - DNA, 20 bp, Artificial Sequence
  Description of Artificial Sequence: Synthetic oligonucleotide
  Target: ATXN1; (-) strand; PAM type: YTN; PAM sequence: CTT
ctggaaagaatgtgttccgt

SEQ ID NO: 198034 - DNA, 20 bp, Artificial Sequence
  Description of Artificial Sequence: Synthetic oligonucleotide
  Target: ATXN1; (-) strand; PAM type: YTN; PAM sequence: TTA
tgcatcaccttctggaaaga

SEQ ID NO: 198035 - DNA, 20 bp, Artificial Sequence
  Description of Artificial Sequence: Synthetic oligonucleotide
  Target: ATXN1; (-) strand; PAM type: YTN; PAM sequence: TTT
atgcatcaccttctggaaag

SEQ ID NO: 198036 - DNA, 20 bp, Artificial Sequence
  Description of Artificial Sequence: Synthetic oligonucleotide
  Target: ATXN1; (-) strand; PAM type: YTN; PAM sequence: TTT
tatgcatcaccttctggaaa

SEQ ID NO: 198037 - DNA, 20 bp, Artificial Sequence
  Description of Artificial Sequence: Synthetic oligonucleotide
  Target: ATXN1; (-) strand; PAM type: YTN; PAM sequence: CTG
tgattttatgcatcaccttc

SEQ ID NO: 198038 - DNA, 20 bp, Artificial Sequence
  Description of Artificial Sequence: Synthetic oligonucleotide
  Target: ATXN1; (-) strand; PAM type: YTN; PAM sequence: TTG
tggacatgctgtgattttat

SEQ ID NO: 198039 - DNA, 20 bp, Artificial Sequence
  Description of Artificial Sequence: Synthetic oligonucleotide
  Target: ATXN1; (-) strand; PAM type: YTN; PAM sequence: TTT
gtggacatgctgtgatttta

SEQ ID NO: 198040 - DNA, 20 bp, Artificial Sequence
  Description of Artificial Sequence: Synthetic oligonucleotide
  Target: ATXN1; (-) strand; PAM type: YTN; PAM sequence: TTC
ccaaaggccatttgtggaca

SEQ ID NO: 198041 - DNA, 20 bp, Artificial Sequence
  Description of Artificial Sequence: Synthetic oligonucleotide
  Target: ATXN1; (-) strand; PAM type: YTN; PAM sequence: CTC
aaatgtcccatcattcccaa

SEQ ID NO: 198042 - DNA, 20 bp, Artificial Sequence
  Description of Artificial Sequence: Synthetic oligonucleotide
  Target: ATXN1; (-) strand; PAM type: YTN; PAM sequence: TTG
taaactcaaatgtcccatca

SEQ ID NO: 198043 - DNA, 20 bp, Artificial Sequence
  Description of Artificial Sequence: Synthetic oligonucleotide
  Target: ATXN1; (-) strand; PAM type: YTN; PAM sequence: TTT
gtaaactcaaatgtcccatc

SEQ ID NO: 198044 - DNA, 20 bp, Artificial Sequence
  Description of Artificial Sequence: Synthetic oligonucleotide
  Target: ATXN1; (-) strand; PAM type: YTN; PAM sequence: TTT
tgtaaactcaaatgtcccat

SEQ ID NO: 198045 - DNA, 20 bp, Artificial Sequence
  Description of Artificial Sequence: Synthetic oligonucleotide
  Target: ATXN1; (-) strand; PAM type: YTN; PAM sequence: CTC
gcattttgtaaactcaaatg

SEQ ID NO: 198046 - DNA, 20 bp, Artificial Sequence
  Description of Artificial Sequence: Synthetic oligonucleotide
  Target: ATXN1; (-) strand; PAM type: YTN; PAM sequence: TTG
tctcgcattttgtaaactca

SEQ ID NO: 198047 - DNA, 20 bp, Artificial Sequence
  Description of Artificial Sequence: Synthetic oligonucleotide
  Target: ATXN1; (-) strand; PAM type: YTN; PAM sequence: CTT
gtctcgcattttgtaaactc

SEQ ID NO: 198048 - DNA, 20 bp, Artificial Sequence
  Description of Artificial Sequence: Synthetic oligonucleotide
  Target: ATXN1; (-) strand; PAM type: YTN; PAM sequence: TTG
cttgtctcgcattttgtaaa

SEQ ID NO: 198049 - DNA, 20 bp, Artificial Sequence
  Description of Artificial Sequence: Synthetic oligonucleotide
  Target: ATXN1; (-) strand; PAM type: YTN; PAM sequence: TTT
gcttgtctcgcattttgtaa

SEQ ID NO: 198050 - DNA, 20 bp, Artificial Sequence
  Description of Artificial Sequence: Synthetic oligonucleotide
  Target: ATXN1; (-) strand; PAM type: YTN; PAM sequence: CTT
tgcttgtctcgcattttgta

SEQ ID NO: 198051 - DNA, 20 bp, Artificial Sequence
  Description of Artificial Sequence: Synthetic oligonucleotide
  Target: ATXN1; (-) strand; PAM type: YTN; PAM sequence: CTG
ggctttgcttgtctcgcatt

SEQ ID NO: 198052 - DNA, 20 bp, Artificial Sequence
  Description of Artificial Sequence: Synthetic oligonucleotide
  Target: ATXN1; (-) strand; PAM type: YTN; PAM sequence: CTC
cctgggctttgcttgtctcg

SEQ ID NO: 198053 - DNA, 20 bp, Artificial Sequence
  Description of Artificial Sequence: Synthetic oligonucleotide
  Target: ATXN1; (-) strand; PAM type: YTN; PAM sequence: CTC
agctccctgggctttgcttg

SEQ ID NO: 198054 - DNA, 20 bp, Artificial Sequence
  Description of Artificial Sequence: Synthetic oligonucleotide
  Target: ATXN1; (-) strand; PAM type: YTN; PAM sequence: CTG
cgggacggtgggaaggaatg

SEQ ID NO: 198055 - DNA, 20 bp, Artificial Sequence
  Description of Artificial Sequence: Synthetic oligonucleotide
  Target: ATXN1; (-) strand; PAM type: YTN; PAM sequence: CTC
ccgcacagaatgagaggtgg

SEQ ID NO: 198056 - DNA, 20 bp, Artificial Sequence
  Description of Artificial Sequence: Synthetic oligonucleotide
  Target: ATXN1; (-) strand; PAM type: YTN; PAM sequence: CTA
gggccacatgtcccctcccg

SEQ ID NO: 198057 - DNA, 20 bp, Artificial Sequence
  Description of Artificial Sequence: Synthetic oligonucleotide
  Target: ATXN1; (-) strand; PAM type: YTN; PAM sequence: TTA
taaggaaagtggtggtgcta

SEQ ID NO: 198058 - DNA, 20 bp, Artificial Sequence
  Description of Artificial Sequence: Synthetic oligonucleotide
  Target: ATXN1; (-) strand; PAM type: YTN; PAM sequence: TTT
ataaggaaagtggtggtgct

SEQ ID NO: 198059 - DNA, 20 bp, Artificial Sequence
  Description of Artificial Sequence: Synthetic oligonucleotide
  Target: ATXN1; (-) strand; PAM type: YTN; PAM sequence: TTT
tataaggaaagtggtggtgc

SEQ ID NO: 198060 - DNA, 20 bp, Artificial Sequence
  Description of Artificial Sequence: Synthetic oligonucleotide
  Target: ATXN1; (-) strand; PAM type: YTN; PAM sequence: TTT
ttataaggaaagtggtggtg

SEQ ID NO: 198061 - DNA, 20 bp, Artificial Sequence
  Description of Artificial Sequence: Synthetic oligonucleotide
  Target: ATXN1; (-) strand; PAM type: YTN; PAM sequence: CTT
tttataaggaaagtggtggt

SEQ ID NO: 198062 - DNA, 20 bp, Artificial Sequence
  Description of Artificial Sequence: Synthetic oligonucleotide
  Target: ATXN1; (-) strand; PAM type: YTN; PAM sequence: TTA
ctttttataaggaaagtggt

SEQ ID NO: 198063 - DNA, 20 bp, Artificial Sequence
  Description of Artificial Sequence: Synthetic oligonucleotide
  Target: ATXN1; (-) strand; PAM type: YTN; PAM sequence: CTG
tcatgggaaagggaaccata

SEQ ID NO: 198064 - DNA, 20 bp, Artificial Sequence
  Description of Artificial Sequence: Synthetic oligonucleotide
  Target: ATXN1; (-) strand; PAM type: YTN; PAM sequence: TTC
ctgtcatgggaaagggaacc

SEQ ID NO: 198065 - DNA, 20 bp, Artificial Sequence
  Description of Artificial Sequence: Synthetic oligonucleotide
  Target: ATXN1; (-) strand; PAM type: YTN; PAM sequence: TTT
cctgtcatgggaaagggaac

SEQ ID NO: 198066 - DNA, 20 bp, Artificial Sequence
  Description of Artificial Sequence: Synthetic oligonucleotide
  Target: ATXN1; (-) strand; PAM type: YTN; PAM sequence: TTT
tcctgtcatgggaaagggaa

SEQ ID NO: 198067 - DNA, 20 bp, Artificial Sequence
  Description of Artificial Sequence: Synthetic oligonucleotide
  Target: ATXN1; (-) strand; PAM type: YTN; PAM sequence: CTA
tcagttttcctgtcatggga

SEQ ID NO: 198068 - DNA, 20 bp, Artificial Sequence
  Description of Artificial Sequence: Synthetic oligonucleotide
  Target: ATXN1; (-) strand; PAM type: YTN; PAM sequence: TTC
tatcagttttcctgtcatgg

SEQ ID NO: 198069 - DNA, 20 bp, Artificial Sequence
  Description of Artificial Sequence: Synthetic oligonucleotide
  Target: ATXN1; (-) strand; PAM type: YTN; PAM sequence: CTT
ctatcagttttcctgtcatg

SEQ ID NO: 198070 - DNA, 20 bp, Artificial Sequence
  Description of Artificial Sequence: Synthetic oligonucleotide
  Target: ATXN1; (-) strand; PAM type: YTN; PAM sequence: CTG
taaacttctatcagttttcc

SEQ ID NO: 198071 - DNA, 20 bp, Artificial Sequence
  Description of Artificial Sequence: Synthetic oligonucleotide
  Target: ATXN1; (-) strand; PAM type: YTN; PAM sequence: TTG
cctgtaaacttctatcagtt

SEQ ID NO: 198072 - DNA, 20 bp, Artificial Sequence
  Description of Artificial Sequence: Synthetic oligonucleotide
  Target: ATXN1; (-) strand; PAM type: YTN; PAM sequence: TTT
gcctgtaaacttctatcagt

SEQ ID NO: 198073 - DNA, 20 bp, Artificial Sequence
  Description of Artificial Sequence: Synthetic oligonucleotide
  Target: ATXN1; (-) strand; PAM type: YTN; PAM sequence: TTT
tgcctgtaaacttctatcag

SEQ ID NO: 198074 - DNA, 20 bp, Artificial Sequence
  Description of Artificial Sequence: Synthetic oligonucleotide
  Target: ATXN1; (-) strand; PAM type: YTN; PAM sequence: CTT
ttgcctgtaaacttctatca

SEQ ID NO: 198075 - DNA, 20 bp, Artificial Sequence
  Description of Artificial Sequence: Synthetic oligonucleotide
  Target: ATXN1; (-) strand; PAM type: YTN; PAM sequence: TTA
gaaataatacttttgcctgt

SEQ ID NO: 198076 - DNA, 20 bp, Artificial Sequence
  Description of Artificial Sequence: Synthetic oligonucleotide
  Target: ATXN1; (-) strand; PAM type: YTN; PAM sequence: TTA
tccccaaatgaaaagaatta

SEQ ID NO: 198077 - DNA, 20 bp, Artificial Sequence
  Description of Artificial Sequence: Synthetic oligonucleotide
  Target: ATXN1; (-) strand; PAM type: YTN; PAM sequence: CTT
atccccaaatgaaaagaatt

SEQ ID NO: 198078 - DNA, 20 bp, Artificial Sequence
  Description of Artificial Sequence: Synthetic oligonucleotide
  Target: ATXN1; (-) strand; PAM type: YTN; PAM sequence: TTG
tcttatccccaaatgaaaag

SEQ ID NO: 198079 - DNA, 20 bp, Artificial Sequence
  Description of Artificial Sequence: Synthetic oligonucleotide
  Target: ATXN1; (-) strand; PAM type: YTN; PAM sequence: CTT
gtcttatccccaaatgaaaa

SEQ ID NO: 198080 - DNA, 20 bp, Artificial Sequence
  Description of Artificial Sequence: Synthetic oligonucleotide
  Target: ATXN1; (-) strand; PAM type: YTN; PAM sequence: TTA
aaaatacacacagaggggga

SEQ ID NO: 198081 - DNA, 20 bp, Artificial Sequence
  Description of Artificial Sequence: Synthetic oligonucleotide
  Target: ATXN1; (-) strand; PAM type: YTN; PAM sequence: TTT
aaaaatacacacagaggggg

SEQ ID NO: 198082 - DNA, 20 bp, Artificial Sequence
  Description of Artificial Sequence: Synthetic oligonucleotide
  Target: ATXN1; (-) strand; PAM type: YTN; PAM sequence: TTT
taaaaatacacacagagggg

SEQ ID NO: 198083 - DNA, 20 bp, Artificial Sequence
  Description of Artificial Sequence: Synthetic oligonucleotide
  Target: ATXN1; (-) strand; PAM type: YTN; PAM sequence: CTA
ttttaaaaatacacacagag

SEQ ID NO: 198084 - DNA, 20 bp, Artificial Sequence
  Description of Artificial Sequence: Synthetic oligonucleotide
  Target: ATXN1; (-) strand; PAM type: YTN; PAM sequence: TTA
ctattttaaaaatacacaca

SEQ ID NO: 198085 - DNA, 20 bp, Artificial Sequence
  Description of Artificial Sequence: Synthetic oligonucleotide
  Target: ATXN1; (-) strand; PAM type: YTN; PAM sequence: TTT
actattttaaaaatacacac

SEQ ID NO: 198086 - DNA, 20 bp, Artificial Sequence
  Description of Artificial Sequence: Synthetic oligonucleotide
  Target: ATXN1; (-) strand; PAM type: YTN; PAM sequence: TTT
tactattttaaaaatacaca

SEQ ID NO: 198087 - DNA, 20 bp, Artificial Sequence
  Description of Artificial Sequence: Synthetic oligonucleotide
  Target: ATXN1; (-) strand; PAM type: YTN; PAM sequence: TTT
ttactattttaaaaatacac

SEQ ID NO: 198088 - DNA, 20 bp, Artificial Sequence
  Description of Artificial Sequence: Synthetic oligonucleotide
  Target: ATXN1; (-) strand; PAM type: YTN; PAM sequence: TTA
aaatttttactattttaaaa

SEQ ID NO: 198089 - DNA, 20 bp, Artificial Sequence
  Description of Artificial Sequence: Synthetic oligonucleotide
  Target: ATXN1; (-) strand; PAM type: YTN; PAM sequence: TTT
aaaatttttactattttaaa

SEQ ID NO: 198090 - DNA, 20 bp, Artificial Sequence
  Description of Artificial Sequence: Synthetic oligonucleotide
  Target: ATXN1; (-) strand; PAM type: YTN; PAM sequence: TTC
atttaaaatttttactattt

SEQ ID NO: 198091 - DNA, 20 bp, Artificial Sequence
  Description of Artificial Sequence: Synthetic oligonucleotide
  Target: ATXN1; (-) strand; PAM type: YTN; PAM sequence: TTA
gcatatgtgcaagccgataa

SEQ ID NO: 198092 - DNA, 20 bp, Artificial Sequence
  Description of Artificial Sequence: Synthetic oligonucleotide
  Target: ATXN1; (-) strand; PAM type: YTN; PAM sequence: TTT
agcatatgtgcaagccgata

SEQ ID NO: 198093 - DNA, 20 bp, Artificial Sequence
  Description of Artificial Sequence: Synthetic oligonucleotide
  Target: ATXN1; (-) strand; PAM type: YTN; PAM sequence: CTT
tagcatatgtgcaagccgat

SEQ ID NO: 198094 - DNA, 20 bp, Artificial Sequence
  Description of Artificial Sequence: Synthetic oligonucleotide
  Target: ATXN1; (-) strand; PAM type: YTN; PAM sequence: CTG
cctttagcatatgtgcaagc

SEQ ID NO: 198095 - DNA, 20 bp, Artificial Sequence
  Description of Artificial Sequence: Synthetic oligonucleotide
  Target: ATXN1; (-) strand; PAM type: YTN; PAM sequence: TTA
tgtgccctgcctttagcata

SEQ ID NO: 198096 - DNA, 20 bp, Artificial Sequence
  Description of Artificial Sequence: Synthetic oligonucleotide
  Target: ATXN1; (-) strand; PAM type: YTN; PAM sequence: CTT
atgtgccctgcctttagcat

SEQ ID NO: 198097 - DNA, 20 bp, Artificial Sequence
  Description of Artificial Sequence: Synthetic oligonucleotide
  Target: ATXN1; (-) strand; PAM type: YTN; PAM sequence: CTG
taagagtcttatgtgccctg

SEQ ID NO: 198098 - DNA, 20 bp, Artificial Sequence
  Description of Artificial Sequence: Synthetic oligonucleotide
  Target: ATXN1; (-) strand; PAM type: YTN; PAM sequence: TTC
ctgtaagagtcttatgtgcc

SEQ ID NO: 198099 - DNA, 20 bp, Artificial Sequence
  Description of Artificial Sequence: Synthetic oligonucleotide
  Target: ATXN1; (-) strand; PAM type: YTN; PAM sequence: TTT
cctgtaagagtcttatgtgc

SEQ ID NO: 198100 - DNA, 20 bp, Artificial Sequence
  Description of Artificial Sequence: Synthetic oligonucleotide
  Target: ATXN1; (-) strand; PAM type: YTN; PAM sequence: CTT
tcctgtaagagtcttatgtg

SEQ ID NO: 198101 - DNA, 20 bp, Artificial Sequence
  Description of Artificial Sequence: Synthetic oligonucleotide
  Target: ATXN1; (-) strand; PAM type: YTN; PAM sequence: TTG
gcatactttcctgtaagagt

SEQ ID NO: 198102 - DNA, 20 bp, Artificial Sequence
  Description of Artificial Sequence: Synthetic oligonucleotide
  Target: ATXN1; (-) strand; PAM type: YTN; PAM sequence: CTT
ggcatactttcctgtaagag

SEQ ID NO: 198103 - DNA, 20 bp, Artificial Sequence
  Description of Artificial Sequence: Synthetic oligonucleotide
  Target: ATXN1; (-) strand; PAM type: YTN; PAM sequence: CTC
ttggcatactttcctgtaag

SEQ ID NO: 198104 - DNA, 20 bp, Artificial Sequence
  Description of Artificial Sequence: Synthetic oligonucleotide
  Target: ATXN1; (-) strand; PAM type: YTN; PAM sequence: TTC
tcttggcatactttcctgta

SEQ ID NO: 198105 - DNA, 20 bp, Artificial Sequence
  Description of Artificial Sequence: Synthetic oligonucleotide
  Target: ATXN1; (-) strand; PAM type: YTN; PAM sequence: TTT
ctcttggcatactttcctgt

SEQ ID NO: 198106 - DNA, 20 bp, Artificial Sequence
  Description of Artificial Sequence: Synthetic oligonucleotide
  Target: ATXN1; (-) strand; PAM type: YTN; PAM sequence: TTT
tctcttggcatactttcctg

SEQ ID NO: 198107 - DNA, 20 bp, Artificial Sequence
  Description of Artificial Sequence: Synthetic oligonucleotide
  Target: ATXN1; (-) strand; PAM type: YTN; PAM sequence: TTT
ttctcttggcatactttcct

SEQ ID NO: 198108 - DNA, 20 bp, Artificial Sequence
  Description of Artificial Sequence: Synthetic oligonucleotide
  Target: ATXN1; (-) strand; PAM type: YTN; PAM sequence: TTT
tttctcttggcatactttcc

SEQ ID NO: 198109 - DNA, 20 bp, Artificial Sequence
  Description of Artificial Sequence: Synthetic oligonucleotide
  Target: ATXN1; (-) strand; PAM type: YTN; PAM sequence: CTT
ttttctcttggcatactttc

SEQ ID NO: 198110 - DNA, 20 bp, Artificial Sequence
  Description of Artificial Sequence: Synthetic oligonucleotide
  Target: ATXN1; (-) strand; PAM type: YTN; PAM sequence: TTC
ttttttctcttggcatactt

SEQ ID NO: 198111 - DNA, 20 bp, Artificial Sequence
  Description of Artificial Sequence: Synthetic oligonucleotide
  Target: ATXN1; (-) strand; PAM type: YTN; PAM sequence: TTG
atcattcttttttctcttgg

SEQ ID NO: 198112 - DNA, 20 bp, Artificial Sequence
  Description of Artificial Sequence: Synthetic oligonucleotide
  Target: ATXN1; (-) strand; PAM type: YTN; PAM sequence: TTC
acatgtaattgatcattctt

SEQ ID NO: 198113 - DNA, 20 bp, Artificial Sequence
  Description of Artificial Sequence: Synthetic oligonucleotide
  Target: ATXN1; (-) strand; PAM type: YTN; PAM sequence: TTC
aattcacatgtaattgatca

SEQ ID NO: 198114 - DNA, 20 bp, Artificial Sequence
  Description of Artificial Sequence: Synthetic oligonucleotide
  Target: ATXN1; (-) strand; PAM type: YTN; PAM sequence: TTA
ggagttcaattcacatgtaa

SEQ ID NO: 198115 - DNA, 20 bp, Artificial Sequence
  Description of Artificial Sequence: Synthetic oligonucleotide
  Target: ATXN1; (-) strand; PAM type: YTN; PAM sequence: TTT
aggagttcaattcacatgta

SEQ ID NO: 198116 - DNA, 20 bp, Artificial Sequence
  Description of Artificial Sequence: Synthetic oligonucleotide
  Target: ATXN1; (-) strand; PAM type: YTN; PAM sequence: TTA
aggcatatttaggagttcaa

SEQ ID NO: 198117 - DNA, 20 bp, Artificial Sequence
  Description of Artificial Sequence: Synthetic oligonucleotide
  Target: ATXN1; (-) strand; PAM type: YTN; PAM sequence: TTT
aaggcatatttaggagttca

SEQ ID NO: 198118 - DNA, 20 bp, Artificial Sequence
  Description of Artificial Sequence: Synthetic oligonucleotide
  Target: ATXN1; (-) strand; PAM type: YTN; PAM sequence: CTG
gtttaaggcatatttaggag

SEQ ID NO: 198119 - DNA, 20 bp, Artificial Sequence
  Description of Artificial Sequence: Synthetic oligonucleotide
  Target: ATXN1; (-) strand; PAM type: YTN; PAM sequence: TTG
gtcacgtatcccctggttta

SEQ ID NO: 198120 - DNA, 20 bp, Artificial Sequence
  Description of Artificial Sequence: Synthetic oligonucleotide
  Target: ATXN1; (-) strand; PAM type: YTN; PAM sequence: CTG
aataaaattggtcacgtatc

SEQ ID NO: 198121 - DNA, 20 bp, Artificial Sequence
  Description of Artificial Sequence: Synthetic oligonucleotide
  Target: ATXN1; (-) strand; PAM type: YTN; PAM sequence: TTA
ctgaataaaattggtcacgt

SEQ ID NO: 198122 - DNA, 20 bp, Artificial Sequence
  Description of Artificial Sequence: Synthetic oligonucleotide
  Target: ATXN1; (-) strand; PAM type: YTN; PAM sequence: TTA
gaacacatgcaaacagaatt

SEQ ID NO: 198123 - DNA, 20 bp, Artificial Sequence
  Description of Artificial Sequence: Synthetic oligonucleotide
  Target: ATXN1; (-) strand; PAM type: YTN; PAM sequence: CTG
aaatggtagtggttagaaca

SEQ ID NO: 198124 - DNA, 20 bp, Artificial Sequence
  Description of Artificial Sequence: Synthetic oligonucleotide
  Target: ATXN1; (-) strand; PAM type: YTN; PAM sequence: TTA
ggaaaatagctgaaatggta

SEQ ID NO: 198125 - DNA, 20 bp, Artificial Sequence
  Description of Artificial Sequence: Synthetic oligonucleotide
  Target: ATXN1; (-) strand; PAM type: YTN; PAM sequence: TTT
aggaaaatagctgaaatggt

SEQ ID NO: 198126 - DNA, 20 bp, Artificial Sequence
  Description of Artificial Sequence: Synthetic oligonucleotide
  Target: ATXN1; (-) strand; PAM type: YTN; PAM sequence: TTT
taggaaaatagctgaaatgg

SEQ ID NO: 198127 - DNA, 20 bp, Artificial Sequence
  Description of Artificial Sequence: Synthetic oligonucleotide
  Target: ATXN1; (-) strand; PAM type: YTN; PAM sequence: TTT
ttaggaaaatagctgaaatg

SEQ ID NO: 198128 - DNA, 20 bp, Artificial Sequence
  Description of Artificial Sequence: Synthetic oligonucleotide
  Target: ATXN1; (-) strand; PAM type: YTN; PAM sequence: TTT
tttaggaaaatagctgaaat

SEQ ID NO: 198129 - DNA, 20 bp, Artificial Sequence
  Description of Artificial Sequence: Synthetic oligonucleotide
  Target: ATXN1; (-) strand; PAM type: YTN; PAM sequence: TTT
ttttaggaaaatagctgaaa

SEQ ID NO: 198130 - DNA, 20 bp, Artificial Sequence
  Description of Artificial Sequence: Synthetic oligonucleotide
  Target: ATXN1; (-) strand; PAM type: YTN; PAM sequence: TTT
tttttaggaaaatagctgaa

SEQ ID NO: 198131 - DNA, 20 bp, Artificial Sequence
  Description of Artificial Sequence: Synthetic oligonucleotide
  Target: ATXN1; (-) strand; PAM type: YTN; PAM sequence: TTT
ttttttaggaaaatagctga

SEQ ID NO: 198132 - DNA, 20 bp, Artificial Sequence
  Description of Artificial Sequence: Synthetic oligonucleotide
  Target: ATXN1; (-) strand; PAM type: YTN; PAM sequence: TTT
tttttttaggaaaatagctg

SEQ ID NO: 198133 - DNA, 20 bp, Artificial Sequence
  Description of Artificial Sequence: Synthetic oligonucleotide
  Target: ATXN1; (-) strand; PAM type: YTN; PAM sequence: TTT
ttttttttaggaaaatagct

SEQ ID NO: 198134 - DNA, 20 bp, Artificial Sequence
  Description of Artificial Sequence: Synthetic oligonucleotide
  Target: ATXN1; (-) strand; PAM type: YTN; PAM sequence: TTT
tttttttttaggaaaatagc

SEQ ID NO: 198135 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaggaaaatag

SEQ ID NO: 198136 - DNA, 20 bp, Artificial Sequence
  Description of Artificial Sequence: Synthetic oligonucleotide
  Target: ATXN1; (-) strand; PAM type: YTN; PAM sequence: TTT
tttttttttttaggaaaata

SEQ ID NO: 198137 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttaggaaaat

SEQ ID NO: 198138 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttaggaaaa

SEQ ID NO: 198139 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttaggaaa

SEQ ID NO: 198140 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttaggaa

SEQ ID NO: 198141 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttagga

SEQ ID NO: 198142 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttagg

SEQ ID NO: 198143 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttag

SEQ ID NO: 198144 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttttta

SEQ ID NO: 198145 - DNA, 20 bp, Artificial Sequence
  Description of Artificial Sequence: Synthetic oligonucleotide
  Target: ATXN1; (-) strand; PAM type: YTN; PAM sequence: CTC
tttttttttttttttttttt

SEQ ID NO: 198146 - DNA, 20 bp, Artificial Sequence
  Description of Artificial Sequence: Synthetic oligonucleotide
  Target: ATXN1; (-) strand; PAM type: YTN; PAM sequence: CTC
tctttttttttttttttttt

SEQ ID NO: 198147 - DNA, 20 bp, Artificial Sequence
  Description of Artificial Sequence: Synthetic oligonucleotide
  Target: ATXN1; (-) strand; PAM type: YTN; PAM sequence: CTC
tctctttttttttttttttt

SEQ ID NO: 198148 - DNA, 20 bp, Artificial Sequence
  Description of Artificial Sequence: Synthetic oligonucleotide
  Target: ATXN1; (-) strand; PAM type: YTN; PAM sequence: CTC
tctctctttttttttttttt

SEQ ID NO: 198149 - DNA, 20 bp, Artificial Sequence
  Description of Artificial Sequence: Synthetic oligonucleotide
  Target: ATXN1; (-) strand; PAM type: YTN; PAM sequence: CTC
tctctctctttttttttttt

SEQ ID NO: 198150 - DNA, 20 bp, Artificial Sequence
  Description of Artificial Sequence: Synthetic oligonucleotide
  Target: ATXN1; (-) strand; PAM type: YTN; PAM sequence: CTC
tctctctctctttttttttt

SEQ ID NO: 198151 - DNA, 20 bp, Artificial Sequence
  Description of Artificial Sequence: Synthetic oligonucleotide
  Target: ATXN1; (-) strand; PAM type: YTN; PAM sequence: TTA
aactctctctctctcttttt

SEQ ID NO: 198152 - DNA, 20 bp, Artificial Sequence
  Description of Artificial Sequence: Synthetic oligonucleotide
  Target: ATXN1; (-) strand; PAM type: YTN; PAM sequence: CTT
aaactctctctctctctttt

SEQ ID NO: 198153 - DNA, 20 bp, Artificial Sequence
  Description of Artificial Sequence: Synthetic oligonucleotide
  Target: ATXN1; (-) strand; PAM type: YTN; PAM sequence: CTA
ggcatgcttaaactctctct

SEQ ID NO: 198154 - DNA, 20 bp, Artificial Sequence
  Description of Artificial Sequence: Synthetic oligonucleotide
  Target: ATXN1; (-) strand; PAM type: YTN; PAM sequence: CTG
agccctaggcatgcttaaac

SEQ ID NO: 198155 - DNA, 20 bp, Artificial Sequence
  Description of Artificial Sequence: Synthetic oligonucleotide
  Target: ATXN1; (-) strand; PAM type: YTN; PAM sequence: CTC
tgagccctaggcatgcttaa

SEQ ID NO: 198156 - DNA, 20 bp, Artificial Sequence
  Description of Artificial Sequence: Synthetic oligonucleotide
  Target: ATXN1; (-) strand; PAM type: YTN; PAM sequence: TTC
ctctgagccctaggcatgct

SEQ ID NO: 198157 - DNA, 20 bp, Artificial Sequence
  Description of Artificial Sequence: Synthetic oligonucleotide
  Target: ATXN1; (-) strand; PAM type: YTN; PAM sequence: CTA
aattcctctgagccctaggc

SEQ ID NO: 198158 - DNA, 20 bp, Artificial Sequence
  Description of Artificial Sequence: Synthetic oligonucleotide
  Target: ATXN1; (-) strand; PAM type: YTN; PAM sequence: TTG
aaaacatctaaattcctctg

SEQ ID NO: 198159 - DNA, 20 bp, Artificial Sequence
  Description of Artificial Sequence: Synthetic oligonucleotide
  Target: ATXN1; (-) strand; PAM type: YTN; PAM sequence: CTT
gaaaacatctaaattcctct

SEQ ID NO: 198160 - DNA, 20 bp, Artificial Sequence
  Description of Artificial Sequence: Synthetic oligonucleotide
  Target: ATXN1; (-) strand; PAM type: YTN; PAM sequence: CTA
aaagcatcaagtagtaatgc

SEQ ID NO: 198161 - DNA, 20 bp, Artificial Sequence
  Description of Artificial Sequence: Synthetic oligonucleotide
  Target: ATXN1; (-) strand; PAM type: YTN; PAM sequence: CTC
taaaagcatcaagtagtaat

SEQ ID NO: 198162 - DNA, 20 bp, Artificial Sequence
  Description of Artificial Sequence: Synthetic oligonucleotide
  Target: ATXN1; (-) strand; PAM type: YTN; PAM sequence: CTC
aagcatgaagctctaaaagc

SEQ ID NO: 198163 - DNA, 20 bp, Artificial Sequence
  Description of Artificial Sequence: Synthetic oligonucleotide
  Target: ATXN1; (-) strand; PAM type: YTN; PAM sequence: TTA
actcaagcatgaagctctaa

SEQ ID NO: 198164 - DNA, 20 bp, Artificial Sequence
  Description of Artificial Sequence: Synthetic oligonucleotide
  Target: ATXN1; (-) strand; PAM type: YTN; PAM sequence: TTT
aactcaagcatgaagctcta

SEQ ID NO: 198165 - DNA, 20 bp, Artificial Sequence
  Description of Artificial Sequence: Synthetic oligonucleotide
  Target: ATXN1; (-) strand; PAM type: YTN; PAM sequence: CTT
taactcaagcatgaagctct

SEQ ID NO: 198166 - DNA, 20 bp, Artificial Sequence
  Description of Artificial Sequence: Synthetic oligonucleotide
  Target: ATXN1; (-) strand; PAM type: YTN; PAM sequence: CTC
gcctttaactcaagcatgaa

SEQ ID NO: 198167 - DNA, 20 bp, Artificial Sequence
  Description of Artificial Sequence: Synthetic oligonucleotide
  Target: ATXN1; (-) strand; PAM type: YTN; PAM sequence: TTA
agtgctcgcctttaactcaa

SEQ ID NO: 198168 - DNA, 20 bp, Artificial Sequence
  Description of Artificial Sequence: Synthetic oligonucleotide
  Target: ATXN1; (-) strand; PAM type: YTN; PAM sequence: TTT
aagtgctcgcctttaactca

SEQ ID NO: 198169 - DNA, 20 bp, Artificial Sequence
  Description of Artificial Sequence: Synthetic oligonucleotide
  Target: ATXN1; (-) strand; PAM type: YTN; PAM sequence: TTT
taagtgctcgcctttaactc

SEQ ID NO: 198170 - DNA, 20 bp, Artificial Sequence
  Description of Artificial Sequence: Synthetic oligonucleotide
  Target: ATXN1; (-) strand; PAM type: YTN; PAM sequence: TTT
ttaagtgctcgcctttaact

SEQ ID NO: 198171 - DNA, 20 bp, Artificial Sequence
  Description of Artificial Sequence: Synthetic oligonucleotide
  Target: ATXN1; (-) strand; PAM type: YTN; PAM sequence: TTA
atttttaagtgctcgccttt

SEQ ID NO: 198172 - DNA, 20 bp, Artificial Sequence
  Description of Artificial Sequence: Synthetic oligonucleotide
  Target: ATXN1; (-) strand; PAM type: YTN; PAM sequence: TTA
gagttaatttttaagtgctc

SEQ ID NO: 198173 - DNA, 20 bp, Artificial Sequence
  Description of Artificial Sequence: Synthetic oligonucleotide
  Target: ATXN1; (-) strand; PAM type: YTN; PAM sequence: CTA
aacccagaggttagagttaa

SEQ ID NO: 198174 - DNA, 20 bp, Artificial Sequence
  Description of Artificial Sequence: Synthetic oligonucleotide
  Target: ATXN1; (-) strand; PAM type: YTN; PAM sequence: CTA
gccctaaacccagaggttag

SEQ ID NO: 198175 - DNA, 20 bp, Artificial Sequence
  Description of Artificial Sequence: Synthetic oligonucleotide
  Target: ATXN1; (-) strand; PAM type: YTN; PAM sequence: TTC
tagccctaaacccagaggtt

SEQ ID NO: 198176 - DNA, 20 bp, Artificial Sequence
  Description of Artificial Sequence: Synthetic oligonucleotide
  Target: ATXN1; (-) strand; PAM type: YTN; PAM sequence: CTT
ctagccctaaacccagaggt

SEQ ID NO: 198177 - DNA, 20 bp, Artificial Sequence
  Description of Artificial Sequence: Synthetic oligonucleotide
  Target: ATXN1; (-) strand; PAM type: YTN; PAM sequence: TTG
gcttctagccctaaacccag

SEQ ID NO: 198178 - DNA, 20 bp, Artificial Sequence
  Description of Artificial Sequence: Synthetic oligonucleotide
  Target: ATXN1; (-) strand; PAM type: YTN; PAM sequence: CTA
tgggaagtcattggcttcta

SEQ ID NO: 198179 - DNA, 20 bp, Artificial Sequence
  Description of Artificial Sequence: Synthetic oligonucleotide
  Target: ATXN1; (-) strand; PAM type: YTN; PAM sequence: TTA
gtgaccctatgggaagtcat

SEQ ID NO: 198180 - DNA, 20 bp, Artificial Sequence
  Description of Artificial Sequence: Synthetic oligonucleotide
  Target: ATXN1; (-) strand; PAM type: YTN; PAM sequence: TTT
agtgaccctatgggaagtca

SEQ ID NO: 198181 - DNA, 20 bp, Artificial Sequence
  Description of Artificial Sequence: Synthetic oligonucleotide
  Target: ATXN1; (-) strand; PAM type: YTN; PAM sequence: CTT
tagtgaccctatgggaagtc

SEQ ID NO: 198182 - DNA, 20 bp, Artificial Sequence
  Description of Artificial Sequence: Synthetic oligonucleotide
  Target: ATXN1; (-) strand; PAM type: YTN; PAM sequence: CTA
gccaacaaatagcatcttta

SEQ ID NO: 198183 - DNA, 20 bp, Artificial Sequence
  Description of Artificial Sequence: Synthetic oligonucleotide
  Target: ATXN1; (-) strand; PAM type: YTN; PAM sequence: CTC
ccaggacaaatctagccaac

SEQ ID NO: 198184 - DNA, 20 bp, Artificial Sequence
  Description of Artificial Sequence: Synthetic oligonucleotide
  Target: ATXN1; (-) strand; PAM type: YTN; PAM sequence: TTG
agtactcccaggacaaatct

SEQ ID NO: 198185 - DNA, 20 bp, Artificial Sequence
  Description of Artificial Sequence: Synthetic oligonucleotide
  Target: ATXN1; (-) strand; PAM type: YTN; PAM sequence: CTT
gagtactcccaggacaaatc

SEQ ID NO: 198186 - DNA, 20 bp, Artificial Sequence
  Description of Artificial Sequence: Synthetic oligonucleotide
  Target: ATXN1; (-) strand; PAM type: YTN; PAM sequence: TTG
cgagacccttgagtactccc

SEQ ID NO: 198187 - DNA, 20 bp, Artificial Sequence
  Description of Artificial Sequence: Synthetic oligonucleotide
  Target: ATXN1; (-) strand; PAM type: YTN; PAM sequence: TTG
ttgcgagacccttgagtact

SEQ ID NO: 198188 - DNA, 20 bp, Artificial Sequence
  Description of Artificial Sequence: Synthetic oligonucleotide
  Target: ATXN1; (-) strand; PAM type: YTN; PAM sequence: TTT
gttgcgagacccttgagtac

SEQ ID NO: 198189 - DNA, 20 bp, Artificial Sequence
  Description of Artificial Sequence: Synthetic oligonucleotide
  Target: ATXN1; (-) strand; PAM type: YTN; PAM sequence: TTT
tgttgcgagacccttgagta

SEQ ID NO: 198190 - DNA, 20 bp, Artificial Sequence
  Description of Artificial Sequence: Synthetic oligonucleotide
  Target: ATXN1; (-) strand; PAM type: YTN; PAM sequence: CTT
ttgttgcgagacccttgagt

SEQ ID NO: 198191 - DNA, 20 bp, Artificial Sequence
  Description of Artificial Sequence: Synthetic oligonucleotide
  Target: ATXN1; (-) strand; PAM type: YTN; PAM sequence: TTA
cttttgttgcgagacccttg

SEQ ID NO: 198192 - DNA, 20 bp, Artificial Sequence
  Description of Artificial Sequence: Synthetic oligonucleotide
  Target: ATXN1; (-) strand; PAM type: YTN; PAM sequence: CTG
ttacttttgttgcgagaccc

SEQ ID NO: 198193 - DNA, 20 bp, Artificial Sequence
  Description of Artificial Sequence: Synthetic oligonucleotide
  Target: ATXN1; (-) strand; PAM type: YTN; PAM sequence: TTC
gaagtgacaaccctgttact

SEQ ID NO: 198194 - DNA, 20 bp, Artificial Sequence
  Description of Artificial Sequence: Synthetic oligonucleotide
  Target: ATXN1; (-) strand; PAM type: YTN; PAM sequence: TTA
ggttcgaagtgacaaccctg

SEQ ID NO: 198195 - DNA, 20 bp, Artificial Sequence
  Description of Artificial Sequence: Synthetic oligonucleotide
  Target: ATXN1; (-) strand; PAM type: YTN; PAM sequence: TTT
aggttcgaagtgacaaccct

SEQ ID NO: 198196 - DNA, 20 bp, Artificial Sequence
  Description of Artificial Sequence: Synthetic oligonucleotide
  Target: ATXN1; (-) strand; PAM type: YTN; PAM sequence: CTT
taggttcgaagtgacaaccc

SEQ ID NO: 198197 - DNA, 20 bp, Artificial Sequence
  Description of Artificial Sequence: Synthetic oligonucleotide
  Target: ATXN1; (-) strand; PAM type: YTN; PAM sequence: CTG
caatcgagtctttaggttcg

SEQ ID NO: 198198 - DNA, 20 bp, Artificial Sequence
  Description of Artificial Sequence: Synthetic oligonucleotide
  Target: ATXN1; (-) strand; PAM type: YTN; PAM sequence: TTC
ccatgctgcaatcgagtctt

SEQ ID NO: 198199 - DNA, 20 bp, Artificial Sequence
  Description of Artificial Sequence: Synthetic oligonucleotide
  Target: ATXN1; (-) strand; PAM type: YTN; PAM sequence: TTT
cccatgctgcaatcgagtct

SEQ ID NO: 198200 - DNA, 20 bp, Artificial Sequence
  Description of Artificial Sequence: Synthetic oligonucleotide
  Target: ATXN1; (-) strand; PAM type: YTN; PAM sequence: TTT
tcccatgctgcaatcgagtc

SEQ ID NO: 198201 - DNA, 20 bp, Artificial Sequence
  Description of Artificial Sequence: Synthetic oligonucleotide
  Target: ATXN1; (-) strand; PAM type: YTN; PAM sequence: TTA
tgttttcccatgctgcaatc

SEQ ID NO: 198202 - DNA, 20 bp, Artificial Sequence
  Description of Artificial Sequence: Synthetic oligonucleotide
  Target: ATXN1; (-) strand; PAM type: YTN; PAM sequence: TTG
ttatgttttcccatgctgca

SEQ ID NO: 198203 - DNA, 20 bp, Artificial Sequence
  Description of Artificial Sequence: Synthetic oligonucleotide
  Target: ATXN1; (-) strand; PAM type: YTN; PAM sequence: TTT
gttatgttttcccatgctgc

SEQ ID NO: 198204 - DNA, 20 bp, Artificial Sequence
  Description of Artificial Sequence: Synthetic oligonucleotide
  Target: ATXN1; (-) strand; PAM type: YTN; PAM sequence: TTT
tgttatgttttcccatgctg

SEQ ID NO: 198205 - DNA, 20 bp, Artificial Sequence
  Description of Artificial Sequence: Synthetic oligonucleotide
  Target: ATXN1; (-) strand; PAM type: YTN; PAM sequence: TTA
tattttgttatgttttccca

SEQ ID NO: 198206 - DNA, 20 bp, Artificial Sequence
  Description of Artificial Sequence: Synthetic oligonucleotide
  Target: ATXN1; (-) strand; PAM type: YTN; PAM sequence: TTA
ttatattttgttatgttttc

SEQ ID NO: 198207 - DNA, 20 bp, Artificial Sequence
  Description of Artificial Sequence: Synthetic oligonucleotide
  Target: ATXN1; (-) strand; PAM type: YTN; PAM sequence: TTG
ataacattattatattttgt

SEQ ID NO: 198208 - DNA, 20 bp, Artificial Sequence
  Description of Artificial Sequence: Synthetic oligonucleotide
  Target: ATXN1; (-) strand; PAM type: YTN; PAM sequence: CTT
gataacattattatattttg

SEQ ID NO: 198209 - DNA, 20 bp, Artificial Sequence
  Description of Artificial Sequence: Synthetic oligonucleotide
  Target: ATXN1; (-) strand; PAM type: YTN; PAM sequence: TTC
ttgataacattattatattt

SEQ ID NO: 198210 - DNA, 20 bp, Artificial Sequence
  Description of Artificial Sequence: Synthetic oligonucleotide
  Target: ATXN1; (-) strand; PAM type: YTN; PAM sequence: TTG
atagtaaaaaaggattcttg

SEQ ID NO: 198211 - DNA, 20 bp, Artificial Sequence
  Description of Artificial Sequence: Synthetic oligonucleotide
  Target: ATXN1; (-) strand; PAM type: YTN; PAM sequence: CTT
gatagtaaaaaaggattctt

SEQ ID NO: 198212 - DNA, 20 bp, Artificial Sequence
  Description of Artificial Sequence: Synthetic oligonucleotide
  Target: ATXN1; (-) strand; PAM type: YTN; PAM sequence: TTC
agacttgatagtaaaaaagg

SEQ ID NO: 198213 - DNA, 20 bp, Artificial Sequence
  Description of Artificial Sequence: Synthetic oligonucleotide
  Target: ATXN1; (-) strand; PAM type: YTN; PAM sequence: CTT
cagacttgatagtaaaaaag

SEQ ID NO: 198214 - DNA, 20 bp, Artificial Sequence
  Description of Artificial Sequence: Synthetic oligonucleotide
  Target: ATXN1; (-) strand; PAM type: YTN; PAM sequence: CTC
cagtacttcagacttgatag

SEQ ID NO: 198215 - DNA, 20 bp, Artificial Sequence
  Description of Artificial Sequence: Synthetic oligonucleotide
  Target: ATXN1; (-) strand; PAM type: YTN; PAM sequence: CTC
atcatctccagtacttcaga

SEQ ID NO: 198216 - DNA, 20 bp, Artificial Sequence
  Description of Artificial Sequence: Synthetic oligonucleotide
  Target: ATXN1; (-) strand; PAM type: YTN; PAM sequence: CTC
tcatcatctccagtacttca

SEQ ID NO: 198217 - DNA, 20 bp, Artificial Sequence
  Description of Artificial Sequence: Synthetic oligonucleotide
  Target: ATXN1; (-) strand; PAM type: YTN; PAM sequence: TTC
ctctcatcatctccagtact

SEQ ID NO: 198218 - DNA, 20 bp, Artificial Sequence
  Description of Artificial Sequence: Synthetic oligonucleotide
  Target: ATXN1; (-) strand; PAM type: YTN; PAM sequence: CTG
atgttcctctcatcatctcc

SEQ ID NO: 198219 - DNA, 20 bp, Artificial Sequence
  Description of Artificial Sequence: Synthetic oligonucleotide
  Target: ATXN1; (-) strand; PAM type: YTN; PAM sequence: TTC
atggtccaataccctgatgt

SEQ ID NO: 198220 - DNA, 20 bp, Artificial Sequence
  Description of Artificial Sequence: Synthetic oligonucleotide
  Target: ATXN1; (-) strand; PAM type: YTN; PAM sequence: CTT
catggtccaataccctgatg

SEQ ID NO: 198221 - DNA, 20 bp, Artificial Sequence
  Description of Artificial Sequence: Synthetic oligonucleotide
  Target: ATXN1; (-) strand; PAM type: YTN; PAM sequence: CTC
ttcatggtccaataccctga

SEQ ID NO: 198222 - DNA, 20 bp, Artificial Sequence
  Description of Artificial Sequence: Synthetic oligonucleotide
  Target: ATXN1; (-) strand; PAM type: YTN; PAM sequence: TTC
tcttcatggtccaataccct

SEQ ID NO: 198223 - DNA, 20 bp, Artificial Sequence
  Description of Artificial Sequence: Synthetic oligonucleotide
  Target: ATXN1; (-) strand; PAM type: YTN; PAM sequence: TTT
ctcttcatggtccaataccc

SEQ ID NO: 198224 - DNA, 20 bp, Artificial Sequence
  Description of Artificial Sequence: Synthetic oligonucleotide
  Target: ATXN1; (-) strand; PAM type: YTN; PAM sequence: TTT
tctcttcatggtccaatacc

SEQ ID NO: 198225 - DNA, 20 bp, Artificial Sequence
  Description of Artificial Sequence: Synthetic oligonucleotide
  Target: ATXN1; (-) strand; PAM type: YTN; PAM sequence: CTG
gaattttctcttcatggtcc

SEQ ID NO: 198226 - DNA, 20 bp, Artificial Sequence
  Description of Artificial Sequence: Synthetic oligonucleotide
  Target: ATXN1; (-) strand; PAM type: YTN; PAM sequence: CTC
aggatggcacacccaggact

SEQ ID NO: 198227 - DNA, 20 bp, Artificial Sequence
  Description of Artificial Sequence: Synthetic oligonucleotide
  Target: ATXN1; (-) strand; PAM type: YTN; PAM sequence: TTG
ctcaggatggcacacccagg

SEQ ID NO: 198228 - DNA, 20 bp, Artificial Sequence
  Description of Artificial Sequence: Synthetic oligonucleotide
  Target: ATXN1; (-) strand; PAM type: YTN; PAM sequence: CTT
gctcaggatggcacacccag

SEQ ID NO: 198229 - DNA, 20 bp, Artificial Sequence
  Description of Artificial Sequence: Synthetic oligonucleotide
  Target: ATXN1; (-) strand; PAM type: YTN; PAM sequence: CTA
tgacttgctcaggatggcac

SEQ ID NO: 198230 - DNA, 20 bp, Artificial Sequence
  Description of Artificial Sequence: Synthetic oligonucleotide
  Target: ATXN1; (-) strand; PAM type: YTN; PAM sequence: CTG
aggtgcagaggagagctatg

SEQ ID NO: 198231 - DNA, 20 bp, Artificial Sequence
  Description of Artificial Sequence: Synthetic oligonucleotide
  Target: ATXN1; (-) strand; PAM type: YTN; PAM sequence: TTA
ggaaactgaggtgcagagga

SEQ ID NO: 198232 - DNA, 20 bp, Artificial Sequence
  Description of Artificial Sequence: Synthetic oligonucleotide
  Target: ATXN1; (-) strand; PAM type: YTN; PAM sequence: CTG
attaggaaactgaggtgcag

SEQ ID NO: 198233 - DNA, 20 bp, Artificial Sequence
  Description of Artificial Sequence: Synthetic oligonucleotide
  Target: ATXN1; (-) strand; PAM type: YTN; PAM sequence: TTA
ctgattaggaaactgaggtg

SEQ ID NO: 198234 - DNA, 20 bp, Artificial Sequence
  Description of Artificial Sequence: Synthetic oligonucleotide
  Target: ATXN1; (-) strand; PAM type: YTN; PAM sequence: TTT
actgattaggaaactgaggt

SEQ ID NO: 198235 - DNA, 20 bp, Artificial Sequence
  Description of Artificial Sequence: Synthetic oligonucleotide
  Target: ATXN1; (-) strand; PAM type: YTN; PAM sequence: TTT
tactgattaggaaactgagg

SEQ ID NO: 198236 - DNA, 20 bp, Artificial Sequence
  Description of Artificial Sequence: Synthetic oligonucleotide
  Target: ATXN1; (-) strand; PAM type: YTN; PAM sequence: TTG
ttttactgattaggaaactg

SEQ ID NO: 198237 - DNA, 20 bp, Artificial Sequence
  Description of Artificial Sequence: Synthetic oligonucleotide
  Target: ATXN1; (-) strand; PAM type: YTN; PAM sequence: CTT
gttttactgattaggaaact

SEQ ID NO: 198238 - DNA, 20 bp, Artificial Sequence
  Description of Artificial Sequence: Synthetic oligonucleotide
  Target: ATXN1; (-) strand; PAM type: YTN; PAM sequence: CTC
ccttgttttactgattagga

SEQ ID NO: 198239 - DNA, 20 bp, Artificial Sequence
  Description of Artificial Sequence: Synthetic oligonucleotide
  Target: ATXN1; (-) strand; PAM type: YTN; PAM sequence: TTC
accaactcccttgttttact

SEQ ID NO: 198240 - DNA, 20 bp, Artificial Sequence
  Description of Artificial Sequence: Synthetic oligonucleotide
  Target: ATXN1; (-) strand; PAM type: YTN; PAM sequence: TTG
agaaattcaccaactccctt

SEQ ID NO: 198241 - DNA, 20 bp, Artificial Sequence
  Description of Artificial Sequence: Synthetic oligonucleotide
  Target: ATXN1; (-) strand; PAM type: YTN; PAM sequence: CTT
gagaaattcaccaactccct

SEQ ID NO: 198242 - DNA, 20 bp, Artificial Sequence
  Description of Artificial Sequence: Synthetic oligonucleotide
  Target: ATXN1; (-) strand; PAM type: YTN; PAM sequence: CTG
gagcatgcgagggacttgag

SEQ ID NO: 198243 - DNA, 20 bp, Artificial Sequence
  Description of Artificial Sequence: Synthetic oligonucleotide
  Target: ATXN1; (-) strand; PAM type: YTN; PAM sequence: CTG
gcaaagagaaagacgaggag

SEQ ID NO: 198244 - DNA, 20 bp, Artificial Sequence
  Description of Artificial Sequence: Synthetic oligonucleotide
  Target: ATXN1; (-) strand; PAM type: YTN; PAM sequence: CTG
ctggcaaagagaaagacgag

SEQ ID NO: 198245 - DNA, 20 bp, Artificial Sequence
  Description of Artificial Sequence: Synthetic oligonucleotide
  Target: ATXN1; (-) strand; PAM type: YTN; PAM sequence: CTC
agtccctgctggcaaagaga

SEQ ID NO: 198246 - DNA, 20 bp, Artificial Sequence
  Description of Artificial Sequence: Synthetic oligonucleotide
  Target: ATXN1; (-) strand; PAM type: YTN; PAM sequence: TTC
gtcacacactcagtccctgc

SEQ ID NO: 198247 - DNA, 20 bp, Artificial Sequence
  Description of Artificial Sequence: Synthetic oligonucleotide
  Target: ATXN1; (-) strand; PAM type: YTN; PAM sequence: CTT
cgtcacacactcagtccctg

SEQ ID NO: 198248 - DNA, 20 bp, Artificial Sequence
  Description of Artificial Sequence: Synthetic oligonucleotide
  Target: ATXN1; (-) strand; PAM type: YTN; PAM sequence: CTG
aggtcaaaggcacaaccttc

SEQ ID NO: 198249 - DNA, 20 bp, Artificial Sequence
  Description of Artificial Sequence: Synthetic oligonucleotide
  Target: ATXN1; (-) strand; PAM type: YTN; PAM sequence: CTC
tgaggtcaaaggcacaacct

SEQ ID NO: 198250 - DNA, 20 bp, Artificial Sequence
  Description of Artificial Sequence: Synthetic oligonucleotide
  Target: ATXN1; (-) strand; PAM type: YTN; PAM sequence: TTC
ctctgaggtcaaaggcacaa

SEQ ID NO: 198251 - DNA, 20 bp, Artificial Sequence
  Description of Artificial Sequence: Synthetic oligonucleotide
  Target: ATXN1; (-) strand; PAM type: YTN; PAM sequence: TTG
tcacattcctctgaggtcaa

SEQ ID NO: 198252 - DNA, 20 bp, Artificial Sequence
  Description of Artificial Sequence: Synthetic oligonucleotide
  Target: ATXN1; (-) strand; PAM type: YTN; PAM sequence: CTG
tgggaacaatgcaaggaagg

SEQ ID NO: 198253 - DNA, 20 bp, Artificial Sequence
  Description of Artificial Sequence: Synthetic oligonucleotide
  Target: ATXN1; (-) strand; PAM type: YTN; PAM sequence: TTA
ctgtgggaacaatgcaagga

SEQ ID NO: 198254 - DNA, 20 bp, Artificial Sequence
  Description of Artificial Sequence: Synthetic oligonucleotide
  Target: ATXN1; (-) strand; PAM type: YTN; PAM sequence: CTG
gttactgtgggaacaatgca

SEQ ID NO: 198255 - DNA, 20 bp, Artificial Sequence
  Description of Artificial Sequence: Synthetic oligonucleotide
  Target: ATXN1; (-) strand; PAM type: YTN; PAM sequence: CTC
tggttactgtgggaacaatg

SEQ ID NO: 198256 - DNA, 20 bp, Artificial Sequence
  Description of Artificial Sequence: Synthetic oligonucleotide
  Target: ATXN1; (-) strand; PAM type: YTN; PAM sequence: CTG
gctctggttactgtgggaac

SEQ ID NO: 198257 - DNA, 20 bp, Artificial Sequence
  Description of Artificial Sequence: Synthetic oligonucleotide
  Target: ATXN1; (-) strand; PAM type: YTN; PAM sequence: CTG
gacagctggctctggttact

SEQ ID NO: 198258 - DNA, 20 bp, Artificial Sequence
  Description of Artificial Sequence: Synthetic oligonucleotide
  Target: ATXN1; (-) strand; PAM type: YTN; PAM sequence: TTG
gccagccggcctggacagct

SEQ ID NO: 198259 - DNA, 20 bp, Artificial Sequence
  Description of Artificial Sequence: Synthetic oligonucleotide
  Target: ATXN1; (-) strand; PAM type: YTN; PAM sequence: CTT
ggccagccggcctggacagc

SEQ ID NO: 198260 - DNA, 20 bp, Artificial Sequence
  Description of Artificial Sequence: Synthetic oligonucleotide
  Target: ATXN1; (-) strand; PAM type: YTN; PAM sequence: CTG
cgccacaacttggccagccg

SEQ ID NO: 198261 - DNA, 20 bp, Artificial Sequence
  Description of Artificial Sequence: Synthetic oligonucleotide
  Target: ATXN1; (-) strand; PAM type: YTN; PAM sequence: TTG
tgtgtgatcctgcgccacaa

SEQ ID NO: 198262 - DNA, 20 bp, Artificial Sequence
  Description of Artificial Sequence: Synthetic oligonucleotide
  Target: ATXN1; (-) strand; PAM type: YTN; PAM sequence: CTT
gtgtgtgatcctgcgccaca

SEQ ID NO: 198263 - DNA, 20 bp, Artificial Sequence
  Description of Artificial Sequence: Synthetic oligonucleotide
  Target: ATXN1; (-) strand; PAM type: YTN; PAM sequence: TTG
aggcggagtcccccaagcag

SEQ ID NO: 198264 - DNA, 20 bp, Artificial Sequence
  Description of Artificial Sequence: Synthetic oligonucleotide
  Target: ATXN1; (-) strand; PAM type: YTN; PAM sequence: CTT
gaggcggagtcccccaagca

SEQ ID NO: 198265 - DNA, 20 bp, Artificial Sequence
  Description of Artificial Sequence: Synthetic oligonucleotide
  Target: ATXN1; (-) strand; PAM type: YTN; PAM sequence: CTA
gaggaagggggaggccttga

SEQ ID NO: 198266 - DNA, 20 bp, Artificial Sequence
  Description of Artificial Sequence: Synthetic oligonucleotide
  Target: ATXN1; (-) strand; PAM type: YTN; PAM sequence: CTG
cggataaagacctagaggaa

SEQ ID NO: 198267 - DNA, 20 bp, Artificial Sequence
  Description of Artificial Sequence: Synthetic oligonucleotide
  Target: ATXN1; (-) strand; PAM type: YTN; PAM sequence: TTA
ggagggtcccgacctgcgga

SEQ ID NO: 198268 - DNA, 20 bp, Artificial Sequence
  Description of Artificial Sequence: Synthetic oligonucleotide
  Target: ATXN1; (-) strand; PAM type: YTN; PAM sequence: CTT
aggagggtcccgacctgcgg

SEQ ID NO: 198269 - DNA, 20 bp, Artificial Sequence
  Description of Artificial Sequence: Synthetic oligonucleotide
  Target: ATXN1; (-) strand; PAM type: YTN; PAM sequence: TTC
ttaggagggtcccgacctgc

SEQ ID NO: 198270 - DNA, 20 bp, Artificial Sequence
  Description of Artificial Sequence: Synthetic oligonucleotide
  Target: ATXN1; (-) strand; PAM type: YTN; PAM sequence: TTG
tgttcttaggagggtcccga

SEQ ID NO: 198271 - DNA, 20 bp, Artificial Sequence
  Description of Artificial Sequence: Synthetic oligonucleotide
  Target: ATXN1; (-) strand; PAM type: YTN; PAM sequence: CTT
gtgttcttaggagggtcccg

SEQ ID NO: 198272 - DNA, 20 bp, Artificial Sequence
  Description of Artificial Sequence: Synthetic oligonucleotide
  Target: ATXN1; (-) strand; PAM type: YTN; PAM sequence: TTC
ttgtgttcttaggagggtcc

SEQ ID NO: 198273 - DNA, 20 bp, Artificial Sequence
  Description of Artificial Sequence: Synthetic oligonucleotide
  Target: ATXN1; (-) strand; PAM type: YTN; PAM sequence: CTC
attcttgtgttcttaggagg

SEQ ID NO: 198274 - DNA, 20 bp, Artificial Sequence
  Description of Artificial Sequence: Synthetic oligonucleotide
  Target: ATXN1; (-) strand; PAM type: YTN; PAM sequence: TTG
caggctcattcttgtgttct

SEQ ID NO: 198275 - DNA, 20 bp, Artificial Sequence
  Description of Artificial Sequence: Synthetic oligonucleotide
  Target: ATXN1; (-) strand; PAM type: YTN; PAM sequence: TTA
ggaaggattgcaggctcatt

SEQ ID NO: 198276 - DNA, 20 bp, Artificial Sequence
  Description of Artificial Sequence: Synthetic oligonucleotide
  Target: ATXN1; (-) strand; PAM type: YTN; PAM sequence: TTT
aggaaggattgcaggctcat

SEQ ID NO: 198277 - DNA, 20 bp, Artificial Sequence
  Description of Artificial Sequence: Synthetic oligonucleotide
  Target: ATXN1; (-) strand; PAM type: YTN; PAM sequence: TTA
tttaggaaggattgcaggct

SEQ ID NO: 198278 - DNA, 20 bp, Artificial Sequence
  Description of Artificial Sequence: Synthetic oligonucleotide
  Target: ATXN1; (-) strand; PAM type: YTN; PAM sequence: TTA
agcccccaaaagttatttag

SEQ ID NO: 198279 - DNA, 20 bp, Artificial Sequence
  Description of Artificial Sequence: Synthetic oligonucleotide
  Target: ATXN1; (-) strand; PAM type: YTN; PAM sequence: TTT
aagcccccaaaagttattta

SEQ ID NO: 198280 - DNA, 20 bp, Artificial Sequence
  Description of Artificial Sequence: Synthetic oligonucleotide
  Target: ATXN1; (-) strand; PAM type: YTN; PAM sequence: TTT
taagcccccaaaagttattt

SEQ ID NO: 198281 - DNA, 20 bp, Artificial Sequence
  Description of Artificial Sequence: Synthetic oligonucleotide
  Target: ATXN1; (-) strand; PAM type: YTN; PAM sequence: CTA
cacccaggattttaagcccc

SEQ ID NO: 198282 - DNA, 20 bp, Artificial Sequence
  Description of Artificial Sequence: Synthetic oligonucleotide
  Target: ATXN1; (-) strand; PAM type: YTN; PAM sequence: TTG
tagctacacccaggatttta

SEQ ID NO: 198283 - DNA, 20 bp, Artificial Sequence
  Description of Artificial Sequence: Synthetic oligonucleotide
  Target: ATXN1; (-) strand; PAM type: YTN; PAM sequence: TTC
acatgattgtagctacaccc

SEQ ID NO: 198284 - DNA, 20 bp, Artificial Sequence
  Description of Artificial Sequence: Synthetic oligonucleotide
  Target: ATXN1; (-) strand; PAM type: YTN; PAM sequence: TTT
cacatgattgtagctacacc

SEQ ID NO: 198285 - DNA, 20 bp, Artificial Sequence
  Description of Artificial Sequence: Synthetic oligonucleotide
  Target: ATXN1; (-) strand; PAM type: YTN; PAM sequence: TTA
gggggagtttcacatgattg

SEQ ID NO: 198286 - DNA, 20 bp, Artificial Sequence
  Description of Artificial Sequence: Synthetic oligonucleotide
  Target: ATXN1; (-) strand; PAM type: YTN; PAM sequence: CTG
tcattagggggagtttcaca

SEQ ID NO: 198287 - DNA, 20 bp, Artificial Sequence
  Description of Artificial Sequence: Synthetic oligonucleotide
  Target: ATXN1; (-) strand; PAM type: YTN; PAM sequence: CTA
gctgtcattagggggagttt

SEQ ID NO: 198288 - DNA, 20 bp, Artificial Sequence
  Description of Artificial Sequence: Synthetic oligonucleotide
  Target: ATXN1; (-) strand; PAM type: YTN; PAM sequence: CTC
tagctgtcattagggggagt

SEQ ID NO: 198289 - DNA, 20 bp, Artificial Sequence
  Description of Artificial Sequence: Synthetic oligonucleotide
  Target: ATXN1; (-) strand; PAM type: YTN; PAM sequence: TTG
aatacacacccaaatcctct

SEQ ID NO: 198290 - DNA, 20 bp, Artificial Sequence
  Description of Artificial Sequence: Synthetic oligonucleotide
  Target: ATXN1; (-) strand; PAM type: YTN; PAM sequence: CTC
agagaattgaatacacaccc

SEQ ID NO: 198291 - DNA, 20 bp, Artificial Sequence
  Description of Artificial Sequence: Synthetic oligonucleotide
  Target: ATXN1; (-) strand; PAM type: YTN; PAM sequence: TTG
caagcaccccacagcatccc

SEQ ID NO: 198292 - DNA, 20 bp, Artificial Sequence
  Description of Artificial Sequence: Synthetic oligonucleotide
  Target: ATXN1; (-) strand; PAM type: YTN; PAM sequence: CTA
taggttgcaagcaccccaca

SEQ ID NO: 198293 - DNA, 20 bp, Artificial Sequence
  Description of Artificial Sequence: Synthetic oligonucleotide
  Target: ATXN1; (-) strand; PAM type: YTN; PAM sequence: CTG
tctataggttgcaagcaccc

SEQ ID NO: 198294 - DNA, 20 bp, Artificial Sequence
  Description of Artificial Sequence: Synthetic oligonucleotide
  Target: ATXN1; (-) strand; PAM type: YTN; PAM sequence: CTG
ctgtctataggttgcaagca

SEQ ID NO: 198295 - DNA, 20 bp, Artificial Sequence
  Description of Artificial Sequence: Synthetic oligonucleotide
  Target: ATXN1; (-) strand; PAM type: YTN; PAM sequence: CTG
gaaaacacctgctgtctata

SEQ ID NO: 198296 - DNA, 20 bp, Artificial Sequence
  Description of Artificial Sequence: Synthetic oligonucleotide
  Target: ATXN1; (-) strand; PAM type: YTN; PAM sequence: TTG
aatcccagtgccataacacg

SEQ ID NO: 198297 - DNA, 20 bp, Artificial Sequence
  Description of Artificial Sequence: Synthetic oligonucleotide
  Target: ATXN1; (-) strand; PAM type: YTN; PAM sequence: CTT
gaatcccagtgccataacac

SEQ ID NO: 198298 - DNA, 20 bp, Artificial Sequence
  Description of Artificial Sequence: Synthetic oligonucleotide
  Target: ATXN1; (-) strand; PAM type: YTN; PAM sequence: CTC
acttgaatcccagtgccata

SEQ ID NO: 198299 - DNA, 20 bp, Artificial Sequence
  Description of Artificial Sequence: Synthetic oligonucleotide
  Target: ATXN1; (-) strand; PAM type: YTN; PAM sequence: TTC
atcctcacttgaatcccagt

SEQ ID NO: 198300 - DNA, 20 bp, Artificial Sequence
  Description of Artificial Sequence: Synthetic oligonucleotide
  Target: ATXN1; (-) strand; PAM type: YTN; PAM sequence: TTA
gatgttcatcctcacttgaa

SEQ ID NO: 198301 - DNA, 20 bp, Artificial Sequence
  Description of Artificial Sequence: Synthetic oligonucleotide
  Target: ATXN1; (-) strand; PAM type: YTN; PAM sequence: CTT
agatgttcatcctcacttga

SEQ ID NO: 198302 - DNA, 20 bp, Artificial Sequence
  Description of Artificial Sequence: Synthetic oligonucleotide
  Target: ATXN1; (-) strand; PAM type: YTN; PAM sequence: CTC
atcttagatgttcatcctca

SEQ ID NO: 198303 - DNA, 20 bp, Artificial Sequence
  Description of Artificial Sequence: Synthetic oligonucleotide
  Target: ATXN1; (-) strand; PAM type: YTN; PAM sequence: CTC
tcatcttagatgttcatcct

SEQ ID NO: 198304 - DNA, 20 bp, Artificial Sequence
  Description of Artificial Sequence: Synthetic oligonucleotide
  Target: ATXN1; (-) strand; PAM type: YTN; PAM sequence: CTC
cagctctcatcttagatgtt

SEQ ID NO: 198305 - DNA, 20 bp, Artificial Sequence
  Description of Artificial Sequence: Synthetic oligonucleotide
  Target: ATXN1; (-) strand; PAM type: YTN; PAM sequence: CTC
actccagctctcatcttaga

SEQ ID NO: 198306 - DNA, 20 bp, Artificial Sequence
  Description of Artificial Sequence: Synthetic oligonucleotide
  Target: ATXN1; (-) strand; PAM type: YTN; PAM sequence: TTA
caaatcgtggctcactccag

SEQ ID NO: 198307 - DNA, 20 bp, Artificial Sequence
  Description of Artificial Sequence: Synthetic oligonucleotide
  Target: ATXN1; (-) strand; PAM type: YTN; PAM sequence: CTG
catggttacaaatcgtggct

SEQ ID NO: 198308 - DNA, 20 bp, Artificial Sequence
  Description of Artificial Sequence: Synthetic oligonucleotide
  Target: ATXN1; (-) strand; PAM type: YTN; PAM sequence: CTC
acatctgcatggttacaaat

SEQ ID NO: 198309 - DNA, 20 bp, Artificial Sequence
  Description of Artificial Sequence: Synthetic oligonucleotide
  Target: ATXN1; (-) strand; PAM type: YTN; PAM sequence: CTG
ctcacatctgcatggttaca

SEQ ID NO: 198310 - DNA, 20 bp, Artificial Sequence
  Description of Artificial Sequence: Synthetic oligonucleotide
  Target: ATXN1; (-) strand; PAM type: YTN; PAM sequence: CTG
ctgctcacatctgcatggtt

SEQ ID NO: 198311 - DNA, 20 bp, Artificial Sequence
  Description of Artificial Sequence: Synthetic oligonucleotide
  Target: ATXN1; (-) strand; PAM type: YTN; PAM sequence: CTG
catggtcgctgctgctcaca

SEQ ID NO: 198312 - DNA, 20 bp, Artificial Sequence
  Description of Artificial Sequence: Synthetic oligonucleotide
  Target: ATXN1; (-) strand; PAM type: YTN; PAM sequence: CTG
caggcaaggaggaaagcctg

SEQ ID NO: 198313 - DNA, 20 bp, Artificial Sequence
  Description of Artificial Sequence: Synthetic oligonucleotide
  Target: ATXN1; (-) strand; PAM type: YTN; PAM sequence: CTC
agatgcaagctgcaggcaag

SEQ ID NO: 198314 - DNA, 20 bp, Artificial Sequence
  Description of Artificial Sequence: Synthetic oligonucleotide
  Target: ATXN1; (-) strand; PAM type: YTN; PAM sequence: TTA
ggatctcagatgcaagctgc

SEQ ID NO: 198315 - DNA, 20 bp, Artificial Sequence
  Description of Artificial Sequence: Synthetic oligonucleotide
  Target: ATXN1; (-) strand; PAM type: YTN; PAM sequence: TTA
ttaggatctcagatgcaagc

SEQ ID NO: 198316 - DNA, 20 bp, Artificial Sequence
  Description of Artificial Sequence: Synthetic oligonucleotide
  Target: ATXN1; (-) strand; PAM type: YTN; PAM sequence: CTT
attaggatctcagatgcaag

SEQ ID NO: 198317 - DNA, 20 bp, Artificial Sequence
  Description of Artificial Sequence: Synthetic oligonucleotide
  Target: ATXN1; (-) strand; PAM type: YTN; PAM sequence: CTC
ccttattaggatctcagatg

SEQ ID NO: 198318 - DNA, 20 bp, Artificial Sequence
  Description of Artificial Sequence: Synthetic oligonucleotide
  Target: ATXN1; (-) strand; PAM type: YTN; PAM sequence: TTC
cagtgatcctcccttattag

SEQ ID NO: 198319 - DNA, 20 bp, Artificial Sequence
  Description of Artificial Sequence: Synthetic oligonucleotide
  Target: ATXN1; (-) strand; PAM type: YTN; PAM sequence: TTT
ccagtgatcctcccttatta

SEQ ID NO: 198320 - DNA, 20 bp, Artificial Sequence
  Description of Artificial Sequence: Synthetic oligonucleotide
  Target: ATXN1; (-) strand; PAM type: YTN; PAM sequence: CTT
tccagtgatcctcccttatt

SEQ ID NO: 198321 - DNA, 20 bp, Artificial Sequence
  Description of Artificial Sequence: Synthetic oligonucleotide
  Target: ATXN1; (-) strand; PAM type: YTN; PAM sequence: CTA
aaaataatggtaatactttc

SEQ ID NO: 198322 - DNA, 20 bp, Artificial Sequence
  Description of Artificial Sequence: Synthetic oligonucleotide
  Target: ATXN1; (-) strand; PAM type: YTN; PAM sequence: TTA
gaaaagctaaaaataatggt

SEQ ID NO: 198323 - DNA, 20 bp, Artificial Sequence
  Description of Artificial Sequence: Synthetic oligonucleotide
  Target: ATXN1; (-) strand; PAM type: YTN; PAM sequence: CTT
agaaaagctaaaaataatgg

SEQ ID NO: 198324 - DNA, 20 bp, Artificial Sequence
  Description of Artificial Sequence: Synthetic oligonucleotide
  Target: ATXN1; (-) strand; PAM type: YTN; PAM sequence: CTC
ccttagaaaagctaaaaata

SEQ ID NO: 198325 - DNA, 20 bp, Artificial Sequence
  Description of Artificial Sequence: Synthetic oligonucleotide
  Target: ATXN1; (-) strand; PAM type: YTN; PAM sequence: CTC
cctcccttagaaaagctaaa

SEQ ID NO: 198326 - DNA, 20 bp, Artificial Sequence
  Description of Artificial Sequence: Synthetic oligonucleotide
  Target: ATXN1; (-) strand; PAM type: YTN; PAM sequence: CTC
ctccctcccttagaaaagct

SEQ ID NO: 198327 - DNA, 20 bp, Artificial Sequence
  Description of Artificial Sequence: Synthetic oligonucleotide
  Target: ATXN1; (-) strand; PAM type: YTN; PAM sequence: TTC
gaaaactcctccctccctta

SEQ ID NO: 198328 - DNA, 20 bp, Artificial Sequence
  Description of Artificial Sequence: Synthetic oligonucleotide
  Target: ATXN1; (-) strand; PAM type: YTN; PAM sequence: TTT
cgaaaactcctccctccctt

SEQ ID NO: 198329 - DNA, 20 bp, Artificial Sequence
  Description of Artificial Sequence: Synthetic oligonucleotide
  Target: ATXN1; (-) strand; PAM type: YTN; PAM sequence: CTT
tcgaaaactcctccctccct

SEQ ID NO: 198330 - DNA, 20 bp, Artificial Sequence
  Description of Artificial Sequence: Synthetic oligonucleotide
  Target: ATXN1; (-) strand; PAM type: YTN; PAM sequence: TTG
tcctttcgaaaactcctccc

SEQ ID NO: 198331 - DNA, 20 bp, Artificial Sequence
  Description of Artificial Sequence: Synthetic oligonucleotide
  Target: ATXN1; (-) strand; PAM type: YTN; PAM sequence: TTT
gtcctttcgaaaactcctcc

SEQ ID NO: 198332 - DNA, 20 bp, Artificial Sequence
  Description of Artificial Sequence: Synthetic oligonucleotide
  Target: ATXN1; (-) strand; PAM type: YTN; PAM sequence: TTT
tgtcctttcgaaaactcctc

SEQ ID NO: 198333 - DNA, 20 bp, Artificial Sequence
  Description of Artificial Sequence: Synthetic oligonucleotide
  Target: ATXN1; (-) strand; PAM type: YTN; PAM sequence: TTC
cattttgtcctttcgaaaac

SEQ ID NO: 198334 - DNA, 20 bp, Artificial Sequence
  Description of Artificial Sequence: Synthetic oligonucleotide
  Target: ATXN1; (-) strand; PAM type: YTN; PAM sequence: TTT
ccattttgtcctttcgaaaa

SEQ ID NO: 198335 - DNA, 20 bp, Artificial Sequence
  Description of Artificial Sequence: Synthetic oligonucleotide
  Target: ATXN1; (-) strand; PAM type: YTN; PAM sequence: CTT
tccattttgtcctttcgaaa

SEQ ID NO: 198336 - DNA, 20 bp, Artificial Sequence
  Description of Artificial Sequence: Synthetic oligonucleotide
  Target: ATXN1; (-) strand; PAM type: YTN; PAM sequence: TTC
ctttccattttgtcctttcg

SEQ ID NO: 198337 - DNA, 20 bp, Artificial Sequence
  Description of Artificial Sequence: Synthetic oligonucleotide
  Target: ATXN1; (-) strand; PAM type: YTN; PAM sequence: CTA
aattcctttccattttgtcc

SEQ ID NO: 198338 - DNA, 20 bp, Artificial Sequence
  Description of Artificial Sequence: Synthetic oligonucleotide
  Target: ATXN1; (-) strand; PAM type: YTN; PAM sequence: TTG
ccctaaattcctttccattt

SEQ ID NO: 198339 - DNA, 20 bp, Artificial Sequence
  Description of Artificial Sequence: Synthetic oligonucleotide
  Target: ATXN1; (-) strand; PAM type: YTN; PAM sequence: CTT
gccctaaattcctttccatt

SEQ ID NO: 198340 - DNA, 20 bp, Artificial Sequence
  Description of Artificial Sequence: Synthetic oligonucleotide
  Target: ATXN1; (-) strand; PAM type: YTN; PAM sequence: CTA
cacacacccttgccctaaat

SEQ ID NO: 198341 - DNA, 20 bp, Artificial Sequence
  Description of Artificial Sequence: Synthetic oligonucleotide
  Target: ATXN1; (-) strand; PAM type: YTN; PAM sequence: CTC
cccacctacacacacccttg

SEQ ID NO: 198342 - DNA, 20 bp, Artificial Sequence
  Description of Artificial Sequence: Synthetic oligonucleotide
  Target: ATXN1; (-) strand; PAM type: YTN; PAM sequence: TTC
cacaccacctccccacctac

SEQ ID NO: 198343 - DNA, 20 bp, Artificial Sequence
  Description of Artificial Sequence: Synthetic oligonucleotide
  Target: ATXN1; (-) strand; PAM type: YTN; PAM sequence: CTT
ccacaccacctccccaccta

SEQ ID NO: 198344 - DNA, 20 bp, Artificial Sequence
  Description of Artificial Sequence: Synthetic oligonucleotide
  Target: ATXN1; (-) strand; PAM type: YTN; PAM sequence: CTC
cttccacaccacctccccac

SEQ ID NO: 198345 - DNA, 20 bp, Artificial Sequence
  Description of Artificial Sequence: Synthetic oligonucleotide
  Target: ATXN1; (-) strand; PAM type: YTN; PAM sequence: CTC
gcctccttccacaccacctc

SEQ ID NO: 198346 - DNA, 20 bp, Artificial Sequence
  Description of Artificial Sequence: Synthetic oligonucleotide
  Target: ATXN1; (-) strand; PAM type: YTN; PAM sequence: TTC
tcgcctccttccacaccacc

SEQ ID NO: 198347 - DNA, 20 bp, Artificial Sequence
  Description of Artificial Sequence: Synthetic oligonucleotide
  Target: ATXN1; (-) strand; PAM type: YTN; PAM sequence: CTT
ctcgcctccttccacaccac

SEQ ID NO: 198348 - DNA, 20 bp, Artificial Sequence
  Description of Artificial Sequence: Synthetic oligonucleotide
  Target: ATXN1; (-) strand; PAM type: YTN; PAM sequence: CTC
atcttctcgcctccttccac

SEQ ID NO: 198349 - DNA, 20 bp, Artificial Sequence
  Description of Artificial Sequence: Synthetic oligonucleotide
  Target: ATXN1; (-) strand; PAM type: YTN; PAM sequence: CTA
ctcatcttctcgcctccttc

SEQ ID NO: 198350 - DNA, 20 bp, Artificial Sequence
  Description of Artificial Sequence: Synthetic oligonucleotide
  Target: ATXN1; (-) strand; PAM type: YTN; PAM sequence: TTC
tactcatcttctcgcctcct

SEQ ID NO: 198351 - DNA, 20 bp, Artificial Sequence
  Description of Artificial Sequence: Synthetic oligonucleotide
  Target: ATXN1; (-) strand; PAM type: YTN; PAM sequence: TTT
ctactcatcttctcgcctcc

SEQ ID NO: 198352 - DNA, 20 bp, Artificial Sequence
  Description of Artificial Sequence: Synthetic oligonucleotide
  Target: ATXN1; (-) strand; PAM type: YTN; PAM sequence: TTA
tttctactcatcttctcgcc

SEQ ID NO: 198353 - DNA, 20 bp, Artificial Sequence
  Description of Artificial Sequence: Synthetic oligonucleotide
  Target: ATXN1; (-) strand; PAM type: YTN; PAM sequence: CTT
atttctactcatcttctcgc

SEQ ID NO: 198354 - DNA, 20 bp, Artificial Sequence
  Description of Artificial Sequence: Synthetic oligonucleotide
  Target: ATXN1; (-) strand; PAM type: YTN; PAM sequence: CTG
aaagtcttatttctactcat

SEQ ID NO: 198355 - DNA, 20 bp, Artificial Sequence
  Description of Artificial Sequence: Synthetic oligonucleotide
  Target: ATXN1; (-) strand; PAM type: YTN; PAM sequence: CTG
tcctgaaagtcttatttcta

SEQ ID NO: 198356 - DNA, 20 bp, Artificial Sequence
  Description of Artificial Sequence: Synthetic oligonucleotide
  Target: ATXN1; (-) strand; PAM type: YTN; PAM sequence: TTA
tctgtcctgaaagtcttatt

SEQ ID NO: 198357 - DNA, 20 bp, Artificial Sequence
  Description of Artificial Sequence: Synthetic oligonucleotide
  Target: ATXN1; (-) strand; PAM type: YTN; PAM sequence: CTT
atctgtcctgaaagtcttat

SEQ ID NO: 198358 - DNA, 20 bp, Artificial Sequence
  Description of Artificial Sequence: Synthetic oligonucleotide
  Target: ATXN1; (-) strand; PAM type: YTN; PAM sequence: CTG
cttatctgtcctgaaagtct

SEQ ID NO: 198359 - DNA, 20 bp, Artificial Sequence
  Description of Artificial Sequence: Synthetic oligonucleotide
  Target: ATXN1; (-) strand; PAM type: YTN; PAM sequence: TTA
aggaaggagaaggaagctgc

SEQ ID NO: 198360 - DNA, 20 bp, Artificial Sequence
  Description of Artificial Sequence: Synthetic oligonucleotide
  Target: ATXN1; (-) strand; PAM type: YTN; PAM sequence: CTA
ttaaggaaggagaaggaagc

SEQ ID NO: 198361 - DNA, 20 bp, Artificial Sequence
  Description of Artificial Sequence: Synthetic oligonucleotide
  Target: ATXN1; (-) strand; PAM type: YTN; PAM sequence: CTG
tgatcatctattaaggaagg

SEQ ID NO: 198362 - DNA, 20 bp, Artificial Sequence
  Description of Artificial Sequence: Synthetic oligonucleotide
  Target: ATXN1; (-) strand; PAM type: YTN; PAM sequence: CTG
gctgtgatcatctattaagg

SEQ ID NO: 198363 - DNA, 20 bp, Artificial Sequence
  Description of Artificial Sequence: Synthetic oligonucleotide
  Target: ATXN1; (-) strand; PAM type: YTN; PAM sequence: CTG
gaagcctggctgtgatcatc

SEQ ID NO: 198364 - DNA, 20 bp, Artificial Sequence
  Description of Artificial Sequence: Synthetic oligonucleotide
  Target: ATXN1; (-) strand; PAM type: YTN; PAM sequence: TTA
taaccctggaagcctggctg

SEQ ID NO: 198365 - DNA, 20 bp, Artificial Sequence
  Description of Artificial Sequence: Synthetic oligonucleotide
  Target: ATXN1; (-) strand; PAM type: YTN; PAM sequence: TTT
ataaccctggaagcctggct

SEQ ID NO: 198366 - DNA, 20 bp, Artificial Sequence
  Description of Artificial Sequence: Synthetic oligonucleotide
  Target: ATXN1; (-) strand; PAM type: YTN; PAM sequence: TTT
tataaccctggaagcctggc

SEQ ID NO: 198367 - DNA, 20 bp, Artificial Sequence
  Description of Artificial Sequence: Synthetic oligonucleotide
  Target: ATXN1; (-) strand; PAM type: YTN; PAM sequence: TTG
ttttataaccctggaagcct

SEQ ID NO: 198368 - DNA, 20 bp, Artificial Sequence
  Description of Artificial Sequence: Synthetic oligonucleotide
  Target: ATXN1; (-) strand; PAM type: YTN; PAM sequence: TTG
gtgttgttttataaccctgg

SEQ ID NO: 198369 - DNA, 20 bp, Artificial Sequence
  Description of Artificial Sequence: Synthetic oligonucleotide
  Target: ATXN1; (-) strand; PAM type: YTN; PAM sequence: CTT
ggtgttgttttataaccctg

SEQ ID NO: 198370 - DNA, 20 bp, Artificial Sequence
  Description of Artificial Sequence: Synthetic oligonucleotide
  Target: ATXN1; (-) strand; PAM type: YTN; PAM sequence: CTG
aagaccttggtgttgtttta

SEQ ID NO: 198371 - DNA, 20 bp, Artificial Sequence
  Description of Artificial Sequence: Synthetic oligonucleotide
  Target: ATXN1; (-) strand; PAM type: YTN; PAM sequence: CTG
gacctgaagaccttggtgtt

SEQ ID NO: 198372 - DNA, 20 bp, Artificial Sequence
  Description of Artificial Sequence: Synthetic oligonucleotide
  Target: ATXN1; (-) strand; PAM type: YTN; PAM sequence: CTA
catacctggacctgaagacc

SEQ ID NO: 198373 - DNA, 20 bp, Artificial Sequence
  Description of Artificial Sequence: Synthetic oligonucleotide
  Target: ATXN1; (-) strand; PAM type: YTN; PAM sequence: CTC
tacatacctggacctgaaga

SEQ ID NO: 198374 - DNA, 20 bp, Artificial Sequence
  Description of Artificial Sequence: Synthetic oligonucleotide
  Target: ATXN1; (-) strand; PAM type: YTN; PAM sequence: TTG
tctctacatacctggacctg

SEQ ID NO: 198375 - DNA, 20 bp, Artificial Sequence
  Description of Artificial Sequence: Synthetic oligonucleotide
  Target: ATXN1; (-) strand; PAM type: YTN; PAM sequence: TTT
gtctctacatacctggacct

SEQ ID NO: 198376 - DNA, 20 bp, Artificial Sequence
  Description of Artificial Sequence: Synthetic oligonucleotide
  Target: ATXN1; (-) strand; PAM type: YTN; PAM sequence: CTT
tgtctctacatacctggacc

SEQ ID NO: 198377 - DNA, 20 bp, Artificial Sequence
  Description of Artificial Sequence: Synthetic oligonucleotide
  Target: ATXN1; (-) strand; PAM type: YTN; PAM sequence: CTC
ctttgtctctacatacctgg

SEQ ID NO: 198378 - DNA, 20 bp, Artificial Sequence
  Description of Artificial Sequence: Synthetic oligonucleotide
  Target: ATXN1; (-) strand; PAM type: YTN; PAM sequence: TTG
cgaagactcctttgtctcta

SEQ ID NO: 198379 - DNA, 20 bp, Artificial Sequence
  Description of Artificial Sequence: Synthetic oligonucleotide
  Target: ATXN1; (-) strand; PAM type: YTN; PAM sequence: CTT
gcgaagactcctttgtctct

SEQ ID NO: 198380 - DNA, 20 bp, Artificial Sequence
  Description of Artificial Sequence: Synthetic oligonucleotide
  Target: ATXN1; (-) strand; PAM type: YTN; PAM sequence: TTC
cttgcgaagactcctttgtc

SEQ ID NO: 198381 - DNA, 20 bp, Artificial Sequence
  Description of Artificial Sequence: Synthetic oligonucleotide
  Target: ATXN1; (-) strand; PAM type: YTN; PAM sequence: TTT
ccttgcgaagactcctttgt

SEQ ID NO: 198382 - DNA, 20 bp, Artificial Sequence
  Description of Artificial Sequence: Synthetic oligonucleotide
  Target: ATXN1; (-) strand; PAM type: YTN; PAM sequence: TTA
gaaaaatggtttccttgcga

SEQ ID NO: 198383 - DNA, 20 bp, Artificial Sequence
  Description of Artificial Sequence: Synthetic oligonucleotide
  Target: ATXN1; (-) strand; PAM type: YTN; PAM sequence: CTT
agaaaaatggtttccttgcg

SEQ ID NO: 198384 - DNA, 20 bp, Artificial Sequence
  Description of Artificial Sequence: Synthetic oligonucleotide
  Target: ATXN1; (-) strand; PAM type: YTN; PAM sequence: CTC
ttagaaaaatggtttccttg

SEQ ID NO: 198385 - DNA, 20 bp, Artificial Sequence
  Description of Artificial Sequence: Synthetic oligonucleotide
  Target: ATXN1; (-) strand; PAM type: YTN; PAM sequence: TTG
ccatgctcttagaaaaatgg

SEQ ID NO: 198386 - DNA, 20 bp, Artificial Sequence
  Description of Artificial Sequence: Synthetic oligonucleotide
  Target: ATXN1; (-) strand; PAM type: YTN; PAM sequence: TTT
gccatgctcttagaaaaatg

SEQ ID NO: 198387 - DNA, 20 bp, Artificial Sequence
  Description of Artificial Sequence: Synthetic oligonucleotide
  Target: ATXN1; (-) strand; PAM type: YTN; PAM sequence: TTG
aaaaaaaatcccacaacatg

SEQ ID NO: 198388 - DNA, 20 bp, Artificial Sequence
  Description of Artificial Sequence: Synthetic oligonucleotide
  Target: ATXN1; (-) strand; PAM type: YTN; PAM sequence: TTC
aagaaaggaagttgaaaaaa

SEQ ID NO: 198389 - DNA, 20 bp, Artificial Sequence
  Description of Artificial Sequence: Synthetic oligonucleotide
  Target: ATXN1; (-) strand; PAM type: YTN; PAM sequence: TTT
caagaaaggaagttgaaaaa

SEQ ID NO: 198390 - DNA, 20 bp, Artificial Sequence
  Description of Artificial Sequence: Synthetic oligonucleotide
  Target: ATXN1; (-) strand; PAM type: YTN; PAM sequence: CTA
tgtttcaagaaaggaagttg

SEQ ID NO: 198391 - DNA, 20 bp, Artificial Sequence
  Description of Artificial Sequence: Synthetic oligonucleotide
  Target: ATXN1; (-) strand; PAM type: YTN; PAM sequence: CTC
atcagctatgtttcaagaaa

SEQ ID NO: 198392 - DNA, 20 bp, Artificial Sequence
  Description of Artificial Sequence: Synthetic oligonucleotide
  Target: ATXN1; (-) strand; PAM type: YTN; PAM sequence: TTA
gtggcctcatcagctatgtt

SEQ ID NO: 198393 - DNA, 20 bp, Artificial Sequence
  Description of Artificial Sequence: Synthetic oligonucleotide
  Target: ATXN1; (-) strand; PAM type: YTN; PAM sequence: CTA
ttagtggcctcatcagctat

SEQ ID NO: 198394 - DNA, 20 bp, Artificial Sequence
  Description of Artificial Sequence: Synthetic oligonucleotide
  Target: ATXN1; (-) strand; PAM type: YTN; PAM sequence: TTC
tattagtggcctcatcagct

SEQ ID NO: 198395 - DNA, 20 bp, Artificial Sequence
  Description of Artificial Sequence: Synthetic oligonucleotide
  Target: ATXN1; (-) strand; PAM type: YTN; PAM sequence: CTT
ctattagtggcctcatcagc

SEQ ID NO: 198396 - DNA, 20 bp, Artificial Sequence
  Description of Artificial Sequence: Synthetic oligonucleotide
  Target: ATXN1; (-) strand; PAM type: YTN; PAM sequence: TTC
caagaagcttctattagtgg

SEQ ID NO: 198397 - DNA, 20 bp, Artificial Sequence
  Description of Artificial Sequence: Synthetic oligonucleotide
  Target: ATXN1; (-) strand; PAM type: YTN; PAM sequence: TTT
ccaagaagcttctattagtg

SEQ ID NO: 198398 - DNA, 20 bp, Artificial Sequence
  Description of Artificial Sequence: Synthetic oligonucleotide
  Target: ATXN1; (-) strand; PAM type: YTN; PAM sequence: TTT
tccaagaagcttctattagt

SEQ ID NO: 198399 - DNA, 20 bp, Artificial Sequence
  Description of Artificial Sequence: Synthetic oligonucleotide
  Target: ATXN1; (-) strand; PAM type: YTN; PAM sequence: CTT
ttccaagaagcttctattag

SEQ ID NO: 198400 - DNA, 20 bp, Artificial Sequence
  Description of Artificial Sequence: Synthetic oligonucleotide
  Target: ATXN1; (-) strand; PAM type: YTN; PAM sequence: CTC
ttttccaagaagcttctatt

SEQ ID NO: 198401 - DNA, 20 bp, Artificial Sequence
  Description of Artificial Sequence: Synthetic oligonucleotide
  Target: ATXN1; (-) strand; PAM type: YTN; PAM sequence: TTA
tgaaactcttttccaagaag

SEQ ID NO: 198402 - DNA, 20 bp, Artificial Sequence
  Description of Artificial Sequence: Synthetic oligonucleotide
  Target: ATXN1; (-) strand; PAM type: YTN; PAM sequence: TTC
aaatcaaacgtgaattatga

SEQ ID NO: 198403 - DNA, 20 bp, Artificial Sequence
  Description of Artificial Sequence: Synthetic oligonucleotide
  Target: ATXN1; (-) strand; PAM type: YTN; PAM sequence: CTT
caaatcaaacgtgaattatg

SEQ ID NO: 198404 - DNA, 20 bp, Artificial Sequence
  Description of Artificial Sequence: Synthetic oligonucleotide
  Target: ATXN1; (-) strand; PAM type: YTN; PAM sequence: CTG
ccttcaaatcaaacgtgaat

SEQ ID NO: 198405 - DNA, 20 bp, Artificial Sequence
  Description of Artificial Sequence: Synthetic oligonucleotide
  Target: ATXN1; (-) strand; PAM type: YTN; PAM sequence: TTA
aagctgccttcaaatcaaac

SEQ ID NO: 198406 - DNA, 20 bp, Artificial Sequence
  Description of Artificial Sequence: Synthetic oligonucleotide
  Target: ATXN1; (-) strand; PAM type: YTN; PAM sequence: TTG
gggggtaataagaaagttaa

SEQ ID NO: 198407 - DNA, 20 bp, Artificial Sequence
  Description of Artificial Sequence: Synthetic oligonucleotide
  Target: ATXN1; (-) strand; PAM type: YTN; PAM sequence: TTT
ggggggtaataagaaagtta

SEQ ID NO: 198408 - DNA, 20 bp, Artificial Sequence
  Description of Artificial Sequence: Synthetic oligonucleotide
  Target: ATXN1; (-) strand; PAM type: YTN; PAM sequence: TTT
tggggggtaataagaaagtt

SEQ ID NO: 198409 - DNA, 20 bp, Artificial Sequence
  Description of Artificial Sequence: Synthetic oligonucleotide
  Target: ATXN1; (-) strand; PAM type: YTN; PAM sequence: CTG
taagaccaaagaggacattt

SEQ ID NO: 198410 - DNA, 20 bp, Artificial Sequence
  Description of Artificial Sequence: Synthetic oligonucleotide
  Target: ATXN1; (-) strand; PAM type: YTN; PAM sequence: TTC
atgatcgctgtaagaccaaa

SEQ ID NO: 198411 - DNA, 20 bp, Artificial Sequence
  Description of Artificial Sequence: Synthetic oligonucleotide
  Target: ATXN1; (-) strand; PAM type: YTN; PAM sequence: CTG
gaacattcatgatcgctgta

SEQ ID NO: 198412 - DNA, 20 bp, Artificial Sequence
  Description of Artificial Sequence: Synthetic oligonucleotide
  Target: ATXN1; (-) strand; PAM type: YTN; PAM sequence: TTA
atctggaacattcatgatcg

SEQ ID NO: 198413 - DNA, 20 bp, Artificial Sequence
  Description of Artificial Sequence: Synthetic oligonucleotide
  Target: ATXN1; (-) strand; PAM type: YTN; PAM sequence: CTA
ttaatctggaacattcatga

SEQ ID NO: 198414 - DNA, 20 bp, Artificial Sequence
  Description of Artificial Sequence: Synthetic oligonucleotide
  Target: ATXN1; (-) strand; PAM type: YTN; PAM sequence: CTC
ctattaatctggaacattca

SEQ ID NO: 198415 - DNA, 20 bp, Artificial Sequence
  Description of Artificial Sequence: Synthetic oligonucleotide
  Target: ATXN1; (-) strand; PAM type: YTN; PAM sequence: TTC
atctcctattaatctggaac

SEQ ID NO: 198416 - DNA, 20 bp, Artificial Sequence
  Description of Artificial Sequence: Synthetic oligonucleotide
  Target: ATXN1; (-) strand; PAM type: YTN; PAM sequence: TTC
attcatctcctattaatctg

SEQ ID NO: 198417 - DNA, 20 bp, Artificial Sequence
  Description of Artificial Sequence: Synthetic oligonucleotide
  Target: ATXN1; (-) strand; PAM type: YTN; PAM sequence: TTA
aggagaattcattcatctcc

SEQ ID NO: 198418 - DNA, 20 bp, Artificial Sequence
  Description of Artificial Sequence: Synthetic oligonucleotide
  Target: ATXN1; (-) strand; PAM type: YTN; PAM sequence: TTT
aaggagaattcattcatctc

SEQ ID NO: 198419 - DNA, 20 bp, Artificial Sequence
  Description of Artificial Sequence: Synthetic oligonucleotide
  Target: ATXN1; (-) strand; PAM type: YTN; PAM sequence: TTA
aggtcatttaaggagaattc

SEQ ID NO: 198420 - DNA, 20 bp, Artificial Sequence
  Description of Artificial Sequence: Synthetic oligonucleotide
  Target: ATXN1; (-) strand; PAM type: YTN; PAM sequence: TTG
aacatattaaggtcatttaa

SEQ ID NO: 198421 - DNA, 20 bp, Artificial Sequence
  Description of Artificial Sequence: Synthetic oligonucleotide
  Target: ATXN1; (-) strand; PAM type: YTN; PAM sequence: CTT
gaacatattaaggtcattta

SEQ ID NO: 198422 - DNA, 20 bp, Artificial Sequence
  Description of Artificial Sequence: Synthetic oligonucleotide
  Target: ATXN1; (-) strand; PAM type: YTN; PAM sequence: CTA
cttgaacatattaaggtcat

SEQ ID NO: 198423 - DNA, 20 bp, Artificial Sequence
  Description of Artificial Sequence: Synthetic oligonucleotide
  Target: ATXN1; (-) strand; PAM type: YTN; PAM sequence: TTG
ctacttgaacatattaaggt

SEQ ID NO: 198424 - DNA, 20 bp, Artificial Sequence
  Description of Artificial Sequence: Synthetic oligonucleotide
  Target: ATXN1; (-) strand; PAM type: YTN; PAM sequence: TTT
gctacttgaacatattaagg

SEQ ID NO: 198425 - DNA, 20 bp, Artificial Sequence
  Description of Artificial Sequence: Synthetic oligonucleotide
  Target: ATXN1; (-) strand; PAM type: YTN; PAM sequence: CTT
tgctacttgaacatattaag

SEQ ID NO: 198426 - DNA, 20 bp, Artificial Sequence
  Description of Artificial Sequence: Synthetic oligonucleotide
  Target: ATXN1; (-) strand; PAM type: YTN; PAM sequence: CTC
cactttgctacttgaacata

SEQ ID NO: 198427 - DNA, 20 bp, Artificial Sequence
  Description of Artificial Sequence: Synthetic oligonucleotide
  Target: ATXN1; (-) strand; PAM type: YTN; PAM sequence: CTC
aaacctccactttgctactt

SEQ ID NO: 198428 - DNA, 20 bp, Artificial Sequence
  Description of Artificial Sequence: Synthetic oligonucleotide
  Target: ATXN1; (-) strand; PAM type: YTN; PAM sequence: CTG
gactcaaacctccactttgc

SEQ ID NO: 198429 - DNA, 20 bp, Artificial Sequence
  Description of Artificial Sequence: Synthetic oligonucleotide
  Target: ATXN1; (-) strand; PAM type: YTN; PAM sequence: CTC
cccagaagtcactggactca

SEQ ID NO: 198430 - DNA, 20 bp, Artificial Sequence
  Description of Artificial Sequence: Synthetic oligonucleotide
  Target: ATXN1; (-) strand; PAM type: YTN; PAM sequence: CTG
tctccccagaagtcactgga

SEQ ID NO: 198431 - DNA, 20 bp, Artificial Sequence
  Description of Artificial Sequence: Synthetic oligonucleotide
  Target: ATXN1; (-) strand; PAM type: YTN; PAM sequence: TTA
gcccatacaactgtctcccc

SEQ ID NO: 198432 - DNA, 20 bp, Artificial Sequence
  Description of Artificial Sequence: Synthetic oligonucleotide
  Target: ATXN1; (-) strand; PAM type: YTN; PAM sequence: CTT
agcccatacaactgtctccc

SEQ ID NO: 198433 - DNA, 20 bp, Artificial Sequence
  Description of Artificial Sequence: Synthetic oligonucleotide
  Target: ATXN1; (-) strand; PAM type: YTN; PAM sequence: TTC
ttagcccatacaactgtctc

SEQ ID NO: 198434 - DNA, 20 bp, Artificial Sequence
  Description of Artificial Sequence: Synthetic oligonucleotide
  Target: ATXN1; (-) strand; PAM type: YTN; PAM sequence: TTA
tgtgttcttagcccatacaa

SEQ ID NO: 198435 - DNA, 20 bp, Artificial Sequence
  Description of Artificial Sequence: Synthetic oligonucleotide
  Target: ATXN1; (-) strand; PAM type: YTN; PAM sequence: CTC
aaaatgttatgtgttcttag

SEQ ID NO: 198436 - DNA, 20 bp, Artificial Sequence
  Description of Artificial Sequence: Synthetic oligonucleotide
  Target: ATXN1; (-) strand; PAM type: YTN; PAM sequence: TTC
ctcaaaatgttatgtgttct

SEQ ID NO: 198437 - DNA, 20 bp, Artificial Sequence
  Description of Artificial Sequence: Synthetic oligonucleotide
  Target: ATXN1; (-) strand; PAM type: YTN; PAM sequence: CTT
cctcaaaatgttatgtgttc

SEQ ID NO: 198438 - DNA, 20 bp, Artificial Sequence
  Description of Artificial Sequence: Synthetic oligonucleotide
  Target: ATXN1; (-) strand; PAM type: YTN; PAM sequence: TTG
ccaaaaaaaaaaaagacaag

SEQ ID NO: 198439 - DNA, 20 bp, Artificial Sequence
  Description of Artificial Sequence: Synthetic oligonucleotide
  Target: ATXN1; (-) strand; PAM type: YTN; PAM sequence: CTA
ttgccaaaaaaaaaaaagac

SEQ ID NO: 198440 - DNA, 20 bp, Artificial Sequence
  Description of Artificial Sequence: Synthetic oligonucleotide
  Target: ATXN1; (-) strand; PAM type: YTN; PAM sequence: TTC
tattgccaaaaaaaaaaaag

SEQ ID NO: 198441 - DNA, 20 bp, Artificial Sequence
  Description of Artificial Sequence: Synthetic oligonucleotide
  Target: ATXN1; (-) strand; PAM type: YTN; PAM sequence: TTT
ctattgccaaaaaaaaaaaa

SEQ ID NO: 198442 - DNA, 20 bp, Artificial Sequence
  Description of Artificial Sequence: Synthetic oligonucleotide
  Target: ATXN1; (-) strand; PAM type: YTN; PAM sequence: CTT
tctattgccaaaaaaaaaaa

SEQ ID NO: 198443 - DNA, 20 bp, Artificial Sequence
  Description of Artificial Sequence: Synthetic oligonucleotide
  Target: ATXN1; (-) strand; PAM type: YTN; PAM sequence: TTA
ctttctattgccaaaaaaaa

SEQ ID NO: 198444 - DNA, 20 bp, Artificial Sequence
  Description of Artificial Sequence: Synthetic oligonucleotide
  Target: ATXN1; (-) strand; PAM type: YTN; PAM sequence: TTT
actttctattgccaaaaaaa

SEQ ID NO: 198445 - DNA, 20 bp, Artificial Sequence
  Description of Artificial Sequence: Synthetic oligonucleotide
  Target: ATXN1; (-) strand; PAM type: YTN; PAM sequence: TTT
tactttctattgccaaaaaa

SEQ ID NO: 198446 - DNA, 20 bp, Artificial Sequence
  Description of Artificial Sequence: Synthetic oligonucleotide
  Target: ATXN1; (-) strand; PAM type: YTN; PAM sequence: TTT
ttactttctattgccaaaaa

SEQ ID NO: 198447 - DNA, 20 bp, Artificial Sequence
  Description of Artificial Sequence: Synthetic oligonucleotide
  Target: ATXN1; (-) strand; PAM type: YTN; PAM sequence: CTT
tttactttctattgccaaaa

SEQ ID NO: 198448 - DNA, 20 bp, Artificial Sequence
  Description of Artificial Sequence: Synthetic oligonucleotide
  Target: ATXN1; (-) strand; PAM type: YTN; PAM sequence: CTC
aggaaactttttactttcta

SEQ ID NO: 198449 - DNA, 20 bp, Artificial Sequence
  Description of Artificial Sequence: Synthetic oligonucleotide
  Target: ATXN1; (-) strand; PAM type: YTN; PAM sequence: TTC
agctcaggaaactttttact

SEQ ID NO: 198450 - DNA, 20 bp, Artificial Sequence
  Description of Artificial Sequence: Synthetic oligonucleotide
  Target: ATXN1; (-) strand; PAM type: YTN; PAM sequence: TTT
cagctcaggaaactttttac

SEQ ID NO: 198451 - DNA, 20 bp, Artificial Sequence
  Description of Artificial Sequence: Synthetic oligonucleotide
  Target: ATXN1; (-) strand; PAM type: YTN; PAM sequence: TTT
tcagctcaggaaacttttta

SEQ ID NO: 198452 - DNA, 20 bp, Artificial Sequence
  Description of Artificial Sequence: Synthetic oligonucleotide
  Target: ATXN1; (-) strand; PAM type: YTN; PAM sequence: CTT
ttcagctcaggaaacttttt

SEQ ID NO: 198453 - DNA, 20 bp, Artificial Sequence
  Description of Artificial Sequence: Synthetic oligonucleotide
  Target: ATXN1; (-) strand; PAM type: YTN; PAM sequence: CTG
tggccttttcagctcaggaa

SEQ ID NO: 198454 - DNA, 20 bp, Artificial Sequence
  Description of Artificial Sequence: Synthetic oligonucleotide
  Target: ATXN1; (-) strand; PAM type: YTN; PAM sequence: TTG
aagaatacatgctgtggcct

SEQ ID NO: 198455 - DNA, 20 bp, Artificial Sequence
  Description of Artificial Sequence: Synthetic oligonucleotide
  Target: ATXN1; (-) strand; PAM type: YTN; PAM sequence: CTG
aattgaagaatacatgctgt

SEQ ID NO: 198456 - DNA, 20 bp, Artificial Sequence
  Description of Artificial Sequence: Synthetic oligonucleotide
  Target: ATXN1; (-) strand; PAM type: YTN; PAM sequence: TTA
ccaggaccctgaattgaaga

SEQ ID NO: 198457 - DNA, 20 bp, Artificial Sequence
  Description of Artificial Sequence: Synthetic oligonucleotide
  Target: ATXN1; (-) strand; PAM type: YTN; PAM sequence: TTC
cagtgattaccaggaccctg

SEQ ID NO: 198458 - DNA, 20 bp, Artificial Sequence
  Description of Artificial Sequence: Synthetic oligonucleotide
  Target: ATXN1; (-) strand; PAM type: YTN; PAM sequence: TTG
tggttccagtgattaccagg

SEQ ID NO: 198459 - DNA, 20 bp, Artificial Sequence
  Description of Artificial Sequence: Synthetic oligonucleotide
  Target: ATXN1; (-) strand; PAM type: YTN; PAM sequence: CTT
gtggttccagtgattaccag

SEQ ID NO: 198460 - DNA, 20 bp, Artificial Sequence
  Description of Artificial Sequence: Synthetic oligonucleotide
  Target: ATXN1; (-) strand; PAM type: YTN; PAM sequence: TTG
aacttgtggttccagtgatt

SEQ ID NO: 198461 - DNA, 20 bp, Artificial Sequence
  Description of Artificial Sequence: Synthetic oligonucleotide
  Target: ATXN1; (-) strand; PAM type: YTN; PAM sequence: TTT
gaacttgtggttccagtgat

SEQ ID NO: 198462 - DNA, 20 bp, Artificial Sequence
  Description of Artificial Sequence: Synthetic oligonucleotide
  Target: ATXN1; (-) strand; PAM type: YTN; PAM sequence: CTA
gatggcatttgaacttgtgg

SEQ ID NO: 198463 - DNA, 20 bp, Artificial Sequence
  Description of Artificial Sequence: Synthetic oligonucleotide
  Target: ATXN1; (-) strand; PAM type: YTN; PAM sequence: TTA
tggtctagatggcatttgaa

SEQ ID NO: 198464 - DNA, 20 bp, Artificial Sequence
  Description of Artificial Sequence: Synthetic oligonucleotide
  Target: ATXN1; (-) strand; PAM type: YTN; PAM sequence: CTT
atggtctagatggcatttga

SEQ ID NO: 198465 - DNA, 20 bp, Artificial Sequence
  Description of Artificial Sequence: Synthetic oligonucleotide
  Target: ATXN1; (-) strand; PAM type: YTN; PAM sequence: TTA
taagagtccttatggtctag

SEQ ID NO: 198466 - DNA, 20 bp, Artificial Sequence
  Description of Artificial Sequence: Synthetic oligonucleotide
  Target: ATXN1; (-) strand; PAM type: YTN; PAM sequence: TTT
ataagagtccttatggtcta

SEQ ID NO: 198467 - DNA, 20 bp, Artificial Sequence
  Description of Artificial Sequence: Synthetic oligonucleotide
  Target: ATXN1; (-) strand; PAM type: YTN; PAM sequence: TTT
tataagagtccttatggtct

SEQ ID NO: 198468 - DNA, 20 bp, Artificial Sequence
  Description of Artificial Sequence: Synthetic oligonucleotide
  Target: ATXN1; (-) strand; PAM type: YTN; PAM sequence: TTG
tgttttataagagtccttat

SEQ ID NO: 198469 - DNA, 20 bp, Artificial Sequence
  Description of Artificial Sequence: Synthetic oligonucleotide
  Target: ATXN1; (-) strand; PAM type: YTN; PAM sequence: TTT
gtgttttataagagtcctta

SEQ ID NO: 198470 - DNA, 20 bp, Artificial Sequence
  Description of Artificial Sequence: Synthetic oligonucleotide
  Target: ATXN1; (-) strand; PAM type: YTN; PAM sequence: TTG
atgatgaagtggtttgtgtt

SEQ ID NO: 198471 - DNA, 20 bp, Artificial Sequence
  Description of Artificial Sequence: Synthetic oligonucleotide
  Target: ATXN1; (-) strand; PAM type: YTN; PAM sequence: TTG
ttgatgatgaagtggtttgt

SEQ ID NO: 198472 - DNA, 20 bp, Artificial Sequence
  Description of Artificial Sequence: Synthetic oligonucleotide
  Target: ATXN1; (-) strand; PAM type: YTN; PAM sequence: TTT
gttgatgatgaagtggtttg

SEQ ID NO: 198473 - DNA, 20 bp, Artificial Sequence
  Description of Artificial Sequence: Synthetic oligonucleotide
  Target: ATXN1; (-) strand; PAM type: YTN; PAM sequence: CTA
gtaggcaaataggtttgttg

SEQ ID NO: 198474 - DNA, 20 bp, Artificial Sequence
  Description of Artificial Sequence: Synthetic oligonucleotide
  Target: ATXN1; (-) strand; PAM type: YTN; PAM sequence: TTC
tagtaggcaaataggtttgt

SEQ ID NO: 198475 - DNA, 20 bp, Artificial Sequence
  Description of Artificial Sequence: Synthetic oligonucleotide
  Target: ATXN1; (-) strand; PAM type: YTN; PAM sequence: TTA
aaagttctagtaggcaaata

SEQ ID NO: 198476 - DNA, 20 bp, Artificial Sequence
  Description of Artificial Sequence: Synthetic oligonucleotide
  Target: ATXN1; (-) strand; PAM type: YTN; PAM sequence: TTT
aaaagttctagtaggcaaat

SEQ ID NO: 198477 - DNA, 20 bp, Artificial Sequence
  Description of Artificial Sequence: Synthetic oligonucleotide
  Target: ATXN1; (-) strand; PAM type: YTN; PAM sequence: CTT
taaaagttctagtaggcaaa

SEQ ID NO: 198478 - DNA, 20 bp, Artificial Sequence
  Description of Artificial Sequence: Synthetic oligonucleotide
  Target: ATXN1; (-) strand; PAM type: YTN; PAM sequence: TTG
ctttaaaagttctagtaggc

SEQ ID NO: 198479 - DNA, 20 bp, Artificial Sequence
  Description of Artificial Sequence: Synthetic oligonucleotide
  Target: ATXN1; (-) strand; PAM type: YTN; PAM sequence: CTT
gctttaaaagttctagtagg

SEQ ID NO: 198480 - DNA, 20 bp, Artificial Sequence
  Description of Artificial Sequence: Synthetic oligonucleotide
  Target: ATXN1; (-) strand; PAM type: YTN; PAM sequence: TTG
cagccttgctttaaaagttc

SEQ ID NO: 198481 - DNA, 20 bp, Artificial Sequence
  Description of Artificial Sequence: Synthetic oligonucleotide
  Target: ATXN1; (-) strand; PAM type: YTN; PAM sequence: TTT
gcagccttgctttaaaagtt

SEQ ID NO: 198482 - DNA, 20 bp, Artificial Sequence
  Description of Artificial Sequence: Synthetic oligonucleotide
  Target: ATXN1; (-) strand; PAM type: YTN; PAM sequence: TTG
aatagtttgcagccttgctt

SEQ ID NO: 198483 - DNA, 20 bp, Artificial Sequence
  Description of Artificial Sequence: Synthetic oligonucleotide
  Target: ATXN1; (-) strand; PAM type: YTN; PAM sequence: CTT
gaatagtttgcagccttgct

SEQ ID NO: 198484 - DNA, 20 bp, Artificial Sequence
  Description of Artificial Sequence: Synthetic oligonucleotide
  Target: ATXN1; (-) strand; PAM type: YTN; PAM sequence: TTA
cttgaatagtttgcagcctt

SEQ ID NO: 198485 - DNA, 20 bp, Artificial Sequence
  Description of Artificial Sequence: Synthetic oligonucleotide
  Target: ATXN1; (-) strand; PAM type: YTN; PAM sequence: TTT
acttgaatagtttgcagcct

SEQ ID NO: 198486 - DNA, 20 bp, Artificial Sequence
  Description of Artificial Sequence: Synthetic oligonucleotide
  Target: ATXN1; (-) strand; PAM type: YTN; PAM sequence: TTG
tttacttgaatagtttgcag

SEQ ID NO: 198487 - DNA, 20 bp, Artificial Sequence
  Description of Artificial Sequence: Synthetic oligonucleotide
  Target: ATXN1; (-) strand; PAM type: YTN; PAM sequence: CTC
ggtccatgtcaaccacccca

SEQ ID NO: 198488 - DNA, 20 bp, Artificial Sequence
  Description of Artificial Sequence: Synthetic oligonucleotide
  Target: ATXN1; (-) strand; PAM type: YTN; PAM sequence: CTC
tcggtccatgtcaaccaccc

SEQ ID NO: 198489 - DNA, 20 bp, Artificial Sequence
  Description of Artificial Sequence: Synthetic oligonucleotide
  Target: ATXN1; (-) strand; PAM type: YTN; PAM sequence: TTA
gctctcggtccatgtcaacc

SEQ ID NO: 198490 - DNA, 20 bp, Artificial Sequence
  Description of Artificial Sequence: Synthetic oligonucleotide
  Target: ATXN1; (-) strand; PAM type: YTN; PAM sequence: TTG
ttagctctcggtccatgtca

SEQ ID NO: 198491 - DNA, 20 bp, Artificial Sequence
  Description of Artificial Sequence: Synthetic oligonucleotide
  Target: ATXN1; (-) strand; PAM type: YTN; PAM sequence: CTT
gttagctctcggtccatgtc

SEQ ID NO: 198492 - DNA, 20 bp, Artificial Sequence
  Description of Artificial Sequence: Synthetic oligonucleotide
  Target: ATXN1; (-) strand; PAM type: YTN; PAM sequence: CTC
ttgttagctctcggtccatg

SEQ ID NO: 198493 - DNA, 20 bp, Artificial Sequence
  Description of Artificial Sequence: Synthetic oligonucleotide
  Target: ATXN1; (-) strand; PAM type: YTN; PAM sequence: TTC
tcttgttagctctcggtcca

SEQ ID NO: 198494 - DNA, 20 bp, Artificial Sequence
  Description of Artificial Sequence: Synthetic oligonucleotide
  Target: ATXN1; (-) strand; PAM type: YTN; PAM sequence: TTC
cagtgttctcttgttagctc

SEQ ID NO: 198495 - DNA, 20 bp, Artificial Sequence
  Description of Artificial Sequence: Synthetic oligonucleotide
  Target: ATXN1; (-) strand; PAM type: YTN; PAM sequence: CTA
attccagtgttctcttgtta

SEQ ID NO: 198496 - DNA, 20 bp, Artificial Sequence
  Description of Artificial Sequence: Synthetic oligonucleotide
  Target: ATXN1; (-) strand; PAM type: YTN; PAM sequence: CTG
agaagctaattccagtgttc

SEQ ID NO: 198497 - DNA, 20 bp, Artificial Sequence
  Description of Artificial Sequence: Synthetic oligonucleotide
  Target: ATXN1; (-) strand; PAM type: YTN; PAM sequence: TTG
aaactgagaagctaattcca

SEQ ID NO: 198498 - DNA, 20 bp, Artificial Sequence
  Description of Artificial Sequence: Synthetic oligonucleotide
  Target: ATXN1; (-) strand; PAM type: YTN; PAM sequence: TTT
gaaactgagaagctaattcc

SEQ ID NO: 198499 - DNA, 20 bp, Artificial Sequence
  Description of Artificial Sequence: Synthetic oligonucleotide
  Target: ATXN1; (-) strand; PAM type: YTN; PAM sequence: TTT
tgaaactgagaagctaattc

SEQ ID NO: 198500 - DNA, 20 bp, Artificial Sequence
  Description of Artificial Sequence: Synthetic oligonucleotide
  Target: ATXN1; (-) strand; PAM type: YTN; PAM sequence: CTA
ttttgaaactgagaagctaa

SEQ ID NO: 198501 - DNA, 20 bp, Artificial Sequence
  Description of Artificial Sequence: Synthetic oligonucleotide
  Target: ATXN1; (-) strand; PAM type: YTN; PAM sequence: TTA
ggtcctattttgaaactgag

SEQ ID NO: 198502 - DNA, 20 bp, Artificial Sequence
  Description of Artificial Sequence: Synthetic oligonucleotide
  Target: ATXN1; (-) strand; PAM type: YTN; PAM sequence: TTT
aggtcctattttgaaactga

SEQ ID NO: 198503 - DNA, 20 bp, Artificial Sequence
  Description of Artificial Sequence: Synthetic oligonucleotide
  Target: ATXN1; (-) strand; PAM type: YTN; PAM sequence: CTT
taggtcctattttgaaactg

SEQ ID NO: 198504 - DNA, 20 bp, Artificial Sequence
  Description of Artificial Sequence: Synthetic oligonucleotide
  Target: ATXN1; (-) strand; PAM type: YTN; PAM sequence: CTC
ctttaggtcctattttgaaa

SEQ ID NO: 198505 - DNA, 20 bp, Artificial Sequence
  Description of Artificial Sequence: Synthetic oligonucleotide
  Target: ATXN1; (-) strand; PAM type: YTN; PAM sequence: CTA
tagcgcaaactcctttaggt

SEQ ID NO: 198506 - DNA, 20 bp, Artificial Sequence
  Description of Artificial Sequence: Synthetic oligonucleotide
  Target: ATXN1; (-) strand; PAM type: YTN; PAM sequence: CTC
ctatagcgcaaactccttta

SEQ ID NO: 198507 - DNA, 20 bp, Artificial Sequence
  Description of Artificial Sequence: Synthetic oligonucleotide
  Target: ATXN1; (-) strand; PAM type: YTN; PAM sequence: TTC
tcctatagcgcaaactcctt

SEQ ID NO: 198508 - DNA, 20 bp, Artificial Sequence
  Description of Artificial Sequence: Synthetic oligonucleotide
  Target: ATXN1; (-) strand; PAM type: YTN; PAM sequence: CTT
ctcctatagcgcaaactcct

SEQ ID NO: 198509 - DNA, 20 bp, Artificial Sequence
  Description of Artificial Sequence: Synthetic oligonucleotide
  Target: ATXN1; (-) strand; PAM type: YTN; PAM sequence: CTC
ttctcctatagcgcaaactc

SEQ ID NO: 198510 - DNA, 20 bp, Artificial Sequence
  Description of Artificial Sequence: Synthetic oligonucleotide
  Target: ATXN1; (-) strand; PAM type: YTN; PAM sequence: TTA
aacaaaatgcagcaactctt

SEQ ID NO: 198511 - DNA, 20 bp, Artificial Sequence
  Description of Artificial Sequence: Synthetic oligonucleotide
  Target: ATXN1; (-) strand; PAM type: YTN; PAM sequence: TTC
cattaaacaaaatgcagcaa

SEQ ID NO: 198512 - DNA, 20 bp, Artificial Sequence
  Description of Artificial Sequence: Synthetic oligonucleotide
  Target: ATXN1; (-) strand; PAM type: YTN; PAM sequence: TTA
gttccattaaacaaaatgca

SEQ ID NO: 198513 - DNA, 20 bp, Artificial Sequence
  Description of Artificial Sequence: Synthetic oligonucleotide
  Target: ATXN1; (-) strand; PAM type: YTN; PAM sequence: TTT
agttccattaaacaaaatgc

SEQ ID NO: 198514 - DNA, 20 bp, Artificial Sequence
  Description of Artificial Sequence: Synthetic oligonucleotide
  Target: ATXN1; (-) strand; PAM type: YTN; PAM sequence: TTA
aatgggcacaaatttagttc

SEQ ID NO: 198515 - DNA, 20 bp, Artificial Sequence
  Description of Artificial Sequence: Synthetic oligonucleotide
  Target: ATXN1; (-) strand; PAM type: YTN; PAM sequence: TTT
aaatgggcacaaatttagtt

SEQ ID NO: 198516 - DNA, 20 bp, Artificial Sequence
  Description of Artificial Sequence: Synthetic oligonucleotide
  Target: ATXN1; (-) strand; PAM type: YTN; PAM sequence: CTC
atgatttaaatgggcacaaa

SEQ ID NO: 198517 - DNA, 20 bp, Artificial Sequence
  Description of Artificial Sequence: Synthetic oligonucleotide
  Target: ATXN1; (-) strand; PAM type: YTN; PAM sequence: CTG
ctcatgatttaaatgggcac

SEQ ID NO: 198518 - DNA, 20 bp, Artificial Sequence
  Description of Artificial Sequence: Synthetic oligonucleotide
  Target: ATXN1; (-) strand; PAM type: YTN; PAM sequence: CTA
ccaagtgccacctgctcatg

SEQ ID NO: 198519 - DNA, 20 bp, Artificial Sequence
  Description of Artificial Sequence: Synthetic oligonucleotide
  Target: ATXN1; (-) strand; PAM type: YTN; PAM sequence: TTG
ctaccaagtgccacctgctc

SEQ ID NO: 198520 - DNA, 20 bp, Artificial Sequence
  Description of Artificial Sequence: Synthetic oligonucleotide
  Target: ATXN1; (-) strand; PAM type: YTN; PAM sequence: TTT
gctaccaagtgccacctgct

SEQ ID NO: 198521 - DNA, 20 bp, Artificial Sequence
  Description of Artificial Sequence: Synthetic oligonucleotide
  Target: ATXN1; (-) strand; PAM type: YTN; PAM sequence: CTT
tgctaccaagtgccacctgc

SEQ ID NO: 198522 - DNA, 20 bp, Artificial Sequence
  Description of Artificial Sequence: Synthetic oligonucleotide
  Target: ATXN1; (-) strand; PAM type: YTN; PAM sequence: TTC
tttgctaccaagtgccacct

SEQ ID NO: 198523 - DNA, 20 bp, Artificial Sequence
  Description of Artificial Sequence: Synthetic oligonucleotide
  Target: ATXN1; (-) strand; PAM type: YTN; PAM sequence: TTT
ctttgctaccaagtgccacc

SEQ ID NO: 198524 - DNA, 20 bp, Artificial Sequence
  Description of Artificial Sequence: Synthetic oligonucleotide
  Target: ATXN1; (-) strand; PAM type: YTN; PAM sequence: CTT
tctttgctaccaagtgccac

SEQ ID NO: 198525 - DNA, 20 bp, Artificial Sequence
  Description of Artificial Sequence: Synthetic oligonucleotide
  Target: ATXN1; (-) strand; PAM type: YTN; PAM sequence: TTC
aggctttctttgctaccaag

SEQ ID NO: 198526 - DNA, 20 bp, Artificial Sequence
  Description of Artificial Sequence: Synthetic oligonucleotide
  Target: ATXN1; (-) strand; PAM type: YTN; PAM sequence: TTT
caggctttctttgctaccaa

SEQ ID NO: 198527 - DNA, 20 bp, Artificial Sequence
  Description of Artificial Sequence: Synthetic oligonucleotide
  Target: ATXN1; (-) strand; PAM type: YTN; PAM sequence: TTT
tcaggctttctttgctacca

SEQ ID NO: 198528 - DNA, 20 bp, Artificial Sequence
  Description of Artificial Sequence: Synthetic oligonucleotide
  Target: ATXN1; (-) strand; PAM type: YTN; PAM sequence: CTA
aatgtgaatattttcaggct

SEQ ID NO: 198529 - DNA, 20 bp, Artificial Sequence
  Description of Artificial Sequence: Synthetic oligonucleotide
  Target: ATXN1; (-) strand; PAM type: YTN; PAM sequence: TTC
actaaatgtgaatattttca

SEQ ID NO: 198530 - DNA, 20 bp, Artificial Sequence
  Description of Artificial Sequence: Synthetic oligonucleotide
  Target: ATXN1; (-) strand; PAM type: YTN; PAM sequence: CTG
cattcactaaatgtgaatat

SEQ ID NO: 198531 - DNA, 20 bp, Artificial Sequence
  Description of Artificial Sequence: Synthetic oligonucleotide
  Target: ATXN1; (-) strand; PAM type: YTN; PAM sequence: TTA
tacatacaactgcattcact

SEQ ID NO: 198532 - DNA, 20 bp, Artificial Sequence
  Description of Artificial Sequence: Synthetic oligonucleotide
  Target: ATXN1; (-) strand; PAM type: YTN; PAM sequence: CTA
attatacatacaactgcatt

SEQ ID NO: 198533 - DNA, 20 bp, Artificial Sequence
  Description of Artificial Sequence: Synthetic oligonucleotide
  Target: ATXN1; (-) strand; PAM type: YTN; PAM sequence: CTC
agctaattatacatacaact

SEQ ID NO: 198534 - DNA, 20 bp, Artificial Sequence
  Description of Artificial Sequence: Synthetic oligonucleotide
  Target: ATXN1; (-) strand; PAM type: YTN; PAM sequence: TTA
aaataaatctcagctaatta

SEQ ID NO: 198535 - DNA, 20 bp, Artificial Sequence
  Description of Artificial Sequence: Synthetic oligonucleotide
  Target: ATXN1; (-) strand; PAM type: YTN; PAM sequence: TTT
aaaataaatctcagctaatt

SEQ ID NO: 198536 - DNA, 20 bp, Artificial Sequence
  Description of Artificial Sequence: Synthetic oligonucleotide
  Target: ATXN1; (-) strand; PAM type: YTN; PAM sequence: CTT
taaaataaatctcagctaat

SEQ ID NO: 198537 - DNA, 20 bp, Artificial Sequence
  Description of Artificial Sequence: Synthetic oligonucleotide
  Target: ATXN1; (-) strand; PAM type: YTN; PAM sequence: TTA
gagtactttaaaataaatct

SEQ ID NO: 198538 - DNA, 20 bp, Artificial Sequence
  Description of Artificial Sequence: Synthetic oligonucleotide
  Target: ATXN1; (-) strand; PAM type: YTN; PAM sequence: TTG
tagaaaagagtacaaaagat

SEQ ID NO: 198539 - DNA, 20 bp, Artificial Sequence
  Description of Artificial Sequence: Synthetic oligonucleotide
  Target: ATXN1; (-) strand; PAM type: YTN; PAM sequence: TTG
aattgtagaaaagagtacaa

SEQ ID NO: 198540 - DNA, 20 bp, Artificial Sequence
  Description of Artificial Sequence: Synthetic oligonucleotide
  Target: ATXN1; (-) strand; PAM type: YTN; PAM sequence: TTT
gaattgtagaaaagagtaca

SEQ ID NO: 198541 - DNA, 20 bp, Artificial Sequence
  Description of Artificial Sequence: Synthetic oligonucleotide
  Target: ATXN1; (-) strand; PAM type: YTN; PAM sequence: CTC
accagtttgaattgtagaaa

SEQ ID NO: 198542 - DNA, 20 bp, Artificial Sequence
  Description of Artificial Sequence: Synthetic oligonucleotide
  Target: ATXN1; (-) strand; PAM type: YTN; PAM sequence: TTC
tcaccagtttgaattgtaga

SEQ ID NO: 198543 - DNA, 20 bp, Artificial Sequence
  Description of Artificial Sequence: Synthetic oligonucleotide
  Target: ATXN1; (-) strand; PAM type: YTN; PAM sequence: TTT
ctcaccagtttgaattgtag

SEQ ID NO: 198544 - DNA, 20 bp, Artificial Sequence
  Description of Artificial Sequence: Synthetic oligonucleotide
  Target: ATXN1; (-) strand; PAM type: YTN; PAM sequence: CTA
tttctcaccagtttgaattg

SEQ ID NO: 198545 - DNA, 20 bp, Artificial Sequence
  Description of Artificial Sequence: Synthetic oligonucleotide
  Target: ATXN1; (-) strand; PAM type: YTN; PAM sequence: CTC
tatttctcaccagtttgaat

SEQ ID NO: 198546 - DNA, 20 bp, Artificial Sequence
  Description of Artificial Sequence: Synthetic oligonucleotide
  Target: ATXN1; (-) strand; PAM type: YTN; PAM sequence: CTC
tctatttctcaccagtttga

SEQ ID NO: 198547 - DNA, 20 bp, Artificial Sequence
  Description of Artificial Sequence: Synthetic oligonucleotide
  Target: ATXN1; (-) strand; PAM type: YTN; PAM sequence: CTG
ctctctatttctcaccagtt

SEQ ID NO: 198548 - DNA, 20 bp, Artificial Sequence
  Description of Artificial Sequence: Synthetic oligonucleotide
  Target: ATXN1; (-) strand; PAM type: YTN; PAM sequence: TTC
aaaagctgctctctatttct

SEQ ID NO: 198549 - DNA, 20 bp, Artificial Sequence
  Description of Artificial Sequence: Synthetic oligonucleotide
  Target: ATXN1; (-) strand; PAM type: YTN; PAM sequence: TTC
ataataaattcaaaagctgc

SEQ ID NO: 198550 - DNA, 20 bp, Artificial Sequence
  Description of Artificial Sequence: Synthetic oligonucleotide
  Target: ATXN1; (-) strand; PAM type: YTN; PAM sequence: TTT
cataataaattcaaaagctg

SEQ ID NO: 198551 - DNA, 20 bp, Artificial Sequence
  Description of Artificial Sequence: Synthetic oligonucleotide
  Target: ATXN1; (-) strand; PAM type: YTN; PAM sequence: CTT
tcataataaattcaaaagct

SEQ ID NO: 198552 - DNA, 20 bp, Artificial Sequence
  Description of Artificial Sequence: Synthetic oligonucleotide
  Target: ATXN1; (-) strand; PAM type: YTN; PAM sequence: CTG
tgctttcataataaattcaa

SEQ ID NO: 198553 - DNA, 20 bp, Artificial Sequence
  Description of Artificial Sequence: Synthetic oligonucleotide
  Target: ATXN1; (-) strand; PAM type: YTN; PAM sequence: CTA
atacgatagctgtgctttca

SEQ ID NO: 198554 - DNA, 20 bp, Artificial Sequence
  Description of Artificial Sequence: Synthetic oligonucleotide
  Target: ATXN1; (-) strand; PAM type: YTN; PAM sequence: TTA
acagctaatacgatagctgt

SEQ ID NO: 198555 - DNA, 20 bp, Artificial Sequence
  Description of Artificial Sequence: Synthetic oligonucleotide
  Target: ATXN1; (-) strand; PAM type: YTN; PAM sequence: CTT
aacagctaatacgatagctg

SEQ ID NO: 198556 - DNA, 20 bp, Artificial Sequence
  Description of Artificial Sequence: Synthetic oligonucleotide
  Target: ATXN1; (-) strand; PAM type: YTN; PAM sequence: TTC
ttaacagctaatacgatagc

SEQ ID NO: 198557 - DNA, 20 bp, Artificial Sequence
  Description of Artificial Sequence: Synthetic oligonucleotide
  Target: ATXN1; (-) strand; PAM type: YTN; PAM sequence: TTT
cttaacagctaatacgatag

SEQ ID NO: 198558 - DNA, 20 bp, Artificial Sequence
  Description of Artificial Sequence: Synthetic oligonucleotide
  Target: ATXN1; (-) strand; PAM type: YTN; PAM sequence: TTA
tttcttaacagctaatacga

SEQ ID NO: 198559 - DNA, 20 bp, Artificial Sequence
  Description of Artificial Sequence: Synthetic oligonucleotide
  Target: ATXN1; (-) strand; PAM type: YTN; PAM sequence: TTT
atttcttaacagctaatacg

SEQ ID NO: 198560 - DNA, 20 bp, Artificial Sequence
  Description of Artificial Sequence: Synthetic oligonucleotide
  Target: ATXN1; (-) strand; PAM type: YTN; PAM sequence: TTT
tatttcttaacagctaatac

SEQ ID NO: 198561 - DNA, 20 bp, Artificial Sequence
  Description of Artificial Sequence: Synthetic oligonucleotide
  Target: ATXN1; (-) strand; PAM type: YTN; PAM sequence: TTT
ttatttcttaacagctaata

SEQ ID NO: 198562 - DNA, 20 bp, Artificial Sequence
  Description of Artificial Sequence: Synthetic oligonucleotide
  Target: ATXN1; (-) strand; PAM type: YTN; PAM sequence: TTT
tttatttcttaacagctaat

SEQ ID NO: 198563 - DNA, 20 bp, Artificial Sequence
  Description of Artificial Sequence: Synthetic oligonucleotide
  Target: ATXN1; (-) strand; PAM type: YTN; PAM sequence: CTC
cccattttttatttcttaac

SEQ ID NO: 198564 - DNA, 20 bp, Artificial Sequence
  Description of Artificial Sequence: Synthetic oligonucleotide
  Target: ATXN1; (-) strand; PAM type: YTN; PAM sequence: TTC
cgacaccctccccatttttt

SEQ ID NO: 198565 - DNA, 20 bp, Artificial Sequence
  Description of Artificial Sequence: Synthetic oligonucleotide
  Target: ATXN1; (-) strand; PAM type: YTN; PAM sequence: TTT
ccgacaccctccccattttt

SEQ ID NO: 198566 - DNA, 20 bp, Artificial Sequence
  Description of Artificial Sequence: Synthetic oligonucleotide
  Target: ATXN1; (-) strand; PAM type: YTN; PAM sequence: TTT
tccgacaccctccccatttt

SEQ ID NO: 198567 - DNA, 20 bp, Artificial Sequence
  Description of Artificial Sequence: Synthetic oligonucleotide
  Target: ATXN1; (-) strand; PAM type: YTN; PAM sequence: CTT
ttccgacaccctccccattt

SEQ ID NO: 198568 - DNA, 20 bp, Artificial Sequence
  Description of Artificial Sequence: Synthetic oligonucleotide
  Target: ATXN1; (-) strand; PAM type: YTN; PAM sequence: TTA
gagacttttccgacaccctc

SEQ ID NO: 198569 - DNA, 20 bp, Artificial Sequence
  Description of Artificial Sequence: Synthetic oligonucleotide
  Target: ATXN1; (-) strand; PAM type: YTN; PAM sequence: TTA
ttagagacttttccgacacc

SEQ ID NO: 198570 - DNA, 20 bp, Artificial Sequence
  Description of Artificial Sequence: Synthetic oligonucleotide
  Target: ATXN1; (-) strand; PAM type: YTN; PAM sequence: CTA
atgtacatattattagagac

SEQ ID NO: 198571 - DNA, 20 bp, Artificial Sequence
  Description of Artificial Sequence: Synthetic oligonucleotide
  Target: ATXN1; (-) strand; PAM type: YTN; PAM sequence: TTC
ctaatgtacatattattaga

SEQ ID NO: 198572 - DNA, 20 bp, Artificial Sequence
  Description of Artificial Sequence: Synthetic oligonucleotide
  Target: ATXN1; (-) strand; PAM type: YTN; PAM sequence: CTG
ttcctaatgtacatattatt

SEQ ID NO: 198573 - DNA, 20 bp, Artificial Sequence
  Description of Artificial Sequence: Synthetic oligonucleotide
  Target: ATXN1; (-) strand; PAM type: YTN; PAM sequence: TTG
gtctgttcctaatgtacata

SEQ ID NO: 198574 - DNA, 20 bp, Artificial Sequence
  Description of Artificial Sequence: Synthetic oligonucleotide
  Target: ATXN1; (-) strand; PAM type: YTN; PAM sequence: TTT
ggtctgttcctaatgtacat

SEQ ID NO: 198575 - DNA, 20 bp, Artificial Sequence
  Description of Artificial Sequence: Synthetic oligonucleotide
  Target: ATXN1; (-) strand; PAM type: YTN; PAM sequence: CTT
tggtctgttcctaatgtaca

SEQ ID NO: 198576 - DNA, 20 bp, Artificial Sequence
  Description of Artificial Sequence: Synthetic oligonucleotide
  Target: ATXN1; (-) strand; PAM type: YTN; PAM sequence: TTG
ctttggtctgttcctaatgt

SEQ ID NO: 198577 - DNA, 20 bp, Artificial Sequence
  Description of Artificial Sequence: Synthetic oligonucleotide
  Target: ATXN1; (-) strand; PAM type: YTN; PAM sequence: TTT
gctttggtctgttcctaatg

SEQ ID NO: 198578 - DNA, 20 bp, Artificial Sequence
  Description of Artificial Sequence: Synthetic oligonucleotide
  Target: ATXN1; (-) strand; PAM type: YTN; PAM sequence: CTT
tgctttggtctgttcctaat

SEQ ID NO: 198579 - DNA, 20 bp, Artificial Sequence
  Description of Artificial Sequence: Synthetic oligonucleotide
  Target: ATXN1; (-) strand; PAM type: YTN; PAM sequence: CTG
aaggaaagaaagccctttgc

SEQ ID NO: 198580 - DNA, 20 bp, Artificial Sequence
  Description of Artificial Sequence: Synthetic oligonucleotide
  Target: ATXN1; (-) strand; PAM type: YTN; PAM sequence: CTC
tgaaggaaagaaagcccttt

SEQ ID NO: 198581 - DNA, 20 bp, Artificial Sequence
  Description of Artificial Sequence: Synthetic oligonucleotide
  Target: ATXN1; (-) strand; PAM type: YTN; PAM sequence: CTA
ctctgaaggaaagaaagccc

SEQ ID NO: 198582 - DNA, 20 bp, Artificial Sequence
  Description of Artificial Sequence: Synthetic oligonucleotide
  Target: ATXN1; (-) strand; PAM type: YTN; PAM sequence: CTC
actactctgaaggaaagaaa

SEQ ID NO: 198583 - DNA, 20 bp, Artificial Sequence
  Description of Artificial Sequence: Synthetic oligonucleotide
  Target: ATXN1; (-) strand; PAM type: YTN; PAM sequence: CTC
aggaacagcagcagactcac

SEQ ID NO: 198584 - DNA, 20 bp, Artificial Sequence
  Description of Artificial Sequence: Synthetic oligonucleotide
  Target: ATXN1; (-) strand; PAM type: YTN; PAM sequence: TTC
tcaggaacagcagcagactc

SEQ ID NO: 198585 - DNA, 20 bp, Artificial Sequence
  Description of Artificial Sequence: Synthetic oligonucleotide
  Target: ATXN1; (-) strand; PAM type: YTN; PAM sequence: TTT
ctcaggaacagcagcagact

SEQ ID NO: 198586 - DNA, 20 bp, Artificial Sequence
  Description of Artificial Sequence: Synthetic oligonucleotide
  Target: ATXN1; (-) strand; PAM type: YTN; PAM sequence: CTC
atttctcaggaacagcagca

SEQ ID NO: 198587 - DNA, 20 bp, Artificial Sequence
  Description of Artificial Sequence: Synthetic oligonucleotide
  Target: ATXN1; (-) strand; PAM type: YTN; PAM sequence: CTC
actcatttctcaggaacagc

SEQ ID NO: 198588 - DNA, 20 bp, Artificial Sequence
  Description of Artificial Sequence: Synthetic oligonucleotide
  Target: ATXN1; (-) strand; PAM type: YTN; PAM sequence: CTG
tgcagctcactcatttctca

SEQ ID NO: 198589 - DNA, 20 bp, Artificial Sequence
  Description of Artificial Sequence: Synthetic oligonucleotide
  Target: ATXN1; (-) strand; PAM type: YTN; PAM sequence: CTG
gtcctgtgcagctcactcat

SEQ ID NO: 198590 - DNA, 20 bp, Artificial Sequence
  Description of Artificial Sequence: Synthetic oligonucleotide
  Target: ATXN1; (-) strand; PAM type: YTN; PAM sequence: CTG
gctggtcctgtgcagctcac

SEQ ID NO: 198591 - DNA, 20 bp, Artificial Sequence
  Description of Artificial Sequence: Synthetic oligonucleotide
  Target: ATXN1; (-) strand; PAM type: YTN; PAM sequence: CTA
ctggctggtcctgtgcagct

SEQ ID NO: 198592 - DNA, 20 bp, Artificial Sequence
  Description of Artificial Sequence: Synthetic oligonucleotide
  Target: ATXN1; (-) strand; PAM type: YTN; PAM sequence: CTC
ctactggctggtcctgtgca

SEQ ID NO: 198593 - DNA, 20 bp, Artificial Sequence
  Description of Artificial Sequence: Synthetic oligonucleotide
  Target: ATXN1; (-) strand; PAM type: YTN; PAM sequence: TTC
ccatcgccctcctactggct

SEQ ID NO: 198594 - DNA, 20 bp, Artificial Sequence
  Description of Artificial Sequence: Synthetic oligonucleotide
  Target: ATXN1; (-) strand; PAM type: YTN; PAM sequence: CTT
cccatcgccctcctactggc

SEQ ID NO: 198595 - DNA, 20 bp, Artificial Sequence
  Description of Artificial Sequence: Synthetic oligonucleotide
  Target: ATXN1; (-) strand; PAM type: YTN; PAM sequence: TTC
ttcccatcgccctcctactg

SEQ ID NO: 198596 - DNA, 20 bp, Artificial Sequence
  Description of Artificial Sequence: Synthetic oligonucleotide
  Target: ATXN1; (-) strand; PAM type: YTN; PAM sequence: TTG
attcttcccatcgccctcct

SEQ ID NO: 198597 - DNA, 20 bp, Artificial Sequence
  Description of Artificial Sequence: Synthetic oligonucleotide
  Target: ATXN1; (-) strand; PAM type: YTN; PAM sequence: CTT
gattcttcccatcgccctcc

SEQ ID NO: 198598 - DNA, 20 bp, Artificial Sequence
  Description of Artificial Sequence: Synthetic oligonucleotide
  Target: ATXN1; (-) strand; PAM type: YTN; PAM sequence: CTA
aaatgcacaccttgattctt

SEQ ID NO: 198599 - DNA, 20 bp, Artificial Sequence
  Description of Artificial Sequence: Synthetic oligonucleotide
  Target: ATXN1; (-) strand; PAM type: YTN; PAM sequence: TTC
taaaatgcacaccttgattc

SEQ ID NO: 198600 - DNA, 20 bp, Artificial Sequence
  Description of Artificial Sequence: Synthetic oligonucleotide
  Target: ATXN1; (-) strand; PAM type: YTN; PAM sequence: CTT
ctaaaatgcacaccttgatt

SEQ ID NO: 198601 - DNA, 20 bp, Artificial Sequence
  Description of Artificial Sequence: Synthetic oligonucleotide
  Target: ATXN1; (-) strand; PAM type: YTN; PAM sequence: CTG
cttctaaaatgcacaccttg

SEQ ID NO: 198602 - DNA, 20 bp, Artificial Sequence
  Description of Artificial Sequence: Synthetic oligonucleotide
  Target: ATXN1; (-) strand; PAM type: YTN; PAM sequence: TTC
tgcttctaaaatgcacacct

SEQ ID NO: 198603 - DNA, 20 bp, Artificial Sequence
  Description of Artificial Sequence: Synthetic oligonucleotide
  Target: ATXN1; (-) strand; PAM type: YTN; PAM sequence: CTT
ctgcttctaaaatgcacacc

SEQ ID NO: 198604 - DNA, 20 bp, Artificial Sequence
  Description of Artificial Sequence: Synthetic oligonucleotide
  Target: ATXN1; (-) strand; PAM type: YTN; PAM sequence: TTC
catgaaaaaaccttctgctt

SEQ ID NO: 198605 - DNA, 20 bp, Artificial Sequence
  Description of Artificial Sequence: Synthetic oligonucleotide
  Target: ATXN1; (-) strand; PAM type: YTN; PAM sequence: TTT
ccatgaaaaaaccttctgct

SEQ ID NO: 198606 - DNA, 20 bp, Artificial Sequence
  Description of Artificial Sequence: Synthetic oligonucleotide
  Target: ATXN1; (-) strand; PAM type: YTN; PAM sequence: TTT
tccatgaaaaaaccttctgc

SEQ ID NO: 198607 - DNA, 20 bp, Artificial Sequence
  Description of Artificial Sequence: Synthetic oligonucleotide
  Target: ATXN1; (-) strand; PAM type: YTN; PAM sequence: TTG
gaattttccatgaaaaaacc

SEQ ID NO: 198608 - DNA, 20 bp, Artificial Sequence
  Description of Artificial Sequence: Synthetic oligonucleotide
  Target: ATXN1; (-) strand; PAM type: YTN; PAM sequence: TTT
ggaattttccatgaaaaaac

SEQ ID NO: 198609 - DNA, 20 bp, Artificial Sequence
  Description of Artificial Sequence: Synthetic oligonucleotide
  Target: ATXN1; (-) strand; PAM type: YTN; PAM sequence: TTG
gtacatgtttggaattttcc

SEQ ID NO: 198610 - DNA, 20 bp, Artificial Sequence
  Description of Artificial Sequence: Synthetic oligonucleotide
  Target: ATXN1; (-) strand; PAM type: YTN; PAM sequence: TTT
ggtacatgtttggaattttc

SEQ ID NO: 198611 - DNA, 20 bp, Artificial Sequence
  Description of Artificial Sequence: Synthetic oligonucleotide
  Target: ATXN1; (-) strand; PAM type: YTN; PAM sequence: CTT
tggtacatgtttggaatttt

SEQ ID NO: 198612 - DNA, 20 bp, Artificial Sequence
  Description of Artificial Sequence: Synthetic oligonucleotide
  Target: ATXN1; (-) strand; PAM type: YTN; PAM sequence: TTG
tgagtctttggtacatgttt

SEQ ID NO: 198613 - DNA, 20 bp, Artificial Sequence
  Description of Artificial Sequence: Synthetic oligonucleotide
  Target: ATXN1; (-) strand; PAM type: YTN; PAM sequence: CTA
ttgtgagtctttggtacatg

SEQ ID NO: 198614 - DNA, 20 bp, Artificial Sequence
  Description of Artificial Sequence: Synthetic oligonucleotide
  Target: ATXN1; (-) strand; PAM type: YTN; PAM sequence: TTC
tattgtgagtctttggtaca

SEQ ID NO: 198615 - DNA, 20 bp, Artificial Sequence
  Description of Artificial Sequence: Synthetic oligonucleotide
  Target: ATXN1; (-) strand; PAM type: YTN; PAM sequence: TTG
gtgttctattgtgagtcttt

SEQ ID NO: 198616 - DNA, 20 bp, Artificial Sequence
  Description of Artificial Sequence: Synthetic oligonucleotide
  Target: ATXN1; (-) strand; PAM type: YTN; PAM sequence: TTT
ggtgttctattgtgagtctt

SEQ ID NO: 198617 - DNA, 20 bp, Artificial Sequence
  Description of Artificial Sequence: Synthetic oligonucleotide
  Target: ATXN1; (-) strand; PAM type: YTN; PAM sequence: CTG
agtaatggatatttggtgtt

SEQ ID NO: 198618 - DNA, 20 bp, Artificial Sequence
  Description of Artificial Sequence: Synthetic oligonucleotide
  Target: ATXN1; (-) strand; PAM type: YTN; PAM sequence: TTG
atgctgagtaatggatattt

SEQ ID NO: 198619 - DNA, 20 bp, Artificial Sequence
  Description of Artificial Sequence: Synthetic oligonucleotide
  Target: ATXN1; (-) strand; PAM type: YTN; PAM sequence: CTG
ttgatgctgagtaatggata

SEQ ID NO: 198620 - DNA, 20 bp, Artificial Sequence
  Description of Artificial Sequence: Synthetic oligonucleotide
  Target: ATXN1; (-) strand; PAM type: YTN; PAM sequence: TTG
tcactgttgatgctgagtaa

SEQ ID NO: 198621 - DNA, 20 bp, Artificial Sequence
  Description of Artificial Sequence: Synthetic oligonucleotide
  Target: ATXN1; (-) strand; PAM type: YTN; PAM sequence: TTT
gtcactgttgatgctgagta

SEQ ID NO: 198622 - DNA, 20 bp, Artificial Sequence
  Description of Artificial Sequence: Synthetic oligonucleotide
  Target: ATXN1; (-) strand; PAM type: YTN; PAM sequence: TTG
aagacacaatcagccatggt

SEQ ID NO: 198623 - DNA, 20 bp, Artificial Sequence
  Description of Artificial Sequence: Synthetic oligonucleotide
  Target: ATXN1; (-) strand; PAM type: YTN; PAM sequence: CTT
gaagacacaatcagccatgg

SEQ ID NO: 198624 - DNA, 20 bp, Artificial Sequence
  Description of Artificial Sequence: Synthetic oligonucleotide
  Target: ATXN1; (-) strand; PAM type: YTN; PAM sequence: TTG
cttgaagacacaatcagcca

SEQ ID NO: 198625 - DNA, 20 bp, Artificial Sequence
  Description of Artificial Sequence: Synthetic oligonucleotide
  Target: ATXN1; (-) strand; PAM type: YTN; PAM sequence: TTT
gcttgaagacacaatcagcc

SEQ ID NO: 198626 - DNA, 20 bp, Artificial Sequence
  Description of Artificial Sequence: Synthetic oligonucleotide
  Target: ATXN1; (-) strand; PAM type: YTN; PAM sequence: CTG
ggatttgcttgaagacacaa

SEQ ID NO: 198627 - DNA, 20 bp, Artificial Sequence
  Description of Artificial Sequence: Synthetic oligonucleotide
  Target: ATXN1; (-) strand; PAM type: YTN; PAM sequence: TTC
tgggatttgcttgaagacac

SEQ ID NO: 198628 - DNA, 20 bp, Artificial Sequence
  Description of Artificial Sequence: Synthetic oligonucleotide
  Target: ATXN1; (-) strand; PAM type: YTN; PAM sequence: TTA
cagttctgggatttgcttga

SEQ ID NO: 198629 - DNA, 20 bp, Artificial Sequence
  Description of Artificial Sequence: Synthetic oligonucleotide
  Target: ATXN1; (-) strand; PAM type: YTN; PAM sequence: TTA
gggatgaaattacagttctg

SEQ ID NO: 198630 - DNA, 20 bp, Artificial Sequence
  Description of Artificial Sequence: Synthetic oligonucleotide
  Target: ATXN1; (-) strand; PAM type: YTN; PAM sequence: CTT
agggatgaaattacagttct

SEQ ID NO: 198631 - DNA, 20 bp, Artificial Sequence
  Description of Artificial Sequence: Synthetic oligonucleotide
  Target: ATXN1; (-) strand; PAM type: YTN; PAM sequence: CTA
atgaaatacttagggatgaa

SEQ ID NO: 198632 - DNA, 20 bp, Artificial Sequence
  Description of Artificial Sequence: Synthetic oligonucleotide
  Target: ATXN1; (-) strand; PAM type: YTN; PAM sequence: TTC
ctaatgaaatacttagggat

SEQ ID NO: 198633 - DNA, 20 bp, Artificial Sequence
  Description of Artificial Sequence: Synthetic oligonucleotide
  Target: ATXN1; (-) strand; PAM type: YTN; PAM sequence: CTA
tggttcctaatgaaatactt

SEQ ID NO: 198634 - DNA, 20 bp, Artificial Sequence
  Description of Artificial Sequence: Synthetic oligonucleotide
  Target: ATXN1; (-) strand; PAM type: YTN; PAM sequence: TTC
tatggttcctaatgaaatac

SEQ ID NO: 198635 - DNA, 20 bp, Artificial Sequence
  Description of Artificial Sequence: Synthetic oligonucleotide
  Target: ATXN1; (-) strand; PAM type: YTN; PAM sequence: TTA
aaaaattctatggttcctaa

SEQ ID NO: 198636 - DNA, 20 bp, Artificial Sequence
  Description of Artificial Sequence: Synthetic oligonucleotide
  Target: ATXN1; (-) strand; PAM type: YTN; PAM sequence: CTT
aaaaaattctatggttccta

SEQ ID NO: 198637 - DNA, 20 bp, Artificial Sequence
  Description of Artificial Sequence: Synthetic oligonucleotide
  Target: ATXN1; (-) strand; PAM type: YTN; PAM sequence: CTC
aggaaaatgagggagcttaa

SEQ ID NO: 198638 - DNA, 20 bp, Artificial Sequence
  Description of Artificial Sequence: Synthetic oligonucleotide
  Target: ATXN1; (-) strand; PAM type: YTN; PAM sequence: TTG
aggacctcaggaaaatgagg

SEQ ID NO: 198639 - DNA, 20 bp, Artificial Sequence
  Description of Artificial Sequence: Synthetic oligonucleotide
  Target: ATXN1; (-) strand; PAM type: YTN; PAM sequence: TTT
gaggacctcaggaaaatgag

SEQ ID NO: 198640 - DNA, 20 bp, Artificial Sequence
  Description of Artificial Sequence: Synthetic oligonucleotide
  Target: ATXN1; (-) strand; PAM type: YTN; PAM sequence: TTT
tgaggacctcaggaaaatga

SEQ ID NO: 198641 - DNA, 20 bp, Artificial Sequence
  Description of Artificial Sequence: Synthetic oligonucleotide
  Target: ATXN1; (-) strand; PAM type: YTN; PAM sequence: CTT
ttgaggacctcaggaaaatg

SEQ ID NO: 198642 - DNA, 20 bp, Artificial Sequence
  Description of Artificial Sequence: Synthetic oligonucleotide
  Target: ATXN1; (-) strand; PAM type: YTN; PAM sequence: TTG
acttttgaggacctcaggaa

SEQ ID NO: 198643 - DNA, 20 bp, Artificial Sequence
  Description of Artificial Sequence: Synthetic oligonucleotide
  Target: ATXN1; (-) strand; PAM type: YTN; PAM sequence: TTT
gacttttgaggacctcagga

SEQ ID NO: 198644 - DNA, 20 bp, Artificial Sequence
  Description of Artificial Sequence: Synthetic oligonucleotide
  Target: ATXN1; (-) strand; PAM type: YTN; PAM sequence: CTG
ggtcatttgacttttgagga

SEQ ID NO: 198645 - DNA, 20 bp, Artificial Sequence
  Description of Artificial Sequence: Synthetic oligonucleotide
  Target: ATXN1; (-) strand; PAM type: YTN; PAM sequence: TTG
gacatgatggccctgggtca

SEQ ID NO: 198646 - DNA, 20 bp, Artificial Sequence
  Description of Artificial Sequence: Synthetic oligonucleotide
  Target: ATXN1; (-) strand; PAM type: YTN; PAM sequence: CTC
atcacagttggacatgatgg

SEQ ID NO: 198647 - DNA, 20 bp, Artificial Sequence
  Description of Artificial Sequence: Synthetic oligonucleotide
  Target: ATXN1; (-) strand; PAM type: YTN; PAM sequence: CTG
cctcatcacagttggacatg

SEQ ID NO: 198648 - DNA, 20 bp, Artificial Sequence
  Description of Artificial Sequence: Synthetic oligonucleotide
  Target: ATXN1; (-) strand; PAM type: YTN; PAM sequence: CTC
cagccctgcctcatcacagt

SEQ ID NO: 198649 - DNA, 20 bp, Artificial Sequence
  Description of Artificial Sequence: Synthetic oligonucleotide
  Target: ATXN1; (-) strand; PAM type: YTN; PAM sequence: CTG
ggctccagccctgcctcatc

SEQ ID NO: 198650 - DNA, 20 bp, Artificial Sequence
  Description of Artificial Sequence: Synthetic oligonucleotide
  Target: ATXN1; (-) strand; PAM type: YTN; PAM sequence: CTG
gccccaggtgacaagactgg

SEQ ID NO: 198651 - DNA, 20 bp, Artificial Sequence
  Description of Artificial Sequence: Synthetic oligonucleotide
  Target: ATXN1; (-) strand; PAM type: YTN; PAM sequence: TTG
aaggagagcacacctggccc

SEQ ID NO: 198652 - DNA, 20 bp, Artificial Sequence
  Description of Artificial Sequence: Synthetic oligonucleotide
  Target: ATXN1; (-) strand; PAM type: YTN; PAM sequence: CTT
gaaggagagcacacctggcc

SEQ ID NO: 198653 - DNA, 20 bp, Artificial Sequence
  Description of Artificial Sequence: Synthetic oligonucleotide
  Target: ATXN1; (-) strand; PAM type: YTN; PAM sequence: TTG
ggggtggggcttgaaggaga

SEQ ID NO: 198654 - DNA, 20 bp, Artificial Sequence
  Description of Artificial Sequence: Synthetic oligonucleotide
  Target: ATXN1; (-) strand; PAM type: YTN; PAM sequence: CTG
aagggagtggtaagtacaag

SEQ ID NO: 198655 - DNA, 20 bp, Artificial Sequence
  Description of Artificial Sequence: Synthetic oligonucleotide
  Target: ATXN1; (-) strand; PAM type: YTN; PAM sequence: TTA
aaaacgtctgaagggagtgg

SEQ ID NO: 198656 - DNA, 20 bp, Artificial Sequence
  Description of Artificial Sequence: Synthetic oligonucleotide
  Target: ATXN1; (-) strand; PAM type: YTN; PAM sequence: CTC
agggtccagttaaaaacgtc

SEQ ID NO: 198657 - DNA, 20 bp, Artificial Sequence
  Description of Artificial Sequence: Synthetic oligonucleotide
  Target: ATXN1; (-) strand; PAM type: YTN; PAM sequence: TTA
tggctcagggtccagttaaa

SEQ ID NO: 198658 - DNA, 20 bp, Artificial Sequence
  Description of Artificial Sequence: Synthetic oligonucleotide
  Target: ATXN1; (-) strand; PAM type: YTN; PAM sequence: TTT
atggctcagggtccagttaa

SEQ ID NO: 198659 - DNA, 20 bp, Artificial Sequence
  Description of Artificial Sequence: Synthetic oligonucleotide
  Target: ATXN1; (-) strand; PAM type: YTN; PAM sequence: TTT
tatggctcagggtccagtta

SEQ ID NO: 198660 - DNA, 20 bp, Artificial Sequence
  Description of Artificial Sequence: Synthetic oligonucleotide
  Target: ATXN1; (-) strand; PAM type: YTN; PAM sequence: TTA
attttatggctcagggtcca

SEQ ID NO: 198661 - DNA, 20 bp, Artificial Sequence
  Description of Artificial Sequence: Synthetic oligonucleotide
  Target: ATXN1; (-) strand; PAM type: YTN; PAM sequence: CTG
tgttaattttatggctcagg

SEQ ID NO: 198662 - DNA, 20 bp, Artificial Sequence
  Description of Artificial Sequence: Synthetic oligonucleotide
  Target: ATXN1; (-) strand; PAM type: YTN; PAM sequence: TTC
tgtgttaattttatggctca

SEQ ID NO: 198663 - DNA, 20 bp, Artificial Sequence
  Description of Artificial Sequence: Synthetic oligonucleotide
  Target: ATXN1; (-) strand; PAM type: YTN; PAM sequence: TTT
ctgtgttaattttatggctc

SEQ ID NO: 198664 - DNA, 20 bp, Artificial Sequence
  Description of Artificial Sequence: Synthetic oligonucleotide
  Target: ATXN1; (-) strand; PAM type: YTN; PAM sequence: TTT
tctgtgttaattttatggct

SEQ ID NO: 198665 - DNA, 20 bp, Artificial Sequence
  Description of Artificial Sequence: Synthetic oligonucleotide
  Target: ATXN1; (-) strand; PAM type: YTN; PAM sequence: CTC
attttctgtgttaattttat

SEQ ID NO: 198666 - DNA, 20 bp, Artificial Sequence
  Description of Artificial Sequence: Synthetic oligonucleotide
  Target: ATXN1; (-) strand; PAM type: YTN; PAM sequence: CTA
gccaatgtcatgctcatttt

SEQ ID NO: 198667 - DNA, 20 bp, Artificial Sequence
  Description of Artificial Sequence: Synthetic oligonucleotide
  Target: ATXN1; (-) strand; PAM type: YTN; PAM sequence: TTC
tagccaatgtcatgctcatt

SEQ ID NO: 198668 - DNA, 20 bp, Artificial Sequence
  Description of Artificial Sequence: Synthetic oligonucleotide
  Target: ATXN1; (-) strand; PAM type: YTN; PAM sequence: TTT
ctagccaatgtcatgctcat

SEQ ID NO: 198669 - DNA, 20 bp, Artificial Sequence
  Description of Artificial Sequence: Synthetic oligonucleotide
  Target: ATXN1; (-) strand; PAM type: YTN; PAM sequence: CTG
atttctagccaatgtcatgc

SEQ ID NO: 198670 - DNA, 20 bp, Artificial Sequence
  Description of Artificial Sequence: Synthetic oligonucleotide
  Target: ATXN1; (-) strand; PAM type: YTN; PAM sequence: TTC
tgatttctagccaatgtcat

SEQ ID NO: 198671 - DNA, 20 bp, Artificial Sequence
  Description of Artificial Sequence: Synthetic oligonucleotide
  Target: ATXN1; (-) strand; PAM type: YTN; PAM sequence: TTT
ctgatttctagccaatgtca

SEQ ID NO: 198672 - DNA, 20 bp, Artificial Sequence
  Description of Artificial Sequence: Synthetic oligonucleotide
  Target: ATXN1; (-) strand; PAM type: YTN; PAM sequence: TTT
tctgatttctagccaatgtc

SEQ ID NO: 198673 - DNA, 20 bp, Artificial Sequence
  Description of Artificial Sequence: Synthetic oligonucleotide
  Target: ATXN1; (-) strand; PAM type: YTN; PAM sequence: TTC
aggattttctgatttctagc

SEQ ID NO: 198674 - DNA, 20 bp, Artificial Sequence
  Description of Artificial Sequence: Synthetic oligonucleotide
  Target: ATXN1; (-) strand; PAM type: YTN; PAM sequence: TTA
aaattcaggattttctgatt

SEQ ID NO: 198675 - DNA, 20 bp, Artificial Sequence
  Description of Artificial Sequence: Synthetic oligonucleotide
  Target: ATXN1; (-) strand; PAM type: YTN; PAM sequence: CTG
agattaaaattcaggatttt

SEQ ID NO: 198676 - DNA, 20 bp, Artificial Sequence
  Description of Artificial Sequence: Synthetic oligonucleotide
  Target: ATXN1; (-) strand; PAM type: YTN; PAM sequence: CTC
agaaaaatggcaaagctgag

SEQ ID NO: 198677 - DNA, 20 bp, Artificial Sequence
  Description of Artificial Sequence: Synthetic oligonucleotide
  Target: ATXN1; (-) strand; PAM type: YTN; PAM sequence: TTA
aggctcagaaaaatggcaaa

SEQ ID NO: 198678 - DNA, 20 bp, Artificial Sequence
  Description of Artificial Sequence: Synthetic oligonucleotide
  Target: ATXN1; (-) strand; PAM type: YTN; PAM sequence: TTG
ggacaattaaggctcagaaa

SEQ ID NO: 198679 - DNA, 20 bp, Artificial Sequence
  Description of Artificial Sequence: Synthetic oligonucleotide
  Target: ATXN1; (-) strand; PAM type: YTN; PAM sequence: TTA
tagttgggacaattaaggct

SEQ ID NO: 198680 - DNA, 20 bp, Artificial Sequence
  Description of Artificial Sequence: Synthetic oligonucleotide
  Target: ATXN1; (-) strand; PAM type: YTN; PAM sequence: CTT
atagttgggacaattaaggc

SEQ ID NO: 198681 - DNA, 20 bp, Artificial Sequence
  Description of Artificial Sequence: Synthetic oligonucleotide
  Target: ATXN1; (-) strand; PAM type: YTN; PAM sequence: CTA
cttatagttgggacaattaa

SEQ ID NO: 198682 - DNA, 20 bp, Artificial Sequence
  Description of Artificial Sequence: Synthetic oligonucleotide
  Target: ATXN1; (-) strand; PAM type: YTN; PAM sequence: CTC
tacttatagttgggacaatt

SEQ ID NO: 198683 - DNA, 20 bp, Artificial Sequence
  Description of Artificial Sequence: Synthetic oligonucleotide
  Target: ATXN1; (-) strand; PAM type: YTN; PAM sequence: TTC
atatctctacttatagttgg

SEQ ID NO: 198684 - DNA, 20 bp, Artificial Sequence
  Description of Artificial Sequence: Synthetic oligonucleotide
  Target: ATXN1; (-) strand; PAM type: YTN; PAM sequence: TTT
catatctctacttatagttg

SEQ ID NO: 198685 - DNA, 20 bp, Artificial Sequence
  Description of Artificial Sequence: Synthetic oligonucleotide
  Target: ATXN1; (-) strand; PAM type: YTN; PAM sequence: TTG
tagtagcaatttcatatctc

SEQ ID NO: 198686 - DNA, 20 bp, Artificial Sequence
  Description of Artificial Sequence: Synthetic oligonucleotide
  Target: ATXN1; (-) strand; PAM type: YTN; PAM sequence: CTT
gtagtagcaatttcatatct

SEQ ID NO: 198687 - DNA, 20 bp, Artificial Sequence
  Description of Artificial Sequence: Synthetic oligonucleotide
  Target: ATXN1; (-) strand; PAM type: YTN; PAM sequence: TTA
tatcttgtagtagcaatttc

SEQ ID NO: 198688 - DNA, 20 bp, Artificial Sequence
  Description of Artificial Sequence: Synthetic oligonucleotide
  Target: ATXN1; (-) strand; PAM type: YTN; PAM sequence: TTA
taagtatgtcagaagtaatt

SEQ ID NO: 198689 - DNA, 20 bp, Artificial Sequence
  Description of Artificial Sequence: Synthetic oligonucleotide
  Target: ATXN1; (-) strand; PAM type: YTN; PAM sequence: TTT
ataagtatgtcagaagtaat

SEQ ID NO: 198690 - DNA, 20 bp, Artificial Sequence
  Description of Artificial Sequence: Synthetic oligonucleotide
  Target: ATXN1; (-) strand; PAM type: YTN; PAM sequence: TTT
tataagtatgtcagaagtaa

SEQ ID NO: 198691 - DNA, 20 bp, Artificial Sequence
  Description of Artificial Sequence: Synthetic oligonucleotide
  Target: ATXN1; (-) strand; PAM type: YTN; PAM sequence: TTT
ttataagtatgtcagaagta

SEQ ID NO: 198692 - DNA, 20 bp, Artificial Sequence
  Description of Artificial Sequence: Synthetic oligonucleotide
  Target: ATXN1; (-) strand; PAM type: YTN; PAM sequence: CTT
tttataagtatgtcagaagt

SEQ ID NO: 198693 - DNA, 20 bp, Artificial Sequence
  Description of Artificial Sequence: Synthetic oligonucleotide
  Target: ATXN1; (-) strand; PAM type: YTN; PAM sequence: TTG
aaagtcaaccctttttataa

SEQ ID NO: 198694 - DNA, 20 bp, Artificial Sequence
  Description of Artificial Sequence: Synthetic oligonucleotide
  Target: ATXN1; (-) strand; PAM type: YTN; PAM sequence: TTA
caagttgaaagtcaaccctt

SEQ ID NO: 198695 - DNA, 20 bp, Artificial Sequence
  Description of Artificial Sequence: Synthetic oligonucleotide
  Target: ATXN1; (-) strand; PAM type: YTN; PAM sequence: CTG
ttacaagttgaaagtcaacc

SEQ ID NO: 198696 - DNA, 20 bp, Artificial Sequence
  Description of Artificial Sequence: Synthetic oligonucleotide
  Target: ATXN1; (-) strand; PAM type: YTN; PAM sequence: TTA
aacataactgttacaagttg

SEQ ID NO: 198697 - DNA, 20 bp, Artificial Sequence
  Description of Artificial Sequence: Synthetic oligonucleotide
  Target: ATXN1; (-) strand; PAM type: YTN; PAM sequence: CTT
aaacataactgttacaagtt

SEQ ID NO: 198698 - DNA, 20 bp, Artificial Sequence
  Description of Artificial Sequence: Synthetic oligonucleotide
  Target: ATXN1; (-) strand; PAM type: YTN; PAM sequence: CTC
catgaaaataccttaaacat

SEQ ID NO: 198699 - DNA, 20 bp, Artificial Sequence
  Description of Artificial Sequence: Synthetic oligonucleotide
  Target: ATXN1; (-) strand; PAM type: YTN; PAM sequence: TTA
cgaaactccatgaaaatacc

SEQ ID NO: 198700 - DNA, 20 bp, Artificial Sequence
  Description of Artificial Sequence: Synthetic oligonucleotide
  Target: ATXN1; (-) strand; PAM type: YTN; PAM sequence: TTT
acgaaactccatgaaaatac

SEQ ID NO: 198701 - DNA, 20 bp, Artificial Sequence
  Description of Artificial Sequence: Synthetic oligonucleotide
  Target: ATXN1; (-) strand; PAM type: YTN; PAM sequence: TTT
tacgaaactccatgaaaata

SEQ ID NO: 198702 - DNA, 20 bp, Artificial Sequence
  Description of Artificial Sequence: Synthetic oligonucleotide
  Target: ATXN1; (-) strand; PAM type: YTN; PAM sequence: CTT
ttacgaaactccatgaaaat

SEQ ID NO: 198703 - DNA, 20 bp, Artificial Sequence
  Description of Artificial Sequence: Synthetic oligonucleotide
  Target: ATXN1; (-) strand; PAM type: YTN; PAM sequence: CTA
acagcttttacgaaactcca

SEQ ID NO: 198704 - DNA, 20 bp, Artificial Sequence
  Description of Artificial Sequence: Synthetic oligonucleotide
  Target: ATXN1; (-) strand; PAM type: YTN; PAM sequence: TTC
taacagcttttacgaaactc

SEQ ID NO: 198705 - DNA, 20 bp, Artificial Sequence
  Description of Artificial Sequence: Synthetic oligonucleotide
  Target: ATXN1; (-) strand; PAM type: YTN; PAM sequence: CTT
ctaacagcttttacgaaact

SEQ ID NO: 198706 - DNA, 20 bp, Artificial Sequence
  Description of Artificial Sequence: Synthetic oligonucleotide
  Target: ATXN1; (-) strand; PAM type: YTN; PAM sequence: TTA
tggcttctaacagcttttac

SEQ ID NO: 198707 - DNA, 20 bp, Artificial Sequence
  Description of Artificial Sequence: Synthetic oligonucleotide
  Target: ATXN1; (-) strand; PAM type: YTN; PAM sequence: TTT
atggcttctaacagctttta

SEQ ID NO: 198708 - DNA, 20 bp, Artificial Sequence
  Description of Artificial Sequence: Synthetic oligonucleotide
  Target: ATXN1; (-) strand; PAM type: YTN; PAM sequence: CTT
tatggcttctaacagctttt

SEQ ID NO: 198709 - DNA, 20 bp, Artificial Sequence
  Description of Artificial Sequence: Synthetic oligonucleotide
  Target: ATXN1; (-) strand; PAM type: YTN; PAM sequence: CTA
agctttatggcttctaacag

SEQ ID NO: 198710 - DNA, 20 bp, Artificial Sequence
  Description of Artificial Sequence: Synthetic oligonucleotide
  Target: ATXN1; (-) strand; PAM type: YTN; PAM sequence: CTC
atagtctaagctttatggct

SEQ ID NO: 198711 - DNA, 20 bp, Artificial Sequence
  Description of Artificial Sequence: Synthetic oligonucleotide
  Target: ATXN1; (-) strand; PAM type: YTN; PAM sequence: CTC
acggaagtcatctcatagtc

SEQ ID NO: 198712 - DNA, 20 bp, Artificial Sequence
  Description of Artificial Sequence: Synthetic oligonucleotide
  Target: ATXN1; (-) strand; PAM type: YTN; PAM sequence: CTC
acctcacggaagtcatctca

SEQ ID NO: 198713 - DNA, 20 bp, Artificial Sequence
  Description of Artificial Sequence: Synthetic oligonucleotide
  Target: ATXN1; (-) strand; PAM type: YTN; PAM sequence: TTA
acataggagatctcacctca

SEQ ID NO: 198714 - DNA, 20 bp, Artificial Sequence
  Description of Artificial Sequence: Synthetic oligonucleotide
  Target: ATXN1; (-) strand; PAM type: YTN; PAM sequence: CTC
attaacataggagatctcac

SEQ ID NO: 198715 - DNA, 20 bp, Artificial Sequence
  Description of Artificial Sequence: Synthetic oligonucleotide
  Target: ATXN1; (-) strand; PAM type: YTN; PAM sequence: CTC
cccaccactcattaacatag

SEQ ID NO: 198716 - DNA, 20 bp, Artificial Sequence
  Description of Artificial Sequence: Synthetic oligonucleotide
  Target: ATXN1; (-) strand; PAM type: YTN; PAM sequence: CTA
tgtatgcctccccaccactc

SEQ ID NO: 198717 - DNA, 20 bp, Artificial Sequence
  Description of Artificial Sequence: Synthetic oligonucleotide
  Target: ATXN1; (-) strand; PAM type: YTN; PAM sequence: TTA
cataataactatgtatgcct

SEQ ID NO: 198718 - DNA, 20 bp, Artificial Sequence
  Description of Artificial Sequence: Synthetic oligonucleotide
  Target: ATXN1; (-) strand; PAM type: YTN; PAM sequence: CTC
agggtacagttacataataa

SEQ ID NO: 198719 - DNA, 20 bp, Artificial Sequence
  Description of Artificial Sequence: Synthetic oligonucleotide
  Target: ATXN1; (-) strand; PAM type: YTN; PAM sequence: CTC
tcagggtacagttacataat

SEQ ID NO: 198720 - DNA, 20 bp, Artificial Sequence
  Description of Artificial Sequence: Synthetic oligonucleotide
  Target: ATXN1; (-) strand; PAM type: YTN; PAM sequence: TTG
tcgtggcaatactctcaggg

SEQ ID NO: 198721 - DNA, 20 bp, Artificial Sequence
  Description of Artificial Sequence: Synthetic oligonucleotide
  Target: ATXN1; (-) strand; PAM type: YTN; PAM sequence: CTT
gtcgtggcaatactctcagg

SEQ ID NO: 198722 - DNA, 20 bp, Artificial Sequence
  Description of Artificial Sequence: Synthetic oligonucleotide
  Target: ATXN1; (-) strand; PAM type: YTN; PAM sequence: TTA
tgtgaaaaataaataaactt

SEQ ID NO: 198723 - DNA, 20 bp, Artificial Sequence
  Description of Artificial Sequence: Synthetic oligonucleotide
  Target: ATXN1; (-) strand; PAM type: YTN; PAM sequence: TTT
atgtgaaaaataaataaact

SEQ ID NO: 198724 - DNA, 20 bp, Artificial Sequence
  Description of Artificial Sequence: Synthetic oligonucleotide
  Target: ATXN1; (-) strand; PAM type: YTN; PAM sequence: TTT
tatgtgaaaaataaataaac

SEQ ID NO: 198725 - DNA, 20 bp, Artificial Sequence
  Description of Artificial Sequence: Synthetic oligonucleotide
  Target: ATXN1; (-) strand; PAM type: YTN; PAM sequence: TTT
ttatgtgaaaaataaataaa

SEQ ID NO: 198726 - DNA, 20 bp, Artificial Sequence
  Description of Artificial Sequence: Synthetic oligonucleotide
  Target: ATXN1; (-) strand; PAM type: YTN; PAM sequence: CTA
atttttatgtgaaaaataaa

SEQ ID NO: 198727 - DNA, 20 bp, Artificial Sequence
  Description of Artificial Sequence: Synthetic oligonucleotide
  Target: ATXN1; (-) strand; PAM type: YTN; PAM sequence: TTC
taatttttatgtgaaaaata

SEQ ID NO: 198728 - DNA, 20 bp, Artificial Sequence
  Description of Artificial Sequence: Synthetic oligonucleotide
  Target: ATXN1; (-) strand; PAM type: YTN; PAM sequence: TTG
gttctaatttttatgtgaaa

SEQ ID NO: 198729 - DNA, 20 bp, Artificial Sequence
  Description of Artificial Sequence: Synthetic oligonucleotide
  Target: ATXN1; (-) strand; PAM type: YTN; PAM sequence: TTG
aaatagttggttctaatttt

SEQ ID NO: 198730 - DNA, 20 bp, Artificial Sequence
  Description of Artificial Sequence: Synthetic oligonucleotide
  Target: ATXN1; (-) strand; PAM type: YTN; PAM sequence: TTC
agcatgttgaaatagttggt

SEQ ID NO: 198731 - DNA, 20 bp, Artificial Sequence
  Description of Artificial Sequence: Synthetic oligonucleotide
  Target: ATXN1; (-) strand; PAM type: YTN; PAM sequence: TTT
cagcatgttgaaatagttgg

SEQ ID NO: 198732 - DNA, 20 bp, Artificial Sequence
  Description of Artificial Sequence: Synthetic oligonucleotide
  Target: ATXN1; (-) strand; PAM type: YTN; PAM sequence: TTC
catttcagcatgttgaaata

SEQ ID NO: 198733 - DNA, 20 bp, Artificial Sequence
  Description of Artificial Sequence: Synthetic oligonucleotide
  Target: ATXN1; (-) strand; PAM type: YTN; PAM sequence: CTT
ccatttcagcatgttgaaat

SEQ ID NO: 198734 - DNA, 20 bp, Artificial Sequence
  Description of Artificial Sequence: Synthetic oligonucleotide
  Target: ATXN1; (-) strand; PAM type: YTN; PAM sequence: TTC
atagaaacttccatttcagc

SEQ ID NO: 198735 - DNA, 20 bp, Artificial Sequence
  Description of Artificial Sequence: Synthetic oligonucleotide
  Target: ATXN1; (-) strand; PAM type: YTN; PAM sequence: TTT
catagaaacttccatttcag

SEQ ID NO: 198736 - DNA, 20 bp, Artificial Sequence
  Description of Artificial Sequence: Synthetic oligonucleotide
  Target: ATXN1; (-) strand; PAM type: YTN; PAM sequence: TTT
tcatagaaacttccatttca

SEQ ID NO: 198737 - DNA, 20 bp, Artificial Sequence
  Description of Artificial Sequence: Synthetic oligonucleotide
  Target: ATXN1; (-) strand; PAM type: YTN; PAM sequence: TTT
ttcatagaaacttccatttc

SEQ ID NO: 198738 - DNA, 20 bp, Artificial Sequence
  Description of Artificial Sequence: Synthetic oligonucleotide
  Target: ATXN1; (-) strand; PAM type: YTN; PAM sequence: TTG
tttttcatagaaacttccat

SEQ ID NO: 198739 - DNA, 20 bp, Artificial Sequence
  Description of Artificial Sequence: Synthetic oligonucleotide
  Target: ATXN1; (-) strand; PAM type: YTN; PAM sequence: TTT
gtttttcatagaaacttcca

SEQ ID NO: 198740 - DNA, 20 bp, Artificial Sequence
  Description of Artificial Sequence: Synthetic oligonucleotide
  Target: ATXN1; (-) strand; PAM type: YTN; PAM sequence: TTA
tatgaaacatttgtttttca

SEQ ID NO: 198741 - DNA, 20 bp, Artificial Sequence
  Description of Artificial Sequence: Synthetic oligonucleotide
  Target: ATXN1; (-) strand; PAM type: YTN; PAM sequence: TTA
tattatatgaaacatttgtt

SEQ ID NO: 198742 - DNA, 20 bp, Artificial Sequence
  Description of Artificial Sequence: Synthetic oligonucleotide
  Target: ATXN1; (-) strand; PAM type: YTN; PAM sequence: TTT
atattatatgaaacatttgt

SEQ ID NO: 198743 - DNA, 20 bp, Artificial Sequence
  Description of Artificial Sequence: Synthetic oligonucleotide
  Target: ATXN1; (-) strand; PAM type: YTN; PAM sequence: TTG
atttatattatatgaaacat

SEQ ID NO: 198744 - DNA, 20 bp, Artificial Sequence
  Description of Artificial Sequence: Synthetic oligonucleotide
  Target: ATXN1; (-) strand; PAM type: YTN; PAM sequence: TTG
ggaaatgttgatttatatta

SEQ ID NO: 198745 - DNA, 20 bp, Artificial Sequence
  Description of Artificial Sequence: Synthetic oligonucleotide
  Target: ATXN1; (-) strand; PAM type: YTN; PAM sequence: CTT
gggaaatgttgatttatatt

SEQ ID NO: 198746 - DNA, 20 bp, Artificial Sequence
  Description of Artificial Sequence: Synthetic oligonucleotide
  Target: ATXN1; (-) strand; PAM type: YTN; PAM sequence: CTC
cttgggaaatgttgatttat

SEQ ID NO: 198747 - DNA, 20 bp, Artificial Sequence
  Description of Artificial Sequence: Synthetic oligonucleotide
  Target: ATXN1; (-) strand; PAM type: YTN; PAM sequence: TTC
ctccttgggaaatgttgatt

SEQ ID NO: 198748 - DNA, 20 bp, Artificial Sequence
  Description of Artificial Sequence: Synthetic oligonucleotide
  Target: ATXN1; (-) strand; PAM type: YTN; PAM sequence: TTT
cctccttgggaaatgttgat

SEQ ID NO: 198749 - DNA, 20 bp, Artificial Sequence
  Description of Artificial Sequence: Synthetic oligonucleotide
  Target: ATXN1; (-) strand; PAM type: YTN; PAM sequence: TTT
tcctccttgggaaatgttga

SEQ ID NO: 198750 - DNA, 20 bp, Artificial Sequence
  Description of Artificial Sequence: Synthetic oligonucleotide
  Target: ATXN1; (-) strand; PAM type: YTN; PAM sequence: TTT
ttcctccttgggaaatgttg

SEQ ID NO: 198751 - DNA, 20 bp, Artificial Sequence
  Description of Artificial Sequence: Synthetic oligonucleotide
  Target: ATXN1; (-) strand; PAM type: YTN; PAM sequence: CTT
tttcctccttgggaaatgtt

SEQ ID NO: 198752 - DNA, 20 bp, Artificial Sequence
  Description of Artificial Sequence: Synthetic oligonucleotide
  Target: ATXN1; (-) strand; PAM type: YTN; PAM sequence: CTG
cctttttcctccttgggaaa

SEQ ID NO: 198753 - DNA, 20 bp, Artificial Sequence
  Description of Artificial Sequence: Synthetic oligonucleotide
  Target: ATXN1; (-) strand; PAM type: YTN; PAM sequence: TTC
cccaaggggagggcctgcct

SEQ ID NO: 198754 - DNA, 20 bp, Artificial Sequence
  Description of Artificial Sequence: Synthetic oligonucleotide
  Target: ATXN1; (-) strand; PAM type: YTN; PAM sequence: CTT
ccccaaggggagggcctgcc

SEQ ID NO: 198755 - DNA, 20 bp, Artificial Sequence
  Description of Artificial Sequence: Synthetic oligonucleotide
  Target: ATXN1; (-) strand; PAM type: YTN; PAM sequence: CTA
gaacttccccaaggggaggg

SEQ ID NO: 198756 - DNA, 20 bp, Artificial Sequence
  Description of Artificial Sequence: Synthetic oligonucleotide
  Target: ATXN1; (-) strand; PAM type: YTN; PAM sequence: CTG
aaagatgctagaacttcccc

SEQ ID NO: 198757 - DNA, 20 bp, Artificial Sequence
  Description of Artificial Sequence: Synthetic oligonucleotide
  Target: ATXN1; (-) strand; PAM type: YTN; PAM sequence: CTC
tgaaagatgctagaacttcc

SEQ ID NO: 198758 - DNA, 20 bp, Artificial Sequence
  Description of Artificial Sequence: Synthetic oligonucleotide
  Target: ATXN1; (-) strand; PAM type: YTN; PAM sequence: TTC
tctgaaagatgctagaactt

SEQ ID NO: 198759 - DNA, 20 bp, Artificial Sequence
  Description of Artificial Sequence: Synthetic oligonucleotide
  Target: ATXN1; (-) strand; PAM type: YTN; PAM sequence: TTT
ctctgaaagatgctagaact

SEQ ID NO: 198760 - DNA, 20 bp, Artificial Sequence
  Description of Artificial Sequence: Synthetic oligonucleotide
  Target: ATXN1; (-) strand; PAM type: YTN; PAM sequence: CTT
tctctgaaagatgctagaac

SEQ ID NO: 198761 - DNA, 20 bp, Artificial Sequence
  Description of Artificial Sequence: Synthetic oligonucleotide
  Target: ATXN1; (-) strand; PAM type: YTN; PAM sequence: TTC
tttctctgaaagatgctaga

SEQ ID NO: 198762 - DNA, 20 bp, Artificial Sequence
  Description of Artificial Sequence: Synthetic oligonucleotide
  Target: ATXN1; (-) strand; PAM type: YTN; PAM sequence: CTG
ttctttctctgaaagatgct

SEQ ID NO: 198763 - DNA, 20 bp, Artificial Sequence
  Description of Artificial Sequence: Synthetic oligonucleotide
  Target: ATXN1; (-) strand; PAM type: YTN; PAM sequence: TTG
cctgttctttctctgaaaga

SEQ ID NO: 198764 - DNA, 20 bp, Artificial Sequence
  Description of Artificial Sequence: Synthetic oligonucleotide
  Target: ATXN1; (-) strand; PAM type: YTN; PAM sequence: CTT
gcctgttctttctctgaaag

SEQ ID NO: 198765 - DNA, 20 bp, Artificial Sequence
  Description of Artificial Sequence: Synthetic oligonucleotide
  Target: ATXN1; (-) strand; PAM type: YTN; PAM sequence: TTG
ggcttgcctgttctttctct

SEQ ID NO: 198766 - DNA, 20 bp, Artificial Sequence
  Description of Artificial Sequence: Synthetic oligonucleotide
  Target: ATXN1; (-) strand; PAM type: YTN; PAM sequence: CTT
gggcttgcctgttctttctc

SEQ ID NO: 198767 - DNA, 20 bp, Artificial Sequence
  Description of Artificial Sequence: Synthetic oligonucleotide
  Target: ATXN1; (-) strand; PAM type: YTN; PAM sequence: TTC
cttgggcttgcctgttcttt

SEQ ID NO: 198768 - DNA, 20 bp, Artificial Sequence
  Description of Artificial Sequence: Synthetic oligonucleotide
  Target: ATXN1; (-) strand; PAM type: YTN; PAM sequence: TTT
ccttgggcttgcctgttctt

SEQ ID NO: 198769 - DNA, 20 bp, Artificial Sequence
  Description of Artificial Sequence: Synthetic oligonucleotide
  Target: ATXN1; (-) strand; PAM type: YTN; PAM sequence: CTT
tccttgggcttgcctgttct

SEQ ID NO: 198770 - DNA, 20 bp, Artificial Sequence
  Description of Artificial Sequence: Synthetic oligonucleotide
  Target: ATXN1; (-) strand; PAM type: YTN; PAM sequence: TTC
ccactttccttgggcttgcc

SEQ ID NO: 198771 - DNA, 20 bp, Artificial Sequence
  Description of Artificial Sequence: Synthetic oligonucleotide
  Target: ATXN1; (-) strand; PAM type: YTN; PAM sequence: TTT
cccactttccttgggcttgc

SEQ ID NO: 198772 - DNA, 20 bp, Artificial Sequence
  Description of Artificial Sequence: Synthetic oligonucleotide
  Target: ATXN1; (-) strand; PAM type: YTN; PAM sequence: TTT
tcccactttccttgggcttg

SEQ ID NO: 198773 - DNA, 20 bp, Artificial Sequence
  Description of Artificial Sequence: Synthetic oligonucleotide
  Target: ATXN1; (-) strand; PAM type: YTN; PAM sequence: CTT
ttcccactttccttgggctt

SEQ ID NO: 198774 - DNA, 20 bp, Artificial Sequence
  Description of Artificial Sequence: Synthetic oligonucleotide
  Target: ATXN1; (-) strand; PAM type: YTN; PAM sequence: TTC
ccttttcccactttccttgg

SEQ ID NO: 198775 - DNA, 20 bp, Artificial Sequence
  Description of Artificial Sequence: Synthetic oligonucleotide
  Target: ATXN1; (-) strand; PAM type: YTN; PAM sequence: TTT
cccttttcccactttccttg

SEQ ID NO: 198776 - DNA, 20 bp, Artificial Sequence
  Description of Artificial Sequence: Synthetic oligonucleotide
  Target: ATXN1; (-) strand; PAM type: YTN; PAM sequence: TTT
tcccttttcccactttcctt

SEQ ID NO: 198777 - DNA, 20 bp, Artificial Sequence
  Description of Artificial Sequence: Synthetic oligonucleotide
  Target: ATXN1; (-) strand; PAM type: YTN; PAM sequence: CTT
ttcccttttcccactttcct

SEQ ID NO: 198778 - DNA, 20 bp, Artificial Sequence
  Description of Artificial Sequence: Synthetic oligonucleotide
  Target: ATXN1; (-) strand; PAM type: YTN; PAM sequence: TTC
ttttcccttttcccactttc

SEQ ID NO: 198779 - DNA, 20 bp, Artificial Sequence
  Description of Artificial Sequence: Synthetic oligonucleotide
  Target: ATXN1; (-) strand; PAM type: YTN; PAM sequence: TTT
cttttcccttttcccacttt

SEQ ID NO: 198780 - DNA, 20 bp, Artificial Sequence
  Description of Artificial Sequence: Synthetic oligonucleotide
  Target: ATXN1; (-) strand; PAM type: YTN; PAM sequence: TTG
gcaagtccacaacaaagaga

SEQ ID NO: 198781 - DNA, 20 bp, Artificial Sequence
  Description of Artificial Sequence: Synthetic oligonucleotide
  Target: ATXN1; (-) strand; PAM type: YTN; PAM sequence: TTT
ggcaagtccacaacaaagag

SEQ ID NO: 198782 - DNA, 20 bp, Artificial Sequence
  Description of Artificial Sequence: Synthetic oligonucleotide
  Target: ATXN1; (-) strand; PAM type: YTN; PAM sequence: TTC
ggtcagggatttggcaagtc

SEQ ID NO: 198783 - DNA, 20 bp, Artificial Sequence
  Description of Artificial Sequence: Synthetic oligonucleotide
  Target: ATXN1; (-) strand; PAM type: YTN; PAM sequence: CTT
cggtcagggatttggcaagt

SEQ ID NO: 198784 - DNA, 20 bp, Artificial Sequence
  Description of Artificial Sequence: Synthetic oligonucleotide
  Target: ATXN1; (-) strand; PAM type: YTN; PAM sequence: TTG
taagtccacttcggtcaggg

SEQ ID NO: 198785 - DNA, 20 bp, Artificial Sequence
  Description of Artificial Sequence: Synthetic oligonucleotide
  Target: ATXN1; (-) strand; PAM type: YTN; PAM sequence: CTG
ttgtaagtccacttcggtca

SEQ ID NO: 198786 - DNA, 20 bp, Artificial Sequence
  Description of Artificial Sequence: Synthetic oligonucleotide
  Target: ATXN1; (-) strand; PAM type: YTN; PAM sequence: TTC
tgttgtaagtccacttcggt

SEQ ID NO: 198787 - DNA, 20 bp, Artificial Sequence
  Description of Artificial Sequence: Synthetic oligonucleotide
  Target: ATXN1; (-) strand; PAM type: YTN; PAM sequence: TTG
cagttctgttgtaagtccac

SEQ ID NO: 198788 - DNA, 20 bp, Artificial Sequence
  Description of Artificial Sequence: Synthetic oligonucleotide
  Target: ATXN1; (-) strand; PAM type: YTN; PAM sequence: TTT
gcagttctgttgtaagtcca

SEQ ID NO: 198789 - DNA, 20 bp, Artificial Sequence
  Description of Artificial Sequence: Synthetic oligonucleotide
  Target: ATXN1; (-) strand; PAM type: YTN; PAM sequence: TTC
gtgagaatatttgcagttct

SEQ ID NO: 198790 - DNA, 20 bp, Artificial Sequence
  Description of Artificial Sequence: Synthetic oligonucleotide
  Target: ATXN1; (-) strand; PAM type: YTN; PAM sequence: TTT
cgtgagaatatttgcagttc

SEQ ID NO: 198791 - DNA, 20 bp, Artificial Sequence
  Description of Artificial Sequence: Synthetic oligonucleotide
  Target: ATXN1; (-) strand; PAM type: YTN; PAM sequence: CTT
tcgtgagaatatttgcagtt

SEQ ID NO: 198792 - DNA, 20 bp, Artificial Sequence
  Description of Artificial Sequence: Synthetic oligonucleotide
  Target: ATXN1; (-) strand; PAM type: YTN; PAM sequence: TTG
gacactttcgtgagaatatt

SEQ ID NO: 198793 - DNA, 20 bp, Artificial Sequence
  Description of Artificial Sequence: Synthetic oligonucleotide
  Target: ATXN1; (-) strand; PAM type: YTN; PAM sequence: CTT
ggacactttcgtgagaatat

SEQ ID NO: 198794 - DNA, 20 bp, Artificial Sequence
  Description of Artificial Sequence: Synthetic oligonucleotide
  Target: ATXN1; (-) strand; PAM type: YTN; PAM sequence: TTC
caggcttggacactttcgtg

SEQ ID NO: 198795 - DNA, 20 bp, Artificial Sequence
  Description of Artificial Sequence: Synthetic oligonucleotide
  Target: ATXN1; (-) strand; PAM type: YTN; PAM sequence: TTT
ccaggcttggacactttcgt

SEQ ID NO: 198796 - DNA, 20 bp, Artificial Sequence
  Description of Artificial Sequence: Synthetic oligonucleotide
  Target: ATXN1; (-) strand; PAM type: YTN; PAM sequence: TTT
tccaggcttggacactttcg

SEQ ID NO: 198797 - DNA, 20 bp, Artificial Sequence
  Description of Artificial Sequence: Synthetic oligonucleotide
  Target: ATXN1; (-) strand; PAM type: YTN; PAM sequence: TTT
ttccaggcttggacactttc

SEQ ID NO: 198798 - DNA, 20 bp, Artificial Sequence
  Description of Artificial Sequence: Synthetic oligonucleotide
  Target: ATXN1; (-) strand; PAM type: YTN; PAM sequence: TTA
tttttccaggcttggacact

SEQ ID NO: 198799 - DNA, 20 bp, Artificial Sequence
  Description of Artificial Sequence: Synthetic oligonucleotide
  Target: ATXN1; (-) strand; PAM type: YTN; PAM sequence: CTT
atttttccaggcttggacac

SEQ ID NO: 198800 - DNA, 20 bp, Artificial Sequence
  Description of Artificial Sequence: Synthetic oligonucleotide
  Target: ATXN1; (-) strand; PAM type: YTN; PAM sequence: TTC
ttatttttccaggcttggac

SEQ ID NO: 198801 - DNA, 20 bp, Artificial Sequence
  Description of Artificial Sequence: Synthetic oligonucleotide
  Target: ATXN1; (-) strand; PAM type: YTN; PAM sequence: CTT
cttatttttccaggcttgga

SEQ ID NO: 198802 - DNA, 20 bp, Artificial Sequence
  Description of Artificial Sequence: Synthetic oligonucleotide
  Target: ATXN1; (-) strand; PAM type: YTN; PAM sequence: TTG
cttcttatttttccaggctt

SEQ ID NO: 198803 - DNA, 20 bp, Artificial Sequence
  Description of Artificial Sequence: Synthetic oligonucleotide
  Target: ATXN1; (-) strand; PAM type: YTN; PAM sequence: TTT
gcttcttatttttccaggct

SEQ ID NO: 198804 - DNA, 20 bp, Artificial Sequence
  Description of Artificial Sequence: Synthetic oligonucleotide
  Target: ATXN1; (-) strand; PAM type: YTN; PAM sequence: TTA
tttgcttcttatttttccag

SEQ ID NO: 198805 - DNA, 20 bp, Artificial Sequence
  Description of Artificial Sequence: Synthetic oligonucleotide
  Target: ATXN1; (-) strand; PAM type: YTN; PAM sequence: TTT
atttgcttcttatttttcca

SEQ ID NO: 198806 - DNA, 20 bp, Artificial Sequence
  Description of Artificial Sequence: Synthetic oligonucleotide
  Target: ATXN1; (-) strand; PAM type: YTN; PAM sequence: TTT
tatttgcttcttatttttcc

SEQ ID NO: 198807 - DNA, 20 bp, Artificial Sequence
  Description of Artificial Sequence: Synthetic oligonucleotide
  Target: ATXN1; (-) strand; PAM type: YTN; PAM sequence: CTT
ttatttgcttcttatttttc

SEQ ID NO: 198808 - DNA, 20 bp, Artificial Sequence
  Description of Artificial Sequence: Synthetic oligonucleotide
  Target: ATXN1; (-) strand; PAM type: YTN; PAM sequence: TTA
ggcaaaaccttttatttgct

SEQ ID NO: 198809 - DNA, 20 bp, Artificial Sequence
  Description of Artificial Sequence: Synthetic oligonucleotide
  Target: ATXN1; (-) strand; PAM type: YTN; PAM sequence: CTG
ttaggcaaaaccttttattt

SEQ ID NO: 198810 - DNA, 20 bp, Artificial Sequence
  Description of Artificial Sequence: Synthetic oligonucleotide
  Target: ATXN1; (-) strand; PAM type: YTN; PAM sequence: TTC
cgtctgttaggcaaaacctt

SEQ ID NO: 198811 - DNA, 20 bp, Artificial Sequence
  Description of Artificial Sequence: Synthetic oligonucleotide
  Target: ATXN1; (-) strand; PAM type: YTN; PAM sequence: TTT
ccgtctgttaggcaaaacct

SEQ ID NO: 198812 - DNA, 20 bp, Artificial Sequence
  Description of Artificial Sequence: Synthetic oligonucleotide
  Target: ATXN1; (-) strand; PAM type: YTN; PAM sequence: TTG
aacagtatatttccgtctgt

SEQ ID NO: 198813 - DNA, 20 bp, Artificial Sequence
  Description of Artificial Sequence: Synthetic oligonucleotide
  Target: ATXN1; (-) strand; PAM type: YTN; PAM sequence: TTG
gaaggaaaaggagtgcaatt

SEQ ID NO: 198814 - DNA, 20 bp, Artificial Sequence
  Description of Artificial Sequence: Synthetic oligonucleotide
  Target: ATXN1; (-) strand; PAM type: YTN; PAM sequence: TTT
ggaaggaaaaggagtgcaat

SEQ ID NO: 198815 - DNA, 20 bp, Artificial Sequence
  Description of Artificial Sequence: Synthetic oligonucleotide
  Target: ATXN1; (-) strand; PAM type: YTN; PAM sequence: TTA
tgtgcatttggaaggaaaag

SEQ ID NO: 198816 - DNA, 20 bp, Artificial Sequence
  Description of Artificial Sequence: Synthetic oligonucleotide
  Target: ATXN1; (-) strand; PAM type: YTN; PAM sequence: TTT
atgtgcatttggaaggaaaa

SEQ ID NO: 198817 - DNA, 20 bp, Artificial Sequence
  Description of Artificial Sequence: Synthetic oligonucleotide
  Target: ATXN1; (-) strand; PAM type: YTN; PAM sequence: CTT
tatgtgcatttggaaggaaa

SEQ ID NO: 198818 - DNA, 20 bp, Artificial Sequence
  Description of Artificial Sequence: Synthetic oligonucleotide
  Target: ATXN1; (-) strand; PAM type: YTN; PAM sequence: CTG
tatctttatgtgcatttgga

SEQ ID NO: 198819 - DNA, 20 bp, Artificial Sequence
  Description of Artificial Sequence: Synthetic oligonucleotide
  Target: ATXN1; (-) strand; PAM type: YTN; PAM sequence: CTC
cccaaatactgtatctttat

SEQ ID NO: 198820 - DNA, 20 bp, Artificial Sequence
  Description of Artificial Sequence: Synthetic oligonucleotide
  Target: ATXN1; (-) strand; PAM type: YTN; PAM sequence: TTG
ccatcacctccccaaatact

SEQ ID NO: 198821 - DNA, 20 bp, Artificial Sequence
  Description of Artificial Sequence: Synthetic oligonucleotide
  Target: ATXN1; (-) strand; PAM type: YTN; PAM sequence: CTC
attgccatcacctccccaaa

SEQ ID NO: 198822 - DNA, 20 bp, Artificial Sequence
  Description of Artificial Sequence: Synthetic oligonucleotide
  Target: ATXN1; (-) strand; PAM type: YTN; PAM sequence: TTG
tctcattgccatcacctccc

SEQ ID NO: 198823 - DNA, 20 bp, Artificial Sequence
  Description of Artificial Sequence: Synthetic oligonucleotide
  Target: ATXN1; (-) strand; PAM type: YTN; PAM sequence: CTA
attgtctcattgccatcacc

SEQ ID NO: 198824 - DNA, 20 bp, Artificial Sequence
  Description of Artificial Sequence: Synthetic oligonucleotide
  Target: ATXN1; (-) strand; PAM type: YTN; PAM sequence: TTC
taattgtctcattgccatca

SEQ ID NO: 198825 - DNA, 20 bp, Artificial Sequence
  Description of Artificial Sequence: Synthetic oligonucleotide
  Target: ATXN1; (-) strand; PAM type: YTN; PAM sequence: CTG
aaacattctaattgtctcat

SEQ ID NO: 198826 - DNA, 20 bp, Artificial Sequence
  Description of Artificial Sequence: Synthetic oligonucleotide
  Target: ATXN1; (-) strand; PAM type: YTN; PAM sequence: TTC
tgaaacattctaattgtctc

SEQ ID NO: 198827 - DNA, 20 bp, Artificial Sequence
  Description of Artificial Sequence: Synthetic oligonucleotide
  Target: ATXN1; (-) strand; PAM type: YTN; PAM sequence: TTT
ctgaaacattctaattgtct

SEQ ID NO: 198828 - DNA, 20 bp, Artificial Sequence
  Description of Artificial Sequence: Synthetic oligonucleotide
  Target: ATXN1; (-) strand; PAM type: YTN; PAM sequence: TTA
gaatgggatttctgaaacat

SEQ ID NO: 198829 - DNA, 20 bp, Artificial Sequence
  Description of Artificial Sequence: Synthetic oligonucleotide
  Target: ATXN1; (-) strand; PAM type: YTN; PAM sequence: TTT
agaatgggatttctgaaaca

SEQ ID NO: 198830 - DNA, 20 bp, Artificial Sequence
  Description of Artificial Sequence: Synthetic oligonucleotide
  Target: ATXN1; (-) strand; PAM type: YTN; PAM sequence: TTG
gtttagaatgggatttctga

SEQ ID NO: 198831 - DNA, 20 bp, Artificial Sequence
  Description of Artificial Sequence: Synthetic oligonucleotide
  Target: ATXN1; (-) strand; PAM type: YTN; PAM sequence: TTG
gggttggtttagaatgggat

SEQ ID NO: 198832 - DNA, 20 bp, Artificial Sequence
  Description of Artificial Sequence: Synthetic oligonucleotide
  Target: ATXN1; (-) strand; PAM type: YTN; PAM sequence: TTT
ggggttggtttagaatggga

SEQ ID NO: 198833 - DNA, 20 bp, Artificial Sequence
  Description of Artificial Sequence: Synthetic oligonucleotide
  Target: ATXN1; (-) strand; PAM type: YTN; PAM sequence: CTC
agggtttggggttggtttag

SEQ ID NO: 198834 - DNA, 20 bp, Artificial Sequence
  Description of Artificial Sequence: Synthetic oligonucleotide
  Target: ATXN1; (-) strand; PAM type: YTN; PAM sequence: TTG
aaagccaaatctcagggttt

SEQ ID NO: 198835 - DNA, 20 bp, Artificial Sequence
  Description of Artificial Sequence: Synthetic oligonucleotide
  Target: ATXN1; (-) strand; PAM type: YTN; PAM sequence: TTG
aaagcaggtgcattgaaagc

SEQ ID NO: 198836 - DNA, 20 bp, Artificial Sequence
  Description of Artificial Sequence: Synthetic oligonucleotide
  Target: ATXN1; (-) strand; PAM type: YTN; PAM sequence: TTT
gaaagcaggtgcattgaaag

SEQ ID NO: 198837 - DNA, 20 bp, Artificial Sequence
  Description of Artificial Sequence: Synthetic oligonucleotide
  Target: ATXN1; (-) strand; PAM type: YTN; PAM sequence: TTT
tgaaagcaggtgcattgaaa

SEQ ID NO: 198838 - DNA, 20 bp, Artificial Sequence
  Description of Artificial Sequence: Synthetic oligonucleotide
  Target: ATXN1; (-) strand; PAM type: YTN; PAM sequence: CTT
ttgaaagcaggtgcattgaa

SEQ ID NO: 198839 - DNA, 20 bp, Artificial Sequence
  Description of Artificial Sequence: Synthetic oligonucleotide
  Target: ATXN1; (-) strand; PAM type: YTN; PAM sequence: TTG
acttttgaaagcaggtgcat

SEQ ID NO: 198840 - DNA, 20 bp, Artificial Sequence
  Description of Artificial Sequence: Synthetic oligonucleotide
  Target: ATXN1; (-) strand; PAM type: YTN; PAM sequence: TTT
gacttttgaaagcaggtgca

SEQ ID NO: 198841 - DNA, 20 bp, Artificial Sequence
  Description of Artificial Sequence: Synthetic oligonucleotide
  Target: ATXN1; (-) strand; PAM type: YTN; PAM sequence: CTG
gtttgacttttgaaagcagg

SEQ ID NO: 198842 - DNA, 20 bp, Artificial Sequence
  Description of Artificial Sequence: Synthetic oligonucleotide
  Target: ATXN1; (-) strand; PAM type: YTN; PAM sequence: CTC
tggtttgacttttgaaagca

SEQ ID NO: 198843 - DNA, 20 bp, Artificial Sequence
  Description of Artificial Sequence: Synthetic oligonucleotide
  Target: ATXN1; (-) strand; PAM type: YTN; PAM sequence: TTC
ctctggtttgacttttgaaa

SEQ ID NO: 198844 - DNA, 20 bp, Artificial Sequence
  Description of Artificial Sequence: Synthetic oligonucleotide
  Target: ATXN1; (-) strand; PAM type: YTN; PAM sequence: TTT
cctctggtttgacttttgaa

SEQ ID NO: 198845 - DNA, 20 bp, Artificial Sequence
  Description of Artificial Sequence: Synthetic oligonucleotide
  Target: ATXN1; (-) strand; PAM type: YTN; PAM sequence: TTA
aaaatgacaagatttcctct

SEQ ID NO: 198846 - DNA, 20 bp, Artificial Sequence
  Description of Artificial Sequence: Synthetic oligonucleotide
  Target: ATXN1; (-) strand; PAM type: YTN; PAM sequence: CTG
gcggtggatgttaaaaatga

SEQ ID NO: 198847 - DNA, 20 bp, Artificial Sequence
  Description of Artificial Sequence: Synthetic oligonucleotide
  Target: ATXN1; (-) strand; PAM type: YTN; PAM sequence: TTG
ctggcggtggatgttaaaaa

SEQ ID NO: 198848 - DNA, 20 bp, Artificial Sequence
  Description of Artificial Sequence: Synthetic oligonucleotide
  Target: ATXN1; (-) strand; PAM type: YTN; PAM sequence: TTT
gctggcggtggatgttaaaa

SEQ ID NO: 198849 - DNA, 20 bp, Artificial Sequence
  Description of Artificial Sequence: Synthetic oligonucleotide
  Target: ATXN1; (-) strand; PAM type: YTN; PAM sequence: CTC
cacatggtaggcatttgctg

SEQ ID NO: 198850 - DNA, 20 bp, Artificial Sequence
  Description of Artificial Sequence: Synthetic oligonucleotide
  Target: ATXN1; (-) strand; PAM type: YTN; PAM sequence: TTG
tggtgagactccacatggta

SEQ ID NO: 198851 - DNA, 20 bp, Artificial Sequence
  Description of Artificial Sequence: Synthetic oligonucleotide
  Target: ATXN1; (-) strand; PAM type: YTN; PAM sequence: CTT
gtggtgagactccacatggt

SEQ ID NO: 198852 - DNA, 20 bp, Artificial Sequence
  Description of Artificial Sequence: Synthetic oligonucleotide
  Target: ATXN1; (-) strand; PAM type: YTN; PAM sequence: TTG
ggtcttgtggtgagactcca

SEQ ID NO: 198853 - DNA, 20 bp, Artificial Sequence
  Description of Artificial Sequence: Synthetic oligonucleotide
  Target: ATXN1; (-) strand; PAM type: YTN; PAM sequence: CTT
gggtcttgtggtgagactcc

SEQ ID NO: 198854 - DNA, 20 bp, Artificial Sequence
  Description of Artificial Sequence: Synthetic oligonucleotide
  Target: ATXN1; (-) strand; PAM type: YTN; PAM sequence: CTG
gtgcacagcttgggtcttgt

SEQ ID NO: 198855 - DNA, 20 bp, Artificial Sequence
  Description of Artificial Sequence: Synthetic oligonucleotide
  Target: ATXN1; (-) strand; PAM type: YTN; PAM sequence: CTG
acgcctggtgcacagcttgg

SEQ ID NO: 198856 - DNA, 20 bp, Artificial Sequence
  Description of Artificial Sequence: Synthetic oligonucleotide
  Target: ATXN1; (-) strand; PAM type: YTN; PAM sequence: CTC
tgacgcctggtgcacagctt

SEQ ID NO: 198857 - DNA, 20 bp, Artificial Sequence
  Description of Artificial Sequence: Synthetic oligonucleotide
  Target: ATXN1; (-) strand; PAM type: YTN; PAM sequence: CTC
tctgacgcctggtgcacagc

SEQ ID NO: 198858 - DNA, 20 bp, Artificial Sequence
  Description of Artificial Sequence: Synthetic oligonucleotide
  Target: ATXN1; (-) strand; PAM type: YTN; PAM sequence: TTC
tctctgacgcctggtgcaca

SEQ ID NO: 198859 - DNA, 20 bp, Artificial Sequence
  Description of Artificial Sequence: Synthetic oligonucleotide
  Target: ATXN1; (-) strand; PAM type: YTN; PAM sequence: CTT
ctctctgacgcctggtgcac

SEQ ID NO: 198860 - DNA, 20 bp, Artificial Sequence
  Description of Artificial Sequence: Synthetic oligonucleotide
  Target: ATXN1; (-) strand; PAM type: YTN; PAM sequence: CTA
acacaggcaggtagaccatc

SEQ ID NO: 198861 - DNA, 20 bp, Artificial Sequence
  Description of Artificial Sequence: Synthetic oligonucleotide
  Target: ATXN1; (-) strand; PAM type: YTN; PAM sequence: TTG
caaccccaggaaactaacac

SEQ ID NO: 198862 - DNA, 20 bp, Artificial Sequence
  Description of Artificial Sequence: Synthetic oligonucleotide
  Target: ATXN1; (-) strand; PAM type: YTN; PAM sequence: TTA
ttgcaaccccaggaaactaa

SEQ ID NO: 198863 - DNA, 20 bp, Artificial Sequence
  Description of Artificial Sequence: Synthetic oligonucleotide
  Target: ATXN1; (-) strand; PAM type: YTN; PAM sequence: CTG
tgttattgcaaccccaggaa

SEQ ID NO: 198864 - DNA, 20 bp, Artificial Sequence
  Description of Artificial Sequence: Synthetic oligonucleotide
  Target: ATXN1; (-) strand; PAM type: YTN; PAM sequence: CTG
tggtactgtgttattgcaac

SEQ ID NO: 198865 - DNA, 20 bp, Artificial Sequence
  Description of Artificial Sequence: Synthetic oligonucleotide
  Target: ATXN1; (-) strand; PAM type: YTN; PAM sequence: TTG
aagccccccagtctgtggta

SEQ ID NO: 198866 - DNA, 20 bp, Artificial Sequence
  Description of Artificial Sequence: Synthetic oligonucleotide
  Target: ATXN1; (-) strand; PAM type: YTN; PAM sequence: TTG
ttgaagccccccagtctgtg

SEQ ID NO: 198867 - DNA, 20 bp, Artificial Sequence
  Description of Artificial Sequence: Synthetic oligonucleotide
  Target: ATXN1; (-) strand; PAM type: YTN; PAM sequence: CTA
ttgttgaagccccccagtct

SEQ ID NO: 198868 - DNA, 20 bp, Artificial Sequence
  Description of Artificial Sequence: Synthetic oligonucleotide
  Target: ATXN1; (-) strand; PAM type: YTN; PAM sequence: TTC
tattgttgaagccccccagt

SEQ ID NO: 198869 - DNA, 20 bp, Artificial Sequence
  Description of Artificial Sequence: Synthetic oligonucleotide
  Target: ATXN1; (-) strand; PAM type: YTN; PAM sequence: TTT
ctattgttgaagccccccag

SEQ ID NO: 198870 - DNA, 20 bp, Artificial Sequence
  Description of Artificial Sequence: Synthetic oligonucleotide
  Target: ATXN1; (-) strand; PAM type: YTN; PAM sequence: CTG
taagacaatgcatttctatt

SEQ ID NO: 198871 - DNA, 20 bp, Artificial Sequence
  Description of Artificial Sequence: Synthetic oligonucleotide
  Target: ATXN1; (-) strand; PAM type: YTN; PAM sequence: CTC
caggactgtaagacaatgca

SEQ ID NO: 198872 - DNA, 20 bp, Artificial Sequence
  Description of Artificial Sequence: Synthetic oligonucleotide
  Target: ATXN1; (-) strand; PAM type: YTN; PAM sequence: CTA
gcctccaggactgtaagaca

SEQ ID NO: 198873 - DNA, 20 bp, Artificial Sequence
  Description of Artificial Sequence: Synthetic oligonucleotide
  Target: ATXN1; (-) strand; PAM type: YTN; PAM sequence: TTC
tagcctccaggactgtaaga

SEQ ID NO: 198874 - DNA, 20 bp, Artificial Sequence
  Description of Artificial Sequence: Synthetic oligonucleotide
  Target: ATXN1; (-) strand; PAM type: YTN; PAM sequence: TTT
ctagcctccaggactgtaag

SEQ ID NO: 198875 - DNA, 20 bp, Artificial Sequence
  Description of Artificial Sequence: Synthetic oligonucleotide
  Target: ATXN1; (-) strand; PAM type: YTN; PAM sequence: CTC
ggatttctagcctccaggac

SEQ ID NO: 198876 - DNA, 20 bp, Artificial Sequence
  Description of Artificial Sequence: Synthetic oligonucleotide
  Target: ATXN1; (-) strand; PAM type: YTN; PAM sequence: TTG
atctcggatttctagcctcc

SEQ ID NO: 198877 - DNA, 20 bp, Artificial Sequence
  Description of Artificial Sequence: Synthetic oligonucleotide
  Target: ATXN1; (-) strand; PAM type: YTN; PAM sequence: CTT
gatctcggatttctagcctc

SEQ ID NO: 198878 - DNA, 20 bp, Artificial Sequence
  Description of Artificial Sequence: Synthetic oligonucleotide
  Target: ATXN1; (-) strand; PAM type: YTN; PAM sequence: CTG
cagacaccttgatctcggat

SEQ ID NO: 198879 - DNA, 20 bp, Artificial Sequence
  Description of Artificial Sequence: Synthetic oligonucleotide
  Target: ATXN1; (-) strand; PAM type: YTN; PAM sequence: CTG
gaaggaaccagccctgcaga

SEQ ID NO: 198880 - DNA, 20 bp, Artificial Sequence
  Description of Artificial Sequence: Synthetic oligonucleotide
  Target: ATXN1; (-) strand; PAM type: YTN; PAM sequence: CTC
ctggaaggaaccagccctgc

SEQ ID NO: 198881 - DNA, 20 bp, Artificial Sequence
  Description of Artificial Sequence: Synthetic oligonucleotide
  Target: ATXN1; (-) strand; PAM type: YTN; PAM sequence: TTG
cacctcctggaaggaaccag

SEQ ID NO: 198882 - DNA, 20 bp, Artificial Sequence
  Description of Artificial Sequence: Synthetic oligonucleotide
  Target: ATXN1; (-) strand; PAM type: YTN; PAM sequence: TTT
gcacctcctggaaggaacca

SEQ ID NO: 198883 - DNA, 20 bp, Artificial Sequence
  Description of Artificial Sequence: Synthetic oligonucleotide
  Target: ATXN1; (-) strand; PAM type: YTN; PAM sequence: CTT
tgcacctcctggaaggaacc

SEQ ID NO: 198884 - DNA, 20 bp, Artificial Sequence
  Description of Artificial Sequence: Synthetic oligonucleotide
  Target: ATXN1; (-) strand; PAM type: YTN; PAM sequence: CTC
ctttgcacctcctggaagga

SEQ ID NO: 198885 - DNA, 20 bp, Artificial Sequence
  Description of Artificial Sequence: Synthetic oligonucleotide
  Target: ATXN1; (-) strand; PAM type: YTN; PAM sequence: TTC
tcctttgcacctcctggaag

SEQ ID NO: 198886 - DNA, 20 bp, Artificial Sequence
  Description of Artificial Sequence: Synthetic oligonucleotide
  Target: ATXN1; (-) strand; PAM type: YTN; PAM sequence: CTG
ggagaggggcatggaacaga

SEQ ID NO: 198887 - DNA, 20 bp, Artificial Sequence
  Description of Artificial Sequence: Synthetic oligonucleotide
  Target: ATXN1; (-) strand; PAM type: YTN; PAM sequence: CTG
cccaaagccaagaaacacca

SEQ ID NO: 198888 - DNA, 20 bp, Artificial Sequence
  Description of Artificial Sequence: Synthetic oligonucleotide
  Target: ATXN1; (-) strand; PAM type: YTN; PAM sequence: TTA
tgctgcccaaagccaagaaa

SEQ ID NO: 198889 - DNA, 20 bp, Artificial Sequence
  Description of Artificial Sequence: Synthetic oligonucleotide
  Target: ATXN1; (-) strand; PAM type: YTN; PAM sequence: CTG
gagttatgctgcccaaagcc

SEQ ID NO: 198890 - DNA, 20 bp, Artificial Sequence
  Description of Artificial Sequence: Synthetic oligonucleotide
  Target: ATXN1; (-) strand; PAM type: YTN; PAM sequence: TTA
ccgtgtaaagactggagtta

SEQ ID NO: 198891 - DNA, 20 bp, Artificial Sequence
  Description of Artificial Sequence: Synthetic oligonucleotide
  Target: ATXN1; (-) strand; PAM type: YTN; PAM sequence: CTA
ttaccgtgtaaagactggag

SEQ ID NO: 198892 - DNA, 20 bp, Artificial Sequence
  Description of Artificial Sequence: Synthetic oligonucleotide
  Target: ATXN1; (-) strand; PAM type: YTN; PAM sequence: CTG
aggctattaccgtgtaaaga

SEQ ID NO: 198893 - DNA, 20 bp, Artificial Sequence
  Description of Artificial Sequence: Synthetic oligonucleotide
  Target: ATXN1; (-) strand; PAM type: YTN; PAM sequence: CTC
tgaggctattaccgtgtaaa

SEQ ID NO: 198894 - DNA, 20 bp, Artificial Sequence
  Description of Artificial Sequence: Synthetic oligonucleotide
  Target: ATXN1; (-) strand; PAM type: YTN; PAM sequence: CTC
cctctgaggctattaccgtg

SEQ ID NO: 198895 - DNA, 20 bp, Artificial Sequence
  Description of Artificial Sequence: Synthetic oligonucleotide
  Target: ATXN1; (-) strand; PAM type: YTN; PAM sequence: CTC
agagatagcctccctctgag

SEQ ID NO: 198896 - DNA, 20 bp, Artificial Sequence
  Description of Artificial Sequence: Synthetic oligonucleotide
  Target: ATXN1; (-) strand; PAM type: YTN; PAM sequence: TTG
ggctcagagatagcctccct

SEQ ID NO: 198897 - DNA, 20 bp, Artificial Sequence
  Description of Artificial Sequence: Synthetic oligonucleotide
  Target: ATXN1; (-) strand; PAM type: YTN; PAM sequence: CTT
gggctcagagatagcctccc

SEQ ID NO: 198898 - DNA, 20 bp, Artificial Sequence
  Description of Artificial Sequence: Synthetic oligonucleotide
  Target: ATXN1; (-) strand; PAM type: YTN; PAM sequence: TTG
taaaaaggggaaacttgggc

SEQ ID NO: 198899 - DNA, 20 bp, Artificial Sequence
  Description of Artificial Sequence: Synthetic oligonucleotide
  Target: ATXN1; (-) strand; PAM type: YTN; PAM sequence: CTT
gtaaaaaggggaaacttggg

SEQ ID NO: 198900 - DNA, 20 bp, Artificial Sequence
  Description of Artificial Sequence: Synthetic oligonucleotide
  Target: ATXN1; (-) strand; PAM type: YTN; PAM sequence: CTC
cttgtaaaaaggggaaactt

SEQ ID NO: 198901 - DNA, 20 bp, Artificial Sequence
  Description of Artificial Sequence: Synthetic oligonucleotide
  Target: ATXN1; (-) strand; PAM type: YTN; PAM sequence: CTC
atctccttgtaaaaagggga

SEQ ID NO: 198902 - DNA, 20 bp, Artificial Sequence
  Description of Artificial Sequence: Synthetic oligonucleotide
  Target: ATXN1; (-) strand; PAM type: YTN; PAM sequence: CTG
atatgactcatctccttgta

SEQ ID NO: 198903 - DNA, 20 bp, Artificial Sequence
  Description of Artificial Sequence: Synthetic oligonucleotide
  Target: ATXN1; (-) strand; PAM type: YTN; PAM sequence: CTA
atctgatatgactcatctcc

SEQ ID NO: 198904 - DNA, 20 bp, Artificial Sequence
  Description of Artificial Sequence: Synthetic oligonucleotide
  Target: ATXN1; (-) strand; PAM type: YTN; PAM sequence: CTC
taatctgatatgactcatct

SEQ ID NO: 198905 - DNA, 20 bp, Artificial Sequence
  Description of Artificial Sequence: Synthetic oligonucleotide
  Target: ATXN1; (-) strand; PAM type: YTN; PAM sequence: TTA
gagtgggctctaatctgata

SEQ ID NO: 198906 - DNA, 20 bp, Artificial Sequence
  Description of Artificial Sequence: Synthetic oligonucleotide
  Target: ATXN1; (-) strand; PAM type: YTN; PAM sequence: TTA
ttagagtgggctctaatctg

SEQ ID NO: 198907 - DNA, 20 bp, Artificial Sequence
  Description of Artificial Sequence: Synthetic oligonucleotide
  Target: ATXN1; (-) strand; PAM type: YTN; PAM sequence: TTC
agatgaggttattagagtgg

SEQ ID NO: 198908 - DNA, 20 bp, Artificial Sequence
  Description of Artificial Sequence: Synthetic oligonucleotide
  Target: ATXN1; (-) strand; PAM type: YTN; PAM sequence: TTG
catatgaccaagttcagatg

SEQ ID NO: 198909 - DNA, 20 bp, Artificial Sequence
  Description of Artificial Sequence: Synthetic oligonucleotide
  Target: ATXN1; (-) strand; PAM type: YTN; PAM sequence: TTT
gcatatgaccaagttcagat

SEQ ID NO: 198910 - DNA, 20 bp, Artificial Sequence
  Description of Artificial Sequence: Synthetic oligonucleotide
  Target: ATXN1; (-) strand; PAM type: YTN; PAM sequence: TTT
tgcatatgaccaagttcaga

SEQ ID NO: 198911 - DNA, 20 bp, Artificial Sequence
  Description of Artificial Sequence: Synthetic oligonucleotide
  Target: ATXN1; (-) strand; PAM type: YTN; PAM sequence: TTG
gaaggagattttgcatatga

SEQ ID NO: 198912 - DNA, 20 bp, Artificial Sequence
  Description of Artificial Sequence: Synthetic oligonucleotide
  Target: ATXN1; (-) strand; PAM type: YTN; PAM sequence: TTT
ggaaggagattttgcatatg

SEQ ID NO: 198913 - DNA, 20 bp, Artificial Sequence
  Description of Artificial Sequence: Synthetic oligonucleotide
  Target: ATXN1; (-) strand; PAM type: YTN; PAM sequence: TTA
tttggaaggagattttgcat

SEQ ID NO: 198914 - DNA, 20 bp, Artificial Sequence
  Description of Artificial Sequence: Synthetic oligonucleotide
  Target: ATXN1; (-) strand; PAM type: YTN; PAM sequence: TTT
atttggaaggagattttgca

SEQ ID NO: 198915 - DNA, 20 bp, Artificial Sequence
  Description of Artificial Sequence: Synthetic oligonucleotide
  Target: ATXN1; (-) strand; PAM type: YTN; PAM sequence: CTT
tatttggaaggagattttgc

SEQ ID NO: 198916 - DNA, 20 bp, Artificial Sequence
  Description of Artificial Sequence: Synthetic oligonucleotide
  Target: ATXN1; (-) strand; PAM type: YTN; PAM sequence: CTC
ccagtgtccatgaacaatgg

SEQ ID NO: 198917 - DNA, 20 bp, Artificial Sequence
  Description of Artificial Sequence: Synthetic oligonucleotide
  Target: ATXN1; (-) strand; PAM type: YTN; PAM sequence: CTA
aacctcccagtgtccatgaa

SEQ ID NO: 198918 - DNA, 20 bp, Artificial Sequence
  Description of Artificial Sequence: Synthetic oligonucleotide
  Target: ATXN1; (-) strand; PAM type: YTN; PAM sequence: TTG
acaggctaaacctcccagtg

SEQ ID NO: 198919 - DNA, 20 bp, Artificial Sequence
  Description of Artificial Sequence: Synthetic oligonucleotide
  Target: ATXN1; (-) strand; PAM type: YTN; PAM sequence: CTG
tgtcccccaccaaaatgttg

SEQ ID NO: 198920 - DNA, 20 bp, Artificial Sequence
  Description of Artificial Sequence: Synthetic oligonucleotide
  Target: ATXN1; (-) strand; PAM type: YTN; PAM sequence: TTA
aactgtgtcccccaccaaaa

SEQ ID NO: 198921 - DNA, 20 bp, Artificial Sequence
  Description of Artificial Sequence: Synthetic oligonucleotide
  Target: ATXN1; (-) strand; PAM type: YTN; PAM sequence: CTG
tgttaaactgtgtcccccac

SEQ ID NO: 198922 - DNA, 20 bp, Artificial Sequence
  Description of Artificial Sequence: Synthetic oligonucleotide
  Target: ATXN1; (-) strand; PAM type: YTN; PAM sequence: CTG
taggtgaggatgaggaggta

SEQ ID NO: 198923 - DNA, 20 bp, Artificial Sequence
  Description of Artificial Sequence: Synthetic oligonucleotide
  Target: ATXN1; (-) strand; PAM type: YTN; PAM sequence: CTA
cccaacacatgcctgtaggt

SEQ ID NO: 198924 - DNA, 20 bp, Artificial Sequence
  Description of Artificial Sequence: Synthetic oligonucleotide
  Target: ATXN1; (-) strand; PAM type: YTN; PAM sequence: CTC
agagcatagcccaccgctac

SEQ ID NO: 198925 - DNA, 20 bp, Artificial Sequence
  Description of Artificial Sequence: Synthetic oligonucleotide
  Target: ATXN1; (-) strand; PAM type: YTN; PAM sequence: TTC
tcagagcatagcccaccgct

SEQ ID NO: 198926 - DNA, 20 bp, Artificial Sequence
  Description of Artificial Sequence: Synthetic oligonucleotide
  Target: ATXN1; (-) strand; PAM type: YTN; PAM sequence: TTT
ctcagagcatagcccaccgc

SEQ ID NO: 198927 - DNA, 20 bp, Artificial Sequence
  Description of Artificial Sequence: Synthetic oligonucleotide
  Target: ATXN1; (-) strand; PAM type: YTN; PAM sequence: TTC
acacaacagaatcacgtgaa

SEQ ID NO: 198928 - DNA, 20 bp, Artificial Sequence
  Description of Artificial Sequence: Synthetic oligonucleotide
  Target: ATXN1; (-) strand; PAM type: YTN; PAM sequence: CTA
cgatgttcacacaacagaat

SEQ ID NO: 198929 - DNA, 20 bp, Artificial Sequence
  Description of Artificial Sequence: Synthetic oligonucleotide
  Target: ATXN1; (-) strand; PAM type: YTN; PAM sequence: CTC
tacgatgttcacacaacaga

SEQ ID NO: 198930 - DNA, 20 bp, Artificial Sequence
  Description of Artificial Sequence: Synthetic oligonucleotide
  Target: ATXN1; (-) strand; PAM type: YTN; PAM sequence: TTG
tgtgagtagactctacgatg

SEQ ID NO: 198931 - DNA, 20 bp, Artificial Sequence
  Description of Artificial Sequence: Synthetic oligonucleotide
  Target: ATXN1; (-) strand; PAM type: YTN; PAM sequence: TTT
gtgtgagtagactctacgat

SEQ ID NO: 198932 - DNA, 20 bp, Artificial Sequence
  Description of Artificial Sequence: Synthetic oligonucleotide
  Target: ATXN1; (-) strand; PAM type: YTN; PAM sequence: CTA
ggtttgtgtgagtagactct

SEQ ID NO: 198933 - DNA, 20 bp, Artificial Sequence
  Description of Artificial Sequence: Synthetic oligonucleotide
  Target: ATXN1; (-) strand; PAM type: YTN; PAM sequence: CTG
tcccatctaggtttgtgtga

SEQ ID NO: 198934 - DNA, 20 bp, Artificial Sequence
  Description of Artificial Sequence: Synthetic oligonucleotide
  Target: ATXN1; (-) strand; PAM type: YTN; PAM sequence: CTA
gatgtgtagtaggctgtccc

SEQ ID NO: 198935 - DNA, 20 bp, Artificial Sequence
  Description of Artificial Sequence: Synthetic oligonucleotide
  Target: ATXN1; (-) strand; PAM type: YTN; PAM sequence: TTG
taccatgtagcctagatgtg

SEQ ID NO: 198936 - DNA, 20 bp, Artificial Sequence
  Description of Artificial Sequence: Synthetic oligonucleotide
  Target: ATXN1; (-) strand; PAM type: YTN; PAM sequence: TTG
tagccgggaagcaatacatt

SEQ ID NO: 198937 - DNA, 20 bp, Artificial Sequence
  Description of Artificial Sequence: Synthetic oligonucleotide
  Target: ATXN1; (-) strand; PAM type: YTN; PAM sequence: TTT
gtagccgggaagcaatacat

SEQ ID NO: 198938 - DNA, 20 bp, Artificial Sequence
  Description of Artificial Sequence: Synthetic oligonucleotide
  Target: ATXN1; (-) strand; PAM type: YTN; PAM sequence: TTC
agtacagtatcatgcagtgt

SEQ ID NO: 198939 - DNA, 20 bp, Artificial Sequence
  Description of Artificial Sequence: Synthetic oligonucleotide
  Target: ATXN1; (-) strand; PAM type: YTN; PAM sequence: CTG
cagtattcagtacagtatca

SEQ ID NO: 198940 - DNA, 20 bp, Artificial Sequence
  Description of Artificial Sequence: Synthetic oligonucleotide
  Target: ATXN1; (-) strand; PAM type: YTN; PAM sequence: TTG
cctgcagtattcagtacagt

SEQ ID NO: 198941 - DNA, 20 bp, Artificial Sequence
  Description of Artificial Sequence: Synthetic oligonucleotide
  Target: ATXN1; (-) strand; PAM type: YTN; PAM sequence: TTT
gcctgcagtattcagtacag

SEQ ID NO: 198942 - DNA, 20 bp, Artificial Sequence
  Description of Artificial Sequence: Synthetic oligonucleotide
  Target: ATXN1; (-) strand; PAM type: YTN; PAM sequence: TTG
taatacatttgcctgcagta

SEQ ID NO: 198943 - DNA, 20 bp, Artificial Sequence
  Description of Artificial Sequence: Synthetic oligonucleotide
  Target: ATXN1; (-) strand; PAM type: YTN; PAM sequence: TTA
ccattgtaatacatttgcct

SEQ ID NO: 198944 - DNA, 20 bp, Artificial Sequence
  Description of Artificial Sequence: Synthetic oligonucleotide
  Target: ATXN1; (-) strand; PAM type: YTN; PAM sequence: CTT
accattgtaatacatttgcc

SEQ ID NO: 198945 - DNA, 20 bp, Artificial Sequence
  Description of Artificial Sequence: Synthetic oligonucleotide
  Target: ATXN1; (-) strand; PAM type: YTN; PAM sequence: TTG
aatgcacaaatacttaccat

SEQ ID NO: 198946 - DNA, 20 bp, Artificial Sequence
  Description of Artificial Sequence: Synthetic oligonucleotide
  Target: ATXN1; (-) strand; PAM type: YTN; PAM sequence: TTT
gaatgcacaaatacttacca

SEQ ID NO: 198947 - DNA, 20 bp, Artificial Sequence
  Description of Artificial Sequence: Synthetic oligonucleotide
  Target: ATXN1; (-) strand; PAM type: YTN; PAM sequence: TTA
ggtatgtttgaatgcacaaa

SEQ ID NO: 198948 - DNA, 20 bp, Artificial Sequence
  Description of Artificial Sequence: Synthetic oligonucleotide
  Target: ATXN1; (-) strand; PAM type: YTN; PAM sequence: TTT
aggtatgtttgaatgcacaa

SEQ ID NO: 198949 - DNA, 20 bp, Artificial Sequence
  Description of Artificial Sequence: Synthetic oligonucleotide
  Target: ATXN1; (-) strand; PAM type: YTN; PAM sequence: CTA
tatttaggtatgtttgaatg

SEQ ID NO: 198950 - DNA, 20 bp, Artificial Sequence
  Description of Artificial Sequence: Synthetic oligonucleotide
  Target: ATXN1; (-) strand; PAM type: YTN; PAM sequence: TTC
tatatttaggtatgtttgaa

SEQ ID NO: 198951 - DNA, 20 bp, Artificial Sequence
  Description of Artificial Sequence: Synthetic oligonucleotide
  Target: ATXN1; (-) strand; PAM type: YTN; PAM sequence: TTT
ctatatttaggtatgtttga

SEQ ID NO: 198952 - DNA, 20 bp, Artificial Sequence
  Description of Artificial Sequence: Synthetic oligonucleotide
  Target: ATXN1; (-) strand; PAM type: YTN; PAM sequence: TTT
tctatatttaggtatgtttg

SEQ ID NO: 198953 - DNA, 20 bp, Artificial Sequence
  Description of Artificial Sequence: Synthetic oligonucleotide
  Target: ATXN1; (-) strand; PAM type: YTN; PAM sequence: CTT
ttctatatttaggtatgttt

SEQ ID NO: 198954 - DNA, 20 bp, Artificial Sequence
  Description of Artificial Sequence: Synthetic oligonucleotide
  Target: ATXN1; (-) strand; PAM type: YTN; PAM sequence: CTG
tatcttttctatatttaggt

SEQ ID NO: 198955 - DNA, 20 bp, Artificial Sequence
  Description of Artificial Sequence: Synthetic oligonucleotide
  Target: ATXN1; (-) strand; PAM type: YTN; PAM sequence: TTG
actgtatcttttctatattt

SEQ ID NO: 198956 - DNA, 20 bp, Artificial Sequence
  Description of Artificial Sequence: Synthetic oligonucleotide
  Target: ATXN1; (-) strand; PAM type: YTN; PAM sequence: TTT
gactgtatcttttctatatt

SEQ ID NO: 198957 - DNA, 20 bp, Artificial Sequence
  Description of Artificial Sequence: Synthetic oligonucleotide
  Target: ATXN1; (-) strand; PAM type: YTN; PAM sequence: TTT
tgactgtatcttttctatat

SEQ ID NO: 198958 - DNA, 20 bp, Artificial Sequence
  Description of Artificial Sequence: Synthetic oligonucleotide
  Target: ATXN1; (-) strand; PAM type: YTN; PAM sequence: TTC
attttgactgtatcttttct

SEQ ID NO: 198959 - DNA, 20 bp, Artificial Sequence
  Description of Artificial Sequence: Synthetic oligonucleotide
  Target: ATXN1; (-) strand; PAM type: YTN; PAM sequence: CTT
cattttgactgtatcttttc

SEQ ID NO: 198960 - DNA, 20 bp, Artificial Sequence
  Description of Artificial Sequence: Synthetic oligonucleotide
  Target: ATXN1; (-) strand; PAM type: YTN; PAM sequence: CTG
cttcattttgactgtatctt

SEQ ID NO: 198961 - DNA, 20 bp, Artificial Sequence
  Description of Artificial Sequence: Synthetic oligonucleotide
  Target: ATXN1; (-) strand; PAM type: YTN; PAM sequence: TTC
tgcttcattttgactgtatc

SEQ ID NO: 198962 - DNA, 20 bp, Artificial Sequence
  Description of Artificial Sequence: Synthetic oligonucleotide
  Target: ATXN1; (-) strand; PAM type: YTN; PAM sequence: TTT
ctgcttcattttgactgtat

SEQ ID NO: 198963 - DNA, 20 bp, Artificial Sequence
  Description of Artificial Sequence: Synthetic oligonucleotide
  Target: ATXN1; (-) strand; PAM type: YTN; PAM sequence: TTT
tctgcttcattttgactgta

SEQ ID NO: 198964 - DNA, 20 bp, Artificial Sequence
  Description of Artificial Sequence: Synthetic oligonucleotide
  Target: ATXN1; (-) strand; PAM type: YTN; PAM sequence: CTT
ttctgcttcattttgactgt

SEQ ID NO: 198965 - DNA, 20 bp, Artificial Sequence
  Description of Artificial Sequence: Synthetic oligonucleotide
  Target: ATXN1; (-) strand; PAM type: YTN; PAM sequence: TTA
tcttttctgcttcattttga

SEQ ID NO: 198966 - DNA, 20 bp, Artificial Sequence
  Description of Artificial Sequence: Synthetic oligonucleotide
  Target: ATXN1; (-) strand; PAM type: YTN; PAM sequence: TTT
atcttttctgcttcattttg

SEQ ID NO: 198967 - DNA, 20 bp, Artificial Sequence
  Description of Artificial Sequence: Synthetic oligonucleotide
  Target: ATXN1; (-) strand; PAM type: YTN; PAM sequence: TTT
tatcttttctgcttcatttt

SEQ ID NO: 198968 - DNA, 20 bp, Artificial Sequence
  Description of Artificial Sequence: Synthetic oligonucleotide
  Target: ATXN1; (-) strand; PAM type: YTN; PAM sequence: CTA
tacaggtgtaccatatttta

SEQ ID NO: 198969 - DNA, 20 bp, Artificial Sequence
  Description of Artificial Sequence: Synthetic oligonucleotide
  Target: ATXN1; (-) strand; PAM type: YTN; PAM sequence: TTC
atgggaagtgccctatacag

SEQ ID NO: 198970 - DNA, 20 bp, Artificial Sequence
  Description of Artificial Sequence: Synthetic oligonucleotide
  Target: ATXN1; (-) strand; PAM type: YTN; PAM sequence: CTC
cattcatgggaagtgcccta

SEQ ID NO: 198971 - DNA, 20 bp, Artificial Sequence
  Description of Artificial Sequence: Synthetic oligonucleotide
  Target: ATXN1; (-) strand; PAM type: YTN; PAM sequence: CTG
caagctccattcatgggaag

SEQ ID NO: 198972 - DNA, 20 bp, Artificial Sequence
  Description of Artificial Sequence: Synthetic oligonucleotide
  Target: ATXN1; (-) strand; PAM type: YTN; PAM sequence: TTC
caatcctgcaagctccattc

SEQ ID NO: 198973 - DNA, 20 bp, Artificial Sequence
  Description of Artificial Sequence: Synthetic oligonucleotide
  Target: ATXN1; (-) strand; PAM type: YTN; PAM sequence: CTT
ccaatcctgcaagctccatt

SEQ ID NO: 198974 - DNA, 20 bp, Artificial Sequence
  Description of Artificial Sequence: Synthetic oligonucleotide
  Target: ATXN1; (-) strand; PAM type: YTN; PAM sequence: CTC
acccagagcaacttccaatc

SEQ ID NO: 198975 - DNA, 20 bp, Artificial Sequence
  Description of Artificial Sequence: Synthetic oligonucleotide
  Target: ATXN1; (-) strand; PAM type: YTN; PAM sequence: CTG
actcacccagagcaacttcc

SEQ ID NO: 198976 - DNA, 20 bp, Artificial Sequence
  Description of Artificial Sequence: Synthetic oligonucleotide
  Target: ATXN1; (-) strand; PAM type: YTN; PAM sequence: CTC
actgactcacccagagcaac

SEQ ID NO: 198977 - DNA, 20 bp, Artificial Sequence
  Description of Artificial Sequence: Synthetic oligonucleotide
  Target: ATXN1; (-) strand; PAM type: YTN; PAM sequence: CTC
accacccactcactgactca

SEQ ID NO: 198978 - DNA, 20 bp, Artificial Sequence
  Description of Artificial Sequence: Synthetic oligonucleotide
  Target: ATXN1; (-) strand; PAM type: YTN; PAM sequence: TTC
gctcaccacccactcactga

SEQ ID NO: 198979 - DNA, 20 bp, Artificial Sequence
  Description of Artificial Sequence: Synthetic oligonucleotide
  Target: ATXN1; (-) strand; PAM type: YTN; PAM sequence: TTC
acattcgctcaccacccact

SEQ ID NO: 198980 - DNA, 20 bp, Artificial Sequence
  Description of Artificial Sequence: Synthetic oligonucleotide
  Target: ATXN1; (-) strand; PAM type: YTN; PAM sequence: CTT
cacattcgctcaccacccac

SEQ ID NO: 198981 - DNA, 20 bp, Artificial Sequence
  Description of Artificial Sequence: Synthetic oligonucleotide
  Target: ATXN1; (-) strand; PAM type: YTN; PAM sequence: CTA
ggccttcacattcgctcacc

SEQ ID NO: 198982 - DNA, 20 bp, Artificial Sequence
  Description of Artificial Sequence: Synthetic oligonucleotide
  Target: ATXN1; (-) strand; PAM type: YTN; PAM sequence: CTG
cagtagtgtacagtaatgtc

SEQ ID NO: 198983 - DNA, 20 bp, Artificial Sequence
  Description of Artificial Sequence: Synthetic oligonucleotide
  Target: ATXN1; (-) strand; PAM type: YTN; PAM sequence: TTA
taaagtctgcagtagtgtac

SEQ ID NO: 198984 - DNA, 20 bp, Artificial Sequence
  Description of Artificial Sequence: Synthetic oligonucleotide
  Target: ATXN1; (-) strand; PAM type: YTN; PAM sequence: TTT
ataaagtctgcagtagtgta

SEQ ID NO: 198985 - DNA, 20 bp, Artificial Sequence
  Description of Artificial Sequence: Synthetic oligonucleotide
  Target: ATXN1; (-) strand; PAM type: YTN; PAM sequence: CTA
agtgtatacagtgtttataa

SEQ ID NO: 198986 - DNA, 20 bp, Artificial Sequence
  Description of Artificial Sequence: Synthetic oligonucleotide
  Target: ATXN1; (-) strand; PAM type: YTN; PAM sequence: TTG
gtgcagcctaagtgtataca

SEQ ID NO: 198987 - DNA, 20 bp, Artificial Sequence
  Description of Artificial Sequence: Synthetic oligonucleotide
  Target: ATXN1; (-) strand; PAM type: YTN; PAM sequence: TTT
ggtgcagcctaagtgtatac

SEQ ID NO: 198988 - DNA, 20 bp, Artificial Sequence
  Description of Artificial Sequence: Synthetic oligonucleotide
  Target: ATXN1; (-) strand; PAM type: YTN; PAM sequence: TTC
aaaaataaatttggtgcagc

SEQ ID NO: 198989 - DNA, 20 bp, Artificial Sequence
  Description of Artificial Sequence: Synthetic oligonucleotide
  Target: ATXN1; (-) strand; PAM type: YTN; PAM sequence: TTT
caaaaataaatttggtgcag

SEQ ID NO: 198990 - DNA, 20 bp, Artificial Sequence
  Description of Artificial Sequence: Synthetic oligonucleotide
  Target: ATXN1; (-) strand; PAM type: YTN; PAM sequence: TTG
aagaaagaaatttcaaaaat

SEQ ID NO: 198991 - DNA, 20 bp, Artificial Sequence
  Description of Artificial Sequence: Synthetic oligonucleotide
  Target: ATXN1; (-) strand; PAM type: YTN; PAM sequence: TTA
ttgaagaaagaaatttcaaa

SEQ ID NO: 198992 - DNA, 20 bp, Artificial Sequence
  Description of Artificial Sequence: Synthetic oligonucleotide
  Target: ATXN1; (-) strand; PAM type: YTN; PAM sequence: TTA
ttattgaagaaagaaatttc

SEQ ID NO: 198993 - DNA, 20 bp, Artificial Sequence
  Description of Artificial Sequence: Synthetic oligonucleotide
  Target: ATXN1; (-) strand; PAM type: YTN; PAM sequence: TTT
attattgaagaaagaaattt

SEQ ID NO: 198994 - DNA, 20 bp, Artificial Sequence
  Description of Artificial Sequence: Synthetic oligonucleotide
  Target: ATXN1; (-) strand; PAM type: YTN; PAM sequence: TTA
atttattattgaagaaagaa

SEQ ID NO: 198995 - DNA, 20 bp, Artificial Sequence
  Description of Artificial Sequence: Synthetic oligonucleotide
  Target: ATXN1; (-) strand; PAM type: YTN; PAM sequence: TTT
aatttattattgaagaaaga

SEQ ID NO: 198996 - DNA, 20 bp, Artificial Sequence
  Description of Artificial Sequence: Synthetic oligonucleotide
  Target: ATXN1; (-) strand; PAM type: YTN; PAM sequence: CTA
agtttaatttattattgaag

SEQ ID NO: 198997 - DNA, 20 bp, Artificial Sequence
  Description of Artificial Sequence: Synthetic oligonucleotide
  Target: ATXN1; (-) strand; PAM type: YTN; PAM sequence: TTA
cagtaagctaagtttaattt

SEQ ID NO: 198998 - DNA, 20 bp, Artificial Sequence
  Description of Artificial Sequence: Synthetic oligonucleotide
  Target: ATXN1; (-) strand; PAM type: YTN; PAM sequence: TTA
taaagtaaaaaagttacagt

SEQ ID NO: 198999 - DNA, 20 bp, Artificial Sequence
  Description of Artificial Sequence: Synthetic oligonucleotide
  Target: ATXN1; (-) strand; PAM type: YTN; PAM sequence: TTT
ataaagtaaaaaagttacag

SEQ ID NO: 199000 - DNA, 20 bp, Artificial Sequence
  Description of Artificial Sequence: Synthetic oligonucleotide
  Target: ATXN1; (-) strand; PAM type: YTN; PAM sequence: TTA
aataatgtgtttataaagta

SEQ ID NO: 199001 - DNA, 20 bp, Artificial Sequence
  Description of Artificial Sequence: Synthetic oligonucleotide
  Target: ATXN1; (-) strand; PAM type: YTN; PAM sequence: TTT
aaataatgtgtttataaagt

SEQ ID NO: 199002 - DNA, 20 bp, Artificial Sequence
  Description of Artificial Sequence: Synthetic oligonucleotide
  Target: ATXN1; (-) strand; PAM type: YTN; PAM sequence: TTT
taaataatgtgtttataaag

SEQ ID NO: 199003 - DNA, 20 bp, Artificial Sequence
  Description of Artificial Sequence: Synthetic oligonucleotide
  Target: ATXN1; (-) strand; PAM type: YTN; PAM sequence: TTA
caagagtcgaaaagttttaa

SEQ ID NO: 199004 - DNA, 20 bp, Artificial Sequence
  Description of Artificial Sequence: Synthetic oligonucleotide
  Target: ATXN1; (-) strand; PAM type: YTN; PAM sequence: TTA
ttacaagagtcgaaaagttt

SEQ ID NO: 199005 - DNA, 20 bp, Artificial Sequence
  Description of Artificial Sequence: Synthetic oligonucleotide
  Target: ATXN1; (-) strand; PAM type: YTN; PAM sequence: CTA
agtattattacaagagtcga

SEQ ID NO: 199006 - DNA, 20 bp, Artificial Sequence
  Description of Artificial Sequence: Synthetic oligonucleotide
  Target: ATXN1; (-) strand; PAM type: YTN; PAM sequence: TTA
agctaagtattattacaaga

SEQ ID NO: 199007 - DNA, 20 bp, Artificial Sequence
  Description of Artificial Sequence: Synthetic oligonucleotide
  Target: ATXN1; (-) strand; PAM type: YTN; PAM sequence: TTT
aagctaagtattattacaag

SEQ ID NO: 199008 - DNA, 20 bp, Artificial Sequence
  Description of Artificial Sequence: Synthetic oligonucleotide
  Target: ATXN1; (-) strand; PAM type: YTN; PAM sequence: TTT
taagctaagtattattacaa

SEQ ID NO: 199009 - DNA, 20 bp, Artificial Sequence
  Description of Artificial Sequence: Synthetic oligonucleotide
  Target: ATXN1; (-) strand; PAM type: YTN; PAM sequence: TTA
aagtggatgatgttttaagc

SEQ ID NO: 199010 - DNA, 20 bp, Artificial Sequence
  Description of Artificial Sequence: Synthetic oligonucleotide
  Target: ATXN1; (-) strand; PAM type: YTN; PAM sequence: TTT
aaagtggatgatgttttaag

SEQ ID NO: 199011 - DNA, 20 bp, Artificial Sequence
  Description of Artificial Sequence: Synthetic oligonucleotide
  Target: ATXN1; (-) strand; PAM type: YTN; PAM sequence: CTT
taaagtggatgatgttttaa

SEQ ID NO: 199012 - DNA, 20 bp, Artificial Sequence
  Description of Artificial Sequence: Synthetic oligonucleotide
  Target: ATXN1; (-) strand; PAM type: YTN; PAM sequence: TTC
gtacaactttaaagtggatg

SEQ ID NO: 199013 - DNA, 20 bp, Artificial Sequence
  Description of Artificial Sequence: Synthetic oligonucleotide
  Target: ATXN1; (-) strand; PAM type: YTN; PAM sequence: TTT
cgtacaactttaaagtggat

SEQ ID NO: 199014 - DNA, 20 bp, Artificial Sequence
  Description of Artificial Sequence: Synthetic oligonucleotide
  Target: ATXN1; (-) strand; PAM type: YTN; PAM sequence: TTT
tcgtacaactttaaagtgga

SEQ ID NO: 199015 - DNA, 20 bp, Artificial Sequence
  Description of Artificial Sequence: Synthetic oligonucleotide
  Target: ATXN1; (-) strand; PAM type: YTN; PAM sequence: TTG
aataaagatataaaagaaga

SEQ ID NO: 199016 - DNA, 20 bp, Artificial Sequence
  Description of Artificial Sequence: Synthetic oligonucleotide
  Target: ATXN1; (-) strand; PAM type: YTN; PAM sequence: TTA
ttgaataaagatataaaaga

SEQ ID NO: 199017 - DNA, 20 bp, Artificial Sequence
  Description of Artificial Sequence: Synthetic oligonucleotide
  Target: ATXN1; (-) strand; PAM type: YTN; PAM sequence: TTT
attgaataaagatataaaag

SEQ ID NO: 199018 - DNA, 20 bp, Artificial Sequence
  Description of Artificial Sequence: Synthetic oligonucleotide
  Target: ATXN1; (-) strand; PAM type: YTN; PAM sequence: TTA
aaaatgaaaatagaaaaatg

SEQ ID NO: 199019 - DNA, 20 bp, Artificial Sequence
  Description of Artificial Sequence: Synthetic oligonucleotide
  Target: ATXN1; (-) strand; PAM type: YTN; PAM sequence: TTT
aaaaatgaaaatagaaaaat

SEQ ID NO: 199020 - DNA, 20 bp, Artificial Sequence
  Description of Artificial Sequence: Synthetic oligonucleotide
  Target: ATXN1; (-) strand; PAM type: YTN; PAM sequence: TTT
taaaaatgaaaatagaaaaa

SEQ ID NO: 199021 - DNA, 20 bp, Artificial Sequence
  Description of Artificial Sequence: Synthetic oligonucleotide
  Target: ATXN1; (-) strand; PAM type: YTN; PAM sequence: TTT
ttaaaaatgaaaatagaaaa

SEQ ID NO: 199022 - DNA, 20 bp, Artificial Sequence
  Description of Artificial Sequence: Synthetic oligonucleotide
  Target: ATXN1; (-) strand; PAM type: YTN; PAM sequence: TTT
tttaaaaatgaaaatagaaa

SEQ ID NO: 199023 - DNA, 20 bp, Artificial Sequence
  Description of Artificial Sequence: Synthetic oligonucleotide
  Target: ATXN1; (-) strand; PAM type: YTN; PAM sequence: TTA
aaattttttaaaaatgaaaa

SEQ ID NO: 199024 - DNA, 20 bp, Artificial Sequence
  Description of Artificial Sequence: Synthetic oligonucleotide
  Target: ATXN1; (-) strand; PAM type: YTN; PAM sequence: TTT
aaaattttttaaaaatgaaa

SEQ ID NO: 199025 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaagtttaaaattt

SEQ ID NO: 199026 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaaaagtttaaaatt

SEQ ID NO: 199027 - DNA, 20 bp, Artificial Sequence
  Description of Artificial Sequence: Synthetic oligonucleotide
  Target: ATXN1; (-) strand; PAM type: YTN; PAM sequence: TTT
taaaaaaaaaagtttaaaat

SEQ ID NO: 199028 - DNA, 20 bp, Artificial Sequence
  Description of Artificial Sequence: Synthetic oligonucleotide
  Target: ATXN1; (-) strand; PAM type: YTN; PAM sequence: TTG
ttttaaaaaaaaaagtttaa

SEQ ID NO: 199029 - DNA, 20 bp, Artificial Sequence
  Description of Artificial Sequence: Synthetic oligonucleotide
  Target: ATXN1; (-) strand; PAM type: YTN; PAM sequence: TTA
gtattgttttaaaaaaaaaa

SEQ ID NO: 199030 - DNA, 20 bp, Artificial Sequence
  Description of Artificial Sequence: Synthetic oligonucleotide
  Target: ATXN1; (-) strand; PAM type: YTN; PAM sequence: CTT
agtattgttttaaaaaaaaa

SEQ ID NO: 199031 - DNA, 20 bp, Artificial Sequence
  Description of Artificial Sequence: Synthetic oligonucleotide
  Target: ATXN1; (-) strand; PAM type: YTN; PAM sequence: CTG
ccttagtattgttttaaaaa

SEQ ID NO: 199032 - DNA, 20 bp, Artificial Sequence
  Description of Artificial Sequence: Synthetic oligonucleotide
  Target: ATXN1; (-) strand; PAM type: YTN; PAM sequence: CTC
ctgccttagtattgttttaa

SEQ ID NO: 199033 - DNA, 20 bp, Artificial Sequence
  Description of Artificial Sequence: Synthetic oligonucleotide
  Target: ATXN1; (-) strand; PAM type: YTN; PAM sequence: CTG
ctcctgccttagtattgttt

SEQ ID NO: 199034 - DNA, 20 bp, Artificial Sequence
  Description of Artificial Sequence: Synthetic oligonucleotide
  Target: ATXN1; (-) strand; PAM type: YTN; PAM sequence: TTA
caggtgtgcaccactgctcc

SEQ ID NO: 199035 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgcaccac

SEQ ID NO: 199036 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 199037 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 199038 - DNA, 20 bp, Artificial Sequence
  Description of Artificial Sequence: Synthetic oligonucleotide
  Target: ATXN1; (-) strand; PAM type: YTN; PAM sequence: CTC
aagcaatccacccgcctcgg

SEQ ID NO: 199039 - DNA, 20 bp, Artificial Sequence
  Description of Artificial Sequence: Synthetic oligonucleotide
  Target: ATXN1; (-) strand; PAM type: YTN; PAM sequence: CTG
gcctcaagcaatccacccgc

SEQ ID NO: 199040 - DNA, 20 bp, Artificial Sequence
  Description of Artificial Sequence: Synthetic oligonucleotide
  Target: ATXN1; (-) strand; PAM type: YTN; PAM sequence: CTC
ctggcctcaagcaatccacc

SEQ ID NO: 199041 - DNA, 20 bp, Artificial Sequence
  Description of Artificial Sequence: Synthetic oligonucleotide
  Target: ATXN1; (-) strand; PAM type: YTN; PAM sequence: CTC
aaactcctggcctcaagcaa

SEQ ID NO: 199042 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcctggcctca

SEQ ID NO: 199043 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtctcaaactc

SEQ ID NO: 199044 - DNA, 20 bp, Artificial Sequence
  Description of Artificial Sequence: Synthetic oligonucleotide
  Target: ATXN1; (-) strand; PAM type: YTN; PAM sequence: CTG
ttggtcaggctggtctcaaa

SEQ ID NO: 199045 - DNA, 20 bp, Artificial Sequence
  Description of Artificial Sequence: Synthetic oligonucleotide
  Target: ATXN1; (-) strand; PAM type: YTN; PAM sequence: CTC
tgttggtcaggctggtctca

SEQ ID NO: 199046 - DNA, 20 bp, Artificial Sequence
  Description of Artificial Sequence: Synthetic oligonucleotide
  Target: ATXN1; (-) strand; PAM type: YTN; PAM sequence: TTA
ctctgttggtcaggctggtc

SEQ ID NO: 199047 - DNA, 20 bp, Artificial Sequence
  Description of Artificial Sequence: Synthetic oligonucleotide
  Target: ATXN1; (-) strand; PAM type: YTN; PAM sequence: TTT
actctgttggtcaggctggt

SEQ ID NO: 199048 - DNA, 20 bp, Artificial Sequence
  Description of Artificial Sequence: Synthetic oligonucleotide
  Target: ATXN1; (-) strand; PAM type: YTN; PAM sequence: TTT
tactctgttggtcaggctgg

SEQ ID NO: 199049 - DNA, 20 bp, Artificial Sequence
  Description of Artificial Sequence: Synthetic oligonucleotide
  Target: ATXN1; (-) strand; PAM type: YTN; PAM sequence: TTA
gcagagacggagttttactc

SEQ ID NO: 199050 - DNA, 20 bp, Artificial Sequence
  Description of Artificial Sequence: Synthetic oligonucleotide
  Target: ATXN1; (-) strand; PAM type: YTN; PAM sequence: TTT
agcagagacggagttttact

SEQ ID NO: 199051 - DNA, 20 bp, Artificial Sequence
  Description of Artificial Sequence: Synthetic oligonucleotide
  Target: ATXN1; (-) strand; PAM type: YTN; PAM sequence: TTT
tagcagagacggagttttac

SEQ ID NO: 199052 - DNA, 20 bp, Artificial Sequence
  Description of Artificial Sequence: Synthetic oligonucleotide
  Target: ATXN1; (-) strand; PAM type: YTN; PAM sequence: TTT
ttagcagagacggagtttta

SEQ ID NO: 199053 - DNA, 20 bp, Artificial Sequence
  Description of Artificial Sequence: Synthetic oligonucleotide
  Target: ATXN1; (-) strand; PAM type: YTN; PAM sequence: TTG
tatttttagcagagacggag

SEQ ID NO: 199054 - DNA, 20 bp, Artificial Sequence
  Description of Artificial Sequence: Synthetic oligonucleotide
  Target: ATXN1; (-) strand; PAM type: YTN; PAM sequence: TTT
gtatttttagcagagacgga

SEQ ID NO: 199055 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagcagagacgg

SEQ ID NO: 199056 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagcagagacg

SEQ ID NO: 199057 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagcaga

SEQ ID NO: 199058 - DNA, 20 bp, Artificial Sequence
  Description of Artificial Sequence: Synthetic oligonucleotide
  Target: ATXN1; (-) strand; PAM type: YTN; PAM sequence: TTA
caggcatgcaccaccacgcc

SEQ ID NO: 199059 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgcaccac

SEQ ID NO: 199060 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattacaggca

SEQ ID NO: 199061 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggattacag

SEQ ID NO: 199062 - DNA, 20 bp, Artificial Sequence
  Description of Artificial Sequence: Synthetic oligonucleotide
  Target: ATXN1; (-) strand; PAM type: YTN; PAM sequence: CTC
agcctcctgagtagctggga

SEQ ID NO: 199063 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcctgagtagct

SEQ ID NO: 199064 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcctgagta

SEQ ID NO: 199065 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcctgag

SEQ ID NO: 199066 - DNA, 20 bp, Artificial Sequence
  Description of Artificial Sequence: Synthetic oligonucleotide
  Target: ATXN1; (-) strand; PAM type: YTN; PAM sequence: TTC
aagccattctcctgcctcag

SEQ ID NO: 199067 - DNA, 20 bp, Artificial Sequence
  Description of Artificial Sequence: Synthetic oligonucleotide
  Target: ATXN1; (-) strand; PAM type: YTN; PAM sequence: CTG
ggttcaagccattctcctgc

SEQ ID NO: 199068 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagccattctcc

SEQ ID NO: 199069 - DNA, 20 bp, Artificial Sequence
  Description of Artificial Sequence: Synthetic oligonucleotide
  Target: ATXN1; (-) strand; PAM type: YTN; PAM sequence: CTG
cctcctgggttcaagccatt

SEQ ID NO: 199070 - DNA, 20 bp, Artificial Sequence
  Description of Artificial Sequence: Synthetic oligonucleotide
  Target: ATXN1; (-) strand; PAM type: YTN; PAM sequence: CTC
tgcctcctgggttcaagcca

SEQ ID NO: 199071 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcctgggtt

SEQ ID NO: 199072 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctcctg

SEQ ID NO: 199073 - DNA, 20 bp, Artificial Sequence
  Description of Artificial Sequence: Synthetic oligonucleotide
  Target: ATXN1; (-) strand; PAM type: YTN; PAM sequence: CTG
ctcactgcaacctctgcctc

SEQ ID NO: 199074 - DNA, 20 bp, Artificial Sequence
  Description of Artificial Sequence: Synthetic oligonucleotide
  Target: ATXN1; (-) strand; PAM type: YTN; PAM sequence: CTC
tgctcactgcaacctctgcc

SEQ ID NO: 199075 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcaatctc

SEQ ID NO: 199076 - DNA, 20 bp, Artificial Sequence
  Description of Artificial Sequence: Synthetic oligonucleotide
  Target: ATXN1; (-) strand; PAM type: YTN; PAM sequence: TTG
tcgcccaggctggagtgcag

SEQ ID NO: 199077 - DNA, 20 bp, Artificial Sequence
  Description of Artificial Sequence: Synthetic oligonucleotide
  Target: ATXN1; (-) strand; PAM type: YTN; PAM sequence: TTT
gtcgcccaggctggagtgca

SEQ ID NO: 199078 - DNA, 20 bp, Artificial Sequence
  Description of Artificial Sequence: Synthetic oligonucleotide
  Target: ATXN1; (-) strand; PAM type: YTN; PAM sequence: CTT
tgtcgcccaggctggagtgc

SEQ ID NO: 199079 - DNA, 20 bp, Artificial Sequence
  Description of Artificial Sequence: Synthetic oligonucleotide
  Target: ATXN1; (-) strand; PAM type: YTN; PAM sequence: TTA
ctttgtcgcccaggctggag

SEQ ID NO: 199080 - DNA, 20 bp, Artificial Sequence
  Description of Artificial Sequence: Synthetic oligonucleotide
  Target: ATXN1; (-) strand; PAM type: YTN; PAM sequence: CTT
actttgtcgcccaggctgga

SEQ ID NO: 199081 - DNA, 20 bp, Artificial Sequence
  Description of Artificial Sequence: Synthetic oligonucleotide
  Target: ATXN1; (-) strand; PAM type: YTN; PAM sequence: TTG
agacagccttactttgtcgc

SEQ ID NO: 199082 - DNA, 20 bp, Artificial Sequence
  Description of Artificial Sequence: Synthetic oligonucleotide
  Target: ATXN1; (-) strand; PAM type: YTN; PAM sequence: TTA
ttgagacagccttactttgt

SEQ ID NO: 199083 - DNA, 20 bp, Artificial Sequence
  Description of Artificial Sequence: Synthetic oligonucleotide
  Target: ATXN1; (-) strand; PAM type: YTN; PAM sequence: TTT
attgagacagccttactttg

SEQ ID NO: 199084 - DNA, 20 bp, Artificial Sequence
  Description of Artificial Sequence: Synthetic oligonucleotide
  Target: ATXN1; (-) strand; PAM type: YTN; PAM sequence: TTA
tttattgagacagccttact

SEQ ID NO: 199085 - DNA, 20 bp, Artificial Sequence
  Description of Artificial Sequence: Synthetic oligonucleotide
  Target: ATXN1; (-) strand; PAM type: YTN; PAM sequence: TTT
atttattgagacagccttac

SEQ ID NO: 199086 - DNA, 20 bp, Artificial Sequence
  Description of Artificial Sequence: Synthetic oligonucleotide
  Target: ATXN1; (-) strand; PAM type: YTN; PAM sequence: TTA
tttatttattgagacagcct

SEQ ID NO: 199087 - DNA, 20 bp, Artificial Sequence
  Description of Artificial Sequence: Synthetic oligonucleotide
  Target: ATXN1; (-) strand; PAM type: YTN; PAM sequence: TTT
atttatttattgagacagcc

SEQ ID NO: 199088 - DNA, 20 bp, Artificial Sequence
  Description of Artificial Sequence: Synthetic oligonucleotide
  Target: ATXN1; (-) strand; PAM type: YTN; PAM sequence: TTA
tgtatttatttatttattga

SEQ ID NO: 199089 - DNA, 20 bp, Artificial Sequence
  Description of Artificial Sequence: Synthetic oligonucleotide
  Target: ATXN1; (-) strand; PAM type: YTN; PAM sequence: TTT
atgtatttatttatttattg

SEQ ID NO: 199090 - DNA, 20 bp, Artificial Sequence
  Description of Artificial Sequence: Synthetic oligonucleotide
  Target: ATXN1; (-) strand; PAM type: YTN; PAM sequence: CTA
tttatgtatttatttattta

SEQ ID NO: 199091 - DNA, 20 bp, Artificial Sequence
  Description of Artificial Sequence: Synthetic oligonucleotide
  Target: ATXN1; (-) strand; PAM type: YTN; PAM sequence: TTG
ctatttatgtatttatttat

SEQ ID NO: 199092 - DNA, 20 bp, Artificial Sequence
  Description of Artificial Sequence: Synthetic oligonucleotide
  Target: ATXN1; (-) strand; PAM type: YTN; PAM sequence: TTT
gctatttatgtatttattta

SEQ ID NO: 199093 - DNA, 20 bp, Artificial Sequence
  Description of Artificial Sequence: Synthetic oligonucleotide
  Target: ATXN1; (-) strand; PAM type: YTN; PAM sequence: TTG
tttgctatttatgtatttat

SEQ ID NO: 199094 - DNA, 20 bp, Artificial Sequence
  Description of Artificial Sequence: Synthetic oligonucleotide
  Target: ATXN1; (-) strand; PAM type: YTN; PAM sequence: TTT
gtttgctatttatgtattta

SEQ ID NO: 199095 - DNA, 20 bp, Artificial Sequence
  Description of Artificial Sequence: Synthetic oligonucleotide
  Target: ATXN1; (-) strand; PAM type: YTN; PAM sequence: TTT
tgtttgctatttatgtattt

SEQ ID NO: 199096 - DNA, 20 bp, Artificial Sequence
  Description of Artificial Sequence: Synthetic oligonucleotide
  Target: ATXN1; (-) strand; PAM type: YTN; PAM sequence: TTA
ttttgtttgctatttatgta

SEQ ID NO: 199097 - DNA, 20 bp, Artificial Sequence
  Description of Artificial Sequence: Synthetic oligonucleotide
  Target: ATXN1; (-) strand; PAM type: YTN; PAM sequence: TTT
attttgtttgctatttatgt

SEQ ID NO: 199098 - DNA, 20 bp, Artificial Sequence
  Description of Artificial Sequence: Synthetic oligonucleotide
  Target: ATXN1; (-) strand; PAM type: YTN; PAM sequence: TTT
tattttgtttgctatttatg

SEQ ID NO: 199099 - DNA, 20 bp, Artificial Sequence
  Description of Artificial Sequence: Synthetic oligonucleotide
  Target: ATXN1; (-) strand; PAM type: YTN; PAM sequence: TTA
gtattttattttgtttgcta

SEQ ID NO: 199100 - DNA, 20 bp, Artificial Sequence
  Description of Artificial Sequence: Synthetic oligonucleotide
  Target: ATXN1; (-) strand; PAM type: YTN; PAM sequence: CTT
agtattttattttgtttgct

SEQ ID NO: 199101 - DNA, 20 bp, Artificial Sequence
  Description of Artificial Sequence: Synthetic oligonucleotide
  Target: ATXN1; (-) strand; PAM type: YTN; PAM sequence: TTC
ttagtattttattttgtttg

SEQ ID NO: 199102 - DNA, 20 bp, Artificial Sequence
  Description of Artificial Sequence: Synthetic oligonucleotide
  Target: ATXN1; (-) strand; PAM type: YTN; PAM sequence: TTT
cttagtattttattttgttt

SEQ ID NO: 199103 - DNA, 20 bp, Artificial Sequence
  Description of Artificial Sequence: Synthetic oligonucleotide
  Target: ATXN1; (-) strand; PAM type: YTN; PAM sequence: TTG
tttcttagtattttattttg

SEQ ID NO: 199104 - DNA, 20 bp, Artificial Sequence
  Description of Artificial Sequence: Synthetic oligonucleotide
  Target: ATXN1; (-) strand; PAM type: YTN; PAM sequence: TTT
gtttcttagtattttatttt

SEQ ID NO: 199105 - DNA, 20 bp, Artificial Sequence
  Description of Artificial Sequence: Synthetic oligonucleotide
  Target: ATXN1; (-) strand; PAM type: YTN; PAM sequence: CTA
atgcgtgtttgtttcttagt

SEQ ID NO: 199106 - DNA, 20 bp, Artificial Sequence
  Description of Artificial Sequence: Synthetic oligonucleotide
  Target: ATXN1; (-) strand; PAM type: YTN; PAM sequence: CTA
gactaatgcgtgtttgtttc

SEQ ID NO: 199107 - DNA, 20 bp, Artificial Sequence
  Description of Artificial Sequence: Synthetic oligonucleotide
  Target: ATXN1; (-) strand; PAM type: YTN; PAM sequence: CTG
tataggcctagactaatgcg

SEQ ID NO: 199108 - DNA, 20 bp, Artificial Sequence
  Description of Artificial Sequence: Synthetic oligonucleotide
  Target: ATXN1; (-) strand; PAM type: YTN; PAM sequence: CTG
accctgtataggcctagact

SEQ ID NO: 199109 - DNA, 20 bp, Artificial Sequence
  Description of Artificial Sequence: Synthetic oligonucleotide
  Target: ATXN1; (-) strand; PAM type: YTN; PAM sequence: CTC
agtgggacaagatgtggagg

SEQ ID NO: 199110 - DNA, 20 bp, Artificial Sequence
  Description of Artificial Sequence: Synthetic oligonucleotide
  Target: ATXN1; (-) strand; PAM type: YTN; PAM sequence: CTC
tcagtgggacaagatgtgga

SEQ ID NO: 199111 - DNA, 20 bp, Artificial Sequence
  Description of Artificial Sequence: Synthetic oligonucleotide
  Target: ATXN1; (-) strand; PAM type: YTN; PAM sequence: CTG
aagacctctcagtgggacaa

SEQ ID NO: 199112 - DNA, 20 bp, Artificial Sequence
  Description of Artificial Sequence: Synthetic oligonucleotide
  Target: ATXN1; (-) strand; PAM type: YTN; PAM sequence: TTG
ccctgaagacctctcagtgg

SEQ ID NO: 199113 - DNA, 20 bp, Artificial Sequence
  Description of Artificial Sequence: Synthetic oligonucleotide
  Target: ATXN1; (-) strand; PAM type: YTN; PAM sequence: TTA
ttgccctgaagacctctcag

SEQ ID NO: 199114 - DNA, 20 bp, Artificial Sequence
  Description of Artificial Sequence: Synthetic oligonucleotide
  Target: ATXN1; (-) strand; PAM type: YTN; PAM sequence: TTG
tcataggagatgacaggtcc

SEQ ID NO: 199115 - DNA, 20 bp, Artificial Sequence
  Description of Artificial Sequence: Synthetic oligonucleotide
  Target: ATXN1; (-) strand; PAM type: YTN; PAM sequence: CTG
ttgtcataggagatgacagg

SEQ ID NO: 199116 - DNA, 20 bp, Artificial Sequence
  Description of Artificial Sequence: Synthetic oligonucleotide
  Target: ATXN1; (-) strand; PAM type: YTN; PAM sequence: TTC
catagatgtgtaagaagaag

SEQ ID NO: 199117 - DNA, 20 bp, Artificial Sequence
  Description of Artificial Sequence: Synthetic oligonucleotide
  Target: ATXN1; (-) strand; PAM type: YTN; PAM sequence: CTT
ccatagatgtgtaagaagaa

SEQ ID NO: 199118 - DNA, 20 bp, Artificial Sequence
  Description of Artificial Sequence: Synthetic oligonucleotide
  Target: ATXN1; (-) strand; PAM type: YTN; PAM sequence: TTC
aggcaggtccttccatagat

SEQ ID NO: 199119 - DNA, 20 bp, Artificial Sequence
  Description of Artificial Sequence: Synthetic oligonucleotide
  Target: ATXN1; (-) strand; PAM type: YTN; PAM sequence: CTT
caggcaggtccttccataga

SEQ ID NO: 199120 - DNA, 20 bp, Artificial Sequence
  Description of Artificial Sequence: Synthetic oligonucleotide
  Target: ATXN1; (-) strand; PAM type: YTN; PAM sequence: CTG
caaaccaacttcaggcaggt

SEQ ID NO: 199121 - DNA, 20 bp, Artificial Sequence
  Description of Artificial Sequence: Synthetic oligonucleotide
  Target: ATXN1; (-) strand; PAM type: YTN; PAM sequence: TTA
actgcaaaccaacttcaggc

SEQ ID NO: 199122 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaaaagttaactgc

SEQ ID NO: 199123 - DNA, 20 bp, Artificial Sequence
  Description of Artificial Sequence: Synthetic oligonucleotide
  Target: ATXN1; (-) strand; PAM type: YTN; PAM sequence: TTT
aaaaaaaaaaaagttaactg

SEQ ID NO: 199124 - DNA, 20 bp, Artificial Sequence
  Description of Artificial Sequence: Synthetic oligonucleotide
  Target: ATXN1; (-) strand; PAM type: YTN; PAM sequence: TTA
tttaaaaaaaaaaaagttaa

SEQ ID NO: 199125 - DNA, 20 bp, Artificial Sequence
  Description of Artificial Sequence: Synthetic oligonucleotide
  Target: ATXN1; (-) strand; PAM type: YTN; PAM sequence: CTT
atttaaaaaaaaaaaagtta

SEQ ID NO: 199126 - DNA, 20 bp, Artificial Sequence
  Description of Artificial Sequence: Synthetic oligonucleotide
  Target: ATXN1; (-) strand; PAM type: YTN; PAM sequence: CTA
cttatttaaaaaaaaaaaag

SEQ ID NO: 199127 - DNA, 20 bp, Artificial Sequence
  Description of Artificial Sequence: Synthetic oligonucleotide
  Target: ATXN1; (-) strand; PAM type: YTN; PAM sequence: TTC
tacttatttaaaaaaaaaaa

SEQ ID NO: 199128 - DNA, 20 bp, Artificial Sequence
  Description of Artificial Sequence: Synthetic oligonucleotide
  Target: ATXN1; (-) strand; PAM type: YTN; PAM sequence: CTT
ctacttatttaaaaaaaaaa

SEQ ID NO: 199129 - DNA, 20 bp, Artificial Sequence
  Description of Artificial Sequence: Synthetic oligonucleotide
  Target: ATXN1; (-) strand; PAM type: YTN; PAM sequence: TTC
ttctacttatttaaaaaaaa

SEQ ID NO: 199130 - DNA, 20 bp, Artificial Sequence
  Description of Artificial Sequence: Synthetic oligonucleotide
  Target: ATXN1; (-) strand; PAM type: YTN; PAM sequence: TTT
cttctacttatttaaaaaaa

SEQ ID NO: 199131 - DNA, 20 bp, Artificial Sequence
  Description of Artificial Sequence: Synthetic oligonucleotide
  Target: ATXN1; (-) strand; PAM type: YTN; PAM sequence: CTG
tatttcttctacttatttaa

SEQ ID NO: 199132 - DNA, 20 bp, Artificial Sequence
  Description of Artificial Sequence: Synthetic oligonucleotide
  Target: ATXN1; (-) strand; PAM type: YTN; PAM sequence: TTA
gactgtatttcttctactta

SEQ ID NO: 199133 - DNA, 20 bp, Artificial Sequence
  Description of Artificial Sequence: Synthetic oligonucleotide
  Target: ATXN1; (-) strand; PAM type: YTN; PAM sequence: TTT
agactgtatttcttctactt

SEQ ID NO: 199134 - DNA, 20 bp, Artificial Sequence
  Description of Artificial Sequence: Synthetic oligonucleotide
  Target: ATXN1; (-) strand; PAM type: YTN; PAM sequence: TTT
tagactgtatttcttctact

SEQ ID NO: 199135 - DNA, 20 bp, Artificial Sequence
  Description of Artificial Sequence: Synthetic oligonucleotide
  Target: ATXN1; (-) strand; PAM type: YTN; PAM sequence: TTG
ttttagactgtatttcttct

SEQ ID NO: 199136 - DNA, 20 bp, Artificial Sequence
  Description of Artificial Sequence: Synthetic oligonucleotide
  Target: ATXN1; (-) strand; PAM type: YTN; PAM sequence: TTG
atcattgttttagactgtat

SEQ ID NO: 199137 - DNA, 20 bp, Artificial Sequence
  Description of Artificial Sequence: Synthetic oligonucleotide
  Target: ATXN1; (-) strand; PAM type: YTN; PAM sequence: TTT
gatcattgttttagactgta

SEQ ID NO: 199138 - DNA, 20 bp, Artificial Sequence
  Description of Artificial Sequence: Synthetic oligonucleotide
  Target: ATXN1; (-) strand; PAM type: YTN; PAM sequence: TTT
tgatcattgttttagactgt

SEQ ID NO: 199139 - DNA, 20 bp, Artificial Sequence
  Description of Artificial Sequence: Synthetic oligonucleotide
  Target: ATXN1; (-) strand; PAM type: YTN; PAM sequence: CTT
ttgatcattgttttagactg

SEQ ID NO: 199140 - DNA, 20 bp, Artificial Sequence
  Description of Artificial Sequence: Synthetic oligonucleotide
  Target: ATXN1; (-) strand; PAM type: YTN; PAM sequence: CTA
tacttttgatcattgtttta

SEQ ID NO: 199141 - DNA, 20 bp, Artificial Sequence
  Description of Artificial Sequence: Synthetic oligonucleotide
  Target: ATXN1; (-) strand; PAM type: YTN; PAM sequence: CTA
tactatacttttgatcattg

SEQ ID NO: 199142 - DNA, 20 bp, Artificial Sequence
  Description of Artificial Sequence: Synthetic oligonucleotide
  Target: ATXN1; (-) strand; PAM type: YTN; PAM sequence: TTA
ctatactatacttttgatca

SEQ ID NO: 199143 - DNA, 20 bp, Artificial Sequence
  Description of Artificial Sequence: Synthetic oligonucleotide
  Target: ATXN1; (-) strand; PAM type: YTN; PAM sequence: CTT
actatactatacttttgatc

SEQ ID NO: 199144 - DNA, 20 bp, Artificial Sequence
  Description of Artificial Sequence: Synthetic oligonucleotide
  Target: ATXN1; (-) strand; PAM type: YTN; PAM sequence: TTA
tgcacttactatactatact

SEQ ID NO: 199145 - DNA, 20 bp, Artificial Sequence
  Description of Artificial Sequence: Synthetic oligonucleotide
  Target: ATXN1; (-) strand; PAM type: YTN; PAM sequence: TTT
atgcacttactatactatac

SEQ ID NO: 199146 - DNA, 20 bp, Artificial Sequence
  Description of Artificial Sequence: Synthetic oligonucleotide
  Target: ATXN1; (-) strand; PAM type: YTN; PAM sequence: TTG
gtttatgcacttactatact

SEQ ID NO: 199147 - DNA, 20 bp, Artificial Sequence
  Description of Artificial Sequence: Synthetic oligonucleotide
  Target: ATXN1; (-) strand; PAM type: YTN; PAM sequence: TTA
ttggtttatgcacttactat

SEQ ID NO: 199148 - DNA, 20 bp, Artificial Sequence
  Description of Artificial Sequence: Synthetic oligonucleotide
  Target: ATXN1; (-) strand; PAM type: YTN; PAM sequence: CTG
ttattggtttatgcacttac

SEQ ID NO: 199149 - DNA, 20 bp, Artificial Sequence
  Description of Artificial Sequence: Synthetic oligonucleotide
  Target: ATXN1; (-) strand; PAM type: YTN; PAM sequence: TTG
ataatggtaataaacaactg

SEQ ID NO: 199150 - DNA, 20 bp, Artificial Sequence
  Description of Artificial Sequence: Synthetic oligonucleotide
  Target: ATXN1; (-) strand; PAM type: YTN; PAM sequence: CTT
gataatggtaataaacaact

SEQ ID NO: 199151 - DNA, 20 bp, Artificial Sequence
  Description of Artificial Sequence: Synthetic oligonucleotide
  Target: ATXN1; (-) strand; PAM type: YTN; PAM sequence: TTC
ggtacagcacataatgcttg

SEQ ID NO: 199152 - DNA, 20 bp, Artificial Sequence
  Description of Artificial Sequence: Synthetic oligonucleotide
  Target: ATXN1; (-) strand; PAM type: YTN; PAM sequence: CTG
ccagtcatgtaagagtagag

SEQ ID NO: 199153 - DNA, 20 bp, Artificial Sequence
  Description of Artificial Sequence: Synthetic oligonucleotide
  Target: ATXN1; (-) strand; PAM type: YTN; PAM sequence: CTG
tgctgccagtcatgtaagag

SEQ ID NO: 199154 - DNA, 20 bp, Artificial Sequence
  Description of Artificial Sequence: Synthetic oligonucleotide
  Target: ATXN1; (-) strand; PAM type: YTN; PAM sequence: CTA
ctgtgctgccagtcatgtaa

SEQ ID NO: 199155 - DNA, 20 bp, Artificial Sequence
  Description of Artificial Sequence: Synthetic oligonucleotide
  Target: ATXN1; (-) strand; PAM type: YTN; PAM sequence: CTG
caaccctactgtgctgccag

SEQ ID NO: 199156 - DNA, 20 bp, Artificial Sequence
  Description of Artificial Sequence: Synthetic oligonucleotide
  Target: ATXN1; (-) strand; PAM type: YTN; PAM sequence: CTG
tgatgctgcaaccctactgt

SEQ ID NO: 199157 - DNA, 20 bp, Artificial Sequence
  Description of Artificial Sequence: Synthetic oligonucleotide
  Target: ATXN1; (-) strand; PAM type: YTN; PAM sequence: TTG
ctgtgatgctgcaaccctac

SEQ ID NO: 199158 - DNA, 20 bp, Artificial Sequence
  Description of Artificial Sequence: Synthetic oligonucleotide
  Target: ATXN1; (-) strand; PAM type: YTN; PAM sequence: TTT
gctgtgatgctgcaacccta

SEQ ID NO: 199159 - DNA, 20 bp, Artificial Sequence
  Description of Artificial Sequence: Synthetic oligonucleotide
  Target: ATXN1; (-) strand; PAM type: YTN; PAM sequence: CTC
atatgtttgctgtgatgctg

SEQ ID NO: 199160 - DNA, 20 bp, Artificial Sequence
  Description of Artificial Sequence: Synthetic oligonucleotide
  Target: ATXN1; (-) strand; PAM type: YTN; PAM sequence: TTA
ctcatatgtttgctgtgatg

SEQ ID NO: 199161 - DNA, 20 bp, Artificial Sequence
  Description of Artificial Sequence: Synthetic oligonucleotide
  Target: ATXN1; (-) strand; PAM type: YTN; PAM sequence: CTC
attactcatatgtttgctgt

SEQ ID NO: 199162 - DNA, 20 bp, Artificial Sequence
  Description of Artificial Sequence: Synthetic oligonucleotide
  Target: ATXN1; (-) strand; PAM type: YTN; PAM sequence: CTA
gtgcaactcattactcatat

SEQ ID NO: 199163 - DNA, 20 bp, Artificial Sequence
  Description of Artificial Sequence: Synthetic oligonucleotide
  Target: ATXN1; (-) strand; PAM type: YTN; PAM sequence: TTG
taatgtcctagtgcaactca

SEQ ID NO: 199164 - DNA, 20 bp, Artificial Sequence
  Description of Artificial Sequence: Synthetic oligonucleotide
  Target: ATXN1; (-) strand; PAM type: YTN; PAM sequence: TTG
tagccattgtaatgtcctag

SEQ ID NO: 199165 - DNA, 20 bp, Artificial Sequence
  Description of Artificial Sequence: Synthetic oligonucleotide
  Target: ATXN1; (-) strand; PAM type: YTN; PAM sequence: CTA
gtaatgttgtagccattgta

SEQ ID NO: 199166 - DNA, 20 bp, Artificial Sequence
  Description of Artificial Sequence: Synthetic oligonucleotide
  Target: ATXN1; (-) strand; PAM type: YTN; PAM sequence: TTA
tcgcctagtaatgttgtagc

SEQ ID NO: 199167 - DNA, 20 bp, Artificial Sequence
  Description of Artificial Sequence: Synthetic oligonucleotide
  Target: ATXN1; (-) strand; PAM type: YTN; PAM sequence: TTT
atcgcctagtaatgttgtag

SEQ ID NO: 199168 - DNA, 20 bp, Artificial Sequence
  Description of Artificial Sequence: Synthetic oligonucleotide
  Target: ATXN1; (-) strand; PAM type: YTN; PAM sequence: TTT
tatcgcctagtaatgttgta

SEQ ID NO: 199169 - DNA, 20 bp, Artificial Sequence
  Description of Artificial Sequence: Synthetic oligonucleotide
  Target: ATXN1; (-) strand; PAM type: YTN; PAM sequence: TTT
ttatcgcctagtaatgttgt

SEQ ID NO: 199170 - DNA, 20 bp, Artificial Sequence
  Description of Artificial Sequence: Synthetic oligonucleotide
  Target: ATXN1; (-) strand; PAM type: YTN; PAM sequence: CTG
aagaatttttatcgcctagt

SEQ ID NO: 199171 - DNA, 20 bp, Artificial Sequence
  Description of Artificial Sequence: Synthetic oligonucleotide
  Target: ATXN1; (-) strand; PAM type: YTN; PAM sequence: TTA
taatgaagctgaagaatttt

SEQ ID NO: 199172 - DNA, 20 bp, Artificial Sequence
  Description of Artificial Sequence: Synthetic oligonucleotide
  Target: ATXN1; (-) strand; PAM type: YTN; PAM sequence: TTG
ggtcaacagtgggtcacata

SEQ ID NO: 199173 - DNA, 20 bp, Artificial Sequence
  Description of Artificial Sequence: Synthetic oligonucleotide
  Target: ATXN1; (-) strand; PAM type: YTN; PAM sequence: TTT
gggtcaacagtgggtcacat

SEQ ID NO: 199174 - DNA, 20 bp, Artificial Sequence
  Description of Artificial Sequence: Synthetic oligonucleotide
  Target: ATXN1; (-) strand; PAM type: YTN; PAM sequence: TTA
cagccatgtgccgcataacg

SEQ ID NO: 199175 - DNA, 20 bp, Artificial Sequence
  Description of Artificial Sequence: Synthetic oligonucleotide
  Target: ATXN1; (-) strand; PAM type: YTN; PAM sequence: TTT
acagccatgtgccgcataac

SEQ ID NO: 199176 - DNA, 20 bp, Artificial Sequence
  Description of Artificial Sequence: Synthetic oligonucleotide
  Target: ATXN1; (-) strand; PAM type: YTN; PAM sequence: TTT
tacagccatgtgccgcataa

SEQ ID NO: 199177 - DNA, 20 bp, Artificial Sequence
  Description of Artificial Sequence: Synthetic oligonucleotide
  Target: ATXN1; (-) strand; PAM type: YTN; PAM sequence: TTT
ttacagccatgtgccgcata

SEQ ID NO: 199178 - DNA, 20 bp, Artificial Sequence
  Description of Artificial Sequence: Synthetic oligonucleotide
  Target: ATXN1; (-) strand; PAM type: YTN; PAM sequence: CTT
tttacagccatgtgccgcat

SEQ ID NO: 199179 - DNA, 20 bp, Artificial Sequence
  Description of Artificial Sequence: Synthetic oligonucleotide
  Target: ATXN1; (-) strand; PAM type: YTN; PAM sequence: TTA
tggctttttacagccatgtg

SEQ ID NO: 199180 - DNA, 20 bp, Artificial Sequence
  Description of Artificial Sequence: Synthetic oligonucleotide
  Target: ATXN1; (-) strand; PAM type: YTN; PAM sequence: CTT
atggctttttacagccatgt

SEQ ID NO: 199181 - DNA, 20 bp, Artificial Sequence
  Description of Artificial Sequence: Synthetic oligonucleotide
  Target: ATXN1; (-) strand; PAM type: YTN; PAM sequence: CTC
acttatggctttttacagcc

SEQ ID NO: 199182 - DNA, 20 bp, Artificial Sequence
  Description of Artificial Sequence: Synthetic oligonucleotide
  Target: ATXN1; (-) strand; PAM type: YTN; PAM sequence: TTC
cctcacttatggctttttac

SEQ ID NO: 199183 - DNA, 20 bp, Artificial Sequence
  Description of Artificial Sequence: Synthetic oligonucleotide
  Target: ATXN1; (-) strand; PAM type: YTN; PAM sequence: CTT
ccctcacttatggcttttta

SEQ ID NO: 199184 - DNA, 20 bp, Artificial Sequence
  Description of Artificial Sequence: Synthetic oligonucleotide
  Target: ATXN1; (-) strand; PAM type: YTN; PAM sequence: TTC
cgcttccctcacttatggct

SEQ ID NO: 199185 - DNA, 20 bp, Artificial Sequence
  Description of Artificial Sequence: Synthetic oligonucleotide
  Target: ATXN1; (-) strand; PAM type: YTN; PAM sequence: CTG
gttccgcttccctcacttat

SEQ ID NO: 199186 - DNA, 20 bp, Artificial Sequence
  Description of Artificial Sequence: Synthetic oligonucleotide
  Target: ATXN1; (-) strand; PAM type: YTN; PAM sequence: CTA
tatgggagctggttccgctt

SEQ ID NO: 199187 - DNA, 20 bp, Artificial Sequence
  Description of Artificial Sequence: Synthetic oligonucleotide
  Target: ATXN1; (-) strand; PAM type: YTN; PAM sequence: CTG
tgggacaacagacacctata

SEQ ID NO: 199188 - DNA, 20 bp, Artificial Sequence
  Description of Artificial Sequence: Synthetic oligonucleotide
  Target: ATXN1; (-) strand; PAM type: YTN; PAM sequence: CTC
tgtgggacaacagacaccta

SEQ ID NO: 199189 - DNA, 20 bp, Artificial Sequence
  Description of Artificial Sequence: Synthetic oligonucleotide
  Target: ATXN1; (-) strand; PAM type: YTN; PAM sequence: CTG
gggcatcggtggtatcctct

SEQ ID NO: 199190 - DNA, 20 bp, Artificial Sequence
  Description of Artificial Sequence: Synthetic oligonucleotide
  Target: ATXN1; (-) strand; PAM type: YTN; PAM sequence: TTA
agcagtagtggacaacctgg

SEQ ID NO: 199191 - DNA, 20 bp, Artificial Sequence
  Description of Artificial Sequence: Synthetic oligonucleotide
  Target: ATXN1; (-) strand; PAM type: YTN; PAM sequence: TTT
aagcagtagtggacaacctg

SEQ ID NO: 199192 - DNA, 20 bp, Artificial Sequence
  Description of Artificial Sequence: Synthetic oligonucleotide
  Target: ATXN1; (-) strand; PAM type: YTN; PAM sequence: CTT
taagcagtagtggacaacct

SEQ ID NO: 199193 - DNA, 20 bp, Artificial Sequence
  Description of Artificial Sequence: Synthetic oligonucleotide
  Target: ATXN1; (-) strand; PAM type: YTN; PAM sequence: TTG
aatgtgccctttaagcagta

SEQ ID NO: 199194 - DNA, 20 bp, Artificial Sequence
  Description of Artificial Sequence: Synthetic oligonucleotide
  Target: ATXN1; (-) strand; PAM type: YTN; PAM sequence: CTT
gaatgtgccctttaagcagt

SEQ ID NO: 199195 - DNA, 20 bp, Artificial Sequence
  Description of Artificial Sequence: Synthetic oligonucleotide
  Target: ATXN1; (-) strand; PAM type: YTN; PAM sequence: TTC
ttgaatgtgccctttaagca

SEQ ID NO: 199196 - DNA, 20 bp, Artificial Sequence
  Description of Artificial Sequence: Synthetic oligonucleotide
  Target: ATXN1; (-) strand; PAM type: YTN; PAM sequence: CTA
ttcttgaatgtgccctttaa

SEQ ID NO: 199197 - DNA, 20 bp, Artificial Sequence
  Description of Artificial Sequence: Synthetic oligonucleotide
  Target: ATXN1; (-) strand; PAM type: YTN; PAM sequence: CTG
gccagcatgcctattcttga

SEQ ID NO: 199198 - DNA, 20 bp, Artificial Sequence
  Description of Artificial Sequence: Synthetic oligonucleotide
  Target: ATXN1; (-) strand; PAM type: YTN; PAM sequence: CTG
cacctggccagcatgcctat

SEQ ID NO: 199199 - DNA, 20 bp, Artificial Sequence
  Description of Artificial Sequence: Synthetic oligonucleotide
  Target: ATXN1; (-) strand; PAM type: YTN; PAM sequence: TTA
caggcgtaagccgctgcacc

SEQ ID NO: 199200 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtaagccgc

SEQ ID NO: 199201 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 199202 - DNA, 20 bp, Artificial Sequence
  Description of Artificial Sequence: Synthetic oligonucleotide
  Target: ATXN1; (-) strand; PAM type: YTN; PAM sequence: CTG
cctcccaaagtgctgggatt

SEQ ID NO: 199203 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaaagtgctggga

SEQ ID NO: 199204 - DNA, 20 bp, Artificial Sequence
  Description of Artificial Sequence: Synthetic oligonucleotide
  Target: ATXN1; (-) strand; PAM type: YTN; PAM sequence: CTC
aggtgatccgcccatctctg

SEQ ID NO: 199205 - DNA, 20 bp, Artificial Sequence
  Description of Artificial Sequence: Synthetic oligonucleotide
  Target: ATXN1; (-) strand; PAM type: YTN; PAM sequence: CTC
ccagcctcaggtgatccgcc

SEQ ID NO: 199206 - DNA, 20 bp, Artificial Sequence
  Description of Artificial Sequence: Synthetic oligonucleotide
  Target: ATXN1; (-) strand; PAM type: YTN; PAM sequence: CTC
gaactcccagcctcaggtga

SEQ ID NO: 199207 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcccagcctca

SEQ ID NO: 199208 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtctcgaactc

SEQ ID NO: 199209 - DNA, 20 bp, Artificial Sequence
  Description of Artificial Sequence: Synthetic oligonucleotide
  Target: ATXN1; (-) strand; PAM type: YTN; PAM sequence: TTC
accatgttggtcaggctggt

SEQ ID NO: 199210 - DNA, 20 bp, Artificial Sequence
  Description of Artificial Sequence: Synthetic oligonucleotide
  Target: ATXN1; (-) strand; PAM type: YTN; PAM sequence: TTT
caccatgttggtcaggctgg

SEQ ID NO: 199211 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcacca

SEQ ID NO: 199212 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcacc

SEQ ID NO: 199213 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 199214 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 199215 - DNA, 20 bp, Artificial Sequence
  Description of Artificial Sequence: Synthetic oligonucleotide
  Target: ATXN1; (-) strand; PAM type: YTN; PAM sequence: TTG
catttttagtagagacgggg

SEQ ID NO: 199216 - DNA, 20 bp, Artificial Sequence
  Description of Artificial Sequence: Synthetic oligonucleotide
  Target: ATXN1; (-) strand; PAM type: YTN; PAM sequence: TTT
gcatttttagtagagacggg

SEQ ID NO: 199217 - DNA, 20 bp, Artificial Sequence
  Description of Artificial Sequence: Synthetic oligonucleotide
  Target: ATXN1; (-) strand; PAM type: YTN; PAM sequence: TTT
tgcatttttagtagagacgg

SEQ ID NO: 199218 - DNA, 20 bp, Artificial Sequence
  Description of Artificial Sequence: Synthetic oligonucleotide
  Target: ATXN1; (-) strand; PAM type: YTN; PAM sequence: CTA
attttgcatttttagtagag

SEQ ID NO: 199219 - DNA, 20 bp, Artificial Sequence
  Description of Artificial Sequence: Synthetic oligonucleotide
  Target: ATXN1; (-) strand; PAM type: YTN; PAM sequence: CTG
ctaattttgcatttttagta

SEQ ID NO: 199220 - DNA, 20 bp, Artificial Sequence
  Description of Artificial Sequence: Synthetic oligonucleotide
  Target: ATXN1; (-) strand; PAM type: YTN; PAM sequence: CTC
catgccctgctaattttgca

SEQ ID NO: 199221 - DNA, 20 bp, Artificial Sequence
  Description of Artificial Sequence: Synthetic oligonucleotide
  Target: ATXN1; (-) strand; PAM type: YTN; PAM sequence: TTA
cgggcatgcacctccatgcc

SEQ ID NO: 199222 - DNA, 20 bp, Artificial Sequence
  Description of Artificial Sequence: Synthetic oligonucleotide
  Target: ATXN1; (-) strand; PAM type: YTN; PAM sequence: CTG
ggattacgggcatgcacctc

SEQ ID NO: 199223 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattacgggca

SEQ ID NO: 199224 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggattacgg

SEQ ID NO: 199225 - DNA, 20 bp, Artificial Sequence
  Description of Artificial Sequence: Synthetic oligonucleotide
  Target: ATXN1; (-) strand; PAM type: YTN; PAM sequence: CTG
agcctcctgagtagctggga

SEQ ID NO: 199226 - DNA, 20 bp, Artificial Sequence
  Description of Artificial Sequence: Synthetic oligonucleotide
  Target: ATXN1; (-) strand; PAM type: YTN; PAM sequence: CTG
cctgagcctcctgagtagct

SEQ ID NO: 199227 - DNA, 20 bp, Artificial Sequence
  Description of Artificial Sequence: Synthetic oligonucleotide
  Target: ATXN1; (-) strand; PAM type: YTN; PAM sequence: CTA
ctgcctgagcctcctgagta

SEQ ID NO: 199228 - DNA, 20 bp, Artificial Sequence
  Description of Artificial Sequence: Synthetic oligonucleotide
  Target: ATXN1; (-) strand; PAM type: YTN; PAM sequence: TTC
tactgcctgagcctcctgag

SEQ ID NO: 199229 - DNA, 20 bp, Artificial Sequence
  Description of Artificial Sequence: Synthetic oligonucleotide
  Target: ATXN1; (-) strand; PAM type: YTN; PAM sequence: TTA
ttctactgcctgagcctcct

SEQ ID NO: 199230 - DNA, 20 bp, Artificial Sequence
  Description of Artificial Sequence: Synthetic oligonucleotide
  Target: ATXN1; (-) strand; PAM type: YTN; PAM sequence: TTC
aagttattctactgcctgag

SEQ ID NO: 199231 - DNA, 20 bp, Artificial Sequence
  Description of Artificial Sequence: Synthetic oligonucleotide
  Target: ATXN1; (-) strand; PAM type: YTN; PAM sequence: CTG
agttcaagttattctactgc

SEQ ID NO: 199232 - DNA, 20 bp, Artificial Sequence
  Description of Artificial Sequence: Synthetic oligonucleotide
  Target: ATXN1; (-) strand; PAM type: YTN; PAM sequence: CTC
ctgagttcaagttattctac

SEQ ID NO: 199233 - DNA, 20 bp, Artificial Sequence
  Description of Artificial Sequence: Synthetic oligonucleotide
  Target: ATXN1; (-) strand; PAM type: YTN; PAM sequence: TTG
ctcctgagttcaagttattc

SEQ ID NO: 199234 - DNA, 20 bp, Artificial Sequence
  Description of Artificial Sequence: Synthetic oligonucleotide
  Target: ATXN1; (-) strand; PAM type: YTN; PAM sequence: TTT
gctcctgagttcaagttatt

SEQ ID NO: 199235 - DNA, 20 bp, Artificial Sequence
  Description of Artificial Sequence: Synthetic oligonucleotide
  Target: ATXN1; (-) strand; PAM type: YTN; PAM sequence: CTT
tgctcctgagttcaagttat

SEQ ID NO: 199236 - DNA, 20 bp, Artificial Sequence
  Description of Artificial Sequence: Synthetic oligonucleotide
  Target: ATXN1; (-) strand; PAM type: YTN; PAM sequence: CTC
accacaatctttgctcctga

SEQ ID NO: 199237 - DNA, 20 bp, Artificial Sequence
  Description of Artificial Sequence: Synthetic oligonucleotide
  Target: ATXN1; (-) strand; PAM type: YTN; PAM sequence: CTC
ggctcaccacaatctttgct

SEQ ID NO: 199238 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatggtgcgatctc

SEQ ID NO: 199239 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcaatgg

SEQ ID NO: 199240 - DNA, 20 bp, Artificial Sequence
  Description of Artificial Sequence: Synthetic oligonucleotide
  Target: ATXN1; (-) strand; PAM type: YTN; PAM sequence: TTG
ttgcccaggctggagtgcaa

SEQ ID NO: 199241 - DNA, 20 bp, Artificial Sequence
  Description of Artificial Sequence: Synthetic oligonucleotide
  Target: ATXN1; (-) strand; PAM type: YTN; PAM sequence: CTT
gttgcccaggctggagtgca

SEQ ID NO: 199242 - DNA, 20 bp, Artificial Sequence
  Description of Artificial Sequence: Synthetic oligonucleotide
  Target: ATXN1; (-) strand; PAM type: YTN; PAM sequence: CTC
ttgttgcccaggctggagtg

SEQ ID NO: 199243 - DNA, 20 bp, Artificial Sequence
  Description of Artificial Sequence: Synthetic oligonucleotide
  Target: ATXN1; (-) strand; PAM type: YTN; PAM sequence: TTC
gctcttgttgcccaggctgg

SEQ ID NO: 199244 - DNA, 20 bp, Artificial Sequence
  Description of Artificial Sequence: Synthetic oligonucleotide
  Target: ATXN1; (-) strand; PAM type: YTN; PAM sequence: TTT
cgctcttgttgcccaggctg

SEQ ID NO: 199245 - DNA, 20 bp, Artificial Sequence
  Description of Artificial Sequence: Synthetic oligonucleotide
  Target: ATXN1; (-) strand; PAM type: YTN; PAM sequence: TTG
agacagagtttcgctcttgt

SEQ ID NO: 199246 - DNA, 20 bp, Artificial Sequence
  Description of Artificial Sequence: Synthetic oligonucleotide
  Target: ATXN1; (-) strand; PAM type: YTN; PAM sequence: TTT
gagacagagtttcgctcttg

SEQ ID NO: 199247 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtttcgctctt

SEQ ID NO: 199248 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtttcgctct

SEQ ID NO: 199249 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtttcgctc

SEQ ID NO: 199250 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtttcgct

SEQ ID NO: 199251 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtttcgc

SEQ ID NO: 199252 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtttcg

SEQ ID NO: 199253 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtttc

SEQ ID NO: 199254 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagttt

SEQ ID NO: 199255 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtt

SEQ ID NO: 199256 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 199257 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 199258 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaga

SEQ ID NO: 199259 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacag

SEQ ID NO: 199260 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagaca

SEQ ID NO: 199261 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 199262 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaga

SEQ ID NO: 199263 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgag

SEQ ID NO: 199264 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttttga

SEQ ID NO: 199265 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttttg

SEQ ID NO: 199266 - DNA, 20 bp, Artificial Sequence
  Description of Artificial Sequence: Synthetic oligonucleotide
  Target: ATXN1; (-) strand; PAM type: YTN; PAM sequence: TTC
cttttttttttttttttttt

SEQ ID NO: 199267 - DNA, 20 bp, Artificial Sequence
  Description of Artificial Sequence: Synthetic oligonucleotide
  Target: ATXN1; (-) strand; PAM type: YTN; PAM sequence: CTA
ttcctttttttttttttttt

SEQ ID NO: 199268 - DNA, 20 bp, Artificial Sequence
  Description of Artificial Sequence: Synthetic oligonucleotide
  Target: ATXN1; (-) strand; PAM type: YTN; PAM sequence: TTA
tgagtgagaatggcatgcct

SEQ ID NO: 199269 - DNA, 20 bp, Artificial Sequence
  Description of Artificial Sequence: Synthetic oligonucleotide
  Target: ATXN1; (-) strand; PAM type: YTN; PAM sequence: CTT
atgagtgagaatggcatgcc

SEQ ID NO: 199270 - DNA, 20 bp, Artificial Sequence
  Description of Artificial Sequence: Synthetic oligonucleotide
  Target: ATXN1; (-) strand; PAM type: YTN; PAM sequence: CTC
ccacttatgagtgagaatgg

SEQ ID NO: 199271 - DNA, 20 bp, Artificial Sequence
  Description of Artificial Sequence: Synthetic oligonucleotide
  Target: ATXN1; (-) strand; PAM type: YTN; PAM sequence: TTC
aactcccacttatgagtgag

SEQ ID NO: 199272 - DNA, 20 bp, Artificial Sequence
  Description of Artificial Sequence: Synthetic oligonucleotide
  Target: ATXN1; (-) strand; PAM type: YTN; PAM sequence: TTT
caactcccacttatgagtga

SEQ ID NO: 199273 - DNA, 20 bp, Artificial Sequence
  Description of Artificial Sequence: Synthetic oligonucleotide
  Target: ATXN1; (-) strand; PAM type: YTN; PAM sequence: TTT
tcaactcccacttatgagtg

SEQ ID NO: 199274 - DNA, 20 bp, Artificial Sequence
  Description of Artificial Sequence: Synthetic oligonucleotide
  Target: ATXN1; (-) strand; PAM type: YTN; PAM sequence: TTT
ttcaactcccacttatgagt

SEQ ID NO: 199275 - DNA, 20 bp, Artificial Sequence
  Description of Artificial Sequence: Synthetic oligonucleotide
  Target: ATXN1; (-) strand; PAM type: YTN; PAM sequence: CTC
atttttcaactcccacttat

SEQ ID NO: 199276 - DNA, 20 bp, Artificial Sequence
  Description of Artificial Sequence: Synthetic oligonucleotide
  Target: ATXN1; (-) strand; PAM type: YTN; PAM sequence: TTC
tcatttttcaactcccactt

SEQ ID NO: 199277 - DNA, 20 bp, Artificial Sequence
  Description of Artificial Sequence: Synthetic oligonucleotide
  Target: ATXN1; (-) strand; PAM type: YTN; PAM sequence: CTG
tgtccatgtgttctcatttt

SEQ ID NO: 199278 - DNA, 20 bp, Artificial Sequence
  Description of Artificial Sequence: Synthetic oligonucleotide
  Target: ATXN1; (-) strand; PAM type: YTN; PAM sequence: TTC
ctgtgtccatgtgttctcat

SEQ ID NO: 199279 - DNA, 20 bp, Artificial Sequence
  Description of Artificial Sequence: Synthetic oligonucleotide
  Target: ATXN1; (-) strand; PAM type: YTN; PAM sequence: CTT
cctgtgtccatgtgttctca

SEQ ID NO: 199280 - DNA, 20 bp, Artificial Sequence
  Description of Artificial Sequence: Synthetic oligonucleotide
  Target: ATXN1; (-) strand; PAM type: YTN; PAM sequence: TTC
cccttcctgtgtccatgtgt

SEQ ID NO: 199281 - DNA, 20 bp, Artificial Sequence
  Description of Artificial Sequence: Synthetic oligonucleotide
  Target: ATXN1; (-) strand; PAM type: YTN; PAM sequence: TTG
ttccccttcctgtgtccatg

SEQ ID NO: 199282 - DNA, 20 bp, Artificial Sequence
  Description of Artificial Sequence: Synthetic oligonucleotide
  Target: ATXN1; (-) strand; PAM type: YTN; PAM sequence: CTC
cccaccccagtccccaacag

SEQ ID NO: 199283 - DNA, 20 bp, Artificial Sequence
  Description of Artificial Sequence: Synthetic oligonucleotide
  Target: ATXN1; (-) strand; PAM type: YTN; PAM sequence: CTC
ccctccccaccccagtcccc

SEQ ID NO: 199284 - DNA, 20 bp, Artificial Sequence
  Description of Artificial Sequence: Synthetic oligonucleotide
  Target: ATXN1; (-) strand; PAM type: YTN; PAM sequence: TTC
cctcccctccccaccccagt

SEQ ID NO: 199285 - DNA, 20 bp, Artificial Sequence
  Description of Artificial Sequence: Synthetic oligonucleotide
  Target: ATXN1; (-) strand; PAM type: YTN; PAM sequence: CTA
ggttccctcccctccccacc

SEQ ID NO: 199286 - DNA, 20 bp, Artificial Sequence
  Description of Artificial Sequence: Synthetic oligonucleotide
  Target: ATXN1; (-) strand; PAM type: YTN; PAM sequence: CTG
tcatctaggttccctcccct

SEQ ID NO: 199287 - DNA, 20 bp, Artificial Sequence
  Description of Artificial Sequence: Synthetic oligonucleotide
  Target: ATXN1; (-) strand; PAM type: YTN; PAM sequence: TTA
acctgtcatctaggttccct

SEQ ID NO: 199288 - DNA, 20 bp, Artificial Sequence
  Description of Artificial Sequence: Synthetic oligonucleotide
  Target: ATXN1; (-) strand; PAM type: YTN; PAM sequence: CTA
ttaacctgtcatctaggttc

SEQ ID NO: 199289 - DNA, 20 bp, Artificial Sequence
  Description of Artificial Sequence: Synthetic oligonucleotide
  Target: ATXN1; (-) strand; PAM type: YTN; PAM sequence: CTG
cacctattaacctgtcatct

SEQ ID NO: 199290 - DNA, 20 bp, Artificial Sequence
  Description of Artificial Sequence: Synthetic oligonucleotide
  Target: ATXN1; (-) strand; PAM type: YTN; PAM sequence: TTG
ctgcacctattaacctgtca

SEQ ID NO: 199291 - DNA, 20 bp, Artificial Sequence
  Description of Artificial Sequence: Synthetic oligonucleotide
  Target: ATXN1; (-) strand; PAM type: YTN; PAM sequence: TTT
gctgcacctattaacctgtc

SEQ ID NO: 199292 - DNA, 20 bp, Artificial Sequence
  Description of Artificial Sequence: Synthetic oligonucleotide
  Target: ATXN1; (-) strand; PAM type: YTN; PAM sequence: CTG
gtggtttgctgcacctatta

SEQ ID NO: 199293 - DNA, 20 bp, Artificial Sequence
  Description of Artificial Sequence: Synthetic oligonucleotide
  Target: ATXN1; (-) strand; PAM type: YTN; PAM sequence: TTC
tggtggtttgctgcacctat

SEQ ID NO: 199294 - DNA, 20 bp, Artificial Sequence
  Description of Artificial Sequence: Synthetic oligonucleotide
  Target: ATXN1; (-) strand; PAM type: YTN; PAM sequence: TTG
cataggtatacatgtgttct

SEQ ID NO: 199295 - DNA, 20 bp, Artificial Sequence
  Description of Artificial Sequence: Synthetic oligonucleotide
  Target: ATXN1; (-) strand; PAM type: YTN; PAM sequence: CTG
ttgcataggtatacatgtgt

SEQ ID NO: 199296 - DNA, 20 bp, Artificial Sequence
  Description of Artificial Sequence: Synthetic oligonucleotide
  Target: ATXN1; (-) strand; PAM type: YTN; PAM sequence: CTG
gggtacatatgtagaacatg

SEQ ID NO: 199297 - DNA, 20 bp, Artificial Sequence
  Description of Artificial Sequence: Synthetic oligonucleotide
  Target: ATXN1; (-) strand; PAM type: YTN; PAM sequence: TTC
tggggtacatatgtagaaca

SEQ ID NO: 199298 - DNA, 20 bp, Artificial Sequence
  Description of Artificial Sequence: Synthetic oligonucleotide
  Target: ATXN1; (-) strand; PAM type: YTN; PAM sequence: TTA
agttctggggtacatatgta

SEQ ID NO: 199299 - DNA, 20 bp, Artificial Sequence
  Description of Artificial Sequence: Synthetic oligonucleotide
  Target: ATXN1; (-) strand; PAM type: YTN; PAM sequence: TTT
aagttctggggtacatatgt

SEQ ID NO: 199300 - DNA, 20 bp, Artificial Sequence
  Description of Artificial Sequence: Synthetic oligonucleotide
  Target: ATXN1; (-) strand; PAM type: YTN; PAM sequence: CTT
taagttctggggtacatatg

SEQ ID NO: 199301 - DNA, 20 bp, Artificial Sequence
  Description of Artificial Sequence: Synthetic oligonucleotide
  Target: ATXN1; (-) strand; PAM type: YTN; PAM sequence: TTA
ctttaagttctggggtacat

SEQ ID NO: 199302 - DNA, 20 bp, Artificial Sequence
  Description of Artificial Sequence: Synthetic oligonucleotide
  Target: ATXN1; (-) strand; PAM type: YTN; PAM sequence: TTT
actttaagttctggggtaca

SEQ ID NO: 199303 - DNA, 20 bp, Artificial Sequence
  Description of Artificial Sequence: Synthetic oligonucleotide
  Target: ATXN1; (-) strand; PAM type: YTN; PAM sequence: TTT
tactttaagttctggggtac

SEQ ID NO: 199304 - DNA, 20 bp, Artificial Sequence
  Description of Artificial Sequence: Synthetic oligonucleotide
  Target: ATXN1; (-) strand; PAM type: YTN; PAM sequence: TTA
ttttactttaagttctgggg

SEQ ID NO: 199305 - DNA, 20 bp, Artificial Sequence
  Description of Artificial Sequence: Synthetic oligonucleotide
  Target: ATXN1; (-) strand; PAM type: YTN; PAM sequence: TTT
attttactttaagttctggg

SEQ ID NO: 199306 - DNA, 20 bp, Artificial Sequence
  Description of Artificial Sequence: Synthetic oligonucleotide
  Target: ATXN1; (-) strand; PAM type: YTN; PAM sequence: TTA
tttattttactttaagttct

SEQ ID NO: 199307 - DNA, 20 bp, Artificial Sequence
  Description of Artificial Sequence: Synthetic oligonucleotide
  Target: ATXN1; (-) strand; PAM type: YTN; PAM sequence: TTT
atttattttactttaagttc

SEQ ID NO: 199308 - DNA, 20 bp, Artificial Sequence
  Description of Artificial Sequence: Synthetic oligonucleotide
  Target: ATXN1; (-) strand; PAM type: YTN; PAM sequence: TTA
tttatttattttactttaag

SEQ ID NO: 199309 - DNA, 20 bp, Artificial Sequence
  Description of Artificial Sequence: Synthetic oligonucleotide
  Target: ATXN1; (-) strand; PAM type: YTN; PAM sequence: TTT
atttatttattttactttaa

SEQ ID NO: 199310 - DNA, 20 bp, Artificial Sequence
  Description of Artificial Sequence: Synthetic oligonucleotide
  Target: ATXN1; (-) strand; PAM type: YTN; PAM sequence: TTT
tatttatttattttacttta

SEQ ID NO: 199311 - DNA, 20 bp, Artificial Sequence
  Description of Artificial Sequence: Synthetic oligonucleotide
  Target: ATXN1; (-) strand; PAM type: YTN; PAM sequence: TTG
tattttatttatttatttta

SEQ ID NO: 199312 - DNA, 20 bp, Artificial Sequence
  Description of Artificial Sequence: Synthetic oligonucleotide
  Target: ATXN1; (-) strand; PAM type: YTN; PAM sequence: TTT
gtattttatttatttatttt

SEQ ID NO: 199313 - DNA, 20 bp, Artificial Sequence
  Description of Artificial Sequence: Synthetic oligonucleotide
  Target: ATXN1; (-) strand; PAM type: YTN; PAM sequence: TTT
tgtattttatttatttattt

SEQ ID NO: 199314 - DNA, 20 bp, Artificial Sequence
  Description of Artificial Sequence: Synthetic oligonucleotide
  Target: ATXN1; (-) strand; PAM type: YTN; PAM sequence: TTT
ttgtattttatttatttatt

SEQ ID NO: 199315 - DNA, 20 bp, Artificial Sequence
  Description of Artificial Sequence: Synthetic oligonucleotide
  Target: ATXN1; (-) strand; PAM type: YTN; PAM sequence: TTT
tttgtattttatttatttat

SEQ ID NO: 199316 - DNA, 20 bp, Artificial Sequence
  Description of Artificial Sequence: Synthetic oligonucleotide
  Target: ATXN1; (-) strand; PAM type: YTN; PAM sequence: TTT
ttttgtattttatttattta

SEQ ID NO: 199317 - DNA, 20 bp, Artificial Sequence
  Description of Artificial Sequence: Synthetic oligonucleotide
  Target: ATXN1; (-) strand; PAM type: YTN; PAM sequence: TTT
tttttgtattttatttattt

SEQ ID NO: 199318 - DNA, 20 bp, Artificial Sequence
  Description of Artificial Sequence: Synthetic oligonucleotide
  Target: ATXN1; (-) strand; PAM type: YTN; PAM sequence: TTT
ttttttgtattttatttatt

SEQ ID NO: 199319 - DNA, 20 bp, Artificial Sequence
  Description of Artificial Sequence: Synthetic oligonucleotide
  Target: ATXN1; (-) strand; PAM type: YTN; PAM sequence: TTT
tttttttgtattttatttat

SEQ ID NO: 199320 - DNA, 20 bp, Artificial Sequence
  Description of Artificial Sequence: Synthetic oligonucleotide
  Target: ATXN1; (-) strand; PAM type: YTN; PAM sequence: TTT
ttttttttgtattttattta

SEQ ID NO: 199321 - DNA, 20 bp, Artificial Sequence
  Description of Artificial Sequence: Synthetic oligonucleotide
  Target: ATXN1; (-) strand; PAM type: YTN; PAM sequence: TTT
tttttttttgtattttattt

SEQ ID NO: 199322 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgtattttatt

SEQ ID NO: 199323 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgtattttat

SEQ ID NO: 199324 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgtatttta

SEQ ID NO: 199325 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgtatttt

SEQ ID NO: 199326 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgtattt

SEQ ID NO: 199327 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgtatt

SEQ ID NO: 199328 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgtat

SEQ ID NO: 199329 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttttttgta

SEQ ID NO: 199330 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttttttg

SEQ ID NO: 199331 - DNA, 20 bp, Artificial Sequence
  Description of Artificial Sequence: Synthetic oligonucleotide
  Target: ATXN1; (-) strand; PAM type: YTN; PAM sequence: CTA
ttcttttttttttttttttt

SEQ ID NO: 199332 - DNA, 20 bp, Artificial Sequence
  Description of Artificial Sequence: Synthetic oligonucleotide
  Target: ATXN1; (-) strand; PAM type: YTN; PAM sequence: TTG
catgcctattcttttttttt

SEQ ID NO: 199333 - DNA, 20 bp, Artificial Sequence
  Description of Artificial Sequence: Synthetic oligonucleotide
  Target: ATXN1; (-) strand; PAM type: YTN; PAM sequence: CTA
gggtgtgtccataagcattg

SEQ ID NO: 199334 - DNA, 20 bp, Artificial Sequence
  Description of Artificial Sequence: Synthetic oligonucleotide
  Target: ATXN1; (-) strand; PAM type: YTN; PAM sequence: TTG
ctagggtgtgtccataagca

SEQ ID NO: 199335 - DNA, 20 bp, Artificial Sequence
  Description of Artificial Sequence: Synthetic oligonucleotide
  Target: ATXN1; (-) strand; PAM type: YTN; PAM sequence: CTT
gctagggtgtgtccataagc

SEQ ID NO: 199336 - DNA, 20 bp, Artificial Sequence
  Description of Artificial Sequence: Synthetic oligonucleotide
  Target: ATXN1; (-) strand; PAM type: YTN; PAM sequence: TTG
gtatccatgtaaaaccagtg

SEQ ID NO: 199337 - DNA, 20 bp, Artificial Sequence
  Description of Artificial Sequence: Synthetic oligonucleotide
  Target: ATXN1; (-) strand; PAM type: YTN; PAM sequence: CTT
ggtatccatgtaaaaccagt

SEQ ID NO: 199338 - DNA, 20 bp, Artificial Sequence
  Description of Artificial Sequence: Synthetic oligonucleotide
  Target: ATXN1; (-) strand; PAM type: YTN; PAM sequence: CTG
agagggtgcaggagggaagg

SEQ ID NO: 199339 - DNA, 20 bp, Artificial Sequence
  Description of Artificial Sequence: Synthetic oligonucleotide
  Target: ATXN1; (-) strand; PAM type: YTN; PAM sequence: TTG
ccagagctgagagggtgcag

SEQ ID NO: 199340 - DNA, 20 bp, Artificial Sequence
  Description of Artificial Sequence: Synthetic oligonucleotide
  Target: ATXN1; (-) strand; PAM type: YTN; PAM sequence: TTG
tgtgatagccacattgccag

SEQ ID NO: 199341 - DNA, 20 bp, Artificial Sequence
  Description of Artificial Sequence: Synthetic oligonucleotide
  Target: ATXN1; (-) strand; PAM type: YTN; PAM sequence: TTG
acatgcagattgtgtgatag

SEQ ID NO: 199342 - DNA, 20 bp, Artificial Sequence
  Description of Artificial Sequence: Synthetic oligonucleotide
  Target: ATXN1; (-) strand; PAM type: YTN; PAM sequence: TTG
gaagaggccatgttgacatg

SEQ ID NO: 199343 - DNA, 20 bp, Artificial Sequence
  Description of Artificial Sequence: Synthetic oligonucleotide
  Target: ATXN1; (-) strand; PAM type: YTN; PAM sequence: TTG
acaggagcatgtggttggaa

SEQ ID NO: 199344 - DNA, 20 bp, Artificial Sequence
  Description of Artificial Sequence: Synthetic oligonucleotide
  Target: ATXN1; (-) strand; PAM type: YTN; PAM sequence: CTG
aatatgcagaagaggatgga

SEQ ID NO: 199345 - DNA, 20 bp, Artificial Sequence
  Description of Artificial Sequence: Synthetic oligonucleotide
  Target: ATXN1; (-) strand; PAM type: YTN; PAM sequence: TTG
tcccaaatatacaagggatg

SEQ ID NO: 199346 - DNA, 20 bp, Artificial Sequence
  Description of Artificial Sequence: Synthetic oligonucleotide
  Target: ATXN1; (-) strand; PAM type: YTN; PAM sequence: CTC
agattgtcccaaatatacaa

SEQ ID NO: 199347 - DNA, 20 bp, Artificial Sequence
  Description of Artificial Sequence: Synthetic oligonucleotide
  Target: ATXN1; (-) strand; PAM type: YTN; PAM sequence: CTC
tcagattgtcccaaatatac

SEQ ID NO: 199348 - DNA, 20 bp, Artificial Sequence
  Description of Artificial Sequence: Synthetic oligonucleotide
  Target: ATXN1; (-) strand; PAM type: YTN; PAM sequence: CTA
ggataccctctcagattgtc

SEQ ID NO: 199349 - DNA, 20 bp, Artificial Sequence
  Description of Artificial Sequence: Synthetic oligonucleotide
  Target: ATXN1; (-) strand; PAM type: YTN; PAM sequence: TTC
taggataccctctcagattg

SEQ ID NO: 199350 - DNA, 20 bp, Artificial Sequence
  Description of Artificial Sequence: Synthetic oligonucleotide
  Target: ATXN1; (-) strand; PAM type: YTN; PAM sequence: TTT
ctaggataccctctcagatt

SEQ ID NO: 199351 - DNA, 20 bp, Artificial Sequence
  Description of Artificial Sequence: Synthetic oligonucleotide
  Target: ATXN1; (-) strand; PAM type: YTN; PAM sequence: TTT
tctaggataccctctcagat

SEQ ID NO: 199352 - DNA, 20 bp, Artificial Sequence
  Description of Artificial Sequence: Synthetic oligonucleotide
  Target: ATXN1; (-) strand; PAM type: YTN; PAM sequence: CTT
ttctaggataccctctcaga

SEQ ID NO: 199353 - DNA, 20 bp, Artificial Sequence
  Description of Artificial Sequence: Synthetic oligonucleotide
  Target: ATXN1; (-) strand; PAM type: YTN; PAM sequence: TTC
ccttttctaggataccctct

SEQ ID NO: 199354 - DNA, 20 bp, Artificial Sequence
  Description of Artificial Sequence: Synthetic oligonucleotide
  Target: ATXN1; (-) strand; PAM type: YTN; PAM sequence: TTG
gattcccttttctaggatac

SEQ ID NO: 199355 - DNA, 20 bp, Artificial Sequence
  Description of Artificial Sequence: Synthetic oligonucleotide
  Target: ATXN1; (-) strand; PAM type: YTN; PAM sequence: TTT
ggattcccttttctaggata

SEQ ID NO: 199356 - DNA, 20 bp, Artificial Sequence
  Description of Artificial Sequence: Synthetic oligonucleotide
  Target: ATXN1; (-) strand; PAM type: YTN; PAM sequence: CTG
tagaaatagatcaaaatgta

SEQ ID NO: 199357 - DNA, 20 bp, Artificial Sequence
  Description of Artificial Sequence: Synthetic oligonucleotide
  Target: ATXN1; (-) strand; PAM type: YTN; PAM sequence: CTA
ctgtagaaatagatcaaaat

SEQ ID NO: 199358 - DNA, 20 bp, Artificial Sequence
  Description of Artificial Sequence: Synthetic oligonucleotide
  Target: ATXN1; (-) strand; PAM type: YTN; PAM sequence: TTA
tgcctactgtagaaatagat

SEQ ID NO: 199359 - DNA, 20 bp, Artificial Sequence
  Description of Artificial Sequence: Synthetic oligonucleotide
  Target: ATXN1; (-) strand; PAM type: YTN; PAM sequence: CTA
ataattatgcctactgtaga

SEQ ID NO: 199360 - DNA, 20 bp, Artificial Sequence
  Description of Artificial Sequence: Synthetic oligonucleotide
  Target: ATXN1; (-) strand; PAM type: YTN; PAM sequence: TTA
tggcctaataattatgccta

SEQ ID NO: 199361 - DNA, 20 bp, Artificial Sequence
  Description of Artificial Sequence: Synthetic oligonucleotide
  Target: ATXN1; (-) strand; PAM type: YTN; PAM sequence: CTT
atggcctaataattatgcct

SEQ ID NO: 199362 - DNA, 20 bp, Artificial Sequence
  Description of Artificial Sequence: Synthetic oligonucleotide
  Target: ATXN1; (-) strand; PAM type: YTN; PAM sequence: CTC
acttatggcctaataattat

SEQ ID NO: 199363 - DNA, 20 bp, Artificial Sequence
  Description of Artificial Sequence: Synthetic oligonucleotide
  Target: ATXN1; (-) strand; PAM type: YTN; PAM sequence: CTA
cagaagagcatagtcaacag

SEQ ID NO: 199364 - DNA, 20 bp, Artificial Sequence
  Description of Artificial Sequence: Synthetic oligonucleotide
  Target: ATXN1; (-) strand; PAM type: YTN; PAM sequence: TTA
aaactacagaagagcatagt

SEQ ID NO: 199365 - DNA, 20 bp, Artificial Sequence
  Description of Artificial Sequence: Synthetic oligonucleotide
  Target: ATXN1; (-) strand; PAM type: YTN; PAM sequence: TTT
aaaactacagaagagcatag

SEQ ID NO: 199366 - DNA, 20 bp, Artificial Sequence
  Description of Artificial Sequence: Synthetic oligonucleotide
  Target: ATXN1; (-) strand; PAM type: YTN; PAM sequence: TTT
taaaactacagaagagcata

SEQ ID NO: 199367 - DNA, 20 bp, Artificial Sequence
  Description of Artificial Sequence: Synthetic oligonucleotide
  Target: ATXN1; (-) strand; PAM type: YTN; PAM sequence: CTT
ttaaaactacagaagagcat

SEQ ID NO: 199368 - DNA, 20 bp, Artificial Sequence
  Description of Artificial Sequence: Synthetic oligonucleotide
  Target: ATXN1; (-) strand; PAM type: YTN; PAM sequence: TTA
tgcatgaaaggcacttttaa

SEQ ID NO: 199369 - DNA, 20 bp, Artificial Sequence
  Description of Artificial Sequence: Synthetic oligonucleotide
  Target: ATXN1; (-) strand; PAM type: YTN; PAM sequence: CTA
ttatgcatgaaaggcacttt

SEQ ID NO: 199370 - DNA, 20 bp, Artificial Sequence
  Description of Artificial Sequence: Synthetic oligonucleotide
  Target: ATXN1; (-) strand; PAM type: YTN; PAM sequence: CTG
caactattatgcatgaaagg

SEQ ID NO: 199371 - DNA, 20 bp, Artificial Sequence
  Description of Artificial Sequence: Synthetic oligonucleotide
  Target: ATXN1; (-) strand; PAM type: YTN; PAM sequence: TTC
tgcaactattatgcatgaaa

SEQ ID NO: 199372 - DNA, 20 bp, Artificial Sequence
  Description of Artificial Sequence: Synthetic oligonucleotide
  Target: ATXN1; (-) strand; PAM type: YTN; PAM sequence: TTA
tattctgcaactattatgca

SEQ ID NO: 199373 - DNA, 20 bp, Artificial Sequence
  Description of Artificial Sequence: Synthetic oligonucleotide
  Target: ATXN1; (-) strand; PAM type: YTN; PAM sequence: TTA
agtaattatattctgcaact

SEQ ID NO: 199374 - DNA, 20 bp, Artificial Sequence
  Description of Artificial Sequence: Synthetic oligonucleotide
  Target: ATXN1; (-) strand; PAM type: YTN; PAM sequence: TTG
ttaagtaattatattctgca

SEQ ID NO: 199375 - DNA, 20 bp, Artificial Sequence
  Description of Artificial Sequence: Synthetic oligonucleotide
  Target: ATXN1; (-) strand; PAM type: YTN; PAM sequence: TTA
gggttgttaagtaattatat

SEQ ID NO: 199376 - DNA, 20 bp, Artificial Sequence
  Description of Artificial Sequence: Synthetic oligonucleotide
  Target: ATXN1; (-) strand; PAM type: YTN; PAM sequence: TTA
ttagggttgttaagtaatta

SEQ ID NO: 199377 - DNA, 20 bp, Artificial Sequence
  Description of Artificial Sequence: Synthetic oligonucleotide
  Target: ATXN1; (-) strand; PAM type: YTN; PAM sequence: TTT
attagggttgttaagtaatt

SEQ ID NO: 199378 - DNA, 20 bp, Artificial Sequence
  Description of Artificial Sequence: Synthetic oligonucleotide
  Target: ATXN1; (-) strand; PAM type: YTN; PAM sequence: CTA
tttattagggttgttaagta

SEQ ID NO: 199379 - DNA, 20 bp, Artificial Sequence
  Description of Artificial Sequence: Synthetic oligonucleotide
  Target: ATXN1; (-) strand; PAM type: YTN; PAM sequence: TTA
ctatttattagggttgttaa

SEQ ID NO: 199380 - DNA, 20 bp, Artificial Sequence
  Description of Artificial Sequence: Synthetic oligonucleotide
  Target: ATXN1; (-) strand; PAM type: YTN; PAM sequence: TTA
tgttactatttattagggtt

SEQ ID NO: 199381 - DNA, 20 bp, Artificial Sequence
  Description of Artificial Sequence: Synthetic oligonucleotide
  Target: ATXN1; (-) strand; PAM type: YTN; PAM sequence: TTG
ggaataattatgttactatt

SEQ ID NO: 199382 - DNA, 20 bp, Artificial Sequence
  Description of Artificial Sequence: Synthetic oligonucleotide
  Target: ATXN1; (-) strand; PAM type: YTN; PAM sequence: CTA
taaattgggaataattatgt

SEQ ID NO: 199383 - DNA, 20 bp, Artificial Sequence
  Description of Artificial Sequence: Synthetic oligonucleotide
  Target: ATXN1; (-) strand; PAM type: YTN; PAM sequence: TTC
tataaattgggaataattat

SEQ ID NO: 199384 - DNA, 20 bp, Artificial Sequence
  Description of Artificial Sequence: Synthetic oligonucleotide
  Target: ATXN1; (-) strand; PAM type: YTN; PAM sequence: TTT
ctataaattgggaataatta

SEQ ID NO: 199385 - DNA, 20 bp, Artificial Sequence
  Description of Artificial Sequence: Synthetic oligonucleotide
  Target: ATXN1; (-) strand; PAM type: YTN; PAM sequence: TTT
tctataaattgggaataatt

SEQ ID NO: 199386 - DNA, 20 bp, Artificial Sequence
  Description of Artificial Sequence: Synthetic oligonucleotide
  Target: ATXN1; (-) strand; PAM type: YTN; PAM sequence: CTT
ttctataaattgggaataat

SEQ ID NO: 199387 - DNA, 20 bp, Artificial Sequence
  Description of Artificial Sequence: Synthetic oligonucleotide
  Target: ATXN1; (-) strand; PAM type: YTN; PAM sequence: TTC
ttttctataaattgggaata

SEQ ID NO: 199388 - DNA, 20 bp, Artificial Sequence
  Description of Artificial Sequence: Synthetic oligonucleotide
  Target: ATXN1; (-) strand; PAM type: YTN; PAM sequence: TTT
cttttctataaattgggaat

SEQ ID NO: 199389 - DNA, 20 bp, Artificial Sequence
  Description of Artificial Sequence: Synthetic oligonucleotide
  Target: ATXN1; (-) strand; PAM type: YTN; PAM sequence: TTC
agtttcttttctataaattg

SEQ ID NO: 199390 - DNA, 20 bp, Artificial Sequence
  Description of Artificial Sequence: Synthetic oligonucleotide
  Target: ATXN1; (-) strand; PAM type: YTN; PAM sequence: CTT
cagtttcttttctataaatt

SEQ ID NO: 199391 - DNA, 20 bp, Artificial Sequence
  Description of Artificial Sequence: Synthetic oligonucleotide
  Target: ATXN1; (-) strand; PAM type: YTN; PAM sequence: TTG
agcttcagtttcttttctat

SEQ ID NO: 199392 - DNA, 20 bp, Artificial Sequence
  Description of Artificial Sequence: Synthetic oligonucleotide
  Target: ATXN1; (-) strand; PAM type: YTN; PAM sequence: TTT
gagcttcagtttcttttcta

SEQ ID NO: 199393 - DNA, 20 bp, Artificial Sequence
  Description of Artificial Sequence: Synthetic oligonucleotide
  Target: ATXN1; (-) strand; PAM type: YTN; PAM sequence: TTT
tgagcttcagtttcttttct

SEQ ID NO: 199394 - DNA, 20 bp, Artificial Sequence
  Description of Artificial Sequence: Synthetic oligonucleotide
  Target: ATXN1; (-) strand; PAM type: YTN; PAM sequence: TTT
ttgagcttcagtttcttttc

SEQ ID NO: 199395 - DNA, 20 bp, Artificial Sequence
  Description of Artificial Sequence: Synthetic oligonucleotide
  Target: ATXN1; (-) strand; PAM type: YTN; PAM sequence: CTT
tttgagcttcagtttctttt

SEQ ID NO: 199396 - DNA, 20 bp, Artificial Sequence
  Description of Artificial Sequence: Synthetic oligonucleotide
  Target: ATXN1; (-) strand; PAM type: YTN; PAM sequence: CTA
acctttttgagcttcagttt

SEQ ID NO: 199397 - DNA, 20 bp, Artificial Sequence
  Description of Artificial Sequence: Synthetic oligonucleotide
  Target: ATXN1; (-) strand; PAM type: YTN; PAM sequence: TTA
cctaacctttttgagcttca

SEQ ID NO: 199398 - DNA, 20 bp, Artificial Sequence
  Description of Artificial Sequence: Synthetic oligonucleotide
  Target: ATXN1; (-) strand; PAM type: YTN; PAM sequence: CTT
acctaacctttttgagcttc

SEQ ID NO: 199399 - DNA, 20 bp, Artificial Sequence
  Description of Artificial Sequence: Synthetic oligonucleotide
  Target: ATXN1; (-) strand; PAM type: YTN; PAM sequence: CTG
acttacctaacctttttgag

SEQ ID NO: 199400 - DNA, 20 bp, Artificial Sequence
  Description of Artificial Sequence: Synthetic oligonucleotide
  Target: ATXN1; (-) strand; PAM type: YTN; PAM sequence: CTG
tgtgtccatggctgacttac

SEQ ID NO: 199401 - DNA, 20 bp, Artificial Sequence
  Description of Artificial Sequence: Synthetic oligonucleotide
  Target: ATXN1; (-) strand; PAM type: YTN; PAM sequence: TTA
gctgtgtgtccatggctgac

SEQ ID NO: 199402 - DNA, 20 bp, Artificial Sequence
  Description of Artificial Sequence: Synthetic oligonucleotide
  Target: ATXN1; (-) strand; PAM type: YTN; PAM sequence: TTA
ttagctgtgtgtccatggct

SEQ ID NO: 199403 - DNA, 20 bp, Artificial Sequence
  Description of Artificial Sequence: Synthetic oligonucleotide
  Target: ATXN1; (-) strand; PAM type: YTN; PAM sequence: TTT
attagctgtgtgtccatggc

SEQ ID NO: 199404 - DNA, 20 bp, Artificial Sequence
  Description of Artificial Sequence: Synthetic oligonucleotide
  Target: ATXN1; (-) strand; PAM type: YTN; PAM sequence: CTG
tggtttattagctgtgtgtc

SEQ ID NO: 199405 - DNA, 20 bp, Artificial Sequence
  Description of Artificial Sequence: Synthetic oligonucleotide
  Target: ATXN1; (-) strand; PAM type: YTN; PAM sequence: CTC
tgtggtttattagctgtgtg

SEQ ID NO: 199406 - DNA, 20 bp, Artificial Sequence
  Description of Artificial Sequence: Synthetic oligonucleotide
  Target: ATXN1; (-) strand; PAM type: YTN; PAM sequence: TTG
gctctgtggtttattagctg

SEQ ID NO: 199407 - DNA, 20 bp, Artificial Sequence
  Description of Artificial Sequence: Synthetic oligonucleotide
  Target: ATXN1; (-) strand; PAM type: YTN; PAM sequence: TTT
ggctctgtggtttattagct

SEQ ID NO: 199408 - DNA, 20 bp, Artificial Sequence
  Description of Artificial Sequence: Synthetic oligonucleotide
  Target: ATXN1; (-) strand; PAM type: YTN; PAM sequence: TTT
tggctctgtggtttattagc

SEQ ID NO: 199409 - DNA, 20 bp, Artificial Sequence
  Description of Artificial Sequence: Synthetic oligonucleotide
  Target: ATXN1; (-) strand; PAM type: YTN; PAM sequence: TTC
gaagagatgagtattttggc

SEQ ID NO: 199410 - DNA, 20 bp, Artificial Sequence
  Description of Artificial Sequence: Synthetic oligonucleotide
  Target: ATXN1; (-) strand; PAM type: YTN; PAM sequence: TTG
acattcgaagagatgagtat

SEQ ID NO: 199411 - DNA, 20 bp, Artificial Sequence
  Description of Artificial Sequence: Synthetic oligonucleotide
  Target: ATXN1; (-) strand; PAM type: YTN; PAM sequence: CTT
gacattcgaagagatgagta

SEQ ID NO: 199412 - DNA, 20 bp, Artificial Sequence
  Description of Artificial Sequence: Synthetic oligonucleotide
  Target: ATXN1; (-) strand; PAM type: YTN; PAM sequence: TTG
caaaaaatgtatagaacttg

SEQ ID NO: 199413 - DNA, 20 bp, Artificial Sequence
  Description of Artificial Sequence: Synthetic oligonucleotide
  Target: ATXN1; (-) strand; PAM type: YTN; PAM sequence: CTA
tatgttgcaaaaaatgtata

SEQ ID NO: 199414 - DNA, 20 bp, Artificial Sequence
  Description of Artificial Sequence: Synthetic oligonucleotide
  Target: ATXN1; (-) strand; PAM type: YTN; PAM sequence: CTG
tgtcatactatatgttgcaa

SEQ ID NO: 199415 - DNA, 20 bp, Artificial Sequence
  Description of Artificial Sequence: Synthetic oligonucleotide
  Target: ATXN1; (-) strand; PAM type: YTN; PAM sequence: CTA
atacagactgtgtcatacta

SEQ ID NO: 199416 - DNA, 20 bp, Artificial Sequence
  Description of Artificial Sequence: Synthetic oligonucleotide
  Target: ATXN1; (-) strand; PAM type: YTN; PAM sequence: TTG
ataatctaatacagactgtg

SEQ ID NO: 199417 - DNA, 20 bp, Artificial Sequence
  Description of Artificial Sequence: Synthetic oligonucleotide
  Target: ATXN1; (-) strand; PAM type: YTN; PAM sequence: TTT
gataatctaatacagactgt

SEQ ID NO: 199418 - DNA, 20 bp, Artificial Sequence
  Description of Artificial Sequence: Synthetic oligonucleotide
  Target: ATXN1; (-) strand; PAM type: YTN; PAM sequence: TTT
tgataatctaatacagactg

SEQ ID NO: 199419 - DNA, 20 bp, Artificial Sequence
  Description of Artificial Sequence: Synthetic oligonucleotide
  Target: ATXN1; (-) strand; PAM type: YTN; PAM sequence: TTT
ttgataatctaatacagact

SEQ ID NO: 199420 - DNA, 20 bp, Artificial Sequence
  Description of Artificial Sequence: Synthetic oligonucleotide
  Target: ATXN1; (-) strand; PAM type: YTN; PAM sequence: CTT
tttgataatctaatacagac

SEQ ID NO: 199421 - DNA, 20 bp, Artificial Sequence
  Description of Artificial Sequence: Synthetic oligonucleotide
  Target: ATXN1; (-) strand; PAM type: YTN; PAM sequence: TTA
atcctttttgataatctaat

SEQ ID NO: 199422 - DNA, 20 bp, Artificial Sequence
  Description of Artificial Sequence: Synthetic oligonucleotide
  Target: ATXN1; (-) strand; PAM type: YTN; PAM sequence: CTT
aatcctttttgataatctaa

SEQ ID NO: 199423 - DNA, 20 bp, Artificial Sequence
  Description of Artificial Sequence: Synthetic oligonucleotide
  Target: ATXN1; (-) strand; PAM type: YTN; PAM sequence: TTA
tagtcaagaaaaaaacttaa

SEQ ID NO: 199424 - DNA, 20 bp, Artificial Sequence
  Description of Artificial Sequence: Synthetic oligonucleotide
  Target: ATXN1; (-) strand; PAM type: YTN; PAM sequence: CTT
atagtcaagaaaaaaactta

SEQ ID NO: 199425 - DNA, 20 bp, Artificial Sequence
  Description of Artificial Sequence: Synthetic oligonucleotide
  Target: ATXN1; (-) strand; PAM type: YTN; PAM sequence: TTG
cttatagtcaagaaaaaaac

SEQ ID NO: 199426 - DNA, 20 bp, Artificial Sequence
  Description of Artificial Sequence: Synthetic oligonucleotide
  Target: ATXN1; (-) strand; PAM type: YTN; PAM sequence: CTA
ccatattgcttatagtcaag

SEQ ID NO: 199427 - DNA, 20 bp, Artificial Sequence
  Description of Artificial Sequence: Synthetic oligonucleotide
  Target: ATXN1; (-) strand; PAM type: YTN; PAM sequence: TTG
ctaccatattgcttatagtc

SEQ ID NO: 199428 - DNA, 20 bp, Artificial Sequence
  Description of Artificial Sequence: Synthetic oligonucleotide
  Target: ATXN1; (-) strand; PAM type: YTN; PAM sequence: TTA
ttgctaccatattgcttata

SEQ ID NO: 199429 - DNA, 20 bp, Artificial Sequence
  Description of Artificial Sequence: Synthetic oligonucleotide
  Target: ATXN1; (-) strand; PAM type: YTN; PAM sequence: TTC
aaatatggaatacaaacatg

SEQ ID NO: 199430 - DNA, 20 bp, Artificial Sequence
  Description of Artificial Sequence: Synthetic oligonucleotide
  Target: ATXN1; (-) strand; PAM type: YTN; PAM sequence: TTT
caaatatggaatacaaacat

SEQ ID NO: 199431 - DNA, 20 bp, Artificial Sequence
  Description of Artificial Sequence: Synthetic oligonucleotide
  Target: ATXN1; (-) strand; PAM type: YTN; PAM sequence: TTT
tcaaatatggaatacaaaca

SEQ ID NO: 199432 - DNA, 20 bp, Artificial Sequence
  Description of Artificial Sequence: Synthetic oligonucleotide
  Target: ATXN1; (-) strand; PAM type: YTN; PAM sequence: TTG
gaaaatgttttcaaatatgg

SEQ ID NO: 199433 - DNA, 20 bp, Artificial Sequence
  Description of Artificial Sequence: Synthetic oligonucleotide
  Target: ATXN1; (-) strand; PAM type: YTN; PAM sequence: TTT
ggaaaatgttttcaaatatg

SEQ ID NO: 199434 - DNA, 20 bp, Artificial Sequence
  Description of Artificial Sequence: Synthetic oligonucleotide
  Target: ATXN1; (-) strand; PAM type: YTN; PAM sequence: TTT
tggaaaatgttttcaaatat

SEQ ID NO: 199435 - DNA, 20 bp, Artificial Sequence
  Description of Artificial Sequence: Synthetic oligonucleotide
  Target: ATXN1; (-) strand; PAM type: YTN; PAM sequence: TTA
aaacattttggaaaatgttt

SEQ ID NO: 199436 - DNA, 20 bp, Artificial Sequence
  Description of Artificial Sequence: Synthetic oligonucleotide
  Target: ATXN1; (-) strand; PAM type: YTN; PAM sequence: CTG
aagttaaaacattttggaaa

SEQ ID NO: 199437 - DNA, 20 bp, Artificial Sequence
  Description of Artificial Sequence: Synthetic oligonucleotide
  Target: ATXN1; (-) strand; PAM type: YTN; PAM sequence: TTA
taaggaaaaataagacctga

SEQ ID NO: 199438 - DNA, 20 bp, Artificial Sequence
  Description of Artificial Sequence: Synthetic oligonucleotide
  Target: ATXN1; (-) strand; PAM type: YTN; PAM sequence: TTT
ataaggaaaaataagacctg

SEQ ID NO: 199439 - DNA, 20 bp, Artificial Sequence
  Description of Artificial Sequence: Synthetic oligonucleotide
  Target: ATXN1; (-) strand; PAM type: YTN; PAM sequence: TTT
tataaggaaaaataagacct

SEQ ID NO: 199440 - DNA, 20 bp, Artificial Sequence
  Description of Artificial Sequence: Synthetic oligonucleotide
  Target: ATXN1; (-) strand; PAM type: YTN; PAM sequence: TTT
ttataaggaaaaataagacc

SEQ ID NO: 199441 - DNA, 20 bp, Artificial Sequence
  Description of Artificial Sequence: Synthetic oligonucleotide
  Target: ATXN1; (-) strand; PAM type: YTN; PAM sequence: CTC
atgatttttataaggaaaaa

SEQ ID NO: 199442 - DNA, 20 bp, Artificial Sequence
  Description of Artificial Sequence: Synthetic oligonucleotide
  Target: ATXN1; (-) strand; PAM type: YTN; PAM sequence: CTA
ggagtaactcatgattttta

SEQ ID NO: 199443 - DNA, 20 bp, Artificial Sequence
  Description of Artificial Sequence: Synthetic oligonucleotide
  Target: ATXN1; (-) strand; PAM type: YTN; PAM sequence: CTG
taaaatggggctaggagtaa

SEQ ID NO: 199444 - DNA, 20 bp, Artificial Sequence
  Description of Artificial Sequence: Synthetic oligonucleotide
  Target: ATXN1; (-) strand; PAM type: YTN; PAM sequence: TTA
tcatctgtaaaatggggcta

SEQ ID NO: 199445 - DNA, 20 bp, Artificial Sequence
  Description of Artificial Sequence: Synthetic oligonucleotide
  Target: ATXN1; (-) strand; PAM type: YTN; PAM sequence: TTT
atcatctgtaaaatggggct

SEQ ID NO: 199446 - DNA, 20 bp, Artificial Sequence
  Description of Artificial Sequence: Synthetic oligonucleotide
  Target: ATXN1; (-) strand; PAM type: YTN; PAM sequence: TTA
atttatcatctgtaaaatgg

SEQ ID NO: 199447 - DNA, 20 bp, Artificial Sequence
  Description of Artificial Sequence: Synthetic oligonucleotide
  Target: ATXN1; (-) strand; PAM type: YTN; PAM sequence: CTT
aatttatcatctgtaaaatg

SEQ ID NO: 199448 - DNA, 20 bp, Artificial Sequence
  Description of Artificial Sequence: Synthetic oligonucleotide
  Target: ATXN1; (-) strand; PAM type: YTN; PAM sequence: CTG
ccttaatttatcatctgtaa

SEQ ID NO: 199449 - DNA, 20 bp, Artificial Sequence
  Description of Artificial Sequence: Synthetic oligonucleotide
  Target: ATXN1; (-) strand; PAM type: YTN; PAM sequence: CTC
tgccttaatttatcatctgt

SEQ ID NO: 199450 - DNA, 20 bp, Artificial Sequence
  Description of Artificial Sequence: Synthetic oligonucleotide
  Target: ATXN1; (-) strand; PAM type: YTN; PAM sequence: TTG
cataacctctgccttaattt

SEQ ID NO: 199451 - DNA, 20 bp, Artificial Sequence
  Description of Artificial Sequence: Synthetic oligonucleotide
  Target: ATXN1; (-) strand; PAM type: YTN; PAM sequence: TTA
ggcaagttgcataacctctg

SEQ ID NO: 199452 - DNA, 20 bp, Artificial Sequence
  Description of Artificial Sequence: Synthetic oligonucleotide
  Target: ATXN1; (-) strand; PAM type: YTN; PAM sequence: TTT
aggcaagttgcataacctct

SEQ ID NO: 199453 - DNA, 20 bp, Artificial Sequence
  Description of Artificial Sequence: Synthetic oligonucleotide
  Target: ATXN1; (-) strand; PAM type: YTN; PAM sequence: TTA
tttaggcaagttgcataacc

SEQ ID NO: 199454 - DNA, 20 bp, Artificial Sequence
  Description of Artificial Sequence: Synthetic oligonucleotide
  Target: ATXN1; (-) strand; PAM type: YTN; PAM sequence: TTT
atttaggcaagttgcataac

SEQ ID NO: 199455 - DNA, 20 bp, Artificial Sequence
  Description of Artificial Sequence: Synthetic oligonucleotide
  Target: ATXN1; (-) strand; PAM type: YTN; PAM sequence: TTA
gtttatttaggcaagttgca

SEQ ID NO: 199456 - DNA, 20 bp, Artificial Sequence
  Description of Artificial Sequence: Synthetic oligonucleotide
  Target: ATXN1; (-) strand; PAM type: YTN; PAM sequence: CTC
attagtttatttaggcaagt

SEQ ID NO: 199457 - DNA, 20 bp, Artificial Sequence
  Description of Artificial Sequence: Synthetic oligonucleotide
  Target: ATXN1; (-) strand; PAM type: YTN; PAM sequence: CTG
tcaactcattagtttattta

SEQ ID NO: 199458 - DNA, 20 bp, Artificial Sequence
  Description of Artificial Sequence: Synthetic oligonucleotide
  Target: ATXN1; (-) strand; PAM type: YTN; PAM sequence: TTC
aggtccactgtcaactcatt

SEQ ID NO: 199459 - DNA, 20 bp, Artificial Sequence
  Description of Artificial Sequence: Synthetic oligonucleotide
  Target: ATXN1; (-) strand; PAM type: YTN; PAM sequence: CTT
caggtccactgtcaactcat

SEQ ID NO: 199460 - DNA, 20 bp, Artificial Sequence
  Description of Artificial Sequence: Synthetic oligonucleotide
  Target: ATXN1; (-) strand; PAM type: YTN; PAM sequence: CTA
acttcaggtccactgtcaac

SEQ ID NO: 199461 - DNA, 20 bp, Artificial Sequence
  Description of Artificial Sequence: Synthetic oligonucleotide
  Target: ATXN1; (-) strand; PAM type: YTN; PAM sequence: TTC
taacttcaggtccactgtca

SEQ ID NO: 199462 - DNA, 20 bp, Artificial Sequence
  Description of Artificial Sequence: Synthetic oligonucleotide
  Target: ATXN1; (-) strand; PAM type: YTN; PAM sequence: TTA
ggatgcagtgattctaactt

SEQ ID NO: 199463 - DNA, 20 bp, Artificial Sequence
  Description of Artificial Sequence: Synthetic oligonucleotide
  Target: ATXN1; (-) strand; PAM type: YTN; PAM sequence: TTG
aattaggatgcagtgattct

SEQ ID NO: 199464 - DNA, 20 bp, Artificial Sequence
  Description of Artificial Sequence: Synthetic oligonucleotide
  Target: ATXN1; (-) strand; PAM type: YTN; PAM sequence: TTT
gaattaggatgcagtgattc

SEQ ID NO: 199465 - DNA, 20 bp, Artificial Sequence
  Description of Artificial Sequence: Synthetic oligonucleotide
  Target: ATXN1; (-) strand; PAM type: YTN; PAM sequence: TTT
tgaattaggatgcagtgatt

SEQ ID NO: 199466 - DNA, 20 bp, Artificial Sequence
  Description of Artificial Sequence: Synthetic oligonucleotide
  Target: ATXN1; (-) strand; PAM type: YTN; PAM sequence: TTT
ttgaattaggatgcagtgat

SEQ ID NO: 199467 - DNA, 20 bp, Artificial Sequence
  Description of Artificial Sequence: Synthetic oligonucleotide
  Target: ATXN1; (-) strand; PAM type: YTN; PAM sequence: CTA
gtttttgaattaggatgcag

SEQ ID NO: 199468 - DNA, 20 bp, Artificial Sequence
  Description of Artificial Sequence: Synthetic oligonucleotide
  Target: ATXN1; (-) strand; PAM type: YTN; PAM sequence: CTG
aaaagccatactagtttttg

SEQ ID NO: 199469 - DNA, 20 bp, Artificial Sequence
  Description of Artificial Sequence: Synthetic oligonucleotide
  Target: ATXN1; (-) strand; PAM type: YTN; PAM sequence: CTC
tgaaaagccatactagtttt

SEQ ID NO: 199470 - DNA, 20 bp, Artificial Sequence
  Description of Artificial Sequence: Synthetic oligonucleotide
  Target: ATXN1; (-) strand; PAM type: YTN; PAM sequence: TTA
tcccctctgaaaagccatac

SEQ ID NO: 199471 - DNA, 20 bp, Artificial Sequence
  Description of Artificial Sequence: Synthetic oligonucleotide
  Target: ATXN1; (-) strand; PAM type: YTN; PAM sequence: TTG
aattatcccctctgaaaagc

SEQ ID NO: 199472 - DNA, 20 bp, Artificial Sequence
  Description of Artificial Sequence: Synthetic oligonucleotide
  Target: ATXN1; (-) strand; PAM type: YTN; PAM sequence: TTA
ggttgaattatcccctctga

SEQ ID NO: 199473 - DNA, 20 bp, Artificial Sequence
  Description of Artificial Sequence: Synthetic oligonucleotide
  Target: ATXN1; (-) strand; PAM type: YTN; PAM sequence: CTC
caaggatgttaggttgaatt

SEQ ID NO: 199474 - DNA, 20 bp, Artificial Sequence
  Description of Artificial Sequence: Synthetic oligonucleotide
  Target: ATXN1; (-) strand; PAM type: YTN; PAM sequence: TTA
tgtctccaaggatgttaggt

SEQ ID NO: 199475 - DNA, 20 bp, Artificial Sequence
  Description of Artificial Sequence: Synthetic oligonucleotide
  Target: ATXN1; (-) strand; PAM type: YTN; PAM sequence: CTC
cagtgttatgtctccaagga

SEQ ID NO: 199476 - DNA, 20 bp, Artificial Sequence
  Description of Artificial Sequence: Synthetic oligonucleotide
  Target: ATXN1; (-) strand; PAM type: YTN; PAM sequence: TTA
tctccagtgttatgtctcca

SEQ ID NO: 199477 - DNA, 20 bp, Artificial Sequence
  Description of Artificial Sequence: Synthetic oligonucleotide
  Target: ATXN1; (-) strand; PAM type: YTN; PAM sequence: TTT
atctccagtgttatgtctcc

SEQ ID NO: 199478 - DNA, 20 bp, Artificial Sequence
  Description of Artificial Sequence: Synthetic oligonucleotide
  Target: ATXN1; (-) strand; PAM type: YTN; PAM sequence: TTT
tatctccagtgttatgtctc

SEQ ID NO: 199479 - DNA, 20 bp, Artificial Sequence
  Description of Artificial Sequence: Synthetic oligonucleotide
  Target: ATXN1; (-) strand; PAM type: YTN; PAM sequence: TTA
ttttatctccagtgttatgt

SEQ ID NO: 199480 - DNA, 20 bp, Artificial Sequence
  Description of Artificial Sequence: Synthetic oligonucleotide
  Target: ATXN1; (-) strand; PAM type: YTN; PAM sequence: TTA
tgttattttatctccagtgt

SEQ ID NO: 199481 - DNA, 20 bp, Artificial Sequence
  Description of Artificial Sequence: Synthetic oligonucleotide
  Target: ATXN1; (-) strand; PAM type: YTN; PAM sequence: TTT
atgttattttatctccagtg

SEQ ID NO: 199482 - DNA, 20 bp, Artificial Sequence
  Description of Artificial Sequence: Synthetic oligonucleotide
  Target: ATXN1; (-) strand; PAM type: YTN; PAM sequence: TTC
atttatgttattttatctcc

SEQ ID NO: 199483 - DNA, 20 bp, Artificial Sequence
  Description of Artificial Sequence: Synthetic oligonucleotide
  Target: ATXN1; (-) strand; PAM type: YTN; PAM sequence: CTT
catttatgttattttatctc

SEQ ID NO: 199484 - DNA, 20 bp, Artificial Sequence
  Description of Artificial Sequence: Synthetic oligonucleotide
  Target: ATXN1; (-) strand; PAM type: YTN; PAM sequence: TTC
ttcatttatgttattttatc

SEQ ID NO: 199485 - DNA, 20 bp, Artificial Sequence
  Description of Artificial Sequence: Synthetic oligonucleotide
  Target: ATXN1; (-) strand; PAM type: YTN; PAM sequence: TTA
ttcttcatttatgttatttt

SEQ ID NO: 199486 - DNA, 20 bp, Artificial Sequence
  Description of Artificial Sequence: Synthetic oligonucleotide
  Target: ATXN1; (-) strand; PAM type: YTN; PAM sequence: TTT
attcttcatttatgttattt

SEQ ID NO: 199487 - DNA, 20 bp, Artificial Sequence
  Description of Artificial Sequence: Synthetic oligonucleotide
  Target: ATXN1; (-) strand; PAM type: YTN; PAM sequence: TTT
tattcttcatttatgttatt

SEQ ID NO: 199488 - DNA, 20 bp, Artificial Sequence
  Description of Artificial Sequence: Synthetic oligonucleotide
  Target: ATXN1; (-) strand; PAM type: YTN; PAM sequence: TTT
ttattcttcatttatgttat

SEQ ID NO: 199489 - DNA, 20 bp, Artificial Sequence
  Description of Artificial Sequence: Synthetic oligonucleotide
  Target: ATXN1; (-) strand; PAM type: YTN; PAM sequence: CTT
tttattcttcatttatgtta

SEQ ID NO: 199490 - DNA, 20 bp, Artificial Sequence
  Description of Artificial Sequence: Synthetic oligonucleotide
  Target: ATXN1; (-) strand; PAM type: YTN; PAM sequence: TTC
tttttattcttcatttatgt

SEQ ID NO: 199491 - DNA, 20 bp, Artificial Sequence
  Description of Artificial Sequence: Synthetic oligonucleotide
  Target: ATXN1; (-) strand; PAM type: YTN; PAM sequence: TTT
ctttttattcttcatttatg

SEQ ID NO: 199492 - DNA, 20 bp, Artificial Sequence
  Description of Artificial Sequence: Synthetic oligonucleotide
  Target: ATXN1; (-) strand; PAM type: YTN; PAM sequence: TTT
tctttttattcttcatttat

SEQ ID NO: 199493 - DNA, 20 bp, Artificial Sequence
  Description of Artificial Sequence: Synthetic oligonucleotide
  Target: ATXN1; (-) strand; PAM type: YTN; PAM sequence: TTT
ttctttttattcttcattta

SEQ ID NO: 199494 - DNA, 20 bp, Artificial Sequence
  Description of Artificial Sequence: Synthetic oligonucleotide
  Target: ATXN1; (-) strand; PAM type: YTN; PAM sequence: TTA
tccaagatttttctttttat

SEQ ID NO: 199495 - DNA, 20 bp, Artificial Sequence
  Description of Artificial Sequence: Synthetic oligonucleotide
  Target: ATXN1; (-) strand; PAM type: YTN; PAM sequence: CTT
atccaagatttttcttttta

SEQ ID NO: 199496 - DNA, 20 bp, Artificial Sequence
  Description of Artificial Sequence: Synthetic oligonucleotide
  Target: ATXN1; (-) strand; PAM type: YTN; PAM sequence: CTG
cagtaaaatatgtaggaact

SEQ ID NO: 199497 - DNA, 20 bp, Artificial Sequence
  Description of Artificial Sequence: Synthetic oligonucleotide
  Target: ATXN1; (-) strand; PAM type: YTN; PAM sequence: TTC
ctgcagtaaaatatgtagga

SEQ ID NO: 199498 - DNA, 20 bp, Artificial Sequence
  Description of Artificial Sequence: Synthetic oligonucleotide
  Target: ATXN1; (-) strand; PAM type: YTN; PAM sequence: CTT
cctgcagtaaaatatgtagg

SEQ ID NO: 199499 - DNA, 20 bp, Artificial Sequence
  Description of Artificial Sequence: Synthetic oligonucleotide
  Target: ATXN1; (-) strand; PAM type: YTN; PAM sequence: TTC
ttcctgcagtaaaatatgta

SEQ ID NO: 199500 - DNA, 20 bp, Artificial Sequence
  Description of Artificial Sequence: Synthetic oligonucleotide
  Target: ATXN1; (-) strand; PAM type: YTN; PAM sequence: CTT
cttcctgcagtaaaatatgt

SEQ ID NO: 199501 - DNA, 20 bp, Artificial Sequence
  Description of Artificial Sequence: Synthetic oligonucleotide
  Target: ATXN1; (-) strand; PAM type: YTN; PAM sequence: CTG
caaacccatcacagaaatac

SEQ ID NO: 199502 - DNA, 20 bp, Artificial Sequence
  Description of Artificial Sequence: Synthetic oligonucleotide
  Target: ATXN1; (-) strand; PAM type: YTN; PAM sequence: TTC
tgcaaacccatcacagaaat

SEQ ID NO: 199503 - DNA, 20 bp, Artificial Sequence
  Description of Artificial Sequence: Synthetic oligonucleotide
  Target: ATXN1; (-) strand; PAM type: YTN; PAM sequence: CTG
ggatccgttctgcaaaccca

SEQ ID NO: 199504 - DNA, 20 bp, Artificial Sequence
  Description of Artificial Sequence: Synthetic oligonucleotide
  Target: ATXN1; (-) strand; PAM type: YTN; PAM sequence: TTC
acagcgctgggatccgttct

SEQ ID NO: 199505 - DNA, 20 bp, Artificial Sequence
  Description of Artificial Sequence: Synthetic oligonucleotide
  Target: ATXN1; (-) strand; PAM type: YTN; PAM sequence: CTT
cacagcgctgggatccgttc

SEQ ID NO: 199506 - DNA, 20 bp, Artificial Sequence
  Description of Artificial Sequence: Synthetic oligonucleotide
  Target: ATXN1; (-) strand; PAM type: YTN; PAM sequence: CTC
cttcacagcgctgggatccg

SEQ ID NO: 199507 - DNA, 20 bp, Artificial Sequence
  Description of Artificial Sequence: Synthetic oligonucleotide
  Target: ATXN1; (-) strand; PAM type: YTN; PAM sequence: CTG
gcctccttcacagcgctggg

SEQ ID NO: 199508 - DNA, 20 bp, Artificial Sequence
  Description of Artificial Sequence: Synthetic oligonucleotide
  Target: ATXN1; (-) strand; PAM type: YTN; PAM sequence: CTA
gactggcctccttcacagcg

SEQ ID NO: 199509 - DNA, 20 bp, Artificial Sequence
  Description of Artificial Sequence: Synthetic oligonucleotide
  Target: ATXN1; (-) strand; PAM type: YTN; PAM sequence: CTA
agggatatgggagcccgtct

SEQ ID NO: 199510 - DNA, 20 bp, Artificial Sequence
  Description of Artificial Sequence: Synthetic oligonucleotide
  Target: ATXN1; (-) strand; PAM type: YTN; PAM sequence: TTC
taagggatatgggagcccgt

SEQ ID NO: 199511 - DNA, 20 bp, Artificial Sequence
  Description of Artificial Sequence: Synthetic oligonucleotide
  Target: ATXN1; (-) strand; PAM type: YTN; PAM sequence: TTA
tgtgttctaagggatatggg

SEQ ID NO: 199512 - DNA, 20 bp, Artificial Sequence
  Description of Artificial Sequence: Synthetic oligonucleotide
  Target: ATXN1; (-) strand; PAM type: YTN; PAM sequence: TTT
atgtgttctaagggatatgg

SEQ ID NO: 199513 - DNA, 20 bp, Artificial Sequence
  Description of Artificial Sequence: Synthetic oligonucleotide
  Target: ATXN1; (-) strand; PAM type: YTN; PAM sequence: CTT
tatgtgttctaagggatatg

SEQ ID NO: 199514 - DNA, 20 bp, Artificial Sequence
  Description of Artificial Sequence: Synthetic oligonucleotide
  Target: ATXN1; (-) strand; PAM type: YTN; PAM sequence: TTC
ctttatgtgttctaagggat

SEQ ID NO: 199515 - DNA, 20 bp, Artificial Sequence
  Description of Artificial Sequence: Synthetic oligonucleotide
  Target: ATXN1; (-) strand; PAM type: YTN; PAM sequence: CTT
cctttatgtgttctaaggga

SEQ ID NO: 199516 - DNA, 20 bp, Artificial Sequence
  Description of Artificial Sequence: Synthetic oligonucleotide
  Target: ATXN1; (-) strand; PAM type: YTN; PAM sequence: CTA
gaatagcttcctttatgtgt

SEQ ID NO: 199517 - DNA, 20 bp, Artificial Sequence
  Description of Artificial Sequence: Synthetic oligonucleotide
  Target: ATXN1; (-) strand; PAM type: YTN; PAM sequence: TTG
cctagaatagcttcctttat

SEQ ID NO: 199518 - DNA, 20 bp, Artificial Sequence
  Description of Artificial Sequence: Synthetic oligonucleotide
  Target: ATXN1; (-) strand; PAM type: YTN; PAM sequence: CTT
gcctagaatagcttccttta

SEQ ID NO: 199519 - DNA, 20 bp, Artificial Sequence
  Description of Artificial Sequence: Synthetic oligonucleotide
  Target: ATXN1; (-) strand; PAM type: YTN; PAM sequence: TTG
tatgacttgcctagaatagc

SEQ ID NO: 199520 - DNA, 20 bp, Artificial Sequence
  Description of Artificial Sequence: Synthetic oligonucleotide
  Target: ATXN1; (-) strand; PAM type: YTN; PAM sequence: CTT
gtatgacttgcctagaatag

SEQ ID NO: 199521 - DNA, 20 bp, Artificial Sequence
  Description of Artificial Sequence: Synthetic oligonucleotide
  Target: ATXN1; (-) strand; PAM type: YTN; PAM sequence: TTC
accaatcacaagtcttgtat

SEQ ID NO: 199522 - DNA, 20 bp, Artificial Sequence
  Description of Artificial Sequence: Synthetic oligonucleotide
  Target: ATXN1; (-) strand; PAM type: YTN; PAM sequence: TTT
caccaatcacaagtcttgta

SEQ ID NO: 199523 - DNA, 20 bp, Artificial Sequence
  Description of Artificial Sequence: Synthetic oligonucleotide
  Target: ATXN1; (-) strand; PAM type: YTN; PAM sequence: TTT
tcaccaatcacaagtcttgt

SEQ ID NO: 199524 - DNA, 20 bp, Artificial Sequence
  Description of Artificial Sequence: Synthetic oligonucleotide
  Target: ATXN1; (-) strand; PAM type: YTN; PAM sequence: CTG
ttttcaccaatcacaagtct

SEQ ID NO: 199525 - DNA, 20 bp, Artificial Sequence
  Description of Artificial Sequence: Synthetic oligonucleotide
  Target: ATXN1; (-) strand; PAM type: YTN; PAM sequence: CTC
tgttttcaccaatcacaagt

SEQ ID NO: 199526 - DNA, 20 bp, Artificial Sequence
  Description of Artificial Sequence: Synthetic oligonucleotide
  Target: ATXN1; (-) strand; PAM type: YTN; PAM sequence: TTC
tctgttttcaccaatcacaa

SEQ ID NO: 199527 - DNA, 20 bp, Artificial Sequence
  Description of Artificial Sequence: Synthetic oligonucleotide
  Target: ATXN1; (-) strand; PAM type: YTN; PAM sequence: TTA
gaaaatatattctctgtttt

SEQ ID NO: 199528 - DNA, 20 bp, Artificial Sequence
  Description of Artificial Sequence: Synthetic oligonucleotide
  Target: ATXN1; (-) strand; PAM type: YTN; PAM sequence: CTG
tcatgaattagaaaatatat

SEQ ID NO: 199529 - DNA, 20 bp, Artificial Sequence
  Description of Artificial Sequence: Synthetic oligonucleotide
  Target: ATXN1; (-) strand; PAM type: YTN; PAM sequence: TTG
gggcctgtcatgaattagaa

SEQ ID NO: 199530 - DNA, 20 bp, Artificial Sequence
  Description of Artificial Sequence: Synthetic oligonucleotide
  Target: ATXN1; (-) strand; PAM type: YTN; PAM sequence: TTC
agatcgtgaaagaccaaagg

SEQ ID NO: 199531 - DNA, 20 bp, Artificial Sequence
  Description of Artificial Sequence: Synthetic oligonucleotide
  Target: ATXN1; (-) strand; PAM type: YTN; PAM sequence: TTC
atgaattcagatcgtgaaag

SEQ ID NO: 199532 - DNA, 20 bp, Artificial Sequence
  Description of Artificial Sequence: Synthetic oligonucleotide
  Target: ATXN1; (-) strand; PAM type: YTN; PAM sequence: TTT
catgaattcagatcgtgaaa

SEQ ID NO: 199533 - DNA, 20 bp, Artificial Sequence
  Description of Artificial Sequence: Synthetic oligonucleotide
  Target: ATXN1; (-) strand; PAM type: YTN; PAM sequence: CTT
tcatgaattcagatcgtgaa

SEQ ID NO: 199534 - DNA, 20 bp, Artificial Sequence
  Description of Artificial Sequence: Synthetic oligonucleotide
  Target: ATXN1; (-) strand; PAM type: YTN; PAM sequence: TTC
tttcatgaattcagatcgtg

SEQ ID NO: 199535 - DNA, 20 bp, Artificial Sequence
  Description of Artificial Sequence: Synthetic oligonucleotide
  Target: ATXN1; (-) strand; PAM type: YTN; PAM sequence: TTT
ctttcatgaattcagatcgt

SEQ ID NO: 199536 - DNA, 20 bp, Artificial Sequence
  Description of Artificial Sequence: Synthetic oligonucleotide
  Target: ATXN1; (-) strand; PAM type: YTN; PAM sequence: CTT
tctttcatgaattcagatcg

SEQ ID NO: 199537 - DNA, 20 bp, Artificial Sequence
  Description of Artificial Sequence: Synthetic oligonucleotide
  Target: ATXN1; (-) strand; PAM type: YTN; PAM sequence: CTG
gaatctttctttcatgaatt

SEQ ID NO: 199538 - DNA, 20 bp, Artificial Sequence
  Description of Artificial Sequence: Synthetic oligonucleotide
  Target: ATXN1; (-) strand; PAM type: YTN; PAM sequence: TTC
tggaatctttctttcatgaa

SEQ ID NO: 199539 - DNA, 20 bp, Artificial Sequence
  Description of Artificial Sequence: Synthetic oligonucleotide
  Target: ATXN1; (-) strand; PAM type: YTN; PAM sequence: CTT
ctggaatctttctttcatga

SEQ ID NO: 199540 - DNA, 20 bp, Artificial Sequence
  Description of Artificial Sequence: Synthetic oligonucleotide
  Target: ATXN1; (-) strand; PAM type: YTN; PAM sequence: TTC
cttctggaatctttctttca

SEQ ID NO: 199541 - DNA, 20 bp, Artificial Sequence
  Description of Artificial Sequence: Synthetic oligonucleotide
  Target: ATXN1; (-) strand; PAM type: YTN; PAM sequence: CTT
ccttctggaatctttctttc

SEQ ID NO: 199542 - DNA, 20 bp, Artificial Sequence
  Description of Artificial Sequence: Synthetic oligonucleotide
  Target: ATXN1; (-) strand; PAM type: YTN; PAM sequence: TTC
cacttccttctggaatcttt

SEQ ID NO: 199543 - DNA, 20 bp, Artificial Sequence
  Description of Artificial Sequence: Synthetic oligonucleotide
  Target: ATXN1; (-) strand; PAM type: YTN; PAM sequence: CTC
agattccacttccttctgga

SEQ ID NO: 199544 - DNA, 20 bp, Artificial Sequence
  Description of Artificial Sequence: Synthetic oligonucleotide
  Target: ATXN1; (-) strand; PAM type: YTN; PAM sequence: TTA
gctcagattccacttccttc

SEQ ID NO: 199545 - DNA, 20 bp, Artificial Sequence
  Description of Artificial Sequence: Synthetic oligonucleotide
  Target: ATXN1; (-) strand; PAM type: YTN; PAM sequence: TTA
gcattagctcagattccact

SEQ ID NO: 199546 - DNA, 20 bp, Artificial Sequence
  Description of Artificial Sequence: Synthetic oligonucleotide
  Target: ATXN1; (-) strand; PAM type: YTN; PAM sequence: TTT
agcattagctcagattccac

SEQ ID NO: 199547 - DNA, 20 bp, Artificial Sequence
  Description of Artificial Sequence: Synthetic oligonucleotide
  Target: ATXN1; (-) strand; PAM type: YTN; PAM sequence: CTT
tagcattagctcagattcca

SEQ ID NO: 199548 - DNA, 20 bp, Artificial Sequence
  Description of Artificial Sequence: Synthetic oligonucleotide
  Target: ATXN1; (-) strand; PAM type: YTN; PAM sequence: TTC
tttagcattagctcagattc

SEQ ID NO: 199549 - DNA, 20 bp, Artificial Sequence
  Description of Artificial Sequence: Synthetic oligonucleotide
  Target: ATXN1; (-) strand; PAM type: YTN; PAM sequence: TTT
ctttagcattagctcagatt

SEQ ID NO: 199550 - DNA, 20 bp, Artificial Sequence
  Description of Artificial Sequence: Synthetic oligonucleotide
  Target: ATXN1; (-) strand; PAM type: YTN; PAM sequence: TTA
tttctttagcattagctcag

SEQ ID NO: 199551 - DNA, 20 bp, Artificial Sequence
  Description of Artificial Sequence: Synthetic oligonucleotide
  Target: ATXN1; (-) strand; PAM type: YTN; PAM sequence: TTT
atttctttagcattagctca

SEQ ID NO: 199552 - DNA, 20 bp, Artificial Sequence
  Description of Artificial Sequence: Synthetic oligonucleotide
  Target: ATXN1; (-) strand; PAM type: YTN; PAM sequence: TTT
tatttctttagcattagctc

SEQ ID NO: 199553 - DNA, 20 bp, Artificial Sequence
  Description of Artificial Sequence: Synthetic oligonucleotide
  Target: ATXN1; (-) strand; PAM type: YTN; PAM sequence: CTG
ttttatttctttagcattag

SEQ ID NO: 199554 - DNA, 20 bp, Artificial Sequence
  Description of Artificial Sequence: Synthetic oligonucleotide
  Target: ATXN1; (-) strand; PAM type: YTN; PAM sequence: CTC
aagctgttttatttctttag

SEQ ID NO: 199555 - DNA, 20 bp, Artificial Sequence
  Description of Artificial Sequence: Synthetic oligonucleotide
  Target: ATXN1; (-) strand; PAM type: YTN; PAM sequence: TTC
tcaagctgttttatttcttt

SEQ ID NO: 199556 - DNA, 20 bp, Artificial Sequence
  Description of Artificial Sequence: Synthetic oligonucleotide
  Target: ATXN1; (-) strand; PAM type: YTN; PAM sequence: TTT
ctcaagctgttttatttctt

SEQ ID NO: 199557 - DNA, 20 bp, Artificial Sequence
  Description of Artificial Sequence: Synthetic oligonucleotide
  Target: ATXN1; (-) strand; PAM type: YTN; PAM sequence: TTT
tctcaagctgttttatttct

SEQ ID NO: 199558 - DNA, 20 bp, Artificial Sequence
  Description of Artificial Sequence: Synthetic oligonucleotide
  Target: ATXN1; (-) strand; PAM type: YTN; PAM sequence: TTT
ttctcaagctgttttatttc

SEQ ID NO: 199559 - DNA, 20 bp, Artificial Sequence
  Description of Artificial Sequence: Synthetic oligonucleotide
  Target: ATXN1; (-) strand; PAM type: YTN; PAM sequence: CTT
tttctcaagctgttttattt

SEQ ID NO: 199560 - DNA, 20 bp, Artificial Sequence
  Description of Artificial Sequence: Synthetic oligonucleotide
  Target: ATXN1; (-) strand; PAM type: YTN; PAM sequence: TTC
ccactttttctcaagctgtt

SEQ ID NO: 199561 - DNA, 20 bp, Artificial Sequence
  Description of Artificial Sequence: Synthetic oligonucleotide
  Target: ATXN1; (-) strand; PAM type: YTN; PAM sequence: CTT
cccactttttctcaagctgt

SEQ ID NO: 199562 - DNA, 20 bp, Artificial Sequence
  Description of Artificial Sequence: Synthetic oligonucleotide
  Target: ATXN1; (-) strand; PAM type: YTN; PAM sequence: TTC
ttcccactttttctcaagct

SEQ ID NO: 199563 - DNA, 20 bp, Artificial Sequence
  Description of Artificial Sequence: Synthetic oligonucleotide
  Target: ATXN1; (-) strand; PAM type: YTN; PAM sequence: TTT
cttcccactttttctcaagc

SEQ ID NO: 199564 - DNA, 20 bp, Artificial Sequence
  Description of Artificial Sequence: Synthetic oligonucleotide
  Target: ATXN1; (-) strand; PAM type: YTN; PAM sequence: TTA
gcacacgtttcttcccactt

SEQ ID NO: 199565 - DNA, 20 bp, Artificial Sequence
  Description of Artificial Sequence: Synthetic oligonucleotide
  Target: ATXN1; (-) strand; PAM type: YTN; PAM sequence: TTG
aacatattagcacacgtttc

SEQ ID NO: 199566 - DNA, 20 bp, Artificial Sequence
  Description of Artificial Sequence: Synthetic oligonucleotide
  Target: ATXN1; (-) strand; PAM type: YTN; PAM sequence: CTT
gaacatattagcacacgttt

SEQ ID NO: 199567 - DNA, 20 bp, Artificial Sequence
  Description of Artificial Sequence: Synthetic oligonucleotide
  Target: ATXN1; (-) strand; PAM type: YTN; PAM sequence: CTC
ttgaacatattagcacacgt

SEQ ID NO: 199568 - DNA, 20 bp, Artificial Sequence
  Description of Artificial Sequence: Synthetic oligonucleotide
  Target: ATXN1; (-) strand; PAM type: YTN; PAM sequence: CTC
caaccgcaatggtctcttga

SEQ ID NO: 199569 - DNA, 20 bp, Artificial Sequence
  Description of Artificial Sequence: Synthetic oligonucleotide
  Target: ATXN1; (-) strand; PAM type: YTN; PAM sequence: CTC
cccacacacatacacctcca

SEQ ID NO: 199570 - DNA, 20 bp, Artificial Sequence
  Description of Artificial Sequence: Synthetic oligonucleotide
  Target: ATXN1; (-) strand; PAM type: YTN; PAM sequence: CTG
tctccccacacacatacacc

SEQ ID NO: 199571 - DNA, 20 bp, Artificial Sequence
  Description of Artificial Sequence: Synthetic oligonucleotide
  Target: ATXN1; (-) strand; PAM type: YTN; PAM sequence: TTC
tgtctccccacacacataca

SEQ ID NO: 199572 - DNA, 20 bp, Artificial Sequence
  Description of Artificial Sequence: Synthetic oligonucleotide
  Target: ATXN1; (-) strand; PAM type: YTN; PAM sequence: CTT
ctgtctccccacacacatac

SEQ ID NO: 199573 - DNA, 20 bp, Artificial Sequence
  Description of Artificial Sequence: Synthetic oligonucleotide
  Target: ATXN1; (-) strand; PAM type: YTN; PAM sequence: CTC
ccacttctgtctccccacac

SEQ ID NO: 199574 - DNA, 20 bp, Artificial Sequence
  Description of Artificial Sequence: Synthetic oligonucleotide
  Target: ATXN1; (-) strand; PAM type: YTN; PAM sequence: CTC
tcccacttctgtctccccac

SEQ ID NO: 199575 - DNA, 20 bp, Artificial Sequence
  Description of Artificial Sequence: Synthetic oligonucleotide
  Target: ATXN1; (-) strand; PAM type: YTN; PAM sequence: CTC
ctctcccacttctgtctccc

SEQ ID NO: 199576 - DNA, 20 bp, Artificial Sequence
  Description of Artificial Sequence: Synthetic oligonucleotide
  Target: ATXN1; (-) strand; PAM type: YTN; PAM sequence: TTC
ctcctctcccacttctgtct

SEQ ID NO: 199577 - DNA, 20 bp, Artificial Sequence
  Description of Artificial Sequence: Synthetic oligonucleotide
  Target: ATXN1; (-) strand; PAM type: YTN; PAM sequence: TTT
cctcctctcccacttctgtc

SEQ ID NO: 199578 - DNA, 20 bp, Artificial Sequence
  Description of Artificial Sequence: Synthetic oligonucleotide
  Target: ATXN1; (-) strand; PAM type: YTN; PAM sequence: CTT
tcctcctctcccacttctgt

SEQ ID NO: 199579 - DNA, 20 bp, Artificial Sequence
  Description of Artificial Sequence: Synthetic oligonucleotide
  Target: ATXN1; (-) strand; PAM type: YTN; PAM sequence: TTC
tttcctcctctcccacttct

SEQ ID NO: 199580 - DNA, 20 bp, Artificial Sequence
  Description of Artificial Sequence: Synthetic oligonucleotide
  Target: ATXN1; (-) strand; PAM type: YTN; PAM sequence: CTT
ctttcctcctctcccacttc

SEQ ID NO: 199581 - DNA, 20 bp, Artificial Sequence
  Description of Artificial Sequence: Synthetic oligonucleotide
  Target: ATXN1; (-) strand; PAM type: YTN; PAM sequence: CTC
ttctttcctcctctcccact

SEQ ID NO: 199582 - DNA, 20 bp, Artificial Sequence
  Description of Artificial Sequence: Synthetic oligonucleotide
  Target: ATXN1; (-) strand; PAM type: YTN; PAM sequence: CTC
caccatgtaacctcttcttt

SEQ ID NO: 199583 - DNA, 20 bp, Artificial Sequence
  Description of Artificial Sequence: Synthetic oligonucleotide
  Target: ATXN1; (-) strand; PAM type: YTN; PAM sequence: TTG
acaccctccaccatgtaacc

SEQ ID NO: 199584 - DNA, 20 bp, Artificial Sequence
  Description of Artificial Sequence: Synthetic oligonucleotide
  Target: ATXN1; (-) strand; PAM type: YTN; PAM sequence: TTT
gacaccctccaccatgtaac

SEQ ID NO: 199585 - DNA, 20 bp, Artificial Sequence
  Description of Artificial Sequence: Synthetic oligonucleotide
  Target: ATXN1; (-) strand; PAM type: YTN; PAM sequence: CTT
tgacaccctccaccatgtaa

SEQ ID NO: 199586 - DNA, 20 bp, Artificial Sequence
  Description of Artificial Sequence: Synthetic oligonucleotide
  Target: ATXN1; (-) strand; PAM type: YTN; PAM sequence: CTC
agcaagacctttgacaccct

SEQ ID NO: 199587 - DNA, 20 bp, Artificial Sequence
  Description of Artificial Sequence: Synthetic oligonucleotide
  Target: ATXN1; (-) strand; PAM type: YTN; PAM sequence: TTA
ctcagcaagacctttgacac

SEQ ID NO: 199588 - DNA, 20 bp, Artificial Sequence
  Description of Artificial Sequence: Synthetic oligonucleotide
  Target: ATXN1; (-) strand; PAM type: YTN; PAM sequence: CTC
aaattactcagcaagacctt

SEQ ID NO: 199589 - DNA, 20 bp, Artificial Sequence
  Description of Artificial Sequence: Synthetic oligonucleotide
  Target: ATXN1; (-) strand; PAM type: YTN; PAM sequence: TTA
cagaatcaactcaaattact

SEQ ID NO: 199590 - DNA, 20 bp, Artificial Sequence
  Description of Artificial Sequence: Synthetic oligonucleotide
  Target: ATXN1; (-) strand; PAM type: YTN; PAM sequence: TTT
acagaatcaactcaaattac

SEQ ID NO: 199591 - DNA, 20 bp, Artificial Sequence
  Description of Artificial Sequence: Synthetic oligonucleotide
  Target: ATXN1; (-) strand; PAM type: YTN; PAM sequence: TTT
tacagaatcaactcaaatta

SEQ ID NO: 199592 - DNA, 20 bp, Artificial Sequence
  Description of Artificial Sequence: Synthetic oligonucleotide
  Target: ATXN1; (-) strand; PAM type: YTN; PAM sequence: CTC
agattttacagaatcaactc

SEQ ID NO: 199593 - DNA, 20 bp, Artificial Sequence
  Description of Artificial Sequence: Synthetic oligonucleotide
  Target: ATXN1; (-) strand; PAM type: YTN; PAM sequence: TTC
agaagtccctcagattttac

SEQ ID NO: 199594 - DNA, 20 bp, Artificial Sequence
  Description of Artificial Sequence: Synthetic oligonucleotide
  Target: ATXN1; (-) strand; PAM type: YTN; PAM sequence: CTT
cagaagtccctcagatttta

SEQ ID NO: 199595 - DNA, 20 bp, Artificial Sequence
  Description of Artificial Sequence: Synthetic oligonucleotide
  Target: ATXN1; (-) strand; PAM type: YTN; PAM sequence: CTC
ggaaatcttcagaagtccct

SEQ ID NO: 199596 - DNA, 20 bp, Artificial Sequence
  Description of Artificial Sequence: Synthetic oligonucleotide
  Target: ATXN1; (-) strand; PAM type: YTN; PAM sequence: CTG
ctcggaaatcttcagaagtc

SEQ ID NO: 199597 - DNA, 20 bp, Artificial Sequence
  Description of Artificial Sequence: Synthetic oligonucleotide
  Target: ATXN1; (-) strand; PAM type: YTN; PAM sequence: TTC
ccctgctcggaaatcttcag

SEQ ID NO: 199598 - DNA, 20 bp, Artificial Sequence
  Description of Artificial Sequence: Synthetic oligonucleotide
  Target: ATXN1; (-) strand; PAM type: YTN; PAM sequence: CTA
atgaaagcattcccctgctc

SEQ ID NO: 199599 - DNA, 20 bp, Artificial Sequence
  Description of Artificial Sequence: Synthetic oligonucleotide
  Target: ATXN1; (-) strand; PAM type: YTN; PAM sequence: TTA
gaagcagtagacatagtaca

SEQ ID NO: 199600 - DNA, 20 bp, Artificial Sequence
  Description of Artificial Sequence: Synthetic oligonucleotide
  Target: ATXN1; (-) strand; PAM type: YTN; PAM sequence: CTT
agaagcagtagacatagtac

SEQ ID NO: 199601 - DNA, 20 bp, Artificial Sequence
  Description of Artificial Sequence: Synthetic oligonucleotide
  Target: ATXN1; (-) strand; PAM type: YTN; PAM sequence: CTC
acttagaagcagtagacata

SEQ ID NO: 199602 - DNA, 20 bp, Artificial Sequence
  Description of Artificial Sequence: Synthetic oligonucleotide
  Target: ATXN1; (-) strand; PAM type: YTN; PAM sequence: TTC
agagtcactcacttagaagc

SEQ ID NO: 199603 - DNA, 20 bp, Artificial Sequence
  Description of Artificial Sequence: Synthetic oligonucleotide
  Target: ATXN1; (-) strand; PAM type: YTN; PAM sequence: TTT
cagagtcactcacttagaag

SEQ ID NO: 199604 - DNA, 20 bp, Artificial Sequence
  Description of Artificial Sequence: Synthetic oligonucleotide
  Target: ATXN1; (-) strand; PAM type: YTN; PAM sequence: TTG
tggatttcagagtcactcac

SEQ ID NO: 199605 - DNA, 20 bp, Artificial Sequence
  Description of Artificial Sequence: Synthetic oligonucleotide
  Target: ATXN1; (-) strand; PAM type: YTN; PAM sequence: CTT
gtggatttcagagtcactca

SEQ ID NO: 199606 - DNA, 20 bp, Artificial Sequence
  Description of Artificial Sequence: Synthetic oligonucleotide
  Target: ATXN1; (-) strand; PAM type: YTN; PAM sequence: CTC
gacttgtggatttcagagtc

SEQ ID NO: 199607 - DNA, 20 bp, Artificial Sequence
  Description of Artificial Sequence: Synthetic oligonucleotide
  Target: ATXN1; (-) strand; PAM type: YTN; PAM sequence: TTG
gaaagagaggtcagggctcg

SEQ ID NO: 199608 - DNA, 20 bp, Artificial Sequence
  Description of Artificial Sequence: Synthetic oligonucleotide
  Target: ATXN1; (-) strand; PAM type: YTN; PAM sequence: CTT
ggaaagagaggtcagggctc

SEQ ID NO: 199609 - DNA, 20 bp, Artificial Sequence
  Description of Artificial Sequence: Synthetic oligonucleotide
  Target: ATXN1; (-) strand; PAM type: YTN; PAM sequence: CTG
catcttggaaagagaggtca

SEQ ID NO: 199610 - DNA, 20 bp, Artificial Sequence
  Description of Artificial Sequence: Synthetic oligonucleotide
  Target: ATXN1; (-) strand; PAM type: YTN; PAM sequence: TTC
agaaaaacagatctgcatct

SEQ ID NO: 199611 - DNA, 20 bp, Artificial Sequence
  Description of Artificial Sequence: Synthetic oligonucleotide
  Target: ATXN1; (-) strand; PAM type: YTN; PAM sequence: CTG
tgtagagacgtgcagcaggc

SEQ ID NO: 199612 - DNA, 20 bp, Artificial Sequence
  Description of Artificial Sequence: Synthetic oligonucleotide
  Target: ATXN1; (-) strand; PAM type: YTN; PAM sequence: CTG
gaagcgccacagcaggatag

SEQ ID NO: 199613 - DNA, 20 bp, Artificial Sequence
  Description of Artificial Sequence: Synthetic oligonucleotide
  Target: ATXN1; (-) strand; PAM type: YTN; PAM sequence: CTA
acatgcccagctggaagcgc

SEQ ID NO: 199614 - DNA, 20 bp, Artificial Sequence
  Description of Artificial Sequence: Synthetic oligonucleotide
  Target: ATXN1; (-) strand; PAM type: YTN; PAM sequence: CTG
tagagatctaacatgcccag

SEQ ID NO: 199615 - DNA, 20 bp, Artificial Sequence
  Description of Artificial Sequence: Synthetic oligonucleotide
  Target: ATXN1; (-) strand; PAM type: YTN; PAM sequence: TTA
gggactgtagagatctaaca

SEQ ID NO: 199616 - DNA, 20 bp, Artificial Sequence
  Description of Artificial Sequence: Synthetic oligonucleotide
  Target: ATXN1; (-) strand; PAM type: YTN; PAM sequence: CTA
gaatcacagaccattaggga

SEQ ID NO: 199617 - DNA, 20 bp, Artificial Sequence
  Description of Artificial Sequence: Synthetic oligonucleotide
  Target: ATXN1; (-) strand; PAM type: YTN; PAM sequence: CTG
ctagaatcacagaccattag

SEQ ID NO: 199618 - DNA, 20 bp, Artificial Sequence
  Description of Artificial Sequence: Synthetic oligonucleotide
  Target: ATXN1; (-) strand; PAM type: YTN; PAM sequence: TTC
tgctagaatcacagaccatt

SEQ ID NO: 199619 - DNA, 20 bp, Artificial Sequence
  Description of Artificial Sequence: Synthetic oligonucleotide
  Target: ATXN1; (-) strand; PAM type: YTN; PAM sequence: CTT
ctgctagaatcacagaccat

SEQ ID NO: 199620 - DNA, 20 bp, Artificial Sequence
  Description of Artificial Sequence: Synthetic oligonucleotide
  Target: ATXN1; (-) strand; PAM type: YTN; PAM sequence: TTC
agacccgtaacttctgctag

SEQ ID NO: 199621 - DNA, 20 bp, Artificial Sequence
  Description of Artificial Sequence: Synthetic oligonucleotide
  Target: ATXN1; (-) strand; PAM type: YTN; PAM sequence: TTT
cagacccgtaacttctgcta

SEQ ID NO: 199622 - DNA, 20 bp, Artificial Sequence
  Description of Artificial Sequence: Synthetic oligonucleotide
  Target: ATXN1; (-) strand; PAM type: YTN; PAM sequence: TTT
tcagacccgtaacttctgct

SEQ ID NO: 199623 - DNA, 20 bp, Artificial Sequence
  Description of Artificial Sequence: Synthetic oligonucleotide
  Target: ATXN1; (-) strand; PAM type: YTN; PAM sequence: TTC
aagggaaatgtcaaattttc

SEQ ID NO: 199624 - DNA, 20 bp, Artificial Sequence
  Description of Artificial Sequence: Synthetic oligonucleotide
  Target: ATXN1; (-) strand; PAM type: YTN; PAM sequence: TTT
caagggaaatgtcaaatttt

SEQ ID NO: 199625 - DNA, 20 bp, Artificial Sequence
  Description of Artificial Sequence: Synthetic oligonucleotide
  Target: ATXN1; (-) strand; PAM type: YTN; PAM sequence: TTT
tcaagggaaatgtcaaattt

SEQ ID NO: 199626 - DNA, 20 bp, Artificial Sequence
  Description of Artificial Sequence: Synthetic oligonucleotide
  Target: ATXN1; (-) strand; PAM type: YTN; PAM sequence: TTC
agtgttttcaagggaaatgt

SEQ ID NO: 199627 - DNA, 20 bp, Artificial Sequence
  Description of Artificial Sequence: Synthetic oligonucleotide
  Target: ATXN1; (-) strand; PAM type: YTN; PAM sequence: TTT
cagtgttttcaagggaaatg

SEQ ID NO: 199628 - DNA, 20 bp, Artificial Sequence
  Description of Artificial Sequence: Synthetic oligonucleotide
  Target: ATXN1; (-) strand; PAM type: YTN; PAM sequence: TTT
tcagtgttttcaagggaaat

SEQ ID NO: 199629 - DNA, 20 bp, Artificial Sequence
  Description of Artificial Sequence: Synthetic oligonucleotide
  Target: ATXN1; (-) strand; PAM type: YTN; PAM sequence: TTA
ttttcagtgttttcaaggga

SEQ ID NO: 199630 - DNA, 20 bp, Artificial Sequence
  Description of Artificial Sequence: Synthetic oligonucleotide
  Target: ATXN1; (-) strand; PAM type: YTN; PAM sequence: CTT
attttcagtgttttcaaggg

SEQ ID NO: 199631 - DNA, 20 bp, Artificial Sequence
  Description of Artificial Sequence: Synthetic oligonucleotide
  Target: ATXN1; (-) strand; PAM type: YTN; PAM sequence: TTC
cttattttcagtgttttcaa

SEQ ID NO: 199632 - DNA, 20 bp, Artificial Sequence
  Description of Artificial Sequence: Synthetic oligonucleotide
  Target: ATXN1; (-) strand; PAM type: YTN; PAM sequence: TTT
ccttattttcagtgttttca

SEQ ID NO: 199633 - DNA, 20 bp, Artificial Sequence
  Description of Artificial Sequence: Synthetic oligonucleotide
  Target: ATXN1; (-) strand; PAM type: YTN; PAM sequence: TTT
tccttattttcagtgttttc

SEQ ID NO: 199634 - DNA, 20 bp, Artificial Sequence
  Description of Artificial Sequence: Synthetic oligonucleotide
  Target: ATXN1; (-) strand; PAM type: YTN; PAM sequence: CTT
ttccttattttcagtgtttt

SEQ ID NO: 199635 - DNA, 20 bp, Artificial Sequence
  Description of Artificial Sequence: Synthetic oligonucleotide
  Target: ATXN1; (-) strand; PAM type: YTN; PAM sequence: TTC
ttttccttattttcagtgtt

SEQ ID NO: 199636 - DNA, 20 bp, Artificial Sequence
  Description of Artificial Sequence: Synthetic oligonucleotide
  Target: ATXN1; (-) strand; PAM type: YTN; PAM sequence: TTT
cttttccttattttcagtgt

SEQ ID NO: 199637 - DNA, 20 bp, Artificial Sequence
  Description of Artificial Sequence: Synthetic oligonucleotide
  Target: ATXN1; (-) strand; PAM type: YTN; PAM sequence: TTT
tcttttccttattttcagtg

SEQ ID NO: 199638 - DNA, 20 bp, Artificial Sequence
  Description of Artificial Sequence: Synthetic oligonucleotide
  Target: ATXN1; (-) strand; PAM type: YTN; PAM sequence: CTT
ttcttttccttattttcagt

SEQ ID NO: 199639 - DNA, 20 bp, Artificial Sequence
  Description of Artificial Sequence: Synthetic oligonucleotide
  Target: ATXN1; (-) strand; PAM type: YTN; PAM sequence: TTG
aatatgacttttcttttcct

SEQ ID NO: 199640 - DNA, 20 bp, Artificial Sequence
  Description of Artificial Sequence: Synthetic oligonucleotide
  Target: ATXN1; (-) strand; PAM type: YTN; PAM sequence: CTT
gaatatgacttttcttttcc

SEQ ID NO: 199641 - DNA, 20 bp, Artificial Sequence
  Description of Artificial Sequence: Synthetic oligonucleotide
  Target: ATXN1; (-) strand; PAM type: YTN; PAM sequence: CTC
ttgaatatgacttttctttt

SEQ ID NO: 199642 - DNA, 20 bp, Artificial Sequence
  Description of Artificial Sequence: Synthetic oligonucleotide
  Target: ATXN1; (-) strand; PAM type: YTN; PAM sequence: TTC
ctcttgaatatgacttttct

SEQ ID NO: 199643 - DNA, 20 bp, Artificial Sequence
  Description of Artificial Sequence: Synthetic oligonucleotide
  Target: ATXN1; (-) strand; PAM type: YTN; PAM sequence: CTT
cctcttgaatatgacttttc

SEQ ID NO: 199644 - DNA, 20 bp, Artificial Sequence
  Description of Artificial Sequence: Synthetic oligonucleotide
  Target: ATXN1; (-) strand; PAM type: YTN; PAM sequence: CTC
ttcctcttgaatatgacttt

SEQ ID NO: 199645 - DNA, 20 bp, Artificial Sequence
  Description of Artificial Sequence: Synthetic oligonucleotide
  Target: ATXN1; (-) strand; PAM type: YTN; PAM sequence: TTG
ctcttcctcttgaatatgac

SEQ ID NO: 199646 - DNA, 20 bp, Artificial Sequence
  Description of Artificial Sequence: Synthetic oligonucleotide
  Target: ATXN1; (-) strand; PAM type: YTN; PAM sequence: TTT
gctcttcctcttgaatatga

SEQ ID NO: 199647 - DNA, 20 bp, Artificial Sequence
  Description of Artificial Sequence: Synthetic oligonucleotide
  Target: ATXN1; (-) strand; PAM type: YTN; PAM sequence: TTT
tgctcttcctcttgaatatg

SEQ ID NO: 199648 - DNA, 20 bp, Artificial Sequence
  Description of Artificial Sequence: Synthetic oligonucleotide
  Target: ATXN1; (-) strand; PAM type: YTN; PAM sequence: TTT
ttgctcttcctcttgaatat

SEQ ID NO: 199649 - DNA, 20 bp, Artificial Sequence
  Description of Artificial Sequence: Synthetic oligonucleotide
  Target: ATXN1; (-) strand; PAM type: YTN; PAM sequence: CTT
tttgctcttcctcttgaata

SEQ ID NO: 199650 - DNA, 20 bp, Artificial Sequence
  Description of Artificial Sequence: Synthetic oligonucleotide
  Target: ATXN1; (-) strand; PAM type: YTN; PAM sequence: CTC
tttttgctcttcctcttgaa

SEQ ID NO: 199651 - DNA, 20 bp, Artificial Sequence
  Description of Artificial Sequence: Synthetic oligonucleotide
  Target: ATXN1; (-) strand; PAM type: YTN; PAM sequence: CTC
ctctttttgctcttcctctt

SEQ ID NO: 199652 - DNA, 20 bp, Artificial Sequence
  Description of Artificial Sequence: Synthetic oligonucleotide
  Target: ATXN1; (-) strand; PAM type: YTN; PAM sequence: TTA
aagacgctcctctttttgct

SEQ ID NO: 199653 - DNA, 20 bp, Artificial Sequence
  Description of Artificial Sequence: Synthetic oligonucleotide
  Target: ATXN1; (-) strand; PAM type: YTN; PAM sequence: TTT
aaagacgctcctctttttgc

SEQ ID NO: 199654 - DNA, 20 bp, Artificial Sequence
  Description of Artificial Sequence: Synthetic oligonucleotide
  Target: ATXN1; (-) strand; PAM type: YTN; PAM sequence: TTC
gatttaaagacgctcctctt

SEQ ID NO: 199655 - DNA, 20 bp, Artificial Sequence
  Description of Artificial Sequence: Synthetic oligonucleotide
  Target: ATXN1; (-) strand; PAM type: YTN; PAM sequence: TTT
cgatttaaagacgctcctct

SEQ ID NO: 199656 - DNA, 20 bp, Artificial Sequence
  Description of Artificial Sequence: Synthetic oligonucleotide
  Target: ATXN1; (-) strand; PAM type: YTN; PAM sequence: TTT
tcgatttaaagacgctcctc

SEQ ID NO: 199657 - DNA, 20 bp, Artificial Sequence
  Description of Artificial Sequence: Synthetic oligonucleotide
  Target: ATXN1; (-) strand; PAM type: YTN; PAM sequence: TTT
ttcgatttaaagacgctcct

SEQ ID NO: 199658 - DNA, 20 bp, Artificial Sequence
  Description of Artificial Sequence: Synthetic oligonucleotide
  Target: ATXN1; (-) strand; PAM type: YTN; PAM sequence: TTG
atttttcgatttaaagacgc

SEQ ID NO: 199659 - DNA, 20 bp, Artificial Sequence
  Description of Artificial Sequence: Synthetic oligonucleotide
  Target: ATXN1; (-) strand; PAM type: YTN; PAM sequence: CTT
gatttttcgatttaaagacg

SEQ ID NO: 199660 - DNA, 20 bp, Artificial Sequence
  Description of Artificial Sequence: Synthetic oligonucleotide
  Target: ATXN1; (-) strand; PAM type: YTN; PAM sequence: CTA
acatagacttgatttttcga

SEQ ID NO: 199661 - DNA, 20 bp, Artificial Sequence
  Description of Artificial Sequence: Synthetic oligonucleotide
  Target: ATXN1; (-) strand; PAM type: YTN; PAM sequence: TTC
acagcccgagcacagccaga

SEQ ID NO: 199662 - DNA, 20 bp, Artificial Sequence
  Description of Artificial Sequence: Synthetic oligonucleotide
  Target: ATXN1; (-) strand; PAM type: YTN; PAM sequence: TTT
cacagcccgagcacagccag

SEQ ID NO: 199663 - DNA, 20 bp, Artificial Sequence
  Description of Artificial Sequence: Synthetic oligonucleotide
  Target: ATXN1; (-) strand; PAM type: YTN; PAM sequence: TTG
cagtttcacagcccgagcac

SEQ ID NO: 199664 - DNA, 20 bp, Artificial Sequence
  Description of Artificial Sequence: Synthetic oligonucleotide
  Target: ATXN1; (-) strand; PAM type: YTN; PAM sequence: CTT
gcagtttcacagcccgagca

SEQ ID NO: 199665 - DNA, 20 bp, Artificial Sequence
  Description of Artificial Sequence: Synthetic oligonucleotide
  Target: ATXN1; (-) strand; PAM type: YTN; PAM sequence: CTA
tacgcacacaggtgcatctt

SEQ ID NO: 199666 - DNA, 20 bp, Artificial Sequence
  Description of Artificial Sequence: Synthetic oligonucleotide
  Target: ATXN1; (-) strand; PAM type: YTN; PAM sequence: CTA
tgcacacgtccaccatccta

SEQ ID NO: 199667 - DNA, 20 bp, Artificial Sequence
  Description of Artificial Sequence: Synthetic oligonucleotide
  Target: ATXN1; (-) strand; PAM type: YTN; PAM sequence: CTC
ccacgacacatatccaccta

SEQ ID NO: 199668 - DNA, 20 bp, Artificial Sequence
  Description of Artificial Sequence: Synthetic oligonucleotide
  Target: ATXN1; (-) strand; PAM type: YTN; PAM sequence: CTG
tgtcctcccacgacacatat

SEQ ID NO: 199669 - DNA, 20 bp, Artificial Sequence
  Description of Artificial Sequence: Synthetic oligonucleotide
  Target: ATXN1; (-) strand; PAM type: YTN; PAM sequence: CTC
ctgtgtcctcccacgacaca

SEQ ID NO: 199670 - DNA, 20 bp, Artificial Sequence
  Description of Artificial Sequence: Synthetic oligonucleotide
  Target: ATXN1; (-) strand; PAM type: YTN; PAM sequence: TTA
gcagtacctcctgtgtcctc

SEQ ID NO: 199671 - DNA, 20 bp, Artificial Sequence
  Description of Artificial Sequence: Synthetic oligonucleotide
  Target: ATXN1; (-) strand; PAM type: YTN; PAM sequence: CTT
agcagtacctcctgtgtcct

SEQ ID NO: 199672 - DNA, 20 bp, Artificial Sequence
  Description of Artificial Sequence: Synthetic oligonucleotide
  Target: ATXN1; (-) strand; PAM type: YTN; PAM sequence: TTG
gagagtgccttagcagtacc

SEQ ID NO: 199673 - DNA, 20 bp, Artificial Sequence
  Description of Artificial Sequence: Synthetic oligonucleotide
  Target: ATXN1; (-) strand; PAM type: YTN; PAM sequence: CTT
ggagagtgccttagcagtac

SEQ ID NO: 199674 - DNA, 20 bp, Artificial Sequence
  Description of Artificial Sequence: Synthetic oligonucleotide
  Target: ATXN1; (-) strand; PAM type: YTN; PAM sequence: TTG
agagcatgtgtccttggaga

SEQ ID NO: 199675 - DNA, 20 bp, Artificial Sequence
  Description of Artificial Sequence: Synthetic oligonucleotide
  Target: ATXN1; (-) strand; PAM type: YTN; PAM sequence: TTG
tcattgagagcatgtgtcct

SEQ ID NO: 199676 - DNA, 20 bp, Artificial Sequence
  Description of Artificial Sequence: Synthetic oligonucleotide
  Target: ATXN1; (-) strand; PAM type: YTN; PAM sequence: CTG
ggttgtcattgagagcatgt

SEQ ID NO: 199677 - DNA, 20 bp, Artificial Sequence
  Description of Artificial Sequence: Synthetic oligonucleotide
  Target: ATXN1; (-) strand; PAM type: YTN; PAM sequence: TTC
tgggttgtcattgagagcat

SEQ ID NO: 199678 - DNA, 20 bp, Artificial Sequence
  Description of Artificial Sequence: Synthetic oligonucleotide
  Target: ATXN1; (-) strand; PAM type: YTN; PAM sequence: TTG
agtggcaagaaaaccattct

SEQ ID NO: 199679 - DNA, 20 bp, Artificial Sequence
  Description of Artificial Sequence: Synthetic oligonucleotide
  Target: ATXN1; (-) strand; PAM type: YTN; PAM sequence: TTT
gagtggcaagaaaaccattc

SEQ ID NO: 199680 - DNA, 20 bp, Artificial Sequence
  Description of Artificial Sequence: Synthetic oligonucleotide
  Target: ATXN1; (-) strand; PAM type: YTN; PAM sequence: CTT
tgagtggcaagaaaaccatt

SEQ ID NO: 199681 - DNA, 20 bp, Artificial Sequence
  Description of Artificial Sequence: Synthetic oligonucleotide
  Target: ATXN1; (-) strand; PAM type: YTN; PAM sequence: CTC
cacgtgtgagtagcatcttt

SEQ ID NO: 199682 - DNA, 20 bp, Artificial Sequence
  Description of Artificial Sequence: Synthetic oligonucleotide
  Target: ATXN1; (-) strand; PAM type: YTN; PAM sequence: CTC
tccacgtgtgagtagcatct

SEQ ID NO: 199683 - DNA, 20 bp, Artificial Sequence
  Description of Artificial Sequence: Synthetic oligonucleotide
  Target: ATXN1; (-) strand; PAM type: YTN; PAM sequence: CTA
gagccagcctctccacgtgt

SEQ ID NO: 199684 - DNA, 20 bp, Artificial Sequence
  Description of Artificial Sequence: Synthetic oligonucleotide
  Target: ATXN1; (-) strand; PAM type: YTN; PAM sequence: TTC
tagagccagcctctccacgt

SEQ ID NO: 199685 - DNA, 20 bp, Artificial Sequence
  Description of Artificial Sequence: Synthetic oligonucleotide
  Target: ATXN1; (-) strand; PAM type: YTN; PAM sequence: TTT
ctagagccagcctctccacg

SEQ ID NO: 199686 - DNA, 20 bp, Artificial Sequence
  Description of Artificial Sequence: Synthetic oligonucleotide
  Target: ATXN1; (-) strand; PAM type: YTN; PAM sequence: TTG
tttctagagccagcctctcc

SEQ ID NO: 199687 - DNA, 20 bp, Artificial Sequence
  Description of Artificial Sequence: Synthetic oligonucleotide
  Target: ATXN1; (-) strand; PAM type: YTN; PAM sequence: TTA
attgtttctagagccagcct

SEQ ID NO: 199688 - DNA, 20 bp, Artificial Sequence
  Description of Artificial Sequence: Synthetic oligonucleotide
  Target: ATXN1; (-) strand; PAM type: YTN; PAM sequence: TTT
aattgtttctagagccagcc

SEQ ID NO: 199689 - DNA, 20 bp, Artificial Sequence
  Description of Artificial Sequence: Synthetic oligonucleotide
  Target: ATXN1; (-) strand; PAM type: YTN; PAM sequence: CTT
taattgtttctagagccagc

SEQ ID NO: 199690 - DNA, 20 bp, Artificial Sequence
  Description of Artificial Sequence: Synthetic oligonucleotide
  Target: ATXN1; (-) strand; PAM type: YTN; PAM sequence: CTG
gactttaattgtttctagag

SEQ ID NO: 199691 - DNA, 20 bp, Artificial Sequence
  Description of Artificial Sequence: Synthetic oligonucleotide
  Target: ATXN1; (-) strand; PAM type: YTN; PAM sequence: TTC
tggactttaattgtttctag

SEQ ID NO: 199692 - DNA, 20 bp, Artificial Sequence
  Description of Artificial Sequence: Synthetic oligonucleotide
  Target: ATXN1; (-) strand; PAM type: YTN; PAM sequence: TTA
ttctggactttaattgtttc

SEQ ID NO: 199693 - DNA, 20 bp, Artificial Sequence
  Description of Artificial Sequence: Synthetic oligonucleotide
  Target: ATXN1; (-) strand; PAM type: YTN; PAM sequence: CTT
attctggactttaattgttt

SEQ ID NO: 199694 - DNA, 20 bp, Artificial Sequence
  Description of Artificial Sequence: Synthetic oligonucleotide
  Target: ATXN1; (-) strand; PAM type: YTN; PAM sequence: TTA
ggatccttattctggacttt

SEQ ID NO: 199695 - DNA, 20 bp, Artificial Sequence
  Description of Artificial Sequence: Synthetic oligonucleotide
  Target: ATXN1; (-) strand; PAM type: YTN; PAM sequence: TTT
aggatccttattctggactt

SEQ ID NO: 199696 - DNA, 20 bp, Artificial Sequence
  Description of Artificial Sequence: Synthetic oligonucleotide
  Target: ATXN1; (-) strand; PAM type: YTN; PAM sequence: TTG
agcaatttaggatccttatt

SEQ ID NO: 199697 - DNA, 20 bp, Artificial Sequence
  Description of Artificial Sequence: Synthetic oligonucleotide
  Target: ATXN1; (-) strand; PAM type: YTN; PAM sequence: TTA
aaatattgagcaatttagga

SEQ ID NO: 199698 - DNA, 20 bp, Artificial Sequence
  Description of Artificial Sequence: Synthetic oligonucleotide
  Target: ATXN1; (-) strand; PAM type: YTN; PAM sequence: TTT
aaaatattgagcaatttagg

SEQ ID NO: 199699 - DNA, 20 bp, Artificial Sequence
  Description of Artificial Sequence: Synthetic oligonucleotide
  Target: ATXN1; (-) strand; PAM type: YTN; PAM sequence: TTG
gggtacagtggcatagaatg

SEQ ID NO: 199700 - DNA, 20 bp, Artificial Sequence
  Description of Artificial Sequence: Synthetic oligonucleotide
  Target: ATXN1; (-) strand; PAM type: YTN; PAM sequence: TTA
gaaagacaagtgtgagttgg

SEQ ID NO: 199701 - DNA, 20 bp, Artificial Sequence
  Description of Artificial Sequence: Synthetic oligonucleotide
  Target: ATXN1; (-) strand; PAM type: YTN; PAM sequence: CTG
gttagaaagacaagtgtgag

SEQ ID NO: 199702 - DNA, 20 bp, Artificial Sequence
  Description of Artificial Sequence: Synthetic oligonucleotide
  Target: ATXN1; (-) strand; PAM type: YTN; PAM sequence: TTA
gacatagagtgagctggtta

SEQ ID NO: 199703 - DNA, 20 bp, Artificial Sequence
  Description of Artificial Sequence: Synthetic oligonucleotide
  Target: ATXN1; (-) strand; PAM type: YTN; PAM sequence: CTC
attagacatagagtgagctg

SEQ ID NO: 199704 - DNA, 20 bp, Artificial Sequence
  Description of Artificial Sequence: Synthetic oligonucleotide
  Target: ATXN1; (-) strand; PAM type: YTN; PAM sequence: TTG
ctcattagacatagagtgag

SEQ ID NO: 199705 - DNA, 20 bp, Artificial Sequence
  Description of Artificial Sequence: Synthetic oligonucleotide
  Target: ATXN1; (-) strand; PAM type: YTN; PAM sequence: CTT
gctcattagacatagagtga

SEQ ID NO: 199706 - DNA, 20 bp, Artificial Sequence
  Description of Artificial Sequence: Synthetic oligonucleotide
  Target: ATXN1; (-) strand; PAM type: YTN; PAM sequence: TTA
gggatgacttgctcattaga

SEQ ID NO: 199707 - DNA, 20 bp, Artificial Sequence
  Description of Artificial Sequence: Synthetic oligonucleotide
  Target: ATXN1; (-) strand; PAM type: YTN; PAM sequence: TTT
agggatgacttgctcattag

SEQ ID NO: 199708 - DNA, 20 bp, Artificial Sequence
  Description of Artificial Sequence: Synthetic oligonucleotide
  Target: ATXN1; (-) strand; PAM type: YTN; PAM sequence: TTC
ataaggatttagggatgact

SEQ ID NO: 199709 - DNA, 20 bp, Artificial Sequence
  Description of Artificial Sequence: Synthetic oligonucleotide
  Target: ATXN1; (-) strand; PAM type: YTN; PAM sequence: CTT
cataaggatttagggatgac

SEQ ID NO: 199710 - DNA, 20 bp, Artificial Sequence
  Description of Artificial Sequence: Synthetic oligonucleotide
  Target: ATXN1; (-) strand; PAM type: YTN; PAM sequence: CTA
catggcttcataaggattta

SEQ ID NO: 199711 - DNA, 20 bp, Artificial Sequence
  Description of Artificial Sequence: Synthetic oligonucleotide
  Target: ATXN1; (-) strand; PAM type: YTN; PAM sequence: CTC
cccactacatggcttcataa

SEQ ID NO: 199712 - DNA, 20 bp, Artificial Sequence
  Description of Artificial Sequence: Synthetic oligonucleotide
  Target: ATXN1; (-) strand; PAM type: YTN; PAM sequence: TTA
tgggggacactccccactac

SEQ ID NO: 199713 - DNA, 20 bp, Artificial Sequence
  Description of Artificial Sequence: Synthetic oligonucleotide
  Target: ATXN1; (-) strand; PAM type: YTN; PAM sequence: TTT
atgggggacactccccacta

SEQ ID NO: 199714 - DNA, 20 bp, Artificial Sequence
  Description of Artificial Sequence: Synthetic oligonucleotide
  Target: ATXN1; (-) strand; PAM type: YTN; PAM sequence: CTT
tatgggggacactccccact

SEQ ID NO: 199715 - DNA, 20 bp, Artificial Sequence
  Description of Artificial Sequence: Synthetic oligonucleotide
  Target: ATXN1; (-) strand; PAM type: YTN; PAM sequence: CTG
tctttatgggggacactccc

SEQ ID NO: 199716 - DNA, 20 bp, Artificial Sequence
  Description of Artificial Sequence: Synthetic oligonucleotide
  Target: ATXN1; (-) strand; PAM type: YTN; PAM sequence: TTC
acctgtctttatgggggaca

SEQ ID NO: 199717 - DNA, 20 bp, Artificial Sequence
  Description of Artificial Sequence: Synthetic oligonucleotide
  Target: ATXN1; (-) strand; PAM type: YTN; PAM sequence: CTT
cacctgtctttatgggggac

SEQ ID NO: 199718 - DNA, 20 bp, Artificial Sequence
  Description of Artificial Sequence: Synthetic oligonucleotide
  Target: ATXN1; (-) strand; PAM type: YTN; PAM sequence: TTC
ttcacctgtctttatggggg

SEQ ID NO: 199719 - DNA, 20 bp, Artificial Sequence
  Description of Artificial Sequence: Synthetic oligonucleotide
  Target: ATXN1; (-) strand; PAM type: YTN; PAM sequence: TTG
gagttcttcacctgtcttta

SEQ ID NO: 199720 - DNA, 20 bp, Artificial Sequence
  Description of Artificial Sequence: Synthetic oligonucleotide
  Target: ATXN1; (-) strand; PAM type: YTN; PAM sequence: CTT
ggagttcttcacctgtcttt

SEQ ID NO: 199721 - DNA, 20 bp, Artificial Sequence
  Description of Artificial Sequence: Synthetic oligonucleotide
  Target: ATXN1; (-) strand; PAM type: YTN; PAM sequence: TTA
aaggagtatcttggagttct

SEQ ID NO: 199722 - DNA, 20 bp, Artificial Sequence
  Description of Artificial Sequence: Synthetic oligonucleotide
  Target: ATXN1; (-) strand; PAM type: YTN; PAM sequence: CTG
ttaaaggagtatcttggagt

SEQ ID NO: 199723 - DNA, 20 bp, Artificial Sequence
  Description of Artificial Sequence: Synthetic oligonucleotide
  Target: ATXN1; (-) strand; PAM type: YTN; PAM sequence: CTC
ctgttaaaggagtatcttgg

SEQ ID NO: 199724 - DNA, 20 bp, Artificial Sequence
  Description of Artificial Sequence: Synthetic oligonucleotide
  Target: ATXN1; (-) strand; PAM type: YTN; PAM sequence: TTA
ctcctgttaaaggagtatct

SEQ ID NO: 199725 - DNA, 20 bp, Artificial Sequence
  Description of Artificial Sequence: Synthetic oligonucleotide
  Target: ATXN1; (-) strand; PAM type: YTN; PAM sequence: TTT
actcctgttaaaggagtatc

SEQ ID NO: 199726 - DNA, 20 bp, Artificial Sequence
  Description of Artificial Sequence: Synthetic oligonucleotide
  Target: ATXN1; (-) strand; PAM type: YTN; PAM sequence: CTT
tactcctgttaaaggagtat

SEQ ID NO: 199727 - DNA, 20 bp, Artificial Sequence
  Description of Artificial Sequence: Synthetic oligonucleotide
  Target: ATXN1; (-) strand; PAM type: YTN; PAM sequence: TTA
atagaaaaatacctttactc

SEQ ID NO: 199728 - DNA, 20 bp, Artificial Sequence
  Description of Artificial Sequence: Synthetic oligonucleotide
  Target: ATXN1; (-) strand; PAM type: YTN; PAM sequence: TTT
aatagaaaaatacctttact

SEQ ID NO: 199729 - DNA, 20 bp, Artificial Sequence
  Description of Artificial Sequence: Synthetic oligonucleotide
  Target: ATXN1; (-) strand; PAM type: YTN; PAM sequence: TTT
taatagaaaaatacctttac

SEQ ID NO: 199730 - DNA, 20 bp, Artificial Sequence
  Description of Artificial Sequence: Synthetic oligonucleotide
  Target: ATXN1; (-) strand; PAM type: YTN; PAM sequence: TTG
aagcagcagaaggacatttt

SEQ ID NO: 199731 - DNA, 20 bp, Artificial Sequence
  Description of Artificial Sequence: Synthetic oligonucleotide
  Target: ATXN1; (-) strand; PAM type: YTN; PAM sequence: TTT
gaagcagcagaaggacattt

SEQ ID NO: 199732 - DNA, 20 bp, Artificial Sequence
  Description of Artificial Sequence: Synthetic oligonucleotide
  Target: ATXN1; (-) strand; PAM type: YTN; PAM sequence: TTT
tgaagcagcagaaggacatt

SEQ ID NO: 199733 - DNA, 20 bp, Artificial Sequence
  Description of Artificial Sequence: Synthetic oligonucleotide
  Target: ATXN1; (-) strand; PAM type: YTN; PAM sequence: CTT
ttgaagcagcagaaggacat

SEQ ID NO: 199734 - DNA, 20 bp, Artificial Sequence
  Description of Artificial Sequence: Synthetic oligonucleotide
  Target: ATXN1; (-) strand; PAM type: YTN; PAM sequence: TTC
ttttgaagcagcagaaggac

SEQ ID NO: 199735 - DNA, 20 bp, Artificial Sequence
  Description of Artificial Sequence: Synthetic oligonucleotide
  Target: ATXN1; (-) strand; PAM type: YTN; PAM sequence: TTT
cttttgaagcagcagaagga

SEQ ID NO: 199736 - DNA, 20 bp, Artificial Sequence
  Description of Artificial Sequence: Synthetic oligonucleotide
  Target: ATXN1; (-) strand; PAM type: YTN; PAM sequence: TTT
tcttttgaagcagcagaagg

SEQ ID NO: 199737 - DNA, 20 bp, Artificial Sequence
  Description of Artificial Sequence: Synthetic oligonucleotide
  Target: ATXN1; (-) strand; PAM type: YTN; PAM sequence: TTT
ttcttttgaagcagcagaag

SEQ ID NO: 199738 - DNA, 20 bp, Artificial Sequence
  Description of Artificial Sequence: Synthetic oligonucleotide
  Target: ATXN1; (-) strand; PAM type: YTN; PAM sequence: TTT
tttcttttgaagcagcagaa

SEQ ID NO: 199739 - DNA, 20 bp, Artificial Sequence
  Description of Artificial Sequence: Synthetic oligonucleotide
  Target: ATXN1; (-) strand; PAM type: YTN; PAM sequence: TTG
tgcacaatattttttctttt

SEQ ID NO: 199740 - DNA, 20 bp, Artificial Sequence
  Description of Artificial Sequence: Synthetic oligonucleotide
  Target: ATXN1; (-) strand; PAM type: YTN; PAM sequence: CTA
acgtaacgttgtgcacaata

SEQ ID NO: 199741 - DNA, 20 bp, Artificial Sequence
  Description of Artificial Sequence: Synthetic oligonucleotide
  Target: ATXN1; (-) strand; PAM type: YTN; PAM sequence: CTG
ctaacgtaacgttgtgcaca

SEQ ID NO: 199742 - DNA, 20 bp, Artificial Sequence
  Description of Artificial Sequence: Synthetic oligonucleotide
  Target: ATXN1; (-) strand; PAM type: YTN; PAM sequence: CTC
tgctaacgtaacgttgtgca

SEQ ID NO: 199743 - DNA, 20 bp, Artificial Sequence
  Description of Artificial Sequence: Synthetic oligonucleotide
  Target: ATXN1; (-) strand; PAM type: YTN; PAM sequence: CTC
tctgctaacgtaacgttgtg

SEQ ID NO: 199744 - DNA, 20 bp, Artificial Sequence
  Description of Artificial Sequence: Synthetic oligonucleotide
  Target: ATXN1; (-) strand; PAM type: YTN; PAM sequence: TTC
tctctgctaacgtaacgttg

SEQ ID NO: 199745 - DNA, 20 bp, Artificial Sequence
  Description of Artificial Sequence: Synthetic oligonucleotide
  Target: ATXN1; (-) strand; PAM type: YTN; PAM sequence: CTT
ctctctgctaacgtaacgtt

SEQ ID NO: 199746 - DNA, 20 bp, Artificial Sequence
  Description of Artificial Sequence: Synthetic oligonucleotide
  Target: ATXN1; (-) strand; PAM type: YTN; PAM sequence: TTC
gtcttctctctgctaacgta

SEQ ID NO: 199747 - DNA, 20 bp, Artificial Sequence
  Description of Artificial Sequence: Synthetic oligonucleotide
  Target: ATXN1; (-) strand; PAM type: YTN; PAM sequence: CTT
cgtcttctctctgctaacgt

SEQ ID NO: 199748 - DNA, 20 bp, Artificial Sequence
  Description of Artificial Sequence: Synthetic oligonucleotide
  Target: ATXN1; (-) strand; PAM type: YTN; PAM sequence: CTG
cttcgtcttctctctgctaa

SEQ ID NO: 199749 - DNA, 20 bp, Artificial Sequence
  Description of Artificial Sequence: Synthetic oligonucleotide
  Target: ATXN1; (-) strand; PAM type: YTN; PAM sequence: CTG
tgtgaatgaaggtgctgctt

SEQ ID NO: 199750 - DNA, 20 bp, Artificial Sequence
  Description of Artificial Sequence: Synthetic oligonucleotide
  Target: ATXN1; (-) strand; PAM type: YTN; PAM sequence: TTC
aaaacacactgtgtgaatga

SEQ ID NO: 199751 - DNA, 20 bp, Artificial Sequence
  Description of Artificial Sequence: Synthetic oligonucleotide
  Target: ATXN1; (-) strand; PAM type: YTN; PAM sequence: TTA
ttcaaaacacactgtgtgaa

SEQ ID NO: 199752 - DNA, 20 bp, Artificial Sequence
  Description of Artificial Sequence: Synthetic oligonucleotide
  Target: ATXN1; (-) strand; PAM type: YTN; PAM sequence: CTT
attcaaaacacactgtgtga

SEQ ID NO: 199753 - DNA, 20 bp, Artificial Sequence
  Description of Artificial Sequence: Synthetic oligonucleotide
  Target: ATXN1; (-) strand; PAM type: YTN; PAM sequence: TTA
caccttattcaaaacacact

SEQ ID NO: 199754 - DNA, 20 bp, Artificial Sequence
  Description of Artificial Sequence: Synthetic oligonucleotide
  Target: ATXN1; (-) strand; PAM type: YTN; PAM sequence: CTG
ataaattacaccttattcaa

SEQ ID NO: 199755 - DNA, 20 bp, Artificial Sequence
  Description of Artificial Sequence: Synthetic oligonucleotide
  Target: ATXN1; (-) strand; PAM type: YTN; PAM sequence: CTA
cctgataaattacaccttat

SEQ ID NO: 199756 - DNA, 20 bp, Artificial Sequence
  Description of Artificial Sequence: Synthetic oligonucleotide
  Target: ATXN1; (-) strand; PAM type: YTN; PAM sequence: CTC
tacctgataaattacacctt

SEQ ID NO: 199757 - DNA, 20 bp, Artificial Sequence
  Description of Artificial Sequence: Synthetic oligonucleotide
  Target: ATXN1; (-) strand; PAM type: YTN; PAM sequence: TTC
tctacctgataaattacacc

SEQ ID NO: 199758 - DNA, 20 bp, Artificial Sequence
  Description of Artificial Sequence: Synthetic oligonucleotide
  Target: ATXN1; (-) strand; PAM type: YTN; PAM sequence: TTT
ctctacctgataaattacac

SEQ ID NO: 199759 - DNA, 20 bp, Artificial Sequence
  Description of Artificial Sequence: Synthetic oligonucleotide
  Target: ATXN1; (-) strand; PAM type: YTN; PAM sequence: CTA
tgtccagaaaagagaagaga

SEQ ID NO: 199760 - DNA, 20 bp, Artificial Sequence
  Description of Artificial Sequence: Synthetic oligonucleotide
  Target: ATXN1; (-) strand; PAM type: YTN; PAM sequence: TTG
gaagctatgtccagaaaaga

SEQ ID NO: 199761 - DNA, 20 bp, Artificial Sequence
  Description of Artificial Sequence: Synthetic oligonucleotide
  Target: ATXN1; (-) strand; PAM type: YTN; PAM sequence: CTG
ttggaagctatgtccagaaa

SEQ ID NO: 199762 - DNA, 20 bp, Artificial Sequence
  Description of Artificial Sequence: Synthetic oligonucleotide
  Target: ATXN1; (-) strand; PAM type: YTN; PAM sequence: TTG
ctgttggaagctatgtccag

SEQ ID NO: 199763 - DNA, 20 bp, Artificial Sequence
  Description of Artificial Sequence: Synthetic oligonucleotide
  Target: ATXN1; (-) strand; PAM type: YTN; PAM sequence: TTT
gctgttggaagctatgtcca

SEQ ID NO: 199764 - DNA, 20 bp, Artificial Sequence
  Description of Artificial Sequence: Synthetic oligonucleotide
  Target: ATXN1; (-) strand; PAM type: YTN; PAM sequence: TTT
tgctgttggaagctatgtcc

SEQ ID NO: 199765 - DNA, 20 bp, Artificial Sequence
  Description of Artificial Sequence: Synthetic oligonucleotide
  Target: ATXN1; (-) strand; PAM type: YTN; PAM sequence: TTT
ttgctgttggaagctatgtc

SEQ ID NO: 199766 - DNA, 20 bp, Artificial Sequence
  Description of Artificial Sequence: Synthetic oligonucleotide
  Target: ATXN1; (-) strand; PAM type: YTN; PAM sequence: CTA
atttttgctgttggaagcta

SEQ ID NO: 199767 - DNA, 20 bp, Artificial Sequence
  Description of Artificial Sequence: Synthetic oligonucleotide
  Target: ATXN1; (-) strand; PAM type: YTN; PAM sequence: TTC
taatttttgctgttggaagc

SEQ ID NO: 199768 - DNA, 20 bp, Artificial Sequence
  Description of Artificial Sequence: Synthetic oligonucleotide
  Target: ATXN1; (-) strand; PAM type: YTN; PAM sequence: CTT
ctaatttttgctgttggaag

SEQ ID NO: 199769 - DNA, 20 bp, Artificial Sequence
  Description of Artificial Sequence: Synthetic oligonucleotide
  Target: ATXN1; (-) strand; PAM type: YTN; PAM sequence: CTA
cacttctaatttttgctgtt

SEQ ID NO: 199770 - DNA, 20 bp, Artificial Sequence
  Description of Artificial Sequence: Synthetic oligonucleotide
  Target: ATXN1; (-) strand; PAM type: YTN; PAM sequence: TTA
gtgagtggagtggcaaccca

SEQ ID NO: 199771 - DNA, 20 bp, Artificial Sequence
  Description of Artificial Sequence: Synthetic oligonucleotide
  Target: ATXN1; (-) strand; PAM type: YTN; PAM sequence: TTT
agtgagtggagtggcaaccc

SEQ ID NO: 199772 - DNA, 20 bp, Artificial Sequence
  Description of Artificial Sequence: Synthetic oligonucleotide
  Target: ATXN1; (-) strand; PAM type: YTN; PAM sequence: TTA
taaatttagtgagtggagtg

SEQ ID NO: 199773 - DNA, 20 bp, Artificial Sequence
  Description of Artificial Sequence: Synthetic oligonucleotide
  Target: ATXN1; (-) strand; PAM type: YTN; PAM sequence: TTT
ataaatttagtgagtggagt

SEQ ID NO: 199774 - DNA, 20 bp, Artificial Sequence
  Description of Artificial Sequence: Synthetic oligonucleotide
  Target: ATXN1; (-) strand; PAM type: YTN; PAM sequence: TTT
tataaatttagtgagtggag

SEQ ID NO: 199775 - DNA, 20 bp, Artificial Sequence
  Description of Artificial Sequence: Synthetic oligonucleotide
  Target: ATXN1; (-) strand; PAM type: YTN; PAM sequence: CTT
ttataaatttagtgagtgga

SEQ ID NO: 199776 - DNA, 20 bp, Artificial Sequence
  Description of Artificial Sequence: Synthetic oligonucleotide
  Target: ATXN1; (-) strand; PAM type: YTN; PAM sequence: TTG
agtatcttttataaatttag

SEQ ID NO: 199777 - DNA, 20 bp, Artificial Sequence
  Description of Artificial Sequence: Synthetic oligonucleotide
  Target: ATXN1; (-) strand; PAM type: YTN; PAM sequence: TTT
gagtatcttttataaattta

SEQ ID NO: 199778 - DNA, 20 bp, Artificial Sequence
  Description of Artificial Sequence: Synthetic oligonucleotide
  Target: ATXN1; (-) strand; PAM type: YTN; PAM sequence: CTT
tgagtatcttttataaattt

SEQ ID NO: 199779 - DNA, 20 bp, Artificial Sequence
  Description of Artificial Sequence: Synthetic oligonucleotide
  Target: ATXN1; (-) strand; PAM type: YTN; PAM sequence: TTG
tgaaaagtgtgagtatcttt

SEQ ID NO: 199780 - DNA, 20 bp, Artificial Sequence
  Description of Artificial Sequence: Synthetic oligonucleotide
  Target: ATXN1; (-) strand; PAM type: YTN; PAM sequence: CTT
gtgaaaagtgtgagtatctt

SEQ ID NO: 199781 - DNA, 20 bp, Artificial Sequence
  Description of Artificial Sequence: Synthetic oligonucleotide
  Target: ATXN1; (-) strand; PAM type: YTN; PAM sequence: CTG
gatgtgggcagatgggggta

SEQ ID NO: 199782 - DNA, 20 bp, Artificial Sequence
  Description of Artificial Sequence: Synthetic oligonucleotide
  Target: ATXN1; (-) strand; PAM type: YTN; PAM sequence: CTG
tcacagcgaagatagatgct

SEQ ID NO: 199783 - DNA, 20 bp, Artificial Sequence
  Description of Artificial Sequence: Synthetic oligonucleotide
  Target: ATXN1; (-) strand; PAM type: YTN; PAM sequence: TTC
tgtcacagcgaagatagatg

SEQ ID NO: 199784 - DNA, 20 bp, Artificial Sequence
  Description of Artificial Sequence: Synthetic oligonucleotide
  Target: ATXN1; (-) strand; PAM type: YTN; PAM sequence: TTT
ctgtcacagcgaagatagat

SEQ ID NO: 199785 - DNA, 20 bp, Artificial Sequence
  Description of Artificial Sequence: Synthetic oligonucleotide
  Target: ATXN1; (-) strand; PAM type: YTN; PAM sequence: TTA
tttctgtcacagcgaagata

SEQ ID NO: 199786 - DNA, 20 bp, Artificial Sequence
  Description of Artificial Sequence: Synthetic oligonucleotide
  Target: ATXN1; (-) strand; PAM type: YTN; PAM sequence: CTG
tacagcggatagtaattatt

SEQ ID NO: 199787 - DNA, 20 bp, Artificial Sequence
  Description of Artificial Sequence: Synthetic oligonucleotide
  Target: ATXN1; (-) strand; PAM type: YTN; PAM sequence: CTC
cgccagtcaaggctgtacag

SEQ ID NO: 199788 - DNA, 20 bp, Artificial Sequence
  Description of Artificial Sequence: Synthetic oligonucleotide
  Target: ATXN1; (-) strand; PAM type: YTN; PAM sequence: CTG
gccagctccgccagtcaagg

SEQ ID NO: 199789 - DNA, 20 bp, Artificial Sequence
  Description of Artificial Sequence: Synthetic oligonucleotide
  Target: ATXN1; (-) strand; PAM type: YTN; PAM sequence: TTC
tggccagctccgccagtcaa

SEQ ID NO: 199790 - DNA, 20 bp, Artificial Sequence
  Description of Artificial Sequence: Synthetic oligonucleotide
  Target: ATXN1; (-) strand; PAM type: YTN; PAM sequence: TTC
aaggtgatacacccccgtaa

SEQ ID NO: 199791 - DNA, 20 bp, Artificial Sequence
  Description of Artificial Sequence: Synthetic oligonucleotide
  Target: ATXN1; (-) strand; PAM type: YTN; PAM sequence: CTT
caaggtgatacacccccgta

SEQ ID NO: 199792 - DNA, 20 bp, Artificial Sequence
  Description of Artificial Sequence: Synthetic oligonucleotide
  Target: ATXN1; (-) strand; PAM type: YTN; PAM sequence: TTG
acatggaccagcaggtaaac

SEQ ID NO: 199793 - DNA, 20 bp, Artificial Sequence
  Description of Artificial Sequence: Synthetic oligonucleotide
  Target: ATXN1; (-) strand; PAM type: YTN; PAM sequence: CTG
aacatcattgacatggacca

SEQ ID NO: 199794 - DNA, 20 bp, Artificial Sequence
  Description of Artificial Sequence: Synthetic oligonucleotide
  Target: ATXN1; (-) strand; PAM type: YTN; PAM sequence: TTA
aacagatgtggaagcgcaga

SEQ ID NO: 199795 - DNA, 20 bp, Artificial Sequence
  Description of Artificial Sequence: Synthetic oligonucleotide
  Target: ATXN1; (-) strand; PAM type: YTN; PAM sequence: TTA
gtatgagtgtgagtggaagt

SEQ ID NO: 199796 - DNA, 20 bp, Artificial Sequence
  Description of Artificial Sequence: Synthetic oligonucleotide
  Target: ATXN1; (-) strand; PAM type: YTN; PAM sequence: TTT
agtatgagtgtgagtggaag

SEQ ID NO: 199797 - DNA, 20 bp, Artificial Sequence
  Description of Artificial Sequence: Synthetic oligonucleotide
  Target: ATXN1; (-) strand; PAM type: YTN; PAM sequence: CTG
gagtagaatttagtatgagt

SEQ ID NO: 199798 - DNA, 20 bp, Artificial Sequence
  Description of Artificial Sequence: Synthetic oligonucleotide
  Target: ATXN1; (-) strand; PAM type: YTN; PAM sequence: CTC
tggagtagaatttagtatga

SEQ ID NO: 199799 - DNA, 20 bp, Artificial Sequence
  Description of Artificial Sequence: Synthetic oligonucleotide
  Target: ATXN1; (-) strand; PAM type: YTN; PAM sequence: TTG
ctctggagtagaatttagta

SEQ ID NO: 199800 - DNA, 20 bp, Artificial Sequence
  Description of Artificial Sequence: Synthetic oligonucleotide
  Target: ATXN1; (-) strand; PAM type: YTN; PAM sequence: TTA
gacagaagaggcccagccac

SEQ ID NO: 199801 - DNA, 20 bp, Artificial Sequence
  Description of Artificial Sequence: Synthetic oligonucleotide
  Target: ATXN1; (-) strand; PAM type: YTN; PAM sequence: CTT
agacagaagaggcccagcca

SEQ ID NO: 199802 - DNA, 20 bp, Artificial Sequence
  Description of Artificial Sequence: Synthetic oligonucleotide
  Target: ATXN1; (-) strand; PAM type: YTN; PAM sequence: CTG
tcatcggaaatacgtggagc

SEQ ID NO: 199803 - DNA, 20 bp, Artificial Sequence
  Description of Artificial Sequence: Synthetic oligonucleotide
  Target: ATXN1; (-) strand; PAM type: YTN; PAM sequence: TTC
tgtcatcggaaatacgtgga

SEQ ID NO: 199804 - DNA, 20 bp, Artificial Sequence
  Description of Artificial Sequence: Synthetic oligonucleotide
  Target: ATXN1; (-) strand; PAM type: YTN; PAM sequence: CTA
ttctgtcatcggaaatacgt

SEQ ID NO: 199805 - DNA, 20 bp, Artificial Sequence
  Description of Artificial Sequence: Synthetic oligonucleotide
  Target: ATXN1; (-) strand; PAM type: YTN; PAM sequence: TTG
ctattctgtcatcggaaata

SEQ ID NO: 199806 - DNA, 20 bp, Artificial Sequence
  Description of Artificial Sequence: Synthetic oligonucleotide
  Target: ATXN1; (-) strand; PAM type: YTN; PAM sequence: TTT
gctattctgtcatcggaaat

SEQ ID NO: 199807 - DNA, 20 bp, Artificial Sequence
  Description of Artificial Sequence: Synthetic oligonucleotide
  Target: ATXN1; (-) strand; PAM type: YTN; PAM sequence: TTA
atgatttgctattctgtcat

SEQ ID NO: 199808 - DNA, 20 bp, Artificial Sequence
  Description of Artificial Sequence: Synthetic oligonucleotide
  Target: ATXN1; (-) strand; PAM type: YTN; PAM sequence: TTT
aatgatttgctattctgtca

SEQ ID NO: 199809 - DNA, 20 bp, Artificial Sequence
  Description of Artificial Sequence: Synthetic oligonucleotide
  Target: ATXN1; (-) strand; PAM type: YTN; PAM sequence: TTT
taatgatttgctattctgtc

SEQ ID NO: 199810 - DNA, 20 bp, Artificial Sequence
  Description of Artificial Sequence: Synthetic oligonucleotide
  Target: ATXN1; (-) strand; PAM type: YTN; PAM sequence: CTG
gcgttttaatgatttgctat

SEQ ID NO: 199811 - DNA, 20 bp, Artificial Sequence
  Description of Artificial Sequence: Synthetic oligonucleotide
  Target: ATXN1; (-) strand; PAM type: YTN; PAM sequence: CTC
tggcgttttaatgatttgct

SEQ ID NO: 199812 - DNA, 20 bp, Artificial Sequence
  Description of Artificial Sequence: Synthetic oligonucleotide
  Target: ATXN1; (-) strand; PAM type: YTN; PAM sequence: TTC
tctggcgttttaatgatttg

SEQ ID NO: 199813 - DNA, 20 bp, Artificial Sequence
  Description of Artificial Sequence: Synthetic oligonucleotide
  Target: ATXN1; (-) strand; PAM type: YTN; PAM sequence: TTG
gttctctggcgttttaatga

SEQ ID NO: 199814 - DNA, 20 bp, Artificial Sequence
  Description of Artificial Sequence: Synthetic oligonucleotide
  Target: ATXN1; (-) strand; PAM type: YTN; PAM sequence: TTT
ggttctctggcgttttaatg

SEQ ID NO: 199815 - DNA, 20 bp, Artificial Sequence
  Description of Artificial Sequence: Synthetic oligonucleotide
  Target: ATXN1; (-) strand; PAM type: YTN; PAM sequence: CTT
tggttctctggcgttttaat

SEQ ID NO: 199816 - DNA, 20 bp, Artificial Sequence
  Description of Artificial Sequence: Synthetic oligonucleotide
  Target: ATXN1; (-) strand; PAM type: YTN; PAM sequence: CTG
aagtcgaagccctttggttc

SEQ ID NO: 199817 - DNA, 20 bp, Artificial Sequence
  Description of Artificial Sequence: Synthetic oligonucleotide
  Target: ATXN1; (-) strand; PAM type: YTN; PAM sequence: CTC
ctgaagtcgaagccctttgg

SEQ ID NO: 199818 - DNA, 20 bp, Artificial Sequence
  Description of Artificial Sequence: Synthetic oligonucleotide
  Target: ATXN1; (-) strand; PAM type: YTN; PAM sequence: TTG
cccacaaggaggtctcctga

SEQ ID NO: 199819 - DNA, 20 bp, Artificial Sequence
  Description of Artificial Sequence: Synthetic oligonucleotide
  Target: ATXN1; (-) strand; PAM type: YTN; PAM sequence: CTG
tgcgattgcccacaaggagg

SEQ ID NO: 199820 - DNA, 20 bp, Artificial Sequence
  Description of Artificial Sequence: Synthetic oligonucleotide
  Target: ATXN1; (-) strand; PAM type: YTN; PAM sequence: TTG
gaaagtcatggtatctgtgc

SEQ ID NO: 199821 - DNA, 20 bp, Artificial Sequence
  Description of Artificial Sequence: Synthetic oligonucleotide
  Target: ATXN1; (-) strand; PAM type: YTN; PAM sequence: CTC
cgaaaagattggaaagtcat

SEQ ID NO: 199822 - DNA, 20 bp, Artificial Sequence
  Description of Artificial Sequence: Synthetic oligonucleotide
  Target: ATXN1; (-) strand; PAM type: YTN; PAM sequence: TTG
aacaacacctccgaaaagat

SEQ ID NO: 199823 - DNA, 20 bp, Artificial Sequence
  Description of Artificial Sequence: Synthetic oligonucleotide
  Target: ATXN1; (-) strand; PAM type: YTN; PAM sequence: TTT
gaacaacacctccgaaaaga

SEQ ID NO: 199824 - DNA, 20 bp, Artificial Sequence
  Description of Artificial Sequence: Synthetic oligonucleotide
  Target: ATXN1; (-) strand; PAM type: YTN; PAM sequence: CTG
aacgaaagcggaatttgaac

SEQ ID NO: 199825 - DNA, 20 bp, Artificial Sequence
  Description of Artificial Sequence: Synthetic oligonucleotide
  Target: ATXN1; (-) strand; PAM type: YTN; PAM sequence: CTA
gaggcgcatagcctgaacga

SEQ ID NO: 199826 - DNA, 20 bp, Artificial Sequence
  Description of Artificial Sequence: Synthetic oligonucleotide
  Target: ATXN1; (-) strand; PAM type: YTN; PAM sequence: CTC
ctagaggcgcatagcctgaa

SEQ ID NO: 199827 - DNA, 20 bp, Artificial Sequence
  Description of Artificial Sequence: Synthetic oligonucleotide
  Target: ATXN1; (-) strand; PAM type: YTN; PAM sequence: CTG
gaagggccatggcagggtag

SEQ ID NO: 199828 - DNA, 20 bp, Artificial Sequence
  Description of Artificial Sequence: Synthetic oligonucleotide
  Target: ATXN1; (-) strand; PAM type: YTN; PAM sequence: CTG
ccaatggccagctggaaggg

SEQ ID NO: 199829 - DNA, 20 bp, Artificial Sequence
  Description of Artificial Sequence: Synthetic oligonucleotide
  Target: ATXN1; (-) strand; PAM type: YTN; PAM sequence: CTG
gcgctgccaatggccagctg

SEQ ID NO: 199830 - DNA, 20 bp, Artificial Sequence
  Description of Artificial Sequence: Synthetic oligonucleotide
  Target: ATXN1; (-) strand; PAM type: YTN; PAM sequence: CTG
tgtcctggcgctgccaatgg

SEQ ID NO: 199831 - DNA, 20 bp, Artificial Sequence
  Description of Artificial Sequence: Synthetic oligonucleotide
  Target: ATXN1; (-) strand; PAM type: YTN; PAM sequence: TTA
tgctgtgtcctggcgctgcc

SEQ ID NO: 199832 - DNA, 20 bp, Artificial Sequence
  Description of Artificial Sequence: Synthetic oligonucleotide
  Target: ATXN1; (-) strand; PAM type: YTN; PAM sequence: TTT
atgctgtgtcctggcgctgc

SEQ ID NO: 199833 - DNA, 20 bp, Artificial Sequence
  Description of Artificial Sequence: Synthetic oligonucleotide
  Target: ATXN1; (-) strand; PAM type: YTN; PAM sequence: CTT
tatgctgtgtcctggcgctg

SEQ ID NO: 199834 - DNA, 20 bp, Artificial Sequence
  Description of Artificial Sequence: Synthetic oligonucleotide
  Target: ATXN1; (-) strand; PAM type: YTN; PAM sequence: TTC
tttatgctgtgtcctggcgc

SEQ ID NO: 199835 - DNA, 20 bp, Artificial Sequence
  Description of Artificial Sequence: Synthetic oligonucleotide
  Target: ATXN1; (-) strand; PAM type: YTN; PAM sequence: TTT
ctttatgctgtgtcctggcg

SEQ ID NO: 199836 - DNA, 20 bp, Artificial Sequence
  Description of Artificial Sequence: Synthetic oligonucleotide
  Target: ATXN1; (-) strand; PAM type: YTN; PAM sequence: TTT
tctttatgctgtgtcctggc

SEQ ID NO: 199837 - DNA, 20 bp, Artificial Sequence
  Description of Artificial Sequence: Synthetic oligonucleotide
  Target: ATXN1; (-) strand; PAM type: YTN; PAM sequence: TTA
taagacccaaaccacagttt

SEQ ID NO: 199838 - DNA, 20 bp, Artificial Sequence
  Description of Artificial Sequence: Synthetic oligonucleotide
  Target: ATXN1; (-) strand; PAM type: YTN; PAM sequence: CTT
ataagacccaaaccacagtt

SEQ ID NO: 199839 - DNA, 20 bp, Artificial Sequence
  Description of Artificial Sequence: Synthetic oligonucleotide
  Target: ATXN1; (-) strand; PAM type: YTN; PAM sequence: CTG
tcagtgatcttataagaccc

SEQ ID NO: 199840 - DNA, 20 bp, Artificial Sequence
  Description of Artificial Sequence: Synthetic oligonucleotide
  Target: ATXN1; (-) strand; PAM type: YTN; PAM sequence: TTG
gctgtcagtgatcttataag

SEQ ID NO: 199841 - DNA, 20 bp, Artificial Sequence
  Description of Artificial Sequence: Synthetic oligonucleotide
  Target: ATXN1; (-) strand; PAM type: YTN; PAM sequence: CTT
ggctgtcagtgatcttataa

SEQ ID NO: 199842 - DNA, 20 bp, Artificial Sequence
  Description of Artificial Sequence: Synthetic oligonucleotide
  Target: ATXN1; (-) strand; PAM type: YTN; PAM sequence: TTG
gaatgtatgcttggctgtca

SEQ ID NO: 199843 - DNA, 20 bp, Artificial Sequence
  Description of Artificial Sequence: Synthetic oligonucleotide
  Target: ATXN1; (-) strand; PAM type: YTN; PAM sequence: TTT
ggaatgtatgcttggctgtc

SEQ ID NO: 199844 - DNA, 20 bp, Artificial Sequence
  Description of Artificial Sequence: Synthetic oligonucleotide
  Target: ATXN1; (-) strand; PAM type: YTN; PAM sequence: TTG
agtcatacagtatttggaat

SEQ ID NO: 199845 - DNA, 20 bp, Artificial Sequence
  Description of Artificial Sequence: Synthetic oligonucleotide
  Target: ATXN1; (-) strand; PAM type: YTN; PAM sequence: TTT
gagtcatacagtatttggaa

SEQ ID NO: 199846 - DNA, 20 bp, Artificial Sequence
  Description of Artificial Sequence: Synthetic oligonucleotide
  Target: ATXN1; (-) strand; PAM type: YTN; PAM sequence: CTT
tgagtcatacagtatttgga

SEQ ID NO: 199847 - DNA, 20 bp, Artificial Sequence
  Description of Artificial Sequence: Synthetic oligonucleotide
  Target: ATXN1; (-) strand; PAM type: YTN; PAM sequence: TTC
gagatagcctttgagtcata

SEQ ID NO: 199848 - DNA, 20 bp, Artificial Sequence
  Description of Artificial Sequence: Synthetic oligonucleotide
  Target: ATXN1; (-) strand; PAM type: YTN; PAM sequence: TTG
taataagtgttcgagatagc

SEQ ID NO: 199849 - DNA, 20 bp, Artificial Sequence
  Description of Artificial Sequence: Synthetic oligonucleotide
  Target: ATXN1; (-) strand; PAM type: YTN; PAM sequence: TTT
gtaataagtgttcgagatag

SEQ ID NO: 199850 - DNA, 20 bp, Artificial Sequence
  Description of Artificial Sequence: Synthetic oligonucleotide
  Target: ATXN1; (-) strand; PAM type: YTN; PAM sequence: TTA
cacatttgtaataagtgttc

SEQ ID NO: 199851 - DNA, 20 bp, Artificial Sequence
  Description of Artificial Sequence: Synthetic oligonucleotide
  Target: ATXN1; (-) strand; PAM type: YTN; PAM sequence: CTA
gaaggaaaaatggagtatta

SEQ ID NO: 199852 - DNA, 20 bp, Artificial Sequence
  Description of Artificial Sequence: Synthetic oligonucleotide
  Target: ATXN1; (-) strand; PAM type: YTN; PAM sequence: TTA
atctagaaggaaaaatggag

SEQ ID NO: 199853 - DNA, 20 bp, Artificial Sequence
  Description of Artificial Sequence: Synthetic oligonucleotide
  Target: ATXN1; (-) strand; PAM type: YTN; PAM sequence: TTT
aatctagaaggaaaaatgga

SEQ ID NO: 199854 - DNA, 20 bp, Artificial Sequence
  Description of Artificial Sequence: Synthetic oligonucleotide
  Target: ATXN1; (-) strand; PAM type: YTN; PAM sequence: CTT
taatctagaaggaaaaatgg

SEQ ID NO: 199855 - DNA, 20 bp, Artificial Sequence
  Description of Artificial Sequence: Synthetic oligonucleotide
  Target: ATXN1; (-) strand; PAM type: YTN; PAM sequence: TTG
gggtgaaataacgccatgaa

SEQ ID NO: 199856 - DNA, 20 bp, Artificial Sequence
  Description of Artificial Sequence: Synthetic oligonucleotide
  Target: ATXN1; (-) strand; PAM type: YTN; PAM sequence: TTT
ggggtgaaataacgccatga

SEQ ID NO: 199857 - DNA, 20 bp, Artificial Sequence
  Description of Artificial Sequence: Synthetic oligonucleotide
  Target: ATXN1; (-) strand; PAM type: YTN; PAM sequence: TTA
gagaggtttggggtgaaata

SEQ ID NO: 199858 - DNA, 20 bp, Artificial Sequence
  Description of Artificial Sequence: Synthetic oligonucleotide
  Target: ATXN1; (-) strand; PAM type: YTN; PAM sequence: CTT
agagaggtttggggtgaaat

SEQ ID NO: 199859 - DNA, 20 bp, Artificial Sequence
  Description of Artificial Sequence: Synthetic oligonucleotide
  Target: ATXN1; (-) strand; PAM type: YTN; PAM sequence: CTA
ccttagagaggtttggggtg

SEQ ID NO: 199860 - DNA, 20 bp, Artificial Sequence
  Description of Artificial Sequence: Synthetic oligonucleotide
  Target: ATXN1; (-) strand; PAM type: YTN; PAM sequence: CTG
aacccggacaggagcaagat

SEQ ID NO: 199861 - DNA, 20 bp, Artificial Sequence
  Description of Artificial Sequence: Synthetic oligonucleotide
  Target: ATXN1; (-) strand; PAM type: YTN; PAM sequence: TTC
ctgaacccggacaggagcaa

SEQ ID NO: 199862 - DNA, 20 bp, Artificial Sequence
  Description of Artificial Sequence: Synthetic oligonucleotide
  Target: ATXN1; (-) strand; PAM type: YTN; PAM sequence: TTT
cctgaacccggacaggagca

SEQ ID NO: 199863 - DNA, 20 bp, Artificial Sequence
  Description of Artificial Sequence: Synthetic oligonucleotide
  Target: ATXN1; (-) strand; PAM type: YTN; PAM sequence: TTC
catgagggtcaagagtttcc

SEQ ID NO: 199864 - DNA, 20 bp, Artificial Sequence
  Description of Artificial Sequence: Synthetic oligonucleotide
  Target: ATXN1; (-) strand; PAM type: YTN; PAM sequence: CTT
ccatgagggtcaagagtttc

SEQ ID NO: 199865 - DNA, 20 bp, Artificial Sequence
  Description of Artificial Sequence: Synthetic oligonucleotide
  Target: ATXN1; (-) strand; PAM type: YTN; PAM sequence: TTG
gaaggccatgcaggacttcc

SEQ ID NO: 199866 - DNA, 20 bp, Artificial Sequence
  Description of Artificial Sequence: Synthetic oligonucleotide
  Target: ATXN1; (-) strand; PAM type: YTN; PAM sequence: CTT
ggaaggccatgcaggacttc

SEQ ID NO: 199867 - DNA, 20 bp, Artificial Sequence
  Description of Artificial Sequence: Synthetic oligonucleotide
  Target: ATXN1; (-) strand; PAM type: YTN; PAM sequence: CTC
acttggaaggccatgcagga

SEQ ID NO: 199868 - DNA, 20 bp, Artificial Sequence
  Description of Artificial Sequence: Synthetic oligonucleotide
  Target: ATXN1; (-) strand; PAM type: YTN; PAM sequence: CTG
accctcacttggaaggccat

SEQ ID NO: 199869 - DNA, 20 bp, Artificial Sequence
  Description of Artificial Sequence: Synthetic oligonucleotide
  Target: ATXN1; (-) strand; PAM type: YTN; PAM sequence: CTG
gagtgacaactgaccctcac

SEQ ID NO: 199870 - DNA, 20 bp, Artificial Sequence
  Description of Artificial Sequence: Synthetic oligonucleotide
  Target: ATXN1; (-) strand; PAM type: YTN; PAM sequence: CTG
tgagacggaaatacaaagta

SEQ ID NO: 199871 - DNA, 20 bp, Artificial Sequence
  Description of Artificial Sequence: Synthetic oligonucleotide
  Target: ATXN1; (-) strand; PAM type: YTN; PAM sequence: CTG
agaaaggtactgtgagacgg

SEQ ID NO: 199872 - DNA, 20 bp, Artificial Sequence
  Description of Artificial Sequence: Synthetic oligonucleotide
  Target: ATXN1; (-) strand; PAM type: YTN; PAM sequence: TTA
ccgtgcactgagaaaggtac

SEQ ID NO: 199873 - DNA, 20 bp, Artificial Sequence
  Description of Artificial Sequence: Synthetic oligonucleotide
  Target: ATXN1; (-) strand; PAM type: YTN; PAM sequence: CTA
gtcaattaccgtgcactgag

SEQ ID NO: 199874 - DNA, 20 bp, Artificial Sequence
  Description of Artificial Sequence: Synthetic oligonucleotide
  Target: ATXN1; (-) strand; PAM type: YTN; PAM sequence: TTA
taggagagtggatagaacat

SEQ ID NO: 199875 - DNA, 20 bp, Artificial Sequence
  Description of Artificial Sequence: Synthetic oligonucleotide
  Target: ATXN1; (-) strand; PAM type: YTN; PAM sequence: TTA
ttataggagagtggatagaa

SEQ ID NO: 199876 - DNA, 20 bp, Artificial Sequence
  Description of Artificial Sequence: Synthetic oligonucleotide
  Target: ATXN1; (-) strand; PAM type: YTN; PAM sequence: TTA
tagttattataggagagtgg

SEQ ID NO: 199877 - DNA, 20 bp, Artificial Sequence
  Description of Artificial Sequence: Synthetic oligonucleotide
  Target: ATXN1; (-) strand; PAM type: YTN; PAM sequence: CTA
cattatagttattataggag

SEQ ID NO: 199878 - DNA, 20 bp, Artificial Sequence
  Description of Artificial Sequence: Synthetic oligonucleotide
  Target: ATXN1; (-) strand; PAM type: YTN; PAM sequence: CTA
cccacatggcactacattat

SEQ ID NO: 199879 - DNA, 20 bp, Artificial Sequence
  Description of Artificial Sequence: Synthetic oligonucleotide
  Target: ATXN1; (-) strand; PAM type: YTN; PAM sequence: CTA
aggtagacaagataaaaatg

SEQ ID NO: 199880 - DNA, 20 bp, Artificial Sequence
  Description of Artificial Sequence: Synthetic oligonucleotide
  Target: ATXN1; (-) strand; PAM type: YTN; PAM sequence: CTG
aagatactaaggtagacaag

SEQ ID NO: 199881 - DNA, 20 bp, Artificial Sequence
  Description of Artificial Sequence: Synthetic oligonucleotide
  Target: ATXN1; (-) strand; PAM type: YTN; PAM sequence: TTC
tgaagatactaaggtagaca

SEQ ID NO: 199882 - DNA, 20 bp, Artificial Sequence
  Description of Artificial Sequence: Synthetic oligonucleotide
  Target: ATXN1; (-) strand; PAM type: YTN; PAM sequence: CTA
agttctgaagatactaaggt

SEQ ID NO: 199883 - DNA, 20 bp, Artificial Sequence
  Description of Artificial Sequence: Synthetic oligonucleotide
  Target: ATXN1; (-) strand; PAM type: YTN; PAM sequence: CTG
ccatgtaccaagcagagtgc

SEQ ID NO: 199884 - DNA, 20 bp, Artificial Sequence
  Description of Artificial Sequence: Synthetic oligonucleotide
  Target: ATXN1; (-) strand; PAM type: YTN; PAM sequence: TTG
agagtctgccatgtaccaag

SEQ ID NO: 199885 - DNA, 20 bp, Artificial Sequence
  Description of Artificial Sequence: Synthetic oligonucleotide
  Target: ATXN1; (-) strand; PAM type: YTN; PAM sequence: TTT
gagagtctgccatgtaccaa

SEQ ID NO: 199886 - DNA, 20 bp, Artificial Sequence
  Description of Artificial Sequence: Synthetic oligonucleotide
  Target: ATXN1; (-) strand; PAM type: YTN; PAM sequence: TTT
tgagagtctgccatgtacca

SEQ ID NO: 199887 - DNA, 20 bp, Artificial Sequence
  Description of Artificial Sequence: Synthetic oligonucleotide
  Target: ATXN1; (-) strand; PAM type: YTN; PAM sequence: TTT
ttgagagtctgccatgtacc

SEQ ID NO: 199888 - DNA, 20 bp, Artificial Sequence
  Description of Artificial Sequence: Synthetic oligonucleotide
  Target: ATXN1; (-) strand; PAM type: YTN; PAM sequence: CTG
atatttttgagagtctgcca

SEQ ID NO: 199889 - DNA, 20 bp, Artificial Sequence
  Description of Artificial Sequence: Synthetic oligonucleotide
  Target: ATXN1; (-) strand; PAM type: YTN; PAM sequence: CTG
tcaactgatatttttgagag

SEQ ID NO: 199890 - DNA, 20 bp, Artificial Sequence
  Description of Artificial Sequence: Synthetic oligonucleotide
  Target: ATXN1; (-) strand; PAM type: YTN; PAM sequence: TTC
aatcagtctgtcaactgata

SEQ ID NO: 199891 - DNA, 20 bp, Artificial Sequence
  Description of Artificial Sequence: Synthetic oligonucleotide
  Target: ATXN1; (-) strand; PAM type: YTN; PAM sequence: TTT
caatcagtctgtcaactgat

SEQ ID NO: 199892 - DNA, 20 bp, Artificial Sequence
  Description of Artificial Sequence: Synthetic oligonucleotide
  Target: ATXN1; (-) strand; PAM type: YTN; PAM sequence: TTT
tcaatcagtctgtcaactga

SEQ ID NO: 199893 - DNA, 20 bp, Artificial Sequence
  Description of Artificial Sequence: Synthetic oligonucleotide
  Target: ATXN1; (-) strand; PAM type: YTN; PAM sequence: CTA
ttttcaatcagtctgtcaac

SEQ ID NO: 199894 - DNA, 20 bp, Artificial Sequence
  Description of Artificial Sequence: Synthetic oligonucleotide
  Target: ATXN1; (-) strand; PAM type: YTN; PAM sequence: TTC
tattttcaatcagtctgtca

SEQ ID NO: 199895 - DNA, 20 bp, Artificial Sequence
  Description of Artificial Sequence: Synthetic oligonucleotide
  Target: ATXN1; (-) strand; PAM type: YTN; PAM sequence: TTC
agaaccacggattctatttt

SEQ ID NO: 199896 - DNA, 20 bp, Artificial Sequence
  Description of Artificial Sequence: Synthetic oligonucleotide
  Target: ATXN1; (-) strand; PAM type: YTN; PAM sequence: TTA
ttcagaaccacggattctat

SEQ ID NO: 199897 - DNA, 20 bp, Artificial Sequence
  Description of Artificial Sequence: Synthetic oligonucleotide
  Target: ATXN1; (-) strand; PAM type: YTN; PAM sequence: CTG
gggtgagtaaatagccatta

SEQ ID NO: 199898 - DNA, 20 bp, Artificial Sequence
  Description of Artificial Sequence: Synthetic oligonucleotide
  Target: ATXN1; (-) strand; PAM type: YTN; PAM sequence: CTG
gactggggtgagtaaatagc

SEQ ID NO: 199899 - DNA, 20 bp, Artificial Sequence
  Description of Artificial Sequence: Synthetic oligonucleotide
  Target: ATXN1; (-) strand; PAM type: YTN; PAM sequence: TTG
agggccatggtgagggccca

SEQ ID NO: 199900 - DNA, 20 bp, Artificial Sequence
  Description of Artificial Sequence: Synthetic oligonucleotide
  Target: ATXN1; (-) strand; PAM type: YTN; PAM sequence: CTG
ttgagggccatggtgagggc

SEQ ID NO: 199901 - DNA, 20 bp, Artificial Sequence
  Description of Artificial Sequence: Synthetic oligonucleotide
  Target: ATXN1; (-) strand; PAM type: YTN; PAM sequence: CTG
tggccatgggctgttgaggg

SEQ ID NO: 199902 - DNA, 20 bp, Artificial Sequence
  Description of Artificial Sequence: Synthetic oligonucleotide
  Target: ATXN1; (-) strand; PAM type: YTN; PAM sequence: CTA
gtagggatggtcagtcccag

SEQ ID NO: 199903 - DNA, 20 bp, Artificial Sequence
  Description of Artificial Sequence: Synthetic oligonucleotide
  Target: ATXN1; (-) strand; PAM type: YTN; PAM sequence: TTC
ctagtagggatggtcagtcc

SEQ ID NO: 199904 - DNA, 20 bp, Artificial Sequence
  Description of Artificial Sequence: Synthetic oligonucleotide
  Target: ATXN1; (-) strand; PAM type: YTN; PAM sequence: TTA
ggggcgtgacacattcctag

SEQ ID NO: 199905 - DNA, 20 bp, Artificial Sequence
  Description of Artificial Sequence: Synthetic oligonucleotide
  Target: ATXN1; (-) strand; PAM type: YTN; PAM sequence: TTT
aggggcgtgacacattccta

SEQ ID NO: 199906 - DNA, 20 bp, Artificial Sequence
  Description of Artificial Sequence: Synthetic oligonucleotide
  Target: ATXN1; (-) strand; PAM type: YTN; PAM sequence: CTC
atttaggggcgtgacacatt

SEQ ID NO: 199907 - DNA, 20 bp, Artificial Sequence
  Description of Artificial Sequence: Synthetic oligonucleotide
  Target: ATXN1; (-) strand; PAM type: YTN; PAM sequence: CTC
acagtctcatttaggggcgt

SEQ ID NO: 199908 - DNA, 20 bp, Artificial Sequence
  Description of Artificial Sequence: Synthetic oligonucleotide
  Target: ATXN1; (-) strand; PAM type: YTN; PAM sequence: TTA
agcagagaaaactcacagtc

SEQ ID NO: 199909 - DNA, 20 bp, Artificial Sequence
  Description of Artificial Sequence: Synthetic oligonucleotide
  Target: ATXN1; (-) strand; PAM type: YTN; PAM sequence: TTT
aagcagagaaaactcacagt

SEQ ID NO: 199910 - DNA, 20 bp, Artificial Sequence
  Description of Artificial Sequence: Synthetic oligonucleotide
  Target: ATXN1; (-) strand; PAM type: YTN; PAM sequence: CTT
taagcagagaaaactcacag

SEQ ID NO: 199911 - DNA, 20 bp, Artificial Sequence
  Description of Artificial Sequence: Synthetic oligonucleotide
  Target: ATXN1; (-) strand; PAM type: YTN; PAM sequence: TTG
tctttaagcagagaaaactc

SEQ ID NO: 199912 - DNA, 20 bp, Artificial Sequence
  Description of Artificial Sequence: Synthetic oligonucleotide
  Target: ATXN1; (-) strand; PAM type: YTN; PAM sequence: CTG
attgtctttaagcagagaaa

SEQ ID NO: 199913 - DNA, 20 bp, Artificial Sequence
  Description of Artificial Sequence: Synthetic oligonucleotide
  Target: ATXN1; (-) strand; PAM type: YTN; PAM sequence: TTC
tgattgtctttaagcagaga

SEQ ID NO: 199914 - DNA, 20 bp, Artificial Sequence
  Description of Artificial Sequence: Synthetic oligonucleotide
  Target: ATXN1; (-) strand; PAM type: YTN; PAM sequence: TTT
ctgattgtctttaagcagag

SEQ ID NO: 199915 - DNA, 20 bp, Artificial Sequence
  Description of Artificial Sequence: Synthetic oligonucleotide
  Target: ATXN1; (-) strand; PAM type: YTN; PAM sequence: TTG
gtttctgattgtctttaagc

SEQ ID NO: 199916 - DNA, 20 bp, Artificial Sequence
  Description of Artificial Sequence: Synthetic oligonucleotide
  Target: ATXN1; (-) strand; PAM type: YTN; PAM sequence: TTT
ggtttctgattgtctttaag

SEQ ID NO: 199917 - DNA, 20 bp, Artificial Sequence
  Description of Artificial Sequence: Synthetic oligonucleotide
  Target: ATXN1; (-) strand; PAM type: YTN; PAM sequence: TTT
tggtttctgattgtctttaa

SEQ ID NO: 199918 - DNA, 20 bp, Artificial Sequence
  Description of Artificial Sequence: Synthetic oligonucleotide
  Target: ATXN1; (-) strand; PAM type: YTN; PAM sequence: CTT
ttggtttctgattgtcttta

SEQ ID NO: 199919 - DNA, 20 bp, Artificial Sequence
  Description of Artificial Sequence: Synthetic oligonucleotide
  Target: ATXN1; (-) strand; PAM type: YTN; PAM sequence: CTA
taatagcttttggtttctga

SEQ ID NO: 199920 - DNA, 20 bp, Artificial Sequence
  Description of Artificial Sequence: Synthetic oligonucleotide
  Target: ATXN1; (-) strand; PAM type: YTN; PAM sequence: CTG
gaaggagaaagctataatag

SEQ ID NO: 199921 - DNA, 20 bp, Artificial Sequence
  Description of Artificial Sequence: Synthetic oligonucleotide
  Target: ATXN1; (-) strand; PAM type: YTN; PAM sequence: CTC
tggaaggagaaagctataat

SEQ ID NO: 199922 - DNA, 20 bp, Artificial Sequence
  Description of Artificial Sequence: Synthetic oligonucleotide
  Target: ATXN1; (-) strand; PAM type: YTN; PAM sequence: TTG
gatctctggaaggagaaagc

SEQ ID NO: 199923 - DNA, 20 bp, Artificial Sequence
  Description of Artificial Sequence: Synthetic oligonucleotide
  Target: ATXN1; (-) strand; PAM type: YTN; PAM sequence: CTT
ggatctctggaaggagaaag

SEQ ID NO: 199924 - DNA, 20 bp, Artificial Sequence
  Description of Artificial Sequence: Synthetic oligonucleotide
  Target: ATXN1; (-) strand; PAM type: YTN; PAM sequence: TTG
aggccccttggatctctgga

SEQ ID NO: 199925 - DNA, 20 bp, Artificial Sequence
  Description of Artificial Sequence: Synthetic oligonucleotide
  Target: ATXN1; (-) strand; PAM type: YTN; PAM sequence: TTT
gaggccccttggatctctgg

SEQ ID NO: 199926 - DNA, 20 bp, Artificial Sequence
  Description of Artificial Sequence: Synthetic oligonucleotide
  Target: ATXN1; (-) strand; PAM type: YTN; PAM sequence: TTT
tgaggccccttggatctctg

SEQ ID NO: 199927 - DNA, 20 bp, Artificial Sequence
  Description of Artificial Sequence: Synthetic oligonucleotide
  Target: ATXN1; (-) strand; PAM type: YTN; PAM sequence: TTT
ttgaggccccttggatctct

SEQ ID NO: 199928 - DNA, 20 bp, Artificial Sequence
  Description of Artificial Sequence: Synthetic oligonucleotide
  Target: ATXN1; (-) strand; PAM type: YTN; PAM sequence: TTT
tttgaggccccttggatctc

SEQ ID NO: 199929 - DNA, 20 bp, Artificial Sequence
  Description of Artificial Sequence: Synthetic oligonucleotide
  Target: ATXN1; (-) strand; PAM type: YTN; PAM sequence: TTA
agattttttgaggccccttg

SEQ ID NO: 199930 - DNA, 20 bp, Artificial Sequence
  Description of Artificial Sequence: Synthetic oligonucleotide
  Target: ATXN1; (-) strand; PAM type: YTN; PAM sequence: TTT
aagattttttgaggcccctt

SEQ ID NO: 199931 - DNA, 20 bp, Artificial Sequence
  Description of Artificial Sequence: Synthetic oligonucleotide
  Target: ATXN1; (-) strand; PAM type: YTN; PAM sequence: TTT
taagattttttgaggcccct

SEQ ID NO: 199932 - DNA, 20 bp, Artificial Sequence
  Description of Artificial Sequence: Synthetic oligonucleotide
  Target: ATXN1; (-) strand; PAM type: YTN; PAM sequence: CTA
ttttaagattttttgaggcc

SEQ ID NO: 199933 - DNA, 20 bp, Artificial Sequence
  Description of Artificial Sequence: Synthetic oligonucleotide
  Target: ATXN1; (-) strand; PAM type: YTN; PAM sequence: TTC
cctattttaagattttttga

SEQ ID NO: 199934 - DNA, 20 bp, Artificial Sequence
  Description of Artificial Sequence: Synthetic oligonucleotide
  Target: ATXN1; (-) strand; PAM type: YTN; PAM sequence: TTT
ccctattttaagattttttg

SEQ ID NO: 199935 - DNA, 20 bp, Artificial Sequence
  Description of Artificial Sequence: Synthetic oligonucleotide
  Target: ATXN1; (-) strand; PAM type: YTN; PAM sequence: CTT
tccctattttaagatttttt

SEQ ID NO: 199936 - DNA, 20 bp, Artificial Sequence
  Description of Artificial Sequence: Synthetic oligonucleotide
  Target: ATXN1; (-) strand; PAM type: YTN; PAM sequence: TTC
aaagctttccctattttaag

SEQ ID NO: 199937 - DNA, 20 bp, Artificial Sequence
  Description of Artificial Sequence: Synthetic oligonucleotide
  Target: ATXN1; (-) strand; PAM type: YTN; PAM sequence: TTT
caaagctttccctattttaa

SEQ ID NO: 199938 - DNA, 20 bp, Artificial Sequence
  Description of Artificial Sequence: Synthetic oligonucleotide
  Target: ATXN1; (-) strand; PAM type: YTN; PAM sequence: CTT
tcaaagctttccctatttta

SEQ ID NO: 199939 - DNA, 20 bp, Artificial Sequence
  Description of Artificial Sequence: Synthetic oligonucleotide
  Target: ATXN1; (-) strand; PAM type: YTN; PAM sequence: CTG
cctttcaaagctttccctat

SEQ ID NO: 199940 - DNA, 20 bp, Artificial Sequence
  Description of Artificial Sequence: Synthetic oligonucleotide
  Target: ATXN1; (-) strand; PAM type: YTN; PAM sequence: CTA
tactgcctttcaaagctttc

SEQ ID NO: 199941 - DNA, 20 bp, Artificial Sequence
  Description of Artificial Sequence: Synthetic oligonucleotide
  Target: ATXN1; (-) strand; PAM type: YTN; PAM sequence: TTG
cctatactgcctttcaaagc

SEQ ID NO: 199942 - DNA, 20 bp, Artificial Sequence
  Description of Artificial Sequence: Synthetic oligonucleotide
  Target: ATXN1; (-) strand; PAM type: YTN; PAM sequence: TTT
gcctatactgcctttcaaag

SEQ ID NO: 199943 - DNA, 20 bp, Artificial Sequence
  Description of Artificial Sequence: Synthetic oligonucleotide
  Target: ATXN1; (-) strand; PAM type: YTN; PAM sequence: CTT
tgcctatactgcctttcaaa

SEQ ID NO: 199944 - DNA, 20 bp, Artificial Sequence
  Description of Artificial Sequence: Synthetic oligonucleotide
  Target: ATXN1; (-) strand; PAM type: YTN; PAM sequence: TTA
ggctttgcctatactgcctt

SEQ ID NO: 199945 - DNA, 20 bp, Artificial Sequence
  Description of Artificial Sequence: Synthetic oligonucleotide
  Target: ATXN1; (-) strand; PAM type: YTN; PAM sequence: TTT
aggctttgcctatactgcct

SEQ ID NO: 199946 - DNA, 20 bp, Artificial Sequence
  Description of Artificial Sequence: Synthetic oligonucleotide
  Target: ATXN1; (-) strand; PAM type: YTN; PAM sequence: CTT
taggctttgcctatactgcc

SEQ ID NO: 199947 - DNA, 20 bp, Artificial Sequence
  Description of Artificial Sequence: Synthetic oligonucleotide
  Target: ATXN1; (-) strand; PAM type: YTN; PAM sequence: CTA
aatgctttaggctttgccta

SEQ ID NO: 199948 - DNA, 20 bp, Artificial Sequence
  Description of Artificial Sequence: Synthetic oligonucleotide
  Target: ATXN1; (-) strand; PAM type: YTN; PAM sequence: TTC
ccacccctaaatgctttagg

SEQ ID NO: 199949 - DNA, 20 bp, Artificial Sequence
  Description of Artificial Sequence: Synthetic oligonucleotide
  Target: ATXN1; (-) strand; PAM type: YTN; PAM sequence: CTG
ttcccacccctaaatgcttt

SEQ ID NO: 199950 - DNA, 20 bp, Artificial Sequence
  Description of Artificial Sequence: Synthetic oligonucleotide
  Target: ATXN1; (-) strand; PAM type: YTN; PAM sequence: TTA
tgtacaaagggataactgtt

SEQ ID NO: 199951 - DNA, 20 bp, Artificial Sequence
  Description of Artificial Sequence: Synthetic oligonucleotide
  Target: ATXN1; (-) strand; PAM type: YTN; PAM sequence: TTT
atgtacaaagggataactgt

SEQ ID NO: 199952 - DNA, 20 bp, Artificial Sequence
  Description of Artificial Sequence: Synthetic oligonucleotide
  Target: ATXN1; (-) strand; PAM type: YTN; PAM sequence: TTC
aaagatgtttatgtacaaag

SEQ ID NO: 199953 - DNA, 20 bp, Artificial Sequence
  Description of Artificial Sequence: Synthetic oligonucleotide
  Target: ATXN1; (-) strand; PAM type: YTN; PAM sequence: CTT
caaagatgtttatgtacaaa

SEQ ID NO: 199954 - DNA, 20 bp, Artificial Sequence
  Description of Artificial Sequence: Synthetic oligonucleotide
  Target: ATXN1; (-) strand; PAM type: YTN; PAM sequence: CTG
tccttcaaagatgtttatgt

SEQ ID NO: 199955 - DNA, 20 bp, Artificial Sequence
  Description of Artificial Sequence: Synthetic oligonucleotide
  Target: ATXN1; (-) strand; PAM type: YTN; PAM sequence: CTG
ccctgtccttcaaagatgtt

SEQ ID NO: 199956 - DNA, 20 bp, Artificial Sequence
  Description of Artificial Sequence: Synthetic oligonucleotide
  Target: ATXN1; (-) strand; PAM type: YTN; PAM sequence: CTC
acagtgctgccctgtccttc

SEQ ID NO: 199957 - DNA, 20 bp, Artificial Sequence
  Description of Artificial Sequence: Synthetic oligonucleotide
  Target: ATXN1; (-) strand; PAM type: YTN; PAM sequence: CTC
catgaaaatggagactcaca

SEQ ID NO: 199958 - DNA, 20 bp, Artificial Sequence
  Description of Artificial Sequence: Synthetic oligonucleotide
  Target: ATXN1; (-) strand; PAM type: YTN; PAM sequence: CTA
gcactccatgaaaatggaga

SEQ ID NO: 199959 - DNA, 20 bp, Artificial Sequence
  Description of Artificial Sequence: Synthetic oligonucleotide
  Target: ATXN1; (-) strand; PAM type: YTN; PAM sequence: CTA
gcctagcactccatgaaaat

SEQ ID NO: 199960 - DNA, 20 bp, Artificial Sequence
  Description of Artificial Sequence: Synthetic oligonucleotide
  Target: ATXN1; (-) strand; PAM type: YTN; PAM sequence: TTA
aaatatgctagcctagcact

SEQ ID NO: 199961 - DNA, 20 bp, Artificial Sequence
  Description of Artificial Sequence: Synthetic oligonucleotide
  Target: ATXN1; (-) strand; PAM type: YTN; PAM sequence: TTT
aaaatatgctagcctagcac

SEQ ID NO: 199962 - DNA, 20 bp, Artificial Sequence
  Description of Artificial Sequence: Synthetic oligonucleotide
  Target: ATXN1; (-) strand; PAM type: YTN; PAM sequence: CTT
taaaatatgctagcctagca

SEQ ID NO: 199963 - DNA, 20 bp, Artificial Sequence
  Description of Artificial Sequence: Synthetic oligonucleotide
  Target: ATXN1; (-) strand; PAM type: YTN; PAM sequence: TTC
tttaaaatatgctagcctag

SEQ ID NO: 199964 - DNA, 20 bp, Artificial Sequence
  Description of Artificial Sequence: Synthetic oligonucleotide
  Target: ATXN1; (-) strand; PAM type: YTN; PAM sequence: CTT
ctttaaaatatgctagccta

SEQ ID NO: 199965 - DNA, 20 bp, Artificial Sequence
  Description of Artificial Sequence: Synthetic oligonucleotide
  Target: ATXN1; (-) strand; PAM type: YTN; PAM sequence: TTC
ttctttaaaatatgctagcc

SEQ ID NO: 199966 - DNA, 20 bp, Artificial Sequence
  Description of Artificial Sequence: Synthetic oligonucleotide
  Target: ATXN1; (-) strand; PAM type: YTN; PAM sequence: CTT
cttctttaaaatatgctagc

SEQ ID NO: 199967 - DNA, 20 bp, Artificial Sequence
  Description of Artificial Sequence: Synthetic oligonucleotide
  Target: ATXN1; (-) strand; PAM type: YTN; PAM sequence: CTG
tgtcataaaagatatcttct

SEQ ID NO: 199968 - DNA, 20 bp, Artificial Sequence
  Description of Artificial Sequence: Synthetic oligonucleotide
  Target: ATXN1; (-) strand; PAM type: YTN; PAM sequence: TTA
tggtgcaagtatctgtgtca

SEQ ID NO: 199969 - DNA, 20 bp, Artificial Sequence
  Description of Artificial Sequence: Synthetic oligonucleotide
  Target: ATXN1; (-) strand; PAM type: YTN; PAM sequence: TTT
atggtgcaagtatctgtgtc

SEQ ID NO: 199970 - DNA, 20 bp, Artificial Sequence
  Description of Artificial Sequence: Synthetic oligonucleotide
  Target: ATXN1; (-) strand; PAM type: YTN; PAM sequence: TTA
caatttatggtgcaagtatc

SEQ ID NO: 199971 - DNA, 20 bp, Artificial Sequence
  Description of Artificial Sequence: Synthetic oligonucleotide
  Target: ATXN1; (-) strand; PAM type: YTN; PAM sequence: CTT
acaatttatggtgcaagtat

SEQ ID NO: 199972 - DNA, 20 bp, Artificial Sequence
  Description of Artificial Sequence: Synthetic oligonucleotide
  Target: ATXN1; (-) strand; PAM type: YTN; PAM sequence: CTA
cttacaatttatggtgcaag

SEQ ID NO: 199973 - DNA, 20 bp, Artificial Sequence
  Description of Artificial Sequence: Synthetic oligonucleotide
  Target: ATXN1; (-) strand; PAM type: YTN; PAM sequence: CTA
atctacttacaatttatggt

SEQ ID NO: 199974 - DNA, 20 bp, Artificial Sequence
  Description of Artificial Sequence: Synthetic oligonucleotide
  Target: ATXN1; (-) strand; PAM type: YTN; PAM sequence: TTG
tggcatagacatatcctaat

SEQ ID NO: 199975 - DNA, 20 bp, Artificial Sequence
  Description of Artificial Sequence: Synthetic oligonucleotide
  Target: ATXN1; (-) strand; PAM type: YTN; PAM sequence: TTG
tgtgttgtggcatagacata

SEQ ID NO: 199976 - DNA, 20 bp, Artificial Sequence
  Description of Artificial Sequence: Synthetic oligonucleotide
  Target: ATXN1; (-) strand; PAM type: YTN; PAM sequence: TTA
aacgattgtgtgttgtggca

SEQ ID NO: 199977 - DNA, 20 bp, Artificial Sequence
  Description of Artificial Sequence: Synthetic oligonucleotide
  Target: ATXN1; (-) strand; PAM type: YTN; PAM sequence: CTT
aaacgattgtgtgttgtggc

SEQ ID NO: 199978 - DNA, 20 bp, Artificial Sequence
  Description of Artificial Sequence: Synthetic oligonucleotide
  Target: ATXN1; (-) strand; PAM type: YTN; PAM sequence: TTA
catcatcttaaacgattgtg

SEQ ID NO: 199979 - DNA, 20 bp, Artificial Sequence
  Description of Artificial Sequence: Synthetic oligonucleotide
  Target: ATXN1; (-) strand; PAM type: YTN; PAM sequence: CTC
gattacatcatcttaaacga

SEQ ID NO: 199980 - DNA, 20 bp, Artificial Sequence
  Description of Artificial Sequence: Synthetic oligonucleotide
  Target: ATXN1; (-) strand; PAM type: YTN; PAM sequence: TTG
tccctcgattacatcatctt

SEQ ID NO: 199981 - DNA, 20 bp, Artificial Sequence
  Description of Artificial Sequence: Synthetic oligonucleotide
  Target: ATXN1; (-) strand; PAM type: YTN; PAM sequence: TTT
gtccctcgattacatcatct

SEQ ID NO: 199982 - DNA, 20 bp, Artificial Sequence
  Description of Artificial Sequence: Synthetic oligonucleotide
  Target: ATXN1; (-) strand; PAM type: YTN; PAM sequence: TTT
tgtccctcgattacatcatc

SEQ ID NO: 199983 - DNA, 20 bp, Artificial Sequence
  Description of Artificial Sequence: Synthetic oligonucleotide
  Target: ATXN1; (-) strand; PAM type: YTN; PAM sequence: TTT
ttgtccctcgattacatcat

SEQ ID NO: 199984 - DNA, 20 bp, Artificial Sequence
  Description of Artificial Sequence: Synthetic oligonucleotide
  Target: ATXN1; (-) strand; PAM type: YTN; PAM sequence: TTA
tttttgtccctcgattacat

SEQ ID NO: 199985 - DNA, 20 bp, Artificial Sequence
  Description of Artificial Sequence: Synthetic oligonucleotide
  Target: ATXN1; (-) strand; PAM type: YTN; PAM sequence: TTA
gcccccaaattatttttgtc

SEQ ID NO: 199986 - DNA, 20 bp, Artificial Sequence
  Description of Artificial Sequence: Synthetic oligonucleotide
  Target: ATXN1; (-) strand; PAM type: YTN; PAM sequence: TTT
agcccccaaattatttttgt

SEQ ID NO: 199987 - DNA, 20 bp, Artificial Sequence
  Description of Artificial Sequence: Synthetic oligonucleotide
  Target: ATXN1; (-) strand; PAM type: YTN; PAM sequence: TTT
tagcccccaaattatttttg

SEQ ID NO: 199988 - DNA, 20 bp, Artificial Sequence
  Description of Artificial Sequence: Synthetic oligonucleotide
  Target: ATXN1; (-) strand; PAM type: YTN; PAM sequence: TTG
atcattttagcccccaaatt

SEQ ID NO: 199989 - DNA, 20 bp, Artificial Sequence
  Description of Artificial Sequence: Synthetic oligonucleotide
  Target: ATXN1; (-) strand; PAM type: YTN; PAM sequence: TTG
tgtggagttgatcattttag

SEQ ID NO: 199990 - DNA, 20 bp, Artificial Sequence
  Description of Artificial Sequence: Synthetic oligonucleotide
  Target: ATXN1; (-) strand; PAM type: YTN; PAM sequence: CTT
gtgtggagttgatcatttta

SEQ ID NO: 199991 - DNA, 20 bp, Artificial Sequence
  Description of Artificial Sequence: Synthetic oligonucleotide
  Target: ATXN1; (-) strand; PAM type: YTN; PAM sequence: TTC
ttgtgtggagttgatcattt

SEQ ID NO: 199992 - DNA, 20 bp, Artificial Sequence
  Description of Artificial Sequence: Synthetic oligonucleotide
  Target: ATXN1; (-) strand; PAM type: YTN; PAM sequence: TTA
ttcttgtgtggagttgatca

SEQ ID NO: 199993 - DNA, 20 bp, Artificial Sequence
  Description of Artificial Sequence: Synthetic oligonucleotide
  Target: ATXN1; (-) strand; PAM type: YTN; PAM sequence: TTA
gtagattattcttgtgtgga

SEQ ID NO: 199994 - DNA, 20 bp, Artificial Sequence
  Description of Artificial Sequence: Synthetic oligonucleotide
  Target: ATXN1; (-) strand; PAM type: YTN; PAM sequence: TTA
taccattagtagattattct

SEQ ID NO: 199995 - DNA, 20 bp, Artificial Sequence
  Description of Artificial Sequence: Synthetic oligonucleotide
  Target: ATXN1; (-) strand; PAM type: YTN; PAM sequence: TTG
ttataccattagtagattat

SEQ ID NO: 199996 - DNA, 20 bp, Artificial Sequence
  Description of Artificial Sequence: Synthetic oligonucleotide
  Target: ATXN1; (-) strand; PAM type: YTN; PAM sequence: CTT
gttataccattagtagatta

SEQ ID NO: 199997 - DNA, 20 bp, Artificial Sequence
  Description of Artificial Sequence: Synthetic oligonucleotide
  Target: ATXN1; (-) strand; PAM type: YTN; PAM sequence: TTC
catgaatcacttgttatacc

SEQ ID NO: 199998 - DNA, 20 bp, Artificial Sequence
  Description of Artificial Sequence: Synthetic oligonucleotide
  Target: ATXN1; (-) strand; PAM type: YTN; PAM sequence: TTT
ccatgaatcacttgttatac

SEQ ID NO: 199999 - DNA, 20 bp, Artificial Sequence
  Description of Artificial Sequence: Synthetic oligonucleotide
  Target: ATXN1; (-) strand; PAM type: YTN; PAM sequence: TTT
tccatgaatcacttgttata

SEQ ID NO: 200000 - DNA, 20 bp, Artificial Sequence
  Description of Artificial Sequence: Synthetic oligonucleotide
  Target: ATXN1; (-) strand; PAM type: YTN; PAM sequence: CTT
ttccatgaatcacttgttat

SEQ ID NO: 200001 - DNA, 20 bp, Artificial Sequence
  Description of Artificial Sequence: Synthetic oligonucleotide
  Target: ATXN1; (-) strand; PAM type: YTN; PAM sequence: TTG
ccaggatcatcttttccatg

SEQ ID NO: 200002 - DNA, 20 bp, Artificial Sequence
  Description of Artificial Sequence: Synthetic oligonucleotide
  Target: ATXN1; (-) strand; PAM type: YTN; PAM sequence: TTT
gccaggatcatcttttccat

SEQ ID NO: 200003 - DNA, 20 bp, Artificial Sequence
  Description of Artificial Sequence: Synthetic oligonucleotide
  Target: ATXN1; (-) strand; PAM type: YTN; PAM sequence: TTT
tgccaggatcatcttttcca

SEQ ID NO: 200004 - DNA, 20 bp, Artificial Sequence
  Description of Artificial Sequence: Synthetic oligonucleotide
  Target: ATXN1; (-) strand; PAM type: YTN; PAM sequence: TTG
ttttgccaggatcatctttt

SEQ ID NO: 200005 - DNA, 20 bp, Artificial Sequence
  Description of Artificial Sequence: Synthetic oligonucleotide
  Target: ATXN1; (-) strand; PAM type: YTN; PAM sequence: TTA
ttgttttgccaggatcatct

SEQ ID NO: 200006 - DNA, 20 bp, Artificial Sequence
  Description of Artificial Sequence: Synthetic oligonucleotide
  Target: ATXN1; (-) strand; PAM type: YTN; PAM sequence: TTG
aacaaaagttattgttttgc

SEQ ID NO: 200007 - DNA, 20 bp, Artificial Sequence
  Description of Artificial Sequence: Synthetic oligonucleotide
  Target: ATXN1; (-) strand; PAM type: YTN; PAM sequence: CTT
gaacaaaagttattgttttg

SEQ ID NO: 200008 - DNA, 20 bp, Artificial Sequence
  Description of Artificial Sequence: Synthetic oligonucleotide
  Target: ATXN1; (-) strand; PAM type: YTN; PAM sequence: TTG
atggccttgaacaaaagtta

SEQ ID NO: 200009 - DNA, 20 bp, Artificial Sequence
  Description of Artificial Sequence: Synthetic oligonucleotide
  Target: ATXN1; (-) strand; PAM type: YTN; PAM sequence: CTT
gatggccttgaacaaaagtt

SEQ ID NO: 200010 - DNA, 20 bp, Artificial Sequence
  Description of Artificial Sequence: Synthetic oligonucleotide
  Target: ATXN1; (-) strand; PAM type: YTN; PAM sequence: CTC
ttgatggccttgaacaaaag

SEQ ID NO: 200011 - DNA, 20 bp, Artificial Sequence
  Description of Artificial Sequence: Synthetic oligonucleotide
  Target: ATXN1; (-) strand; PAM type: YTN; PAM sequence: TTA
gggaaaacctcttgatggcc

SEQ ID NO: 200012 - DNA, 20 bp, Artificial Sequence
  Description of Artificial Sequence: Synthetic oligonucleotide
  Target: ATXN1; (-) strand; PAM type: YTN; PAM sequence: TTT
agggaaaacctcttgatggc

SEQ ID NO: 200013 - DNA, 20 bp, Artificial Sequence
  Description of Artificial Sequence: Synthetic oligonucleotide
  Target: ATXN1; (-) strand; PAM type: YTN; PAM sequence: TTT
tagggaaaacctcttgatgg

SEQ ID NO: 200014 - DNA, 20 bp, Artificial Sequence
  Description of Artificial Sequence: Synthetic oligonucleotide
  Target: ATXN1; (-) strand; PAM type: YTN; PAM sequence: TTT
ttagggaaaacctcttgatg

SEQ ID NO: 200015 - DNA, 20 bp, Artificial Sequence
  Description of Artificial Sequence: Synthetic oligonucleotide
  Target: ATXN1; (-) strand; PAM type: YTN; PAM sequence: CTA
aacgcatagtagatttttag

SEQ ID NO: 200016 - DNA, 20 bp, Artificial Sequence
  Description of Artificial Sequence: Synthetic oligonucleotide
  Target: ATXN1; (-) strand; PAM type: YTN; PAM sequence: TTA
gcacagggctaaacgcatag

SEQ ID NO: 200017 - DNA, 20 bp, Artificial Sequence
  Description of Artificial Sequence: Synthetic oligonucleotide
  Target: ATXN1; (-) strand; PAM type: YTN; PAM sequence: CTT
agcacagggctaaacgcata

SEQ ID NO: 200018 - DNA, 20 bp, Artificial Sequence
  Description of Artificial Sequence: Synthetic oligonucleotide
  Target: ATXN1; (-) strand; PAM type: YTN; PAM sequence: TTC
cacaaatcttagcacagggc

SEQ ID NO: 200019 - DNA, 20 bp, Artificial Sequence
  Description of Artificial Sequence: Synthetic oligonucleotide
  Target: ATXN1; (-) strand; PAM type: YTN; PAM sequence: TTT
ccacaaatcttagcacaggg

SEQ ID NO: 200020 - DNA, 20 bp, Artificial Sequence
  Description of Artificial Sequence: Synthetic oligonucleotide
  Target: ATXN1; (-) strand; PAM type: YTN; PAM sequence: TTT
tccacaaatcttagcacagg

SEQ ID NO: 200021 - DNA, 20 bp, Artificial Sequence
  Description of Artificial Sequence: Synthetic oligonucleotide
  Target: ATXN1; (-) strand; PAM type: YTN; PAM sequence: TTC
catattttccacaaatctta

SEQ ID NO: 200022 - DNA, 20 bp, Artificial Sequence
  Description of Artificial Sequence: Synthetic oligonucleotide
  Target: ATXN1; (-) strand; PAM type: YTN; PAM sequence: CTT
ccatattttccacaaatctt

SEQ ID NO: 200023 - DNA, 20 bp, Artificial Sequence
  Description of Artificial Sequence: Synthetic oligonucleotide
  Target: ATXN1; (-) strand; PAM type: YTN; PAM sequence: TTC
ttccatattttccacaaatc

SEQ ID NO: 200024 - DNA, 20 bp, Artificial Sequence
  Description of Artificial Sequence: Synthetic oligonucleotide
  Target: ATXN1; (-) strand; PAM type: YTN; PAM sequence: TTT
cttccatattttccacaaat

SEQ ID NO: 200025 - DNA, 20 bp, Artificial Sequence
  Description of Artificial Sequence: Synthetic oligonucleotide
  Target: ATXN1; (-) strand; PAM type: YTN; PAM sequence: CTG
gcccagggtaatgatttctt

SEQ ID NO: 200026 - DNA, 20 bp, Artificial Sequence
  Description of Artificial Sequence: Synthetic oligonucleotide
  Target: ATXN1; (-) strand; PAM type: YTN; PAM sequence: CTC
tggcccagggtaatgatttc

SEQ ID NO: 200027 - DNA, 20 bp, Artificial Sequence
  Description of Artificial Sequence: Synthetic oligonucleotide
  Target: ATXN1; (-) strand; PAM type: YTN; PAM sequence: TTG
gggaggaaatgagctctggc

SEQ ID NO: 200028 - DNA, 20 bp, Artificial Sequence
  Description of Artificial Sequence: Synthetic oligonucleotide
  Target: ATXN1; (-) strand; PAM type: YTN; PAM sequence: TTA
gagattggggaggaaatgag

SEQ ID NO: 200029 - DNA, 20 bp, Artificial Sequence
  Description of Artificial Sequence: Synthetic oligonucleotide
  Target: ATXN1; (-) strand; PAM type: YTN; PAM sequence: TTT
agagattggggaggaaatga

SEQ ID NO: 200030 - DNA, 20 bp, Artificial Sequence
  Description of Artificial Sequence: Synthetic oligonucleotide
  Target: ATXN1; (-) strand; PAM type: YTN; PAM sequence: CTC
gggtgggtttagagattggg

SEQ ID NO: 200031 - DNA, 20 bp, Artificial Sequence
  Description of Artificial Sequence: Synthetic oligonucleotide
  Target: ATXN1; (-) strand; PAM type: YTN; PAM sequence: CTC
tcgggtgggtttagagattg

SEQ ID NO: 200032 - DNA, 20 bp, Artificial Sequence
  Description of Artificial Sequence: Synthetic oligonucleotide
  Target: ATXN1; (-) strand; PAM type: YTN; PAM sequence: TTG
gaaatgtgacagtaatgtct

SEQ ID NO: 200033 - DNA, 20 bp, Artificial Sequence
  Description of Artificial Sequence: Synthetic oligonucleotide
  Target: ATXN1; (-) strand; PAM type: YTN; PAM sequence: TTT
ggaaatgtgacagtaatgtc

SEQ ID NO: 200034 - DNA, 20 bp, Artificial Sequence
  Description of Artificial Sequence: Synthetic oligonucleotide
  Target: ATXN1; (-) strand; PAM type: YTN; PAM sequence: TTT
tggaaatgtgacagtaatgt

SEQ ID NO: 200035 - DNA, 20 bp, Artificial Sequence
  Description of Artificial Sequence: Synthetic oligonucleotide
  Target: ATXN1; (-) strand; PAM type: YTN; PAM sequence: TTG
cattttggaaatgtgacagt

SEQ ID NO: 200036 - DNA, 20 bp, Artificial Sequence
  Description of Artificial Sequence: Synthetic oligonucleotide
  Target: ATXN1; (-) strand; PAM type: YTN; PAM sequence: TTT
gcattttggaaatgtgacag

SEQ ID NO: 200037 - DNA, 20 bp, Artificial Sequence
  Description of Artificial Sequence: Synthetic oligonucleotide
  Target: ATXN1; (-) strand; PAM type: YTN; PAM sequence: TTC
atttgcattttggaaatgtg

SEQ ID NO: 200038 - DNA, 20 bp, Artificial Sequence
  Description of Artificial Sequence: Synthetic oligonucleotide
  Target: ATXN1; (-) strand; PAM type: YTN; PAM sequence: TTT
catttgcattttggaaatgt

SEQ ID NO: 200039 - DNA, 20 bp, Artificial Sequence
  Description of Artificial Sequence: Synthetic oligonucleotide
  Target: ATXN1; (-) strand; PAM type: YTN; PAM sequence: CTG
tagacatgagggacagcatt

SEQ ID NO: 200040 - DNA, 20 bp, Artificial Sequence
  Description of Artificial Sequence: Synthetic oligonucleotide
  Target: ATXN1; (-) strand; PAM type: YTN; PAM sequence: CTC
aaaaaataaaaaagctgtag

SEQ ID NO: 200041 - DNA, 20 bp, Artificial Sequence
  Description of Artificial Sequence: Synthetic oligonucleotide
  Target: ATXN1; (-) strand; PAM type: YTN; PAM sequence: CTC
catctcaaaaaataaaaaag

SEQ ID NO: 200042 - DNA, 20 bp, Artificial Sequence
  Description of Artificial Sequence: Synthetic oligonucleotide
  Target: ATXN1; (-) strand; PAM type: YTN; PAM sequence: CTG
ggcgacaagaaccaaactcc

SEQ ID NO: 200043 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacaagaacc

SEQ ID NO: 200044 - DNA, 20 bp, Artificial Sequence
  Description of Artificial Sequence: Synthetic oligonucleotide
  Target: ATXN1; (-) strand; PAM type: YTN; PAM sequence: TTG
cactccagcctgggcgacaa

SEQ ID NO: 200045 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagaccgcacc

SEQ ID NO: 200046 - DNA, 20 bp, Artificial Sequence
  Description of Artificial Sequence: Synthetic oligonucleotide
  Target: ATXN1; (-) strand; PAM type: YTN; PAM sequence: CTG
gaggttgcagtgagccaaga

SEQ ID NO: 200047 - DNA, 20 bp, Artificial Sequence
  Description of Artificial Sequence: Synthetic oligonucleotide
  Target: ATXN1; (-) strand; PAM type: YTN; PAM sequence: CTG
ggagctggaggttgcagtga

SEQ ID NO: 200048 - DNA, 20 bp, Artificial Sequence
  Description of Artificial Sequence: Synthetic oligonucleotide
  Target: ATXN1; (-) strand; PAM type: YTN; PAM sequence: TTG
aatctgggagctggaggttg

SEQ ID NO: 200049 - DNA, 20 bp, Artificial Sequence
  Description of Artificial Sequence: Synthetic oligonucleotide
  Target: ATXN1; (-) strand; PAM type: YTN; PAM sequence: CTT
gaatctgggagctggaggtt

SEQ ID NO: 200050 - DNA, 20 bp, Artificial Sequence
  Description of Artificial Sequence: Synthetic oligonucleotide
  Target: ATXN1; (-) strand; PAM type: YTN; PAM sequence: TTG
cttgaatctgggagctggag

SEQ ID NO: 200051 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaattgcttgaa

SEQ ID NO: 200052 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcaggagaa

SEQ ID NO: 200053 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagga

SEQ ID NO: 200054 - DNA, 20 bp, Artificial Sequence
  Description of Artificial Sequence: Synthetic oligonucleotide
  Target: ATXN1; (-) strand; PAM type: YTN; PAM sequence: CTC
agctactcaggaggctgagg

SEQ ID NO: 200055 - DNA, 20 bp, Artificial Sequence
  Description of Artificial Sequence: Synthetic oligonucleotide
  Target: ATXN1; (-) strand; PAM type: YTN; PAM sequence: CTG
taatctcagctactcaggag

SEQ ID NO: 200056 - DNA, 20 bp, Artificial Sequence
  Description of Artificial Sequence: Synthetic oligonucleotide
  Target: ATXN1; (-) strand; PAM type: YTN; PAM sequence: TTA
gccgggcgtggtggcgggcg

SEQ ID NO: 200057 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaaattagcc

SEQ ID NO: 200058 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaaatta

SEQ ID NO: 200059 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaaat

SEQ ID NO: 200060 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaacccca

SEQ ID NO: 200061 - DNA, 20 bp, Artificial Sequence
  Description of Artificial Sequence: Synthetic oligonucleotide
  Target: ATXN1; (-) strand; PAM type: YTN; PAM sequence: CTA
gcctggccaacatggtgaaa

SEQ ID NO: 200062 - DNA, 20 bp, Artificial Sequence
  Description of Artificial Sequence: Synthetic oligonucleotide
  Target: ATXN1; (-) strand; PAM type: YTN; PAM sequence: TTC
gagactagcctggccaacat

SEQ ID NO: 200063 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacta

SEQ ID NO: 200064 - DNA, 20 bp, Artificial Sequence
  Description of Artificial Sequence: Synthetic oligonucleotide
  Target: ATXN1; (-) strand; PAM type: YTN; PAM sequence: CTG
aggtgggtgcatcacctgag

SEQ ID NO: 200065 - DNA, 20 bp, Artificial Sequence
  Description of Artificial Sequence: Synthetic oligonucleotide
  Target: ATXN1; (-) strand; PAM type: YTN; PAM sequence: TTG
ggacgctgaggtgggtgcat

SEQ ID NO: 200066 - DNA, 20 bp, Artificial Sequence
  Description of Artificial Sequence: Synthetic oligonucleotide
  Target: ATXN1; (-) strand; PAM type: YTN; PAM sequence: TTT
gggacgctgaggtgggtgca

SEQ ID NO: 200067 - DNA, 20 bp, Artificial Sequence
  Description of Artificial Sequence: Synthetic oligonucleotide
  Target: ATXN1; (-) strand; PAM type: YTN; PAM sequence: CTT
tgggacgctgaggtgggtgc

SEQ ID NO: 200068 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggac

SEQ ID NO: 200069 - DNA, 20 bp, Artificial Sequence
  Description of Artificial Sequence: Synthetic oligonucleotide
  Target: ATXN1; (-) strand; PAM type: YTN; PAM sequence: TTA
gccgggcgtggtggcatgtg

SEQ ID NO: 200070 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaaattagcc

SEQ ID NO: 200071 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaaatta

SEQ ID NO: 200072 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaaat

SEQ ID NO: 200073 - DNA, 20 bp, Artificial Sequence
  Description of Artificial Sequence: Synthetic oligonucleotide
  Target: ATXN1; (-) strand; PAM type: YTN; PAM sequence: CTA
tctctactaaaaatacaaaa

SEQ ID NO: 200074 - DNA, 20 bp, Artificial Sequence
  Description of Artificial Sequence: Synthetic oligonucleotide
  Target: ATXN1; (-) strand; PAM type: YTN; PAM sequence: CTA
gccaacatggtgaaacccta

SEQ ID NO: 200075 - DNA, 20 bp, Artificial Sequence
  Description of Artificial Sequence: Synthetic oligonucleotide
  Target: ATXN1; (-) strand; PAM type: YTN; PAM sequence: TTC
gagaccagcctagccaacat

SEQ ID NO: 200076 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttcgagacca

SEQ ID NO: 200077 - DNA, 20 bp, Artificial Sequence
  Description of Artificial Sequence: Synthetic oligonucleotide
  Target: ATXN1; (-) strand; PAM type: YTN; PAM sequence: CTG
aggcgggtgcatcacctgag

SEQ ID NO: 200078 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcgggtgcat

SEQ ID NO: 200079 - DNA, 20 bp, Artificial Sequence
  Description of Artificial Sequence: Synthetic oligonucleotide
  Target: ATXN1; (-) strand; PAM type: YTN; PAM sequence: TTT
gggaggctgaggcgggtgca

SEQ ID NO: 200080 - DNA, 20 bp, Artificial Sequence
  Description of Artificial Sequence: Synthetic oligonucleotide
  Target: ATXN1; (-) strand; PAM type: YTN; PAM sequence: CTT
tgggaggctgaggcgggtgc

SEQ ID NO: 200081 - DNA, 20 bp, Artificial Sequence
  Description of Artificial Sequence: Synthetic oligonucleotide
  Target: ATXN1; (-) strand; PAM type: YTN; PAM sequence: CTC
agcactttgggaggctgagg

SEQ ID NO: 200082 - DNA, 20 bp, Artificial Sequence
  Description of Artificial Sequence: Synthetic oligonucleotide
  Target: ATXN1; (-) strand; PAM type: YTN; PAM sequence: TTG
taatctcagcactttgggag

SEQ ID NO: 200083 - DNA, 20 bp, Artificial Sequence
  Description of Artificial Sequence: Synthetic oligonucleotide
  Target: ATXN1; (-) strand; PAM type: YTN; PAM sequence: CTT
gtaatctcagcactttggga

SEQ ID NO: 200084 - DNA, 20 bp, Artificial Sequence
  Description of Artificial Sequence: Synthetic oligonucleotide
  Target: ATXN1; (-) strand; PAM type: YTN; PAM sequence: CTC
atgcttgtaatctcagcact

SEQ ID NO: 200085 - DNA, 20 bp, Artificial Sequence
  Description of Artificial Sequence: Synthetic oligonucleotide
  Target: ATXN1; (-) strand; PAM type: YTN; PAM sequence: CTG
tagacatggccaggcatagt

SEQ ID NO: 200086 - DNA, 20 bp, Artificial Sequence
  Description of Artificial Sequence: Synthetic oligonucleotide
  Target: ATXN1; (-) strand; PAM type: YTN; PAM sequence: TTA
aaggctgtagacatggccag

SEQ ID NO: 200087 - DNA, 20 bp, Artificial Sequence
  Description of Artificial Sequence: Synthetic oligonucleotide
  Target: ATXN1; (-) strand; PAM type: YTN; PAM sequence: CTA
tagtcacgatgatggagagt

SEQ ID NO: 200088 - DNA, 20 bp, Artificial Sequence
  Description of Artificial Sequence: Synthetic oligonucleotide
  Target: ATXN1; (-) strand; PAM type: YTN; PAM sequence: TTC
agactatagtcacgatgatg

SEQ ID NO: 200089 - DNA, 20 bp, Artificial Sequence
  Description of Artificial Sequence: Synthetic oligonucleotide
  Target: ATXN1; (-) strand; PAM type: YTN; PAM sequence: CTG
ttcagactatagtcacgatg

SEQ ID NO: 200090 - DNA, 20 bp, Artificial Sequence
  Description of Artificial Sequence: Synthetic oligonucleotide
  Target: ATXN1; (-) strand; PAM type: YTN; PAM sequence: CTC
gtgtatcctgttcagactat

SEQ ID NO: 200091 - DNA, 20 bp, Artificial Sequence
  Description of Artificial Sequence: Synthetic oligonucleotide
  Target: ATXN1; (-) strand; PAM type: YTN; PAM sequence: TTG
agtggggactcgtgtatcct

SEQ ID NO: 200092 - DNA, 20 bp, Artificial Sequence
  Description of Artificial Sequence: Synthetic oligonucleotide
  Target: ATXN1; (-) strand; PAM type: YTN; PAM sequence: TTG
agacaggacagatgagccag

SEQ ID NO: 200093 - DNA, 20 bp, Artificial Sequence
  Description of Artificial Sequence: Synthetic oligonucleotide
  Target: ATXN1; (-) strand; PAM type: YTN; PAM sequence: CTC
attgagacaggacagatgag

SEQ ID NO: 200094 - DNA, 20 bp, Artificial Sequence
  Description of Artificial Sequence: Synthetic oligonucleotide
  Target: ATXN1; (-) strand; PAM type: YTN; PAM sequence: TTC
actcattgagacaggacaga

SEQ ID NO: 200095 - DNA, 20 bp, Artificial Sequence
  Description of Artificial Sequence: Synthetic oligonucleotide
  Target: ATXN1; (-) strand; PAM type: YTN; PAM sequence: TTT
cactcattgagacaggacag

SEQ ID NO: 200096 - DNA, 20 bp, Artificial Sequence
  Description of Artificial Sequence: Synthetic oligonucleotide
  Target: ATXN1; (-) strand; PAM type: YTN; PAM sequence: CTC
agtcccagggtatgagatgg

SEQ ID NO: 200097 - DNA, 20 bp, Artificial Sequence
  Description of Artificial Sequence: Synthetic oligonucleotide
  Target: ATXN1; (-) strand; PAM type: YTN; PAM sequence: CTG
tagtagagcatggctcagtc

SEQ ID NO: 200098 - DNA, 20 bp, Artificial Sequence
  Description of Artificial Sequence: Synthetic oligonucleotide
  Target: ATXN1; (-) strand; PAM type: YTN; PAM sequence: TTG
aaacccagggaactgtagta

SEQ ID NO: 200099 - DNA, 20 bp, Artificial Sequence
  Description of Artificial Sequence: Synthetic oligonucleotide
  Target: ATXN1; (-) strand; PAM type: YTN; PAM sequence: TTT
gaaacccagggaactgtagt

SEQ ID NO: 200100 - DNA, 20 bp, Artificial Sequence
  Description of Artificial Sequence: Synthetic oligonucleotide
  Target: ATXN1; (-) strand; PAM type: YTN; PAM sequence: CTT
tgaaacccagggaactgtag

SEQ ID NO: 200101 - DNA, 20 bp, Artificial Sequence
  Description of Artificial Sequence: Synthetic oligonucleotide
  Target: ATXN1; (-) strand; PAM type: YTN; PAM sequence: TTC
aaaggcatgggtgtggagga

SEQ ID NO: 200102 - DNA, 20 bp, Artificial Sequence
  Description of Artificial Sequence: Synthetic oligonucleotide
  Target: ATXN1; (-) strand; PAM type: YTN; PAM sequence: TTT
caaaggcatgggtgtggagg

SEQ ID NO: 200103 - DNA, 20 bp, Artificial Sequence
  Description of Artificial Sequence: Synthetic oligonucleotide
  Target: ATXN1; (-) strand; PAM type: YTN; PAM sequence: TTT
tcaaaggcatgggtgtggag

SEQ ID NO: 200104 - DNA, 20 bp, Artificial Sequence
  Description of Artificial Sequence: Synthetic oligonucleotide
  Target: ATXN1; (-) strand; PAM type: YTN; PAM sequence: CTA
agcatagaagggcagcattt

SEQ ID NO: 200105 - DNA, 20 bp, Artificial Sequence
  Description of Artificial Sequence: Synthetic oligonucleotide
  Target: ATXN1; (-) strand; PAM type: YTN; PAM sequence: TTC
taagcatagaagggcagcat

SEQ ID NO: 200106 - DNA, 20 bp, Artificial Sequence
  Description of Artificial Sequence: Synthetic oligonucleotide
  Target: ATXN1; (-) strand; PAM type: YTN; PAM sequence: CTT
ctaagcatagaagggcagca

SEQ ID NO: 200107 - DNA, 20 bp, Artificial Sequence
  Description of Artificial Sequence: Synthetic oligonucleotide
  Target: ATXN1; (-) strand; PAM type: YTN; PAM sequence: TTG
ggaagtgcttctaagcatag

SEQ ID NO: 200108 - DNA, 20 bp, Artificial Sequence
  Description of Artificial Sequence: Synthetic oligonucleotide
  Target: ATXN1; (-) strand; PAM type: YTN; PAM sequence: CTT
gggaagtgcttctaagcata

SEQ ID NO: 200109 - DNA, 20 bp, Artificial Sequence
  Description of Artificial Sequence: Synthetic oligonucleotide
  Target: ATXN1; (-) strand; PAM type: YTN; PAM sequence: TTC
ttgggaagtgcttctaagca

SEQ ID NO: 200110 - DNA, 20 bp, Artificial Sequence
  Description of Artificial Sequence: Synthetic oligonucleotide
  Target: ATXN1; (-) strand; PAM type: YTN; PAM sequence: TTA
tgtacaataaacaggaagca

SEQ ID NO: 200111 - DNA, 20 bp, Artificial Sequence
  Description of Artificial Sequence: Synthetic oligonucleotide
  Target: ATXN1; (-) strand; PAM type: YTN; PAM sequence: TTG
agatggattatgtacaataa

SEQ ID NO: 200112 - DNA, 20 bp, Artificial Sequence
  Description of Artificial Sequence: Synthetic oligonucleotide
  Target: ATXN1; (-) strand; PAM type: YTN; PAM sequence: CTC
cgagatgatggttgagatgg

SEQ ID NO: 200113 - DNA, 20 bp, Artificial Sequence
  Description of Artificial Sequence: Synthetic oligonucleotide
  Target: ATXN1; (-) strand; PAM type: YTN; PAM sequence: TTG
taggaaagacctccgagatg

SEQ ID NO: 200114 - DNA, 20 bp, Artificial Sequence
  Description of Artificial Sequence: Synthetic oligonucleotide
  Target: ATXN1; (-) strand; PAM type: YTN; PAM sequence: TTT
gtaggaaagacctccgagat

SEQ ID NO: 200115 - DNA, 20 bp, Artificial Sequence
  Description of Artificial Sequence: Synthetic oligonucleotide
  Target: ATXN1; (-) strand; PAM type: YTN; PAM sequence: TTG
taagtggagcacaggaagca

SEQ ID NO: 200116 - DNA, 20 bp, Artificial Sequence
  Description of Artificial Sequence: Synthetic oligonucleotide
  Target: ATXN1; (-) strand; PAM type: YTN; PAM sequence: TTT
gtaagtggagcacaggaagc

SEQ ID NO: 200117 - DNA, 20 bp, Artificial Sequence
  Description of Artificial Sequence: Synthetic oligonucleotide
  Target: ATXN1; (-) strand; PAM type: YTN; PAM sequence: CTC
aggcagtgtttgtaagtgga

SEQ ID NO: 200118 - DNA, 20 bp, Artificial Sequence
  Description of Artificial Sequence: Synthetic oligonucleotide
  Target: ATXN1; (-) strand; PAM type: YTN; PAM sequence: TTG
ctcaggcagtgtttgtaagt

SEQ ID NO: 200119 - DNA, 20 bp, Artificial Sequence
  Description of Artificial Sequence: Synthetic oligonucleotide
  Target: ATXN1; (-) strand; PAM type: YTN; PAM sequence: TTG
tagagagcagttgctcaggc

SEQ ID NO: 200120 - DNA, 20 bp, Artificial Sequence
  Description of Artificial Sequence: Synthetic oligonucleotide
  Target: ATXN1; (-) strand; PAM type: YTN; PAM sequence: CTT
gtagagagcagttgctcagg

SEQ ID NO: 200121 - DNA, 20 bp, Artificial Sequence
  Description of Artificial Sequence: Synthetic oligonucleotide
  Target: ATXN1; (-) strand; PAM type: YTN; PAM sequence: CTC
acatggggcttgtagagagc

SEQ ID NO: 200122 - DNA, 20 bp, Artificial Sequence
  Description of Artificial Sequence: Synthetic oligonucleotide
  Target: ATXN1; (-) strand; PAM type: YTN; PAM sequence: CTA
gcacctcacatggggcttgt

SEQ ID NO: 200123 - DNA, 20 bp, Artificial Sequence
  Description of Artificial Sequence: Synthetic oligonucleotide
  Target: ATXN1; (-) strand; PAM type: YTN; PAM sequence: TTG
tacatctagcacctcacatg

SEQ ID NO: 200124 - DNA, 20 bp, Artificial Sequence
  Description of Artificial Sequence: Synthetic oligonucleotide
  Target: ATXN1; (-) strand; PAM type: YTN; PAM sequence: TTA
tgagatgttgtacatctagc

SEQ ID NO: 200125 - DNA, 20 bp, Artificial Sequence
  Description of Artificial Sequence: Synthetic oligonucleotide
  Target: ATXN1; (-) strand; PAM type: YTN; PAM sequence: CTT
atgagatgttgtacatctag

SEQ ID NO: 200126 - DNA, 20 bp, Artificial Sequence
  Description of Artificial Sequence: Synthetic oligonucleotide
  Target: ATXN1; (-) strand; PAM type: YTN; PAM sequence: TTG
tatgtacttatgagatgttg

SEQ ID NO: 200127 - DNA, 20 bp, Artificial Sequence
  Description of Artificial Sequence: Synthetic oligonucleotide
  Target: ATXN1; (-) strand; PAM type: YTN; PAM sequence: TTT
gtatgtacttatgagatgtt

SEQ ID NO: 200128 - DNA, 20 bp, Artificial Sequence
  Description of Artificial Sequence: Synthetic oligonucleotide
  Target: ATXN1; (-) strand; PAM type: YTN; PAM sequence: TTT
tgtatgtacttatgagatgt

SEQ ID NO: 200129 - DNA, 20 bp, Artificial Sequence
  Description of Artificial Sequence: Synthetic oligonucleotide
  Target: ATXN1; (-) strand; PAM type: YTN; PAM sequence: CTT
ttgtatgtacttatgagatg

SEQ ID NO: 200130 - DNA, 20 bp, Artificial Sequence
  Description of Artificial Sequence: Synthetic oligonucleotide
  Target: ATXN1; (-) strand; PAM type: YTN; PAM sequence: TTC
acggcttttgtatgtactta

SEQ ID NO: 200131 - DNA, 20 bp, Artificial Sequence
  Description of Artificial Sequence: Synthetic oligonucleotide
  Target: ATXN1; (-) strand; PAM type: YTN; PAM sequence: CTA
cagttcacggcttttgtatg

SEQ ID NO: 200132 - DNA, 20 bp, Artificial Sequence
  Description of Artificial Sequence: Synthetic oligonucleotide
  Target: ATXN1; (-) strand; PAM type: YTN; PAM sequence: CTG
caagtaatgcctacagttca

SEQ ID NO: 200133 - DNA, 20 bp, Artificial Sequence
  Description of Artificial Sequence: Synthetic oligonucleotide
  Target: ATXN1; (-) strand; PAM type: YTN; PAM sequence: TTG
tcatctgcaagtaatgccta

SEQ ID NO: 200134 - DNA, 20 bp, Artificial Sequence
  Description of Artificial Sequence: Synthetic oligonucleotide
  Target: ATXN1; (-) strand; PAM type: YTN; PAM sequence: TTT
gtcatctgcaagtaatgcct

SEQ ID NO: 200135 - DNA, 20 bp, Artificial Sequence
  Description of Artificial Sequence: Synthetic oligonucleotide
  Target: ATXN1; (-) strand; PAM type: YTN; PAM sequence: CTA
gtttgtcatctgcaagtaat

SEQ ID NO: 200136 - DNA, 20 bp, Artificial Sequence
  Description of Artificial Sequence: Synthetic oligonucleotide
  Target: ATXN1; (-) strand; PAM type: YTN; PAM sequence: CTG
agcctagtttgtcatctgca

SEQ ID NO: 200137 - DNA, 20 bp, Artificial Sequence
  Description of Artificial Sequence: Synthetic oligonucleotide
  Target: ATXN1; (-) strand; PAM type: YTN; PAM sequence: TTC
tgagcctagtttgtcatctg

SEQ ID NO: 200138 - DNA, 20 bp, Artificial Sequence
  Description of Artificial Sequence: Synthetic oligonucleotide
  Target: ATXN1; (-) strand; PAM type: YTN; PAM sequence: TTT
ctgagcctagtttgtcatct

SEQ ID NO: 200139 - DNA, 20 bp, Artificial Sequence
  Description of Artificial Sequence: Synthetic oligonucleotide
  Target: ATXN1; (-) strand; PAM type: YTN; PAM sequence: TTT
tctgagcctagtttgtcatc

SEQ ID NO: 200140 - DNA, 20 bp, Artificial Sequence
  Description of Artificial Sequence: Synthetic oligonucleotide
  Target: ATXN1; (-) strand; PAM type: YTN; PAM sequence: CTT
ttctgagcctagtttgtcat

SEQ ID NO: 200141 - DNA, 20 bp, Artificial Sequence
  Description of Artificial Sequence: Synthetic oligonucleotide
  Target: ATXN1; (-) strand; PAM type: YTN; PAM sequence: CTG
aacttttctgagcctagttt

SEQ ID NO: 200142 - DNA, 20 bp, Artificial Sequence
  Description of Artificial Sequence: Synthetic oligonucleotide
  Target: ATXN1; (-) strand; PAM type: YTN; PAM sequence: CTA
ctgaacttttctgagcctag

SEQ ID NO: 200143 - DNA, 20 bp, Artificial Sequence
  Description of Artificial Sequence: Synthetic oligonucleotide
  Target: ATXN1; (-) strand; PAM type: YTN; PAM sequence: TTG
accaagctactgaacttttc

SEQ ID NO: 200144 - DNA, 20 bp, Artificial Sequence
  Description of Artificial Sequence: Synthetic oligonucleotide
  Target: ATXN1; (-) strand; PAM type: YTN; PAM sequence: CTT
gaccaagctactgaactttt

SEQ ID NO: 200145 - DNA, 20 bp, Artificial Sequence
  Description of Artificial Sequence: Synthetic oligonucleotide
  Target: ATXN1; (-) strand; PAM type: YTN; PAM sequence: CTG
tgtgaacttgaccaagctac

SEQ ID NO: 200146 - DNA, 20 bp, Artificial Sequence
  Description of Artificial Sequence: Synthetic oligonucleotide
  Target: ATXN1; (-) strand; PAM type: YTN; PAM sequence: CTG
gctgtgtgaacttgaccaag

SEQ ID NO: 200147 - DNA, 20 bp, Artificial Sequence
  Description of Artificial Sequence: Synthetic oligonucleotide
  Target: ATXN1; (-) strand; PAM type: YTN; PAM sequence: CTC
actggctgtgtgaacttgac

SEQ ID NO: 200148 - DNA, 20 bp, Artificial Sequence
  Description of Artificial Sequence: Synthetic oligonucleotide
  Target: ATXN1; (-) strand; PAM type: YTN; PAM sequence: CTC
agagccaaaagcatggagct

SEQ ID NO: 200149 - DNA, 20 bp, Artificial Sequence
  Description of Artificial Sequence: Synthetic oligonucleotide
  Target: ATXN1; (-) strand; PAM type: YTN; PAM sequence: TTA
ggagaagccaaccagggcct

SEQ ID NO: 200150 - DNA, 20 bp, Artificial Sequence
  Description of Artificial Sequence: Synthetic oligonucleotide
  Target: ATXN1; (-) strand; PAM type: YTN; PAM sequence: TTT
aggagaagccaaccagggcc

SEQ ID NO: 200151 - DNA, 20 bp, Artificial Sequence
  Description of Artificial Sequence: Synthetic oligonucleotide
  Target: ATXN1; (-) strand; PAM type: YTN; PAM sequence: TTA
ggtggtgtgtttaggagaag

SEQ ID NO: 200152 - DNA, 20 bp, Artificial Sequence
  Description of Artificial Sequence: Synthetic oligonucleotide
  Target: ATXN1; (-) strand; PAM type: YTN; PAM sequence: TTG
ttaggtggtgtgtttaggag

SEQ ID NO: 200153 - DNA, 20 bp, Artificial Sequence
  Description of Artificial Sequence: Synthetic oligonucleotide
  Target: ATXN1; (-) strand; PAM type: YTN; PAM sequence: TTG
acatatggtagcattgttag

SEQ ID NO: 200154 - DNA, 20 bp, Artificial Sequence
  Description of Artificial Sequence: Synthetic oligonucleotide
  Target: ATXN1; (-) strand; PAM type: YTN; PAM sequence: TTT
gacatatggtagcattgtta

SEQ ID NO: 200155 - DNA, 20 bp, Artificial Sequence
  Description of Artificial Sequence: Synthetic oligonucleotide
  Target: ATXN1; (-) strand; PAM type: YTN; PAM sequence: TTG
agtttgacatatggtagcat

SEQ ID NO: 200156 - DNA, 20 bp, Artificial Sequence
  Description of Artificial Sequence: Synthetic oligonucleotide
  Target: ATXN1; (-) strand; PAM type: YTN; PAM sequence: TTA
gtgttgagtttgacatatgg

SEQ ID NO: 200157 - DNA, 20 bp, Artificial Sequence
  Description of Artificial Sequence: Synthetic oligonucleotide
  Target: ATXN1; (-) strand; PAM type: YTN; PAM sequence: CTT
agtgttgagtttgacatatg

SEQ ID NO: 200158 - DNA, 20 bp, Artificial Sequence
  Description of Artificial Sequence: Synthetic oligonucleotide
  Target: ATXN1; (-) strand; PAM type: YTN; PAM sequence: CTG
ccttagtgttgagtttgaca

SEQ ID NO: 200159 - DNA, 20 bp, Artificial Sequence
  Description of Artificial Sequence: Synthetic oligonucleotide
  Target: ATXN1; (-) strand; PAM type: YTN; PAM sequence: TTA
ggcgagtctgccttagtgtt

SEQ ID NO: 200160 - DNA, 20 bp, Artificial Sequence
  Description of Artificial Sequence: Synthetic oligonucleotide
  Target: ATXN1; (-) strand; PAM type: YTN; PAM sequence: CTT
aggcgagtctgccttagtgt

SEQ ID NO: 200161 - DNA, 20 bp, Artificial Sequence
  Description of Artificial Sequence: Synthetic oligonucleotide
  Target: ATXN1; (-) strand; PAM type: YTN; PAM sequence: CTG
ggtgggtgtcttaggcgagt

SEQ ID NO: 200162 - DNA, 20 bp, Artificial Sequence
  Description of Artificial Sequence: Synthetic oligonucleotide
  Target: ATXN1; (-) strand; PAM type: YTN; PAM sequence: CTC
tgggtgggtgtcttaggcga

SEQ ID NO: 200163 - DNA, 20 bp, Artificial Sequence
  Description of Artificial Sequence: Synthetic oligonucleotide
  Target: ATXN1; (-) strand; PAM type: YTN; PAM sequence: CTG
ggctctgggtgggtgtctta

SEQ ID NO: 200164 - DNA, 20 bp, Artificial Sequence
  Description of Artificial Sequence: Synthetic oligonucleotide
  Target: ATXN1; (-) strand; PAM type: YTN; PAM sequence: TTG
taggaaccactgggctctgg

SEQ ID NO: 200165 - DNA, 20 bp, Artificial Sequence
  Description of Artificial Sequence: Synthetic oligonucleotide
  Target: ATXN1; (-) strand; PAM type: YTN; PAM sequence: TTC
cgattgtaggaaccactggg

SEQ ID NO: 200166 - DNA, 20 bp, Artificial Sequence
  Description of Artificial Sequence: Synthetic oligonucleotide
  Target: ATXN1; (-) strand; PAM type: YTN; PAM sequence: TTT
ccgattgtaggaaccactgg

SEQ ID NO: 200167 - DNA, 20 bp, Artificial Sequence
  Description of Artificial Sequence: Synthetic oligonucleotide
  Target: ATXN1; (-) strand; PAM type: YTN; PAM sequence: TTT
tccgattgtaggaaccactg

SEQ ID NO: 200168 - DNA, 20 bp, Artificial Sequence
  Description of Artificial Sequence: Synthetic oligonucleotide
  Target: ATXN1; (-) strand; PAM type: YTN; PAM sequence: TTA
tgtgattttccgattgtagg

SEQ ID NO: 200169 - DNA, 20 bp, Artificial Sequence
  Description of Artificial Sequence: Synthetic oligonucleotide
  Target: ATXN1; (-) strand; PAM type: YTN; PAM sequence: TTT
atgtgattttccgattgtag

SEQ ID NO: 200170 - DNA, 20 bp, Artificial Sequence
  Description of Artificial Sequence: Synthetic oligonucleotide
  Target: ATXN1; (-) strand; PAM type: YTN; PAM sequence: TTT
tatgtgattttccgattgta

SEQ ID NO: 200171 - DNA, 20 bp, Artificial Sequence
  Description of Artificial Sequence: Synthetic oligonucleotide
  Target: ATXN1; (-) strand; PAM type: YTN; PAM sequence: CTT
ttatgtgattttccgattgt

SEQ ID NO: 200172 - DNA, 20 bp, Artificial Sequence
  Description of Artificial Sequence: Synthetic oligonucleotide
  Target: ATXN1; (-) strand; PAM type: YTN; PAM sequence: TTC
ttttatgtgattttccgatt

SEQ ID NO: 200173 - DNA, 20 bp, Artificial Sequence
  Description of Artificial Sequence: Synthetic oligonucleotide
  Target: ATXN1; (-) strand; PAM type: YTN; PAM sequence: TTT
cttttatgtgattttccgat

SEQ ID NO: 200174 - DNA, 20 bp, Artificial Sequence
  Description of Artificial Sequence: Synthetic oligonucleotide
  Target: ATXN1; (-) strand; PAM type: YTN; PAM sequence: CTT
tcttttatgtgattttccga

SEQ ID NO: 200175 - DNA, 20 bp, Artificial Sequence
  Description of Artificial Sequence: Synthetic oligonucleotide
  Target: ATXN1; (-) strand; PAM type: YTN; PAM sequence: CTC
atgtcaaaactttcttttat

SEQ ID NO: 200176 - DNA, 20 bp, Artificial Sequence
  Description of Artificial Sequence: Synthetic oligonucleotide
  Target: ATXN1; (-) strand; PAM type: YTN; PAM sequence: TTG
acagccggtctcatgtcaaa

SEQ ID NO: 200177 - DNA, 20 bp, Artificial Sequence
  Description of Artificial Sequence: Synthetic oligonucleotide
  Target: ATXN1; (-) strand; PAM type: YTN; PAM sequence: TTT
gacagccggtctcatgtcaa

SEQ ID NO: 200178 - DNA, 20 bp, Artificial Sequence
  Description of Artificial Sequence: Synthetic oligonucleotide
  Target: ATXN1; (-) strand; PAM type: YTN; PAM sequence: CTA
tttgacagccggtctcatgt

SEQ ID NO: 200179 - DNA, 20 bp, Artificial Sequence
  Description of Artificial Sequence: Synthetic oligonucleotide
  Target: ATXN1; (-) strand; PAM type: YTN; PAM sequence: CTG
cagaggtgtctatttgacag

SEQ ID NO: 200180 - DNA, 20 bp, Artificial Sequence
  Description of Artificial Sequence: Synthetic oligonucleotide
  Target: ATXN1; (-) strand; PAM type: YTN; PAM sequence: CTG
gcctgcagaggtgtctattt

SEQ ID NO: 200181 - DNA, 20 bp, Artificial Sequence
  Description of Artificial Sequence: Synthetic oligonucleotide
  Target: ATXN1; (-) strand; PAM type: YTN; PAM sequence: TTA
gacacacacacccctggcct

SEQ ID NO: 200182 - DNA, 20 bp, Artificial Sequence
  Description of Artificial Sequence: Synthetic oligonucleotide
  Target: ATXN1; (-) strand; PAM type: YTN; PAM sequence: TTT
agacacacacacccctggcc

SEQ ID NO: 200183 - DNA, 20 bp, Artificial Sequence
  Description of Artificial Sequence: Synthetic oligonucleotide
  Target: ATXN1; (-) strand; PAM type: YTN; PAM sequence: TTT
tagacacacacacccctggc

SEQ ID NO: 200184 - DNA, 20 bp, Artificial Sequence
  Description of Artificial Sequence: Synthetic oligonucleotide
  Target: ATXN1; (-) strand; PAM type: YTN; PAM sequence: TTG
gttttagacacacacacccc

SEQ ID NO: 200185 - DNA, 20 bp, Artificial Sequence
  Description of Artificial Sequence: Synthetic oligonucleotide
  Target: ATXN1; (-) strand; PAM type: YTN; PAM sequence: CTG
cagaacaatgtggccaccca

SEQ ID NO: 200186 - DNA, 20 bp, Artificial Sequence
  Description of Artificial Sequence: Synthetic oligonucleotide
  Target: ATXN1; (-) strand; PAM type: YTN; PAM sequence: CTG
gaaggcaaacagactgcaga

SEQ ID NO: 200187 - DNA, 20 bp, Artificial Sequence
  Description of Artificial Sequence: Synthetic oligonucleotide
  Target: ATXN1; (-) strand; PAM type: YTN; PAM sequence: CTG
catgacaggcaggaaagaaa

SEQ ID NO: 200188 - DNA, 20 bp, Artificial Sequence
  Description of Artificial Sequence: Synthetic oligonucleotide
  Target: ATXN1; (-) strand; PAM type: YTN; PAM sequence: TTA
tctgcatgacaggcaggaaa

SEQ ID NO: 200189 - DNA, 20 bp, Artificial Sequence
  Description of Artificial Sequence: Synthetic oligonucleotide
  Target: ATXN1; (-) strand; PAM type: YTN; PAM sequence: CTA
cacaattatctgcatgacag

SEQ ID NO: 200190 - DNA, 20 bp, Artificial Sequence
  Description of Artificial Sequence: Synthetic oligonucleotide
  Target: ATXN1; (-) strand; PAM type: YTN; PAM sequence: TTG
ggacacactacacaattatc

SEQ ID NO: 200191 - DNA, 20 bp, Artificial Sequence
  Description of Artificial Sequence: Synthetic oligonucleotide
  Target: ATXN1; (-) strand; PAM type: YTN; PAM sequence: CTT
gggacacactacacaattat

SEQ ID NO: 200192 - DNA, 20 bp, Artificial Sequence
  Description of Artificial Sequence: Synthetic oligonucleotide
  Target: ATXN1; (-) strand; PAM type: YTN; PAM sequence: TTG
cttgggacacactacacaat

SEQ ID NO: 200193 - DNA, 20 bp, Artificial Sequence
  Description of Artificial Sequence: Synthetic oligonucleotide
  Target: ATXN1; (-) strand; PAM type: YTN; PAM sequence: CTG
ttgcttgggacacactacac

SEQ ID NO: 200194 - DNA, 20 bp, Artificial Sequence
  Description of Artificial Sequence: Synthetic oligonucleotide
  Target: ATXN1; (-) strand; PAM type: YTN; PAM sequence: CTG
atgcgtcctgttgcttggga

SEQ ID NO: 200195 - DNA, 20 bp, Artificial Sequence
  Description of Artificial Sequence: Synthetic oligonucleotide
  Target: ATXN1; (-) strand; PAM type: YTN; PAM sequence: TTA
gggaaactgatgcgtcctgt

SEQ ID NO: 200196 - DNA, 20 bp, Artificial Sequence
  Description of Artificial Sequence: Synthetic oligonucleotide
  Target: ATXN1; (-) strand; PAM type: YTN; PAM sequence: CTC
cataaattagggaaactgat

SEQ ID NO: 200197 - DNA, 20 bp, Artificial Sequence
  Description of Artificial Sequence: Synthetic oligonucleotide
  Target: ATXN1; (-) strand; PAM type: YTN; PAM sequence: CTG
actccataaattagggaaac

SEQ ID NO: 200198 - DNA, 20 bp, Artificial Sequence
  Description of Artificial Sequence: Synthetic oligonucleotide
  Target: ATXN1; (-) strand; PAM type: YTN; PAM sequence: TTA
ggctgactccataaattagg

SEQ ID NO: 200199 - DNA, 20 bp, Artificial Sequence
  Description of Artificial Sequence: Synthetic oligonucleotide
  Target: ATXN1; (-) strand; PAM type: YTN; PAM sequence: TTT
aggctgactccataaattag

SEQ ID NO: 200200 - DNA, 20 bp, Artificial Sequence
  Description of Artificial Sequence: Synthetic oligonucleotide
  Target: ATXN1; (-) strand; PAM type: YTN; PAM sequence: TTG
tggtcataaacaaaaggagt

SEQ ID NO: 200201 - DNA, 20 bp, Artificial Sequence
  Description of Artificial Sequence: Synthetic oligonucleotide
  Target: ATXN1; (-) strand; PAM type: YTN; PAM sequence: TTA
gtgtgttgtggtcataaaca

SEQ ID NO: 200202 - DNA, 20 bp, Artificial Sequence
  Description of Artificial Sequence: Synthetic oligonucleotide
  Target: ATXN1; (-) strand; PAM type: YTN; PAM sequence: CTA
acatacagagttagtgtgtt

SEQ ID NO: 200203 - DNA, 20 bp, Artificial Sequence
  Description of Artificial Sequence: Synthetic oligonucleotide
  Target: ATXN1; (-) strand; PAM type: YTN; PAM sequence: TTG
gaaacatctaacatacagag

SEQ ID NO: 200204 - DNA, 20 bp, Artificial Sequence
  Description of Artificial Sequence: Synthetic oligonucleotide
  Target: ATXN1; (-) strand; PAM type: YTN; PAM sequence: TTG
ttggaaacatctaacataca

SEQ ID NO: 200205 - DNA, 20 bp, Artificial Sequence
  Description of Artificial Sequence: Synthetic oligonucleotide
  Target: ATXN1; (-) strand; PAM type: YTN; PAM sequence: CTT
gttggaaacatctaacatac

SEQ ID NO: 200206 - DNA, 20 bp, Artificial Sequence
  Description of Artificial Sequence: Synthetic oligonucleotide
  Target: ATXN1; (-) strand; PAM type: YTN; PAM sequence: TTG
atgcttgttggaaacatcta

SEQ ID NO: 200207 - DNA, 20 bp, Artificial Sequence
  Description of Artificial Sequence: Synthetic oligonucleotide
  Target: ATXN1; (-) strand; PAM type: YTN; PAM sequence: TTT
gatgcttgttggaaacatct

SEQ ID NO: 200208 - DNA, 20 bp, Artificial Sequence
  Description of Artificial Sequence: Synthetic oligonucleotide
  Target: ATXN1; (-) strand; PAM type: YTN; PAM sequence: CTT
tgatgcttgttggaaacatc

SEQ ID NO: 200209 - DNA, 20 bp, Artificial Sequence
  Description of Artificial Sequence: Synthetic oligonucleotide
  Target: ATXN1; (-) strand; PAM type: YTN; PAM sequence: TTG
aggctttgatgcttgttgga

SEQ ID NO: 200210 - DNA, 20 bp, Artificial Sequence
  Description of Artificial Sequence: Synthetic oligonucleotide
  Target: ATXN1; (-) strand; PAM type: YTN; PAM sequence: CTG
gaaaacaaaacaaaagacag

SEQ ID NO: 200211 - DNA, 20 bp, Artificial Sequence
  Description of Artificial Sequence: Synthetic oligonucleotide
  Target: ATXN1; (-) strand; PAM type: YTN; PAM sequence: TTA
gcagaactggaaaacaaaac

SEQ ID NO: 200212 - DNA, 20 bp, Artificial Sequence
  Description of Artificial Sequence: Synthetic oligonucleotide
  Target: ATXN1; (-) strand; PAM type: YTN; PAM sequence: TTG
cattagcagaactggaaaac

SEQ ID NO: 200213 - DNA, 20 bp, Artificial Sequence
  Description of Artificial Sequence: Synthetic oligonucleotide
  Target: ATXN1; (-) strand; PAM type: YTN; PAM sequence: CTT
gcattagcagaactggaaaa

SEQ ID NO: 200214 - DNA, 20 bp, Artificial Sequence
  Description of Artificial Sequence: Synthetic oligonucleotide
  Target: ATXN1; (-) strand; PAM type: YTN; PAM sequence: CTG
tcccttgcattagcagaact

SEQ ID NO: 200215 - DNA, 20 bp, Artificial Sequence
  Description of Artificial Sequence: Synthetic oligonucleotide
  Target: ATXN1; (-) strand; PAM type: YTN; PAM sequence: CTA
gtaataaataccaggacagg

SEQ ID NO: 200216 - DNA, 20 bp, Artificial Sequence
  Description of Artificial Sequence: Synthetic oligonucleotide
  Target: ATXN1; (-) strand; PAM type: YTN; PAM sequence: CTC
tagtaataaataccaggaca

SEQ ID NO: 200217 - DNA, 20 bp, Artificial Sequence
  Description of Artificial Sequence: Synthetic oligonucleotide
  Target: ATXN1; (-) strand; PAM type: YTN; PAM sequence: TTA
ctctagtaataaataccagg

SEQ ID NO: 200218 - DNA, 20 bp, Artificial Sequence
  Description of Artificial Sequence: Synthetic oligonucleotide
  Target: ATXN1; (-) strand; PAM type: YTN; PAM sequence: CTG
acattactctagtaataaat

SEQ ID NO: 200219 - DNA, 20 bp, Artificial Sequence
  Description of Artificial Sequence: Synthetic oligonucleotide
  Target: ATXN1; (-) strand; PAM type: YTN; PAM sequence: CTA
accccaaacctgacattact

SEQ ID NO: 200220 - DNA, 20 bp, Artificial Sequence
  Description of Artificial Sequence: Synthetic oligonucleotide
  Target: ATXN1; (-) strand; PAM type: YTN; PAM sequence: TTA
tgagctaaccccaaacctga

SEQ ID NO: 200221 - DNA, 20 bp, Artificial Sequence
  Description of Artificial Sequence: Synthetic oligonucleotide
  Target: ATXN1; (-) strand; PAM type: YTN; PAM sequence: TTT
atgagctaaccccaaacctg

SEQ ID NO: 200222 - DNA, 20 bp, Artificial Sequence
  Description of Artificial Sequence: Synthetic oligonucleotide
  Target: ATXN1; (-) strand; PAM type: YTN; PAM sequence: TTT
tatgagctaaccccaaacct

SEQ ID NO: 200223 - DNA, 20 bp, Artificial Sequence
  Description of Artificial Sequence: Synthetic oligonucleotide
  Target: ATXN1; (-) strand; PAM type: YTN; PAM sequence: CTA
gagaggtattttatgagcta

SEQ ID NO: 200224 - DNA, 20 bp, Artificial Sequence
  Description of Artificial Sequence: Synthetic oligonucleotide
  Target: ATXN1; (-) strand; PAM type: YTN; PAM sequence: TTG
caaagaaagccaaactagag

SEQ ID NO: 200225 - DNA, 20 bp, Artificial Sequence
  Description of Artificial Sequence: Synthetic oligonucleotide
  Target: ATXN1; (-) strand; PAM type: YTN; PAM sequence: CTT
gcaaagaaagccaaactaga

SEQ ID NO: 200226 - DNA, 20 bp, Artificial Sequence
  Description of Artificial Sequence: Synthetic oligonucleotide
  Target: ATXN1; (-) strand; PAM type: YTN; PAM sequence: CTC
ttgcaaagaaagccaaacta

SEQ ID NO: 200227 - DNA, 20 bp, Artificial Sequence
  Description of Artificial Sequence: Synthetic oligonucleotide
  Target: ATXN1; (-) strand; PAM type: YTN; PAM sequence: TTG
atctcttgcaaagaaagcca

SEQ ID NO: 200228 - DNA, 20 bp, Artificial Sequence
  Description of Artificial Sequence: Synthetic oligonucleotide
  Target: ATXN1; (-) strand; PAM type: YTN; PAM sequence: TTT
gatctcttgcaaagaaagcc

SEQ ID NO: 200229 - DNA, 20 bp, Artificial Sequence
  Description of Artificial Sequence: Synthetic oligonucleotide
  Target: ATXN1; (-) strand; PAM type: YTN; PAM sequence: TTT
tgatctcttgcaaagaaagc

SEQ ID NO: 200230 - DNA, 20 bp, Artificial Sequence
  Description of Artificial Sequence: Synthetic oligonucleotide
  Target: ATXN1; (-) strand; PAM type: YTN; PAM sequence: TTA
aagaaaaaagaatgttttga

SEQ ID NO: 200231 - DNA, 20 bp, Artificial Sequence
  Description of Artificial Sequence: Synthetic oligonucleotide
  Target: ATXN1; (-) strand; PAM type: YTN; PAM sequence: TTG
atggtgccattaaagaaaaa

SEQ ID NO: 200232 - DNA, 20 bp, Artificial Sequence
  Description of Artificial Sequence: Synthetic oligonucleotide
  Target: ATXN1; (-) strand; PAM type: YTN; PAM sequence: TTT
gatggtgccattaaagaaaa

SEQ ID NO: 200233 - DNA, 20 bp, Artificial Sequence
  Description of Artificial Sequence: Synthetic oligonucleotide
  Target: ATXN1; (-) strand; PAM type: YTN; PAM sequence: TTT
tgatggtgccattaaagaaa

SEQ ID NO: 200234 - DNA, 20 bp, Artificial Sequence
  Description of Artificial Sequence: Synthetic oligonucleotide
  Target: ATXN1; (-) strand; PAM type: YTN; PAM sequence: TTT
ttgatggtgccattaaagaa

SEQ ID NO: 200235 - DNA, 20 bp, Artificial Sequence
  Description of Artificial Sequence: Synthetic oligonucleotide
  Target: ATXN1; (-) strand; PAM type: YTN; PAM sequence: CTT
tttgatggtgccattaaaga

SEQ ID NO: 200236 - DNA, 20 bp, Artificial Sequence
  Description of Artificial Sequence: Synthetic oligonucleotide
  Target: ATXN1; (-) strand; PAM type: YTN; PAM sequence: TTC
tttttgatggtgccattaaa

SEQ ID NO: 200237 - DNA, 20 bp, Artificial Sequence
  Description of Artificial Sequence: Synthetic oligonucleotide
  Target: ATXN1; (-) strand; PAM type: YTN; PAM sequence: TTG
attctttttgatggtgccat

SEQ ID NO: 200238 - DNA, 20 bp, Artificial Sequence
  Description of Artificial Sequence: Synthetic oligonucleotide
  Target: ATXN1; (-) strand; PAM type: YTN; PAM sequence: TTA
tatgttgattctttttgatg

SEQ ID NO: 200239 - DNA, 20 bp, Artificial Sequence
  Description of Artificial Sequence: Synthetic oligonucleotide
  Target: ATXN1; (-) strand; PAM type: YTN; PAM sequence: TTT
atatgttgattctttttgat

SEQ ID NO: 200240 - DNA, 20 bp, Artificial Sequence
  Description of Artificial Sequence: Synthetic oligonucleotide
  Target: ATXN1; (-) strand; PAM type: YTN; PAM sequence: TTG
aaacatgtttatatgttgat

SEQ ID NO: 200241 - DNA, 20 bp, Artificial Sequence
  Description of Artificial Sequence: Synthetic oligonucleotide
  Target: ATXN1; (-) strand; PAM type: YTN; PAM sequence: CTA
ttgaaacatgtttatatgtt

SEQ ID NO: 200242 - DNA, 20 bp, Artificial Sequence
  Description of Artificial Sequence: Synthetic oligonucleotide
  Target: ATXN1; (-) strand; PAM type: YTN; PAM sequence: CTG
agaaaccacaagaggaaaaa

SEQ ID NO: 200243 - DNA, 20 bp, Artificial Sequence
  Description of Artificial Sequence: Synthetic oligonucleotide
  Target: ATXN1; (-) strand; PAM type: YTN; PAM sequence: TTC
caaatactgagaaaccacaa

SEQ ID NO: 200244 - DNA, 20 bp, Artificial Sequence
  Description of Artificial Sequence: Synthetic oligonucleotide
  Target: ATXN1; (-) strand; PAM type: YTN; PAM sequence: TTG
taagcaaaagataataatac

SEQ ID NO: 200245 - DNA, 20 bp, Artificial Sequence
  Description of Artificial Sequence: Synthetic oligonucleotide
  Target: ATXN1; (-) strand; PAM type: YTN; PAM sequence: TTT
gtaagcaaaagataataata

SEQ ID NO: 200246 - DNA, 20 bp, Artificial Sequence
  Description of Artificial Sequence: Synthetic oligonucleotide
  Target: ATXN1; (-) strand; PAM type: YTN; PAM sequence: TTA
tcatttgtaagcaaaagata

SEQ ID NO: 200247 - DNA, 20 bp, Artificial Sequence
  Description of Artificial Sequence: Synthetic oligonucleotide
  Target: ATXN1; (-) strand; PAM type: YTN; PAM sequence: TTT
atcatttgtaagcaaaagat

SEQ ID NO: 200248 - DNA, 20 bp, Artificial Sequence
  Description of Artificial Sequence: Synthetic oligonucleotide
  Target: ATXN1; (-) strand; PAM type: YTN; PAM sequence: TTT
tatcatttgtaagcaaaaga

SEQ ID NO: 200249 - DNA, 20 bp, Artificial Sequence
  Description of Artificial Sequence: Synthetic oligonucleotide
  Target: ATXN1; (-) strand; PAM type: YTN; PAM sequence: TTG
caagaaaatagtgaaatatt

SEQ ID NO: 200250 - DNA, 20 bp, Artificial Sequence
  Description of Artificial Sequence: Synthetic oligonucleotide
  Target: ATXN1; (-) strand; PAM type: YTN; PAM sequence: CTT
gcaagaaaatagtgaaatat

SEQ ID NO: 200251 - DNA, 20 bp, Artificial Sequence
  Description of Artificial Sequence: Synthetic oligonucleotide
  Target: ATXN1; (-) strand; PAM type: YTN; PAM sequence: CTC
cgaaaaggcttgcaagaaaa

SEQ ID NO: 200252 - DNA, 20 bp, Artificial Sequence
  Description of Artificial Sequence: Synthetic oligonucleotide
  Target: ATXN1; (-) strand; PAM type: YTN; PAM sequence: TTG
tcaaccaaaatgataaagag

SEQ ID NO: 200253 - DNA, 20 bp, Artificial Sequence
  Description of Artificial Sequence: Synthetic oligonucleotide
  Target: ATXN1; (-) strand; PAM type: YTN; PAM sequence: CTA
attgtcaaccaaaatgataa

SEQ ID NO: 200254 - DNA, 20 bp, Artificial Sequence
  Description of Artificial Sequence: Synthetic oligonucleotide
  Target: ATXN1; (-) strand; PAM type: YTN; PAM sequence: TTA
ccaaaaaatgacacaaaaca

SEQ ID NO: 200255 - DNA, 20 bp, Artificial Sequence
  Description of Artificial Sequence: Synthetic oligonucleotide
  Target: ATXN1; (-) strand; PAM type: YTN; PAM sequence: TTA
ttaccaaaaaatgacacaaa

SEQ ID NO: 200256 - DNA, 20 bp, Artificial Sequence
  Description of Artificial Sequence: Synthetic oligonucleotide
  Target: ATXN1; (-) strand; PAM type: YTN; PAM sequence: TTC
cccaaaatattattaccaaa

SEQ ID NO: 200257 - DNA, 20 bp, Artificial Sequence
  Description of Artificial Sequence: Synthetic oligonucleotide
  Target: ATXN1; (-) strand; PAM type: YTN; PAM sequence: TTT
ccccaaaatattattaccaa

SEQ ID NO: 200258 - DNA, 20 bp, Artificial Sequence
  Description of Artificial Sequence: Synthetic oligonucleotide
  Target: ATXN1; (-) strand; PAM type: YTN; PAM sequence: TTT
tccccaaaatattattacca

SEQ ID NO: 200259 - DNA, 20 bp, Artificial Sequence
  Description of Artificial Sequence: Synthetic oligonucleotide
  Target: ATXN1; (-) strand; PAM type: YTN; PAM sequence: TTT
ttccccaaaatattattacc

SEQ ID NO: 200260 - DNA, 20 bp, Artificial Sequence
  Description of Artificial Sequence: Synthetic oligonucleotide
  Target: ATXN1; (-) strand; PAM type: YTN; PAM sequence: TTT
tttccccaaaatattattac

SEQ ID NO: 200261 - DNA, 20 bp, Artificial Sequence
  Description of Artificial Sequence: Synthetic oligonucleotide
  Target: ATXN1; (-) strand; PAM type: YTN; PAM sequence: TTT
ttttccccaaaatattatta

SEQ ID NO: 200262 - DNA, 20 bp, Artificial Sequence
  Description of Artificial Sequence: Synthetic oligonucleotide
  Target: ATXN1; (-) strand; PAM type: YTN; PAM sequence: CTA
gggtagtttttttccccaaa

SEQ ID NO: 200263 - DNA, 20 bp, Artificial Sequence
  Description of Artificial Sequence: Synthetic oligonucleotide
  Target: ATXN1; (-) strand; PAM type: YTN; PAM sequence: TTA
ctagggtagtttttttcccc

SEQ ID NO: 200264 - DNA, 20 bp, Artificial Sequence
  Description of Artificial Sequence: Synthetic oligonucleotide
  Target: ATXN1; (-) strand; PAM type: YTN; PAM sequence: CTG
ataaaccaaatattactagg

SEQ ID NO: 200265 - DNA, 20 bp, Artificial Sequence
  Description of Artificial Sequence: Synthetic oligonucleotide
  Target: ATXN1; (-) strand; PAM type: YTN; PAM sequence: CTC
agcgtccccccagatcaagt

SEQ ID NO: 200266 - DNA, 20 bp, Artificial Sequence
  Description of Artificial Sequence: Synthetic oligonucleotide
  Target: ATXN1; (-) strand; PAM type: YTN; PAM sequence: TTC
ctcagcgtccccccagatca

SEQ ID NO: 200267 - DNA, 20 bp, Artificial Sequence
  Description of Artificial Sequence: Synthetic oligonucleotide
  Target: ATXN1; (-) strand; PAM type: YTN; PAM sequence: TTT
cctcagcgtccccccagatc

SEQ ID NO: 200268 - DNA, 20 bp, Artificial Sequence
  Description of Artificial Sequence: Synthetic oligonucleotide
  Target: ATXN1; (-) strand; PAM type: YTN; PAM sequence: TTT
tcctcagcgtccccccagat

SEQ ID NO: 200269 - DNA, 20 bp, Artificial Sequence
  Description of Artificial Sequence: Synthetic oligonucleotide
  Target: ATXN1; (-) strand; PAM type: YTN; PAM sequence: CTC
attttcctcagcgtcccccc

SEQ ID NO: 200270 - DNA, 20 bp, Artificial Sequence
  Description of Artificial Sequence: Synthetic oligonucleotide
  Target: ATXN1; (-) strand; PAM type: YTN; PAM sequence: CTA
agagagaaaaggaagaaagg

SEQ ID NO: 200271 - DNA, 20 bp, Artificial Sequence
  Description of Artificial Sequence: Synthetic oligonucleotide
  Target: ATXN1; (-) strand; PAM type: YTN; PAM sequence: TTG
ctaagagagaaaaggaagaa

SEQ ID NO: 200272 - DNA, 20 bp, Artificial Sequence
  Description of Artificial Sequence: Synthetic oligonucleotide
  Target: ATXN1; (-) strand; PAM type: YTN; PAM sequence: TTT
gctaagagagaaaaggaaga

SEQ ID NO: 200273 - DNA, 20 bp, Artificial Sequence
  Description of Artificial Sequence: Synthetic oligonucleotide
  Target: ATXN1; (-) strand; PAM type: YTN; PAM sequence: TTT
tgctaagagagaaaaggaag

SEQ ID NO: 200274 - DNA, 20 bp, Artificial Sequence
  Description of Artificial Sequence: Synthetic oligonucleotide
  Target: ATXN1; (-) strand; PAM type: YTN; PAM sequence: CTT
ttgctaagagagaaaaggaa

SEQ ID NO: 200275 - DNA, 20 bp, Artificial Sequence
  Description of Artificial Sequence: Synthetic oligonucleotide
  Target: ATXN1; (-) strand; PAM type: YTN; PAM sequence: CTA
taggaatatgtagtaaaggc

SEQ ID NO: 200276 - DNA, 20 bp, Artificial Sequence
  Description of Artificial Sequence: Synthetic oligonucleotide
  Target: ATXN1; (-) strand; PAM type: YTN; PAM sequence: CTA
agaagctataggaatatgta

SEQ ID NO: 200277 - DNA, 20 bp, Artificial Sequence
  Description of Artificial Sequence: Synthetic oligonucleotide
  Target: ATXN1; (-) strand; PAM type: YTN; PAM sequence: TTG
ccaacgaagtaaaaagacta

SEQ ID NO: 200278 - DNA, 20 bp, Artificial Sequence
  Description of Artificial Sequence: Synthetic oligonucleotide
  Target: ATXN1; (-) strand; PAM type: YTN; PAM sequence: TTT
gccaacgaagtaaaaagact

SEQ ID NO: 200279 - DNA, 20 bp, Artificial Sequence
  Description of Artificial Sequence: Synthetic oligonucleotide
  Target: ATXN1; (-) strand; PAM type: YTN; PAM sequence: TTT
tgccaacgaagtaaaaagac

SEQ ID NO: 200280 - DNA, 20 bp, Artificial Sequence
  Description of Artificial Sequence: Synthetic oligonucleotide
  Target: ATXN1; (-) strand; PAM type: YTN; PAM sequence: CTT
ttgccaacgaagtaaaaaga

SEQ ID NO: 200281 - DNA, 20 bp, Artificial Sequence
  Description of Artificial Sequence: Synthetic oligonucleotide
  Target: ATXN1; (-) strand; PAM type: YTN; PAM sequence: TTC
ttttgccaacgaagtaaaaa

SEQ ID NO: 200282 - DNA, 20 bp, Artificial Sequence
  Description of Artificial Sequence: Synthetic oligonucleotide
  Target: ATXN1; (-) strand; PAM type: YTN; PAM sequence: TTT
cttttgccaacgaagtaaaa

SEQ ID NO: 200283 - DNA, 20 bp, Artificial Sequence
  Description of Artificial Sequence: Synthetic oligonucleotide
  Target: ATXN1; (-) strand; PAM type: YTN; PAM sequence: TTT
tcttttgccaacgaagtaaa

SEQ ID NO: 200284 - DNA, 20 bp, Artificial Sequence
  Description of Artificial Sequence: Synthetic oligonucleotide
  Target: ATXN1; (-) strand; PAM type: YTN; PAM sequence: TTT
ttcttttgccaacgaagtaa

SEQ ID NO: 200285 - DNA, 20 bp, Artificial Sequence
  Description of Artificial Sequence: Synthetic oligonucleotide
  Target: ATXN1; (-) strand; PAM type: YTN; PAM sequence: CTA
tttttcttttgccaacgaag

SEQ ID NO: 200286 - DNA, 20 bp, Artificial Sequence
  Description of Artificial Sequence: Synthetic oligonucleotide
  Target: ATXN1; (-) strand; PAM type: YTN; PAM sequence: CTC
atgctatttttcttttgcca

SEQ ID NO: 200287 - DNA, 20 bp, Artificial Sequence
  Description of Artificial Sequence: Synthetic oligonucleotide
  Target: ATXN1; (-) strand; PAM type: YTN; PAM sequence: TTA
atctcatgctatttttcttt

SEQ ID NO: 200288 - DNA, 20 bp, Artificial Sequence
  Description of Artificial Sequence: Synthetic oligonucleotide
  Target: ATXN1; (-) strand; PAM type: YTN; PAM sequence: TTT
aatctcatgctatttttctt

SEQ ID NO: 200289 - DNA, 20 bp, Artificial Sequence
  Description of Artificial Sequence: Synthetic oligonucleotide
  Target: ATXN1; (-) strand; PAM type: YTN; PAM sequence: TTT
taatctcatgctatttttct

SEQ ID NO: 200290 - DNA, 20 bp, Artificial Sequence
  Description of Artificial Sequence: Synthetic oligonucleotide
  Target: ATXN1; (-) strand; PAM type: YTN; PAM sequence: TTG
tattttaatctcatgctatt

SEQ ID NO: 200291 - DNA, 20 bp, Artificial Sequence
  Description of Artificial Sequence: Synthetic oligonucleotide
  Target: ATXN1; (-) strand; PAM type: YTN; PAM sequence: CTA
taaaggaagaaggcagcaat

SEQ ID NO: 200292 - DNA, 20 bp, Artificial Sequence
  Description of Artificial Sequence: Synthetic oligonucleotide
  Target: ATXN1; (-) strand; PAM type: YTN; PAM sequence: CTG
tgctataaaggaagaaggca

SEQ ID NO: 200293 - DNA, 20 bp, Artificial Sequence
  Description of Artificial Sequence: Synthetic oligonucleotide
  Target: ATXN1; (-) strand; PAM type: YTN; PAM sequence: TTA
tgagtgggaagtctgtgcta

SEQ ID NO: 200294 - DNA, 20 bp, Artificial Sequence
  Description of Artificial Sequence: Synthetic oligonucleotide
  Target: ATXN1; (-) strand; PAM type: YTN; PAM sequence: TTT
atgagtgggaagtctgtgct

SEQ ID NO: 200295 - DNA, 20 bp, Artificial Sequence
  Description of Artificial Sequence: Synthetic oligonucleotide
  Target: ATXN1; (-) strand; PAM type: YTN; PAM sequence: TTG
acaggagtttatgagtggga

SEQ ID NO: 200296 - DNA, 20 bp, Artificial Sequence
  Description of Artificial Sequence: Synthetic oligonucleotide
  Target: ATXN1; (-) strand; PAM type: YTN; PAM sequence: TTA
ccagcattgacaggagttta

SEQ ID NO: 200297 - DNA, 20 bp, Artificial Sequence
  Description of Artificial Sequence: Synthetic oligonucleotide
  Target: ATXN1; (-) strand; PAM type: YTN; PAM sequence: CTT
accagcattgacaggagttt

SEQ ID NO: 200298 - DNA, 20 bp, Artificial Sequence
  Description of Artificial Sequence: Synthetic oligonucleotide
  Target: ATXN1; (-) strand; PAM type: YTN; PAM sequence: TTC
ttaccagcattgacaggagt

SEQ ID NO: 200299 - DNA, 20 bp, Artificial Sequence
  Description of Artificial Sequence: Synthetic oligonucleotide
  Target: ATXN1; (-) strand; PAM type: YTN; PAM sequence: TTT
cttaccagcattgacaggag

SEQ ID NO: 200300 - DNA, 20 bp, Artificial Sequence
  Description of Artificial Sequence: Synthetic oligonucleotide
  Target: ATXN1; (-) strand; PAM type: YTN; PAM sequence: TTT
tcttaccagcattgacagga

SEQ ID NO: 200301 - DNA, 20 bp, Artificial Sequence
  Description of Artificial Sequence: Synthetic oligonucleotide
  Target: ATXN1; (-) strand; PAM type: YTN; PAM sequence: TTT
ttcttaccagcattgacagg

SEQ ID NO: 200302 - DNA, 20 bp, Artificial Sequence
  Description of Artificial Sequence: Synthetic oligonucleotide
  Target: ATXN1; (-) strand; PAM type: YTN; PAM sequence: CTG
atttttcttaccagcattga

SEQ ID NO: 200303 - DNA, 20 bp, Artificial Sequence
  Description of Artificial Sequence: Synthetic oligonucleotide
  Target: ATXN1; (-) strand; PAM type: YTN; PAM sequence: CTC
ccgcagtgataaaatagtag

SEQ ID NO: 200304 - DNA, 20 bp, Artificial Sequence
  Description of Artificial Sequence: Synthetic oligonucleotide
  Target: ATXN1; (-) strand; PAM type: YTN; PAM sequence: TTC
tcccgcagtgataaaatagt

SEQ ID NO: 200305 - DNA, 20 bp, Artificial Sequence
  Description of Artificial Sequence: Synthetic oligonucleotide
  Target: ATXN1; (-) strand; PAM type: YTN; PAM sequence: TTA
gttctcccgcagtgataaaa

SEQ ID NO: 200306 - DNA, 20 bp, Artificial Sequence
  Description of Artificial Sequence: Synthetic oligonucleotide
  Target: ATXN1; (-) strand; PAM type: YTN; PAM sequence: CTG
tgttagttctcccgcagtga

SEQ ID NO: 200307 - DNA, 20 bp, Artificial Sequence
  Description of Artificial Sequence: Synthetic oligonucleotide
  Target: ATXN1; (-) strand; PAM type: YTN; PAM sequence: TTG
cagaaaggtaaagtatgctg

SEQ ID NO: 200308 - DNA, 20 bp, Artificial Sequence
  Description of Artificial Sequence: Synthetic oligonucleotide
  Target: ATXN1; (-) strand; PAM type: YTN; PAM sequence: TTT
gcagaaaggtaaagtatgct

SEQ ID NO: 200309 - DNA, 20 bp, Artificial Sequence
  Description of Artificial Sequence: Synthetic oligonucleotide
  Target: ATXN1; (-) strand; PAM type: YTN; PAM sequence: TTA
tttgcagaaaggtaaagtat

SEQ ID NO: 200310 - DNA, 20 bp, Artificial Sequence
  Description of Artificial Sequence: Synthetic oligonucleotide
  Target: ATXN1; (-) strand; PAM type: YTN; PAM sequence: CTG
acggaattatttgcagaaag

SEQ ID NO: 200311 - DNA, 20 bp, Artificial Sequence
  Description of Artificial Sequence: Synthetic oligonucleotide
  Target: ATXN1; (-) strand; PAM type: YTN; PAM sequence: CTG
aatctgacggaattatttgc

SEQ ID NO: 200312 - DNA, 20 bp, Artificial Sequence
  Description of Artificial Sequence: Synthetic oligonucleotide
  Target: ATXN1; (-) strand; PAM type: YTN; PAM sequence: TTG
gaaatgctgaatctgacgga

SEQ ID NO: 200313 - DNA, 20 bp, Artificial Sequence
  Description of Artificial Sequence: Synthetic oligonucleotide
  Target: ATXN1; (-) strand; PAM type: YTN; PAM sequence: TTT
ggaaatgctgaatctgacgg

SEQ ID NO: 200314 - DNA, 20 bp, Artificial Sequence
  Description of Artificial Sequence: Synthetic oligonucleotide
  Target: ATXN1; (-) strand; PAM type: YTN; PAM sequence: TTT
tggaaatgctgaatctgacg

SEQ ID NO: 200315 - DNA, 20 bp, Artificial Sequence
  Description of Artificial Sequence: Synthetic oligonucleotide
  Target: ATXN1; (-) strand; PAM type: YTN; PAM sequence: TTA
taatgagtagaaaacgtttt

SEQ ID NO: 200316 - DNA, 20 bp, Artificial Sequence
  Description of Artificial Sequence: Synthetic oligonucleotide
  Target: ATXN1; (-) strand; PAM type: YTN; PAM sequence: TTT
ataatgagtagaaaacgttt

SEQ ID NO: 200317 - DNA, 20 bp, Artificial Sequence
  Description of Artificial Sequence: Synthetic oligonucleotide
  Target: ATXN1; (-) strand; PAM type: YTN; PAM sequence: TTT
tataatgagtagaaaacgtt

SEQ ID NO: 200318 - DNA, 20 bp, Artificial Sequence
  Description of Artificial Sequence: Synthetic oligonucleotide
  Target: ATXN1; (-) strand; PAM type: YTN; PAM sequence: CTT
ttataatgagtagaaaacgt

SEQ ID NO: 200319 - DNA, 20 bp, Artificial Sequence
  Description of Artificial Sequence: Synthetic oligonucleotide
  Target: ATXN1; (-) strand; PAM type: YTN; PAM sequence: TTG
tagggcttttataatgagta

SEQ ID NO: 200320 - DNA, 20 bp, Artificial Sequence
  Description of Artificial Sequence: Synthetic oligonucleotide
  Target: ATXN1; (-) strand; PAM type: YTN; PAM sequence: TTT
gtagggcttttataatgagt

SEQ ID NO: 200321 - DNA, 20 bp, Artificial Sequence
  Description of Artificial Sequence: Synthetic oligonucleotide
  Target: ATXN1; (-) strand; PAM type: YTN; PAM sequence: TTG
gcgtttgtagggcttttata

SEQ ID NO: 200322 - DNA, 20 bp, Artificial Sequence
  Description of Artificial Sequence: Synthetic oligonucleotide
  Target: ATXN1; (-) strand; PAM type: YTN; PAM sequence: TTT
ggcgtttgtagggcttttat

SEQ ID NO: 200323 - DNA, 20 bp, Artificial Sequence
  Description of Artificial Sequence: Synthetic oligonucleotide
  Target: ATXN1; (-) strand; PAM type: YTN; PAM sequence: TTG
tccatttggcgtttgtaggg

SEQ ID NO: 200324 - DNA, 20 bp, Artificial Sequence
  Description of Artificial Sequence: Synthetic oligonucleotide
  Target: ATXN1; (-) strand; PAM type: YTN; PAM sequence: TTA
ttgtccatttggcgtttgta

SEQ ID NO: 200325 - DNA, 20 bp, Artificial Sequence
  Description of Artificial Sequence: Synthetic oligonucleotide
  Target: ATXN1; (-) strand; PAM type: YTN; PAM sequence: TTT
attgtccatttggcgtttgt

SEQ ID NO: 200326 - DNA, 20 bp, Artificial Sequence
  Description of Artificial Sequence: Synthetic oligonucleotide
  Target: ATXN1; (-) strand; PAM type: YTN; PAM sequence: CTG
tttattgtccatttggcgtt

SEQ ID NO: 200327 - DNA, 20 bp, Artificial Sequence
  Description of Artificial Sequence: Synthetic oligonucleotide
  Target: ATXN1; (-) strand; PAM type: YTN; PAM sequence: TTG
gggtggagcctgtttattgt

SEQ ID NO: 200328 - DNA, 20 bp, Artificial Sequence
  Description of Artificial Sequence: Synthetic oligonucleotide
  Target: ATXN1; (-) strand; PAM type: YTN; PAM sequence: TTT
ggggtggagcctgtttattg

SEQ ID NO: 200329 - DNA, 20 bp, Artificial Sequence
  Description of Artificial Sequence: Synthetic oligonucleotide
  Target: ATXN1; (-) strand; PAM type: YTN; PAM sequence: CTT
tggggtggagcctgtttatt

SEQ ID NO: 200330 - DNA, 20 bp, Artificial Sequence
  Description of Artificial Sequence: Synthetic oligonucleotide
  Target: ATXN1; (-) strand; PAM type: YTN; PAM sequence: CTG
cctttggggtggagcctgtt

SEQ ID NO: 200331 - DNA, 20 bp, Artificial Sequence
  Description of Artificial Sequence: Synthetic oligonucleotide
  Target: ATXN1; (-) strand; PAM type: YTN; PAM sequence: TTA
acagtgagcctgcctttggg

SEQ ID NO: 200332 - DNA, 20 bp, Artificial Sequence
  Description of Artificial Sequence: Synthetic oligonucleotide
  Target: ATXN1; (-) strand; PAM type: YTN; PAM sequence: TTC
ccccattaacagtgagcctg

SEQ ID NO: 200333 - DNA, 20 bp, Artificial Sequence
  Description of Artificial Sequence: Synthetic oligonucleotide
  Target: ATXN1; (-) strand; PAM type: YTN; PAM sequence: CTC
atgttcccccattaacagtg

SEQ ID NO: 200334 - DNA, 20 bp, Artificial Sequence
  Description of Artificial Sequence: Synthetic oligonucleotide
  Target: ATXN1; (-) strand; PAM type: YTN; PAM sequence: TTC
tcatgttcccccattaacag

SEQ ID NO: 200335 - DNA, 20 bp, Artificial Sequence
  Description of Artificial Sequence: Synthetic oligonucleotide
  Target: ATXN1; (-) strand; PAM type: YTN; PAM sequence: CTT
ctcatgttcccccattaaca

SEQ ID NO: 200336 - DNA, 20 bp, Artificial Sequence
  Description of Artificial Sequence: Synthetic oligonucleotide
  Target: ATXN1; (-) strand; PAM type: YTN; PAM sequence: TTA
atgggatgcttctcatgttc

SEQ ID NO: 200337 - DNA, 20 bp, Artificial Sequence
  Description of Artificial Sequence: Synthetic oligonucleotide
  Target: ATXN1; (-) strand; PAM type: YTN; PAM sequence: TTT
aatgggatgcttctcatgtt

SEQ ID NO: 200338 - DNA, 20 bp, Artificial Sequence
  Description of Artificial Sequence: Synthetic oligonucleotide
  Target: ATXN1; (-) strand; PAM type: YTN; PAM sequence: TTT
taatgggatgcttctcatgt

SEQ ID NO: 200339 - DNA, 20 bp, Artificial Sequence
  Description of Artificial Sequence: Synthetic oligonucleotide
  Target: ATXN1; (-) strand; PAM type: YTN; PAM sequence: TTT
ttaatgggatgcttctcatg

SEQ ID NO: 200340 - DNA, 20 bp, Artificial Sequence
  Description of Artificial Sequence: Synthetic oligonucleotide
  Target: ATXN1; (-) strand; PAM type: YTN; PAM sequence: CTA
tttttaatgggatgcttctc

SEQ ID NO: 200341 - DNA, 20 bp, Artificial Sequence
  Description of Artificial Sequence: Synthetic oligonucleotide
  Target: ATXN1; (-) strand; PAM type: YTN; PAM sequence: TTC
ctatttttaatgggatgctt

SEQ ID NO: 200342 - DNA, 20 bp, Artificial Sequence
  Description of Artificial Sequence: Synthetic oligonucleotide
  Target: ATXN1; (-) strand; PAM type: YTN; PAM sequence: TTG
ttcctatttttaatgggatg

SEQ ID NO: 200343 - DNA, 20 bp, Artificial Sequence
  Description of Artificial Sequence: Synthetic oligonucleotide
  Target: ATXN1; (-) strand; PAM type: YTN; PAM sequence: CTC
atgttgttcctatttttaat

SEQ ID NO: 200344 - DNA, 20 bp, Artificial Sequence
  Description of Artificial Sequence: Synthetic oligonucleotide
  Target: ATXN1; (-) strand; PAM type: YTN; PAM sequence: TTA
aataacagagatgatggtag

SEQ ID NO: 200345 - DNA, 20 bp, Artificial Sequence
  Description of Artificial Sequence: Synthetic oligonucleotide
  Target: ATXN1; (-) strand; PAM type: YTN; PAM sequence: TTA
acagatcagtgttaaataac

SEQ ID NO: 200346 - DNA, 20 bp, Artificial Sequence
  Description of Artificial Sequence: Synthetic oligonucleotide
  Target: ATXN1; (-) strand; PAM type: YTN; PAM sequence: TTT
aacagatcagtgttaaataa

SEQ ID NO: 200347 - DNA, 20 bp, Artificial Sequence
  Description of Artificial Sequence: Synthetic oligonucleotide
  Target: ATXN1; (-) strand; PAM type: YTN; PAM sequence: CTA
agtttaacagatcagtgtta

SEQ ID NO: 200348 - DNA, 20 bp, Artificial Sequence
  Description of Artificial Sequence: Synthetic oligonucleotide
  Target: ATXN1; (-) strand; PAM type: YTN; PAM sequence: TTG
gctaagtttaacagatcagt

SEQ ID NO: 200349 - DNA, 20 bp, Artificial Sequence
  Description of Artificial Sequence: Synthetic oligonucleotide
  Target: ATXN1; (-) strand; PAM type: YTN; PAM sequence: TTA
aattggctaagtttaacaga

SEQ ID NO: 200350 - DNA, 20 bp, Artificial Sequence
  Description of Artificial Sequence: Synthetic oligonucleotide
  Target: ATXN1; (-) strand; PAM type: YTN; PAM sequence: TTA
tgcagttaaattggctaagt

SEQ ID NO: 200351 - DNA, 20 bp, Artificial Sequence
  Description of Artificial Sequence: Synthetic oligonucleotide
  Target: ATXN1; (-) strand; PAM type: YTN; PAM sequence: CTT
atgcagttaaattggctaag

SEQ ID NO: 200352 - DNA, 20 bp, Artificial Sequence
  Description of Artificial Sequence: Synthetic oligonucleotide
  Target: ATXN1; (-) strand; PAM type: YTN; PAM sequence: CTC
ttatgcagttaaattggcta

SEQ ID NO: 200353 - DNA, 20 bp, Artificial Sequence
  Description of Artificial Sequence: Synthetic oligonucleotide
  Target: ATXN1; (-) strand; PAM type: YTN; PAM sequence: TTC
tcttatgcagttaaattggc

SEQ ID NO: 200354 - DNA, 20 bp, Artificial Sequence
  Description of Artificial Sequence: Synthetic oligonucleotide
  Target: ATXN1; (-) strand; PAM type: YTN; PAM sequence: TTT
ctcttatgcagttaaattgg

SEQ ID NO: 200355 - DNA, 20 bp, Artificial Sequence
  Description of Artificial Sequence: Synthetic oligonucleotide
  Target: ATXN1; (-) strand; PAM type: YTN; PAM sequence: TTA
tttctcttatgcagttaaat

SEQ ID NO: 200356 - DNA, 20 bp, Artificial Sequence
  Description of Artificial Sequence: Synthetic oligonucleotide
  Target: ATXN1; (-) strand; PAM type: YTN; PAM sequence: TTT
atttctcttatgcagttaaa

SEQ ID NO: 200357 - DNA, 20 bp, Artificial Sequence
  Description of Artificial Sequence: Synthetic oligonucleotide
  Target: ATXN1; (-) strand; PAM type: YTN; PAM sequence: TTA
tttatttctcttatgcagtt

SEQ ID NO: 200358 - DNA, 20 bp, Artificial Sequence
  Description of Artificial Sequence: Synthetic oligonucleotide
  Target: ATXN1; (-) strand; PAM type: YTN; PAM sequence: CTT
atttatttctcttatgcagt

SEQ ID NO: 200359 - DNA, 20 bp, Artificial Sequence
  Description of Artificial Sequence: Synthetic oligonucleotide
  Target: ATXN1; (-) strand; PAM type: YTN; PAM sequence: TTA
tatcccttatttatttctct

SEQ ID NO: 200360 - DNA, 20 bp, Artificial Sequence
  Description of Artificial Sequence: Synthetic oligonucleotide
  Target: ATXN1; (-) strand; PAM type: YTN; PAM sequence: TTT
atatcccttatttatttctc

SEQ ID NO: 200361 - DNA, 20 bp, Artificial Sequence
  Description of Artificial Sequence: Synthetic oligonucleotide
  Target: ATXN1; (-) strand; PAM type: YTN; PAM sequence: TTT
tatatcccttatttatttct

SEQ ID NO: 200362 - DNA, 20 bp, Artificial Sequence
  Description of Artificial Sequence: Synthetic oligonucleotide
  Target: ATXN1; (-) strand; PAM type: YTN; PAM sequence: TTT
ttatatcccttatttatttc

SEQ ID NO: 200363 - DNA, 20 bp, Artificial Sequence
  Description of Artificial Sequence: Synthetic oligonucleotide
  Target: ATXN1; (-) strand; PAM type: YTN; PAM sequence: TTA
taatttttatatcccttatt

SEQ ID NO: 200364 - DNA, 20 bp, Artificial Sequence
  Description of Artificial Sequence: Synthetic oligonucleotide
  Target: ATXN1; (-) strand; PAM type: YTN; PAM sequence: CTG
ttataatttttatatccctt

SEQ ID NO: 200365 - DNA, 20 bp, Artificial Sequence
  Description of Artificial Sequence: Synthetic oligonucleotide
  Target: ATXN1; (-) strand; PAM type: YTN; PAM sequence: CTG
cctgttataatttttatatc

SEQ ID NO: 200366 - DNA, 20 bp, Artificial Sequence
  Description of Artificial Sequence: Synthetic oligonucleotide
  Target: ATXN1; (-) strand; PAM type: YTN; PAM sequence: TTC
tgcctgttataatttttata

SEQ ID NO: 200367 - DNA, 20 bp, Artificial Sequence
  Description of Artificial Sequence: Synthetic oligonucleotide
  Target: ATXN1; (-) strand; PAM type: YTN; PAM sequence: TTT
ctgcctgttataatttttat

SEQ ID NO: 200368 - DNA, 20 bp, Artificial Sequence
  Description of Artificial Sequence: Synthetic oligonucleotide
  Target: ATXN1; (-) strand; PAM type: YTN; PAM sequence: TTT
tctgcctgttataattttta

SEQ ID NO: 200369 - DNA, 20 bp, Artificial Sequence
  Description of Artificial Sequence: Synthetic oligonucleotide
  Target: ATXN1; (-) strand; PAM type: YTN; PAM sequence: TTT
ttctgcctgttataattttt

SEQ ID NO: 200370 - DNA, 20 bp, Artificial Sequence
  Description of Artificial Sequence: Synthetic oligonucleotide
  Target: ATXN1; (-) strand; PAM type: YTN; PAM sequence: TTA
taaataataatttttctgcc

SEQ ID NO: 200371 - DNA, 20 bp, Artificial Sequence
  Description of Artificial Sequence: Synthetic oligonucleotide
  Target: ATXN1; (-) strand; PAM type: YTN; PAM sequence: TTT
ataaataataatttttctgc

SEQ ID NO: 200372 - DNA, 20 bp, Artificial Sequence
  Description of Artificial Sequence: Synthetic oligonucleotide
  Target: ATXN1; (-) strand; PAM type: YTN; PAM sequence: CTC
agatcatagcatttataaat

SEQ ID NO: 200373 - DNA, 20 bp, Artificial Sequence
  Description of Artificial Sequence: Synthetic oligonucleotide
  Target: ATXN1; (-) strand; PAM type: YTN; PAM sequence: TTG
ctcagatcatagcatttata

SEQ ID NO: 200374 - DNA, 20 bp, Artificial Sequence
  Description of Artificial Sequence: Synthetic oligonucleotide
  Target: ATXN1; (-) strand; PAM type: YTN; PAM sequence: CTT
gctcagatcatagcatttat

SEQ ID NO: 200375 - DNA, 20 bp, Artificial Sequence
  Description of Artificial Sequence: Synthetic oligonucleotide
  Target: ATXN1; (-) strand; PAM type: YTN; PAM sequence: TTG
acttgctcagatcatagcat

SEQ ID NO: 200376 - DNA, 20 bp, Artificial Sequence
  Description of Artificial Sequence: Synthetic oligonucleotide
  Target: ATXN1; (-) strand; PAM type: YTN; PAM sequence: TTC
aattgacttgctcagatcat

SEQ ID NO: 200377 - DNA, 20 bp, Artificial Sequence
  Description of Artificial Sequence: Synthetic oligonucleotide
  Target: ATXN1; (-) strand; PAM type: YTN; PAM sequence: TTG
ttcaattgacttgctcagat

SEQ ID NO: 200378 - DNA, 20 bp, Artificial Sequence
  Description of Artificial Sequence: Synthetic oligonucleotide
  Target: ATXN1; (-) strand; PAM type: YTN; PAM sequence: TTA
ataagttgttcaattgactt

SEQ ID NO: 200379 - DNA, 20 bp, Artificial Sequence
  Description of Artificial Sequence: Synthetic oligonucleotide
  Target: ATXN1; (-) strand; PAM type: YTN; PAM sequence: CTA
attaataagttgttcaattg

SEQ ID NO: 200380 - DNA, 20 bp, Artificial Sequence
  Description of Artificial Sequence: Synthetic oligonucleotide
  Target: ATXN1; (-) strand; PAM type: YTN; PAM sequence: CTC
taattaataagttgttcaat

SEQ ID NO: 200381 - DNA, 20 bp, Artificial Sequence
  Description of Artificial Sequence: Synthetic oligonucleotide
  Target: ATXN1; (-) strand; PAM type: YTN; PAM sequence: TTC
tctaattaataagttgttca

SEQ ID NO: 200382 - DNA, 20 bp, Artificial Sequence
  Description of Artificial Sequence: Synthetic oligonucleotide
  Target: ATXN1; (-) strand; PAM type: YTN; PAM sequence: CTA
cagaattctctaattaataa

SEQ ID NO: 200383 - DNA, 20 bp, Artificial Sequence
  Description of Artificial Sequence: Synthetic oligonucleotide
  Target: ATXN1; (-) strand; PAM type: YTN; PAM sequence: TTA
ccctacagaattctctaatt

SEQ ID NO: 200384 - DNA, 20 bp, Artificial Sequence
  Description of Artificial Sequence: Synthetic oligonucleotide
  Target: ATXN1; (-) strand; PAM type: YTN; PAM sequence: TTC
agttaccctacagaattctc

SEQ ID NO: 200385 - DNA, 20 bp, Artificial Sequence
  Description of Artificial Sequence: Synthetic oligonucleotide
  Target: ATXN1; (-) strand; PAM type: YTN; PAM sequence: TTT
cagttaccctacagaattct

SEQ ID NO: 200386 - DNA, 20 bp, Artificial Sequence
  Description of Artificial Sequence: Synthetic oligonucleotide
  Target: ATXN1; (-) strand; PAM type: YTN; PAM sequence: TTG
tttcagttaccctacagaat

SEQ ID NO: 200387 - DNA, 20 bp, Artificial Sequence
  Description of Artificial Sequence: Synthetic oligonucleotide
  Target: ATXN1; (-) strand; PAM type: YTN; PAM sequence: TTT
gtttcagttaccctacagaa

SEQ ID NO: 200388 - DNA, 20 bp, Artificial Sequence
  Description of Artificial Sequence: Synthetic oligonucleotide
  Target: ATXN1; (-) strand; PAM type: YTN; PAM sequence: TTT
tgtttcagttaccctacaga

SEQ ID NO: 200389 - DNA, 20 bp, Artificial Sequence
  Description of Artificial Sequence: Synthetic oligonucleotide
  Target: ATXN1; (-) strand; PAM type: YTN; PAM sequence: CTT
ttgtttcagttaccctacag

SEQ ID NO: 200390 - DNA, 20 bp, Artificial Sequence
  Description of Artificial Sequence: Synthetic oligonucleotide
  Target: ATXN1; (-) strand; PAM type: YTN; PAM sequence: TTC
ttttgtttcagttaccctac

SEQ ID NO: 200391 - DNA, 20 bp, Artificial Sequence
  Description of Artificial Sequence: Synthetic oligonucleotide
  Target: ATXN1; (-) strand; PAM type: YTN; PAM sequence: TTG
tatattcttttgtttcagtt

SEQ ID NO: 200392 - DNA, 20 bp, Artificial Sequence
  Description of Artificial Sequence: Synthetic oligonucleotide
  Target: ATXN1; (-) strand; PAM type: YTN; PAM sequence: TTT
gtatattcttttgtttcagt

SEQ ID NO: 200393 - DNA, 20 bp, Artificial Sequence
  Description of Artificial Sequence: Synthetic oligonucleotide
  Target: ATXN1; (-) strand; PAM type: YTN; PAM sequence: TTT
tgtatattcttttgtttcag

SEQ ID NO: 200394 - DNA, 20 bp, Artificial Sequence
  Description of Artificial Sequence: Synthetic oligonucleotide
  Target: ATXN1; (-) strand; PAM type: YTN; PAM sequence: TTT
ttgtatattcttttgtttca

SEQ ID NO: 200395 - DNA, 20 bp, Artificial Sequence
  Description of Artificial Sequence: Synthetic oligonucleotide
  Target: ATXN1; (-) strand; PAM type: YTN; PAM sequence: TTG
atttttgtatattcttttgt

SEQ ID NO: 200396 - DNA, 20 bp, Artificial Sequence
  Description of Artificial Sequence: Synthetic oligonucleotide
  Target: ATXN1; (-) strand; PAM type: YTN; PAM sequence: TTA
ttgatttttgtatattcttt

SEQ ID NO: 200397 - DNA, 20 bp, Artificial Sequence
  Description of Artificial Sequence: Synthetic oligonucleotide
  Target: ATXN1; (-) strand; PAM type: YTN; PAM sequence: TTA
gaaaggttattgatttttgt

SEQ ID NO: 200398 - DNA, 20 bp, Artificial Sequence
  Description of Artificial Sequence: Synthetic oligonucleotide
  Target: ATXN1; (-) strand; PAM type: YTN; PAM sequence: TTT
agaaaggttattgatttttg

SEQ ID NO: 200399 - DNA, 20 bp, Artificial Sequence
  Description of Artificial Sequence: Synthetic oligonucleotide
  Target: ATXN1; (-) strand; PAM type: YTN; PAM sequence: CTT
tagaaaggttattgattttt

SEQ ID NO: 200400 - DNA, 20 bp, Artificial Sequence
  Description of Artificial Sequence: Synthetic oligonucleotide
  Target: ATXN1; (-) strand; PAM type: YTN; PAM sequence: TTG
tcctttagaaaggttattga

SEQ ID NO: 200401 - DNA, 20 bp, Artificial Sequence
  Description of Artificial Sequence: Synthetic oligonucleotide
  Target: ATXN1; (-) strand; PAM type: YTN; PAM sequence: CTG
gttgtcctttagaaaggtta

SEQ ID NO: 200402 - DNA, 20 bp, Artificial Sequence
  Description of Artificial Sequence: Synthetic oligonucleotide
  Target: ATXN1; (-) strand; PAM type: YTN; PAM sequence: TTA
ctggttgtcctttagaaagg

SEQ ID NO: 200403 - DNA, 20 bp, Artificial Sequence
  Description of Artificial Sequence: Synthetic oligonucleotide
  Target: ATXN1; (-) strand; PAM type: YTN; PAM sequence: TTT
actggttgtcctttagaaag

SEQ ID NO: 200404 - DNA, 20 bp, Artificial Sequence
  Description of Artificial Sequence: Synthetic oligonucleotide
  Target: ATXN1; (-) strand; PAM type: YTN; PAM sequence: TTT
tactggttgtcctttagaaa

SEQ ID NO: 200405 - DNA, 20 bp, Artificial Sequence
  Description of Artificial Sequence: Synthetic oligonucleotide
  Target: ATXN1; (-) strand; PAM type: YTN; PAM sequence: TTT
ttactggttgtcctttagaa

SEQ ID NO: 200406 - DNA, 20 bp, Artificial Sequence
  Description of Artificial Sequence: Synthetic oligonucleotide
  Target: ATXN1; (-) strand; PAM type: YTN; PAM sequence: CTT
tttactggttgtcctttaga

SEQ ID NO: 200407 - DNA, 20 bp, Artificial Sequence
  Description of Artificial Sequence: Synthetic oligonucleotide
  Target: ATXN1; (-) strand; PAM type: YTN; PAM sequence: TTA
aatatgggatacctttttac

SEQ ID NO: 200408 - DNA, 20 bp, Artificial Sequence
  Description of Artificial Sequence: Synthetic oligonucleotide
  Target: ATXN1; (-) strand; PAM type: YTN; PAM sequence: TTT
aaatatgggataccttttta

SEQ ID NO: 200409 - DNA, 20 bp, Artificial Sequence
  Description of Artificial Sequence: Synthetic oligonucleotide
  Target: ATXN1; (-) strand; PAM type: YTN; PAM sequence: TTA
tttaaatatgggataccttt

SEQ ID NO: 200410 - DNA, 20 bp, Artificial Sequence
  Description of Artificial Sequence: Synthetic oligonucleotide
  Target: ATXN1; (-) strand; PAM type: YTN; PAM sequence: TTG
ttatttaaatatgggatacc

SEQ ID NO: 200411 - DNA, 20 bp, Artificial Sequence
  Description of Artificial Sequence: Synthetic oligonucleotide
  Target: ATXN1; (-) strand; PAM type: YTN; PAM sequence: TTG
ttgttatttaaatatgggat

SEQ ID NO: 200412 - DNA, 20 bp, Artificial Sequence
  Description of Artificial Sequence: Synthetic oligonucleotide
  Target: ATXN1; (-) strand; PAM type: YTN; PAM sequence: TTT
gttgttatttaaatatggga

SEQ ID NO: 200413 - DNA, 20 bp, Artificial Sequence
  Description of Artificial Sequence: Synthetic oligonucleotide
  Target: ATXN1; (-) strand; PAM type: YTN; PAM sequence: TTT
tgttgttatttaaatatggg

SEQ ID NO: 200414 - DNA, 20 bp, Artificial Sequence
  Description of Artificial Sequence: Synthetic oligonucleotide
  Target: ATXN1; (-) strand; PAM type: YTN; PAM sequence: TTT
ttgttgttatttaaatatgg

SEQ ID NO: 200415 - DNA, 20 bp, Artificial Sequence
  Description of Artificial Sequence: Synthetic oligonucleotide
  Target: ATXN1; (-) strand; PAM type: YTN; PAM sequence: TTA
tatttttgttgttatttaaa

SEQ ID NO: 200416 - DNA, 20 bp, Artificial Sequence
  Description of Artificial Sequence: Synthetic oligonucleotide
  Target: ATXN1; (-) strand; PAM type: YTN; PAM sequence: TTT
atatttttgttgttatttaa

SEQ ID NO: 200417 - DNA, 20 bp, Artificial Sequence
  Description of Artificial Sequence: Synthetic oligonucleotide
  Target: ATXN1; (-) strand; PAM type: YTN; PAM sequence: TTT
tatatttttgttgttattta

SEQ ID NO: 200418 - DNA, 20 bp, Artificial Sequence
  Description of Artificial Sequence: Synthetic oligonucleotide
  Target: ATXN1; (-) strand; PAM type: YTN; PAM sequence: CTA
ggcattttatatttttgttg

SEQ ID NO: 200419 - DNA, 20 bp, Artificial Sequence
  Description of Artificial Sequence: Synthetic oligonucleotide
  Target: ATXN1; (-) strand; PAM type: YTN; PAM sequence: TTA
tccctaggcattttatattt

SEQ ID NO: 200420 - DNA, 20 bp, Artificial Sequence
  Description of Artificial Sequence: Synthetic oligonucleotide
  Target: ATXN1; (-) strand; PAM type: YTN; PAM sequence: TTT
atccctaggcattttatatt

SEQ ID NO: 200421 - DNA, 20 bp, Artificial Sequence
  Description of Artificial Sequence: Synthetic oligonucleotide
  Target: ATXN1; (-) strand; PAM type: YTN; PAM sequence: TTC
agtttatccctaggcatttt

SEQ ID NO: 200422 - DNA, 20 bp, Artificial Sequence
  Description of Artificial Sequence: Synthetic oligonucleotide
  Target: ATXN1; (-) strand; PAM type: YTN; PAM sequence: CTT
cagtttatccctaggcattt

SEQ ID NO: 200423 - DNA, 20 bp, Artificial Sequence
  Description of Artificial Sequence: Synthetic oligonucleotide
  Target: ATXN1; (-) strand; PAM type: YTN; PAM sequence: CTC
cttcagtttatccctaggca

SEQ ID NO: 200424 - DNA, 20 bp, Artificial Sequence
  Description of Artificial Sequence: Synthetic oligonucleotide
  Target: ATXN1; (-) strand; PAM type: YTN; PAM sequence: TTG
catatagtcctccttcagtt

SEQ ID NO: 200425 - DNA, 20 bp, Artificial Sequence
  Description of Artificial Sequence: Synthetic oligonucleotide
  Target: ATXN1; (-) strand; PAM type: YTN; PAM sequence: CTT
gcatatagtcctccttcagt

SEQ ID NO: 200426 - DNA, 20 bp, Artificial Sequence
  Description of Artificial Sequence: Synthetic oligonucleotide
  Target: ATXN1; (-) strand; PAM type: YTN; PAM sequence: TTA
tgtagatcttgcatatagtc

SEQ ID NO: 200427 - DNA, 20 bp, Artificial Sequence
  Description of Artificial Sequence: Synthetic oligonucleotide
  Target: ATXN1; (-) strand; PAM type: YTN; PAM sequence: TTT
atgtagatcttgcatatagt

SEQ ID NO: 200428 - DNA, 20 bp, Artificial Sequence
  Description of Artificial Sequence: Synthetic oligonucleotide
  Target: ATXN1; (-) strand; PAM type: YTN; PAM sequence: CTT
tatgtagatcttgcatatag

SEQ ID NO: 200429 - DNA, 20 bp, Artificial Sequence
  Description of Artificial Sequence: Synthetic oligonucleotide
  Target: ATXN1; (-) strand; PAM type: YTN; PAM sequence: CTC
tttatgtagatcttgcatat

SEQ ID NO: 200430 - DNA, 20 bp, Artificial Sequence
  Description of Artificial Sequence: Synthetic oligonucleotide
  Target: ATXN1; (-) strand; PAM type: YTN; PAM sequence: CTG
cacccagccctctttatgta

SEQ ID NO: 200431 - DNA, 20 bp, Artificial Sequence
  Description of Artificial Sequence: Synthetic oligonucleotide
  Target: ATXN1; (-) strand; PAM type: YTN; PAM sequence: CTG
agccactgcacccagccctc

SEQ ID NO: 200432 - DNA, 20 bp, Artificial Sequence
  Description of Artificial Sequence: Synthetic oligonucleotide
  Target: ATXN1; (-) strand; PAM type: YTN; PAM sequence: CTG
gaataataggcctgagccac

SEQ ID NO: 200433 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctggaataatag

SEQ ID NO: 200434 - DNA, 20 bp, Artificial Sequence
  Description of Artificial Sequence: Synthetic oligonucleotide
  Target: ATXN1; (-) strand; PAM type: YTN; PAM sequence: CTC
gccctcccaaagtgctggaa

SEQ ID NO: 200435 - DNA, 20 bp, Artificial Sequence
  Description of Artificial Sequence: Synthetic oligonucleotide
  Target: ATXN1; (-) strand; PAM type: YTN; PAM sequence: CTG
cccacctcgccctcccaaag

SEQ ID NO: 200436 - DNA, 20 bp, Artificial Sequence
  Description of Artificial Sequence: Synthetic oligonucleotide
  Target: ATXN1; (-) strand; PAM type: YTN; PAM sequence: CTC
aagtgatctgcccacctcgc

SEQ ID NO: 200437 - DNA, 20 bp, Artificial Sequence
  Description of Artificial Sequence: Synthetic oligonucleotide
  Target: ATXN1; (-) strand; PAM type: YTN; PAM sequence: CTG
acctcaagtgatctgcccac

SEQ ID NO: 200438 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaagtgatctgcc

SEQ ID NO: 200439 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaagtga

SEQ ID NO: 200440 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 200441 - DNA, 20 bp, Artificial Sequence
  Description of Artificial Sequence: Synthetic oligonucleotide
  Target: ATXN1; (-) strand; PAM type: YTN; PAM sequence: TTA
ggctggtctcgaactcctga

SEQ ID NO: 200442 - DNA, 20 bp, Artificial Sequence
  Description of Artificial Sequence: Synthetic oligonucleotide
  Target: ATXN1; (-) strand; PAM type: YTN; PAM sequence: TTG
gttaggctggtctcgaactc

SEQ ID NO: 200443 - DNA, 20 bp, Artificial Sequence
  Description of Artificial Sequence: Synthetic oligonucleotide
  Target: ATXN1; (-) strand; PAM type: YTN; PAM sequence: TTT
ggttaggctggtctcgaact

SEQ ID NO: 200444 - DNA, 20 bp, Artificial Sequence
  Description of Artificial Sequence: Synthetic oligonucleotide
  Target: ATXN1; (-) strand; PAM type: YTN; PAM sequence: TTA
ccatgtttggttaggctggt

SEQ ID NO: 200445 - DNA, 20 bp, Artificial Sequence
  Description of Artificial Sequence: Synthetic oligonucleotide
  Target: ATXN1; (-) strand; PAM type: YTN; PAM sequence: TTT
accatgtttggttaggctgg

SEQ ID NO: 200446 - DNA, 20 bp, Artificial Sequence
  Description of Artificial Sequence: Synthetic oligonucleotide
  Target: ATXN1; (-) strand; PAM type: YTN; PAM sequence: TTT
taccatgtttggttaggctg

SEQ ID NO: 200447 - DNA, 20 bp, Artificial Sequence
  Description of Artificial Sequence: Synthetic oligonucleotide
  Target: ATXN1; (-) strand; PAM type: YTN; PAM sequence: TTA
gtagagacggcgttttacca

SEQ ID NO: 200448 - DNA, 20 bp, Artificial Sequence
  Description of Artificial Sequence: Synthetic oligonucleotide
  Target: ATXN1; (-) strand; PAM type: YTN; PAM sequence: TTT
agtagagacggcgttttacc

SEQ ID NO: 200449 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggcgttttac

SEQ ID NO: 200450 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggcgtttta

SEQ ID NO: 200451 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacggcg

SEQ ID NO: 200452 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggc

SEQ ID NO: 200453 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 200454 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 200455 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 200456 - DNA, 20 bp, Artificial Sequence
  Description of Artificial Sequence: Synthetic oligonucleotide
  Target: ATXN1; (-) strand; PAM type: YTN; PAM sequence: TTT
ttttgtatttttagtagaga

SEQ ID NO: 200457 - DNA, 20 bp, Artificial Sequence
  Description of Artificial Sequence: Synthetic oligonucleotide
  Target: ATXN1; (-) strand; PAM type: YTN; PAM sequence: CTA
atttttttgtatttttagta

SEQ ID NO: 200458 - DNA, 20 bp, Artificial Sequence
  Description of Artificial Sequence: Synthetic oligonucleotide
  Target: ATXN1; (-) strand; PAM type: YTN; PAM sequence: CTG
gctaatttttttgtattttt

SEQ ID NO: 200459 - DNA, 20 bp, Artificial Sequence
  Description of Artificial Sequence: Synthetic oligonucleotide
  Target: ATXN1; (-) strand; PAM type: YTN; PAM sequence: CTG
ccaccacacctggctaattt

SEQ ID NO: 200460 - DNA, 20 bp, Artificial Sequence
  Description of Artificial Sequence: Synthetic oligonucleotide
  Target: ATXN1; (-) strand; PAM type: YTN; PAM sequence: CTA
caggtgtctgccaccacacc

SEQ ID NO: 200461 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgtctgccac

SEQ ID NO: 200462 - DNA, 20 bp, Artificial Sequence
  Description of Artificial Sequence: Synthetic oligonucleotide
  Target: ATXN1; (-) strand; PAM type: YTN; PAM sequence: CTC
cccagtaactgggactacag

SEQ ID NO: 200463 - DNA, 20 bp, Artificial Sequence
  Description of Artificial Sequence: Synthetic oligonucleotide
  Target: ATXN1; (-) strand; PAM type: YTN; PAM sequence: TTA
gcctccccagtaactgggac

SEQ ID NO: 200464 - DNA, 20 bp, Artificial Sequence
  Description of Artificial Sequence: Synthetic oligonucleotide
  Target: ATXN1; (-) strand; PAM type: YTN; PAM sequence: CTT
agcctccccagtaactggga

SEQ ID NO: 200465 - DNA, 20 bp, Artificial Sequence
  Description of Artificial Sequence: Synthetic oligonucleotide
  Target: ATXN1; (-) strand; PAM type: YTN; PAM sequence: TTG
tgccttagcctccccagtaa

SEQ ID NO: 200466 - DNA, 20 bp, Artificial Sequence
  Description of Artificial Sequence: Synthetic oligonucleotide
  Target: ATXN1; (-) strand; PAM type: YTN; PAM sequence: CTT
gtgccttagcctccccagta

SEQ ID NO: 200467 - DNA, 20 bp, Artificial Sequence
  Description of Artificial Sequence: Synthetic oligonucleotide
  Target: ATXN1; (-) strand; PAM type: YTN; PAM sequence: TTC
ttgtgccttagcctccccag

SEQ ID NO: 200468 - DNA, 20 bp, Artificial Sequence
  Description of Artificial Sequence: Synthetic oligonucleotide
  Target: ATXN1; (-) strand; PAM type: YTN; PAM sequence: TTC
aagcgattcttgtgccttag

SEQ ID NO: 200469 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcgattcttg

SEQ ID NO: 200470 - DNA, 20 bp, Artificial Sequence
  Description of Artificial Sequence: Synthetic oligonucleotide
  Target: ATXN1; (-) strand; PAM type: YTN; PAM sequence: CTG
gctcccaggttcaagcgatt

SEQ ID NO: 200471 - DNA, 20 bp, Artificial Sequence
  Description of Artificial Sequence: Synthetic oligonucleotide
  Target: ATXN1; (-) strand; PAM type: YTN; PAM sequence: CTC
tggctcccaggttcaagcga

SEQ ID NO: 200472 - DNA, 20 bp, Artificial Sequence
  Description of Artificial Sequence: Synthetic oligonucleotide
  Target: ATXN1; (-) strand; PAM type: YTN; PAM sequence: CTG
aaacctctggctcccaggtt

SEQ ID NO: 200473 - DNA, 20 bp, Artificial Sequence
  Description of Artificial Sequence: Synthetic oligonucleotide
  Target: ATXN1; (-) strand; PAM type: YTN; PAM sequence: CTC
actgaaacctctggctccca

SEQ ID NO: 200474 - DNA, 20 bp, Artificial Sequence
  Description of Artificial Sequence: Synthetic oligonucleotide
  Target: ATXN1; (-) strand; PAM type: YTN; PAM sequence: TTG
gctcactgaaacctctggct

SEQ ID NO: 200475 - DNA, 20 bp, Artificial Sequence
  Description of Artificial Sequence: Synthetic oligonucleotide
  Target: ATXN1; (-) strand; PAM type: YTN; PAM sequence: CTT
ggctcactgaaacctctggc

SEQ ID NO: 200476 - DNA, 20 bp, Artificial Sequence
  Description of Artificial Sequence: Synthetic oligonucleotide
  Target: ATXN1; (-) strand; PAM type: YTN; PAM sequence: CTA
aagtgcagtggcacaatctt

SEQ ID NO: 200477 - DNA, 20 bp, Artificial Sequence
  Description of Artificial Sequence: Synthetic oligonucleotide
  Target: ATXN1; (-) strand; PAM type: YTN; PAM sequence: TTC
ccaggctaaagtgcagtggc

SEQ ID NO: 200478 - DNA, 20 bp, Artificial Sequence
  Description of Artificial Sequence: Synthetic oligonucleotide
  Target: ATXN1; (-) strand; PAM type: YTN; PAM sequence: TTT
cccaggctaaagtgcagtgg

SEQ ID NO: 200479 - DNA, 20 bp, Artificial Sequence
  Description of Artificial Sequence: Synthetic oligonucleotide
  Target: ATXN1; (-) strand; PAM type: YTN; PAM sequence: CTG
tttcccaggctaaagtgcag

SEQ ID NO: 200480 - DNA, 20 bp, Artificial Sequence
  Description of Artificial Sequence: Synthetic oligonucleotide
  Target: ATXN1; (-) strand; PAM type: YTN; PAM sequence: CTC
tgtttcccaggctaaagtgc

SEQ ID NO: 200481 - DNA, 20 bp, Artificial Sequence
  Description of Artificial Sequence: Synthetic oligonucleotide
  Target: ATXN1; (-) strand; PAM type: YTN; PAM sequence: TTC
actctgtttcccaggctaaa

SEQ ID NO: 200482 - DNA, 20 bp, Artificial Sequence
  Description of Artificial Sequence: Synthetic oligonucleotide
  Target: ATXN1; (-) strand; PAM type: YTN; PAM sequence: TTT
cactctgtttcccaggctaa

SEQ ID NO: 200483 - DNA, 20 bp, Artificial Sequence
  Description of Artificial Sequence: Synthetic oligonucleotide
  Target: ATXN1; (-) strand; PAM type: YTN; PAM sequence: TTG
aaatggggtttcactctgtt

SEQ ID NO: 200484 - DNA, 20 bp, Artificial Sequence
  Description of Artificial Sequence: Synthetic oligonucleotide
  Target: ATXN1; (-) strand; PAM type: YTN; PAM sequence: TTT
gaaatggggtttcactctgt

SEQ ID NO: 200485 - DNA, 20 bp, Artificial Sequence
  Description of Artificial Sequence: Synthetic oligonucleotide
  Target: ATXN1; (-) strand; PAM type: YTN; PAM sequence: TTT
tgaaatggggtttcactctg

SEQ ID NO: 200486 - DNA, 20 bp, Artificial Sequence
  Description of Artificial Sequence: Synthetic oligonucleotide
  Target: ATXN1; (-) strand; PAM type: YTN; PAM sequence: TTT
ttgaaatggggtttcactct

SEQ ID NO: 200487 - DNA, 20 bp, Artificial Sequence
  Description of Artificial Sequence: Synthetic oligonucleotide
  Target: ATXN1; (-) strand; PAM type: YTN; PAM sequence: TTT
tttgaaatggggtttcactc

SEQ ID NO: 200488 - DNA, 20 bp, Artificial Sequence
  Description of Artificial Sequence: Synthetic oligonucleotide
  Target: ATXN1; (-) strand; PAM type: YTN; PAM sequence: TTT
ttttgaaatggggtttcact

SEQ ID NO: 200489 - DNA, 20 bp, Artificial Sequence
  Description of Artificial Sequence: Synthetic oligonucleotide
  Target: ATXN1; (-) strand; PAM type: YTN; PAM sequence: TTT
tttttgaaatggggtttcac

SEQ ID NO: 200490 - DNA, 20 bp, Artificial Sequence
  Description of Artificial Sequence: Synthetic oligonucleotide
  Target: ATXN1; (-) strand; PAM type: YTN; PAM sequence: TTT
ttttttgaaatggggtttca

SEQ ID NO: 200491 - DNA, 20 bp, Artificial Sequence
  Description of Artificial Sequence: Synthetic oligonucleotide
  Target: ATXN1; (-) strand; PAM type: YTN; PAM sequence: TTT
tttttttgaaatggggtttc

SEQ ID NO: 200492 - DNA, 20 bp, Artificial Sequence
  Description of Artificial Sequence: Synthetic oligonucleotide
  Target: ATXN1; (-) strand; PAM type: YTN; PAM sequence: TTT
ttttttttgaaatggggttt

SEQ ID NO: 200493 - DNA, 20 bp, Artificial Sequence
  Description of Artificial Sequence: Synthetic oligonucleotide
  Target: ATXN1; (-) strand; PAM type: YTN; PAM sequence: TTT
tttttttttgaaatggggtt

SEQ ID NO: 200494 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgaaatggggt

SEQ ID NO: 200495 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgaaatgggg

SEQ ID NO: 200496 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgaaatggg

SEQ ID NO: 200497 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgaaatgg

SEQ ID NO: 200498 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgaaatg

SEQ ID NO: 200499 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgaaat

SEQ ID NO: 200500 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttttgaaa

SEQ ID NO: 200501 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttttgaa

SEQ ID NO: 200502 - DNA, 20 bp, Artificial Sequence
  Description of Artificial Sequence: Synthetic oligonucleotide
  Target: ATXN1; (-) strand; PAM type: YTN; PAM sequence: TTG
tttttttttttttttttttt

SEQ ID NO: 200503 - DNA, 20 bp, Artificial Sequence
  Description of Artificial Sequence: Synthetic oligonucleotide
  Target: ATXN1; (-) strand; PAM type: YTN; PAM sequence: TTT
gttttttttttttttttttt

SEQ ID NO: 200504 - DNA, 20 bp, Artificial Sequence
  Description of Artificial Sequence: Synthetic oligonucleotide
  Target: ATXN1; (-) strand; PAM type: YTN; PAM sequence: TTA
tgtagatttgtttttttttt

SEQ ID NO: 200505 - DNA, 20 bp, Artificial Sequence
  Description of Artificial Sequence: Synthetic oligonucleotide
  Target: ATXN1; (-) strand; PAM type: YTN; PAM sequence: TTT
atgtagatttgttttttttt

SEQ ID NO: 200506 - DNA, 20 bp, Artificial Sequence
  Description of Artificial Sequence: Synthetic oligonucleotide
  Target: ATXN1; (-) strand; PAM type: YTN; PAM sequence: CTT
tatgtagatttgtttttttt

SEQ ID NO: 200507 - DNA, 20 bp, Artificial Sequence
  Description of Artificial Sequence: Synthetic oligonucleotide
  Target: ATXN1; (-) strand; PAM type: YTN; PAM sequence: TTC
tttatgtagatttgtttttt

SEQ ID NO: 200508 - DNA, 20 bp, Artificial Sequence
  Description of Artificial Sequence: Synthetic oligonucleotide
  Target: ATXN1; (-) strand; PAM type: YTN; PAM sequence: CTT
ctttatgtagatttgttttt

SEQ ID NO: 200509 - DNA, 20 bp, Artificial Sequence
  Description of Artificial Sequence: Synthetic oligonucleotide
  Target: ATXN1; (-) strand; PAM type: YTN; PAM sequence: TTC
ttctttatgtagatttgttt

SEQ ID NO: 200510 - DNA, 20 bp, Artificial Sequence
  Description of Artificial Sequence: Synthetic oligonucleotide
  Target: ATXN1; (-) strand; PAM type: YTN; PAM sequence: TTA
acattcttctttatgtagat

SEQ ID NO: 200511 - DNA, 20 bp, Artificial Sequence
  Description of Artificial Sequence: Synthetic oligonucleotide
  Target: ATXN1; (-) strand; PAM type: YTN; PAM sequence: TTT
aacattcttctttatgtaga

SEQ ID NO: 200512 - DNA, 20 bp, Artificial Sequence
  Description of Artificial Sequence: Synthetic oligonucleotide
  Target: ATXN1; (-) strand; PAM type: YTN; PAM sequence: CTC
agtagtatttaacattcttc

SEQ ID NO: 200513 - DNA, 20 bp, Artificial Sequence
  Description of Artificial Sequence: Synthetic oligonucleotide
  Target: ATXN1; (-) strand; PAM type: YTN; PAM sequence: CTG
tccctcagtagtatttaaca

SEQ ID NO: 200514 - DNA, 20 bp, Artificial Sequence
  Description of Artificial Sequence: Synthetic oligonucleotide
  Target: ATXN1; (-) strand; PAM type: YTN; PAM sequence: CTC
tgtccctcagtagtatttaa

SEQ ID NO: 200515 - DNA, 20 bp, Artificial Sequence
  Description of Artificial Sequence: Synthetic oligonucleotide
  Target: ATXN1; (-) strand; PAM type: YTN; PAM sequence: CTC
ctctgtccctcagtagtatt

SEQ ID NO: 200516 - DNA, 20 bp, Artificial Sequence
  Description of Artificial Sequence: Synthetic oligonucleotide
  Target: ATXN1; (-) strand; PAM type: YTN; PAM sequence: CTC
ctcctctgtccctcagtagt

SEQ ID NO: 200517 - DNA, 20 bp, Artificial Sequence
  Description of Artificial Sequence: Synthetic oligonucleotide
  Target: ATXN1; (-) strand; PAM type: YTN; PAM sequence: CTA
tctcctcctctgtccctcag

SEQ ID NO: 200518 - DNA, 20 bp, Artificial Sequence
  Description of Artificial Sequence: Synthetic oligonucleotide
  Target: ATXN1; (-) strand; PAM type: YTN; PAM sequence: TTC
ctatctcctcctctgtccct

SEQ ID NO: 200519 - DNA, 20 bp, Artificial Sequence
  Description of Artificial Sequence: Synthetic oligonucleotide
  Target: ATXN1; (-) strand; PAM type: YTN; PAM sequence: TTG
ttcctatctcctcctctgtc

SEQ ID NO: 200520 - DNA, 20 bp, Artificial Sequence
  Description of Artificial Sequence: Synthetic oligonucleotide
  Target: ATXN1; (-) strand; PAM type: YTN; PAM sequence: TTG
cagttgttcctatctcctcc

SEQ ID NO: 200521 - DNA, 20 bp, Artificial Sequence
  Description of Artificial Sequence: Synthetic oligonucleotide
  Target: ATXN1; (-) strand; PAM type: YTN; PAM sequence: TTT
gcagttgttcctatctcctc

SEQ ID NO: 200522 - DNA, 20 bp, Artificial Sequence
  Description of Artificial Sequence: Synthetic oligonucleotide
  Target: ATXN1; (-) strand; PAM type: YTN; PAM sequence: CTT
tgcagttgttcctatctcct

SEQ ID NO: 200523 - DNA, 20 bp, Artificial Sequence
  Description of Artificial Sequence: Synthetic oligonucleotide
  Target: ATXN1; (-) strand; PAM type: YTN; PAM sequence: TTC
aagaagaagatagacctttg

SEQ ID NO: 200524 - DNA, 20 bp, Artificial Sequence
  Description of Artificial Sequence: Synthetic oligonucleotide
  Target: ATXN1; (-) strand; PAM type: YTN; PAM sequence: CTA
ttcaagaagaagatagacct

SEQ ID NO: 200525 - DNA, 20 bp, Artificial Sequence
  Description of Artificial Sequence: Synthetic oligonucleotide
  Target: ATXN1; (-) strand; PAM type: YTN; PAM sequence: TTC
tattcaagaagaagatagac

SEQ ID NO: 200526 - DNA, 20 bp, Artificial Sequence
  Description of Artificial Sequence: Synthetic oligonucleotide
  Target: ATXN1; (-) strand; PAM type: YTN; PAM sequence: TTT
ctattcaagaagaagataga

SEQ ID NO: 200527 - DNA, 20 bp, Artificial Sequence
  Description of Artificial Sequence: Synthetic oligonucleotide
  Target: ATXN1; (-) strand; PAM type: YTN; PAM sequence: CTT
tctattcaagaagaagatag

SEQ ID NO: 200528 - DNA, 20 bp, Artificial Sequence
  Description of Artificial Sequence: Synthetic oligonucleotide
  Target: ATXN1; (-) strand; PAM type: YTN; PAM sequence: TTG
actttctattcaagaagaag

SEQ ID NO: 200529 - DNA, 20 bp, Artificial Sequence
  Description of Artificial Sequence: Synthetic oligonucleotide
  Target: ATXN1; (-) strand; PAM type: YTN; PAM sequence: TTG
atattgactttctattcaag

SEQ ID NO: 200530 - DNA, 20 bp, Artificial Sequence
  Description of Artificial Sequence: Synthetic oligonucleotide
  Target: ATXN1; (-) strand; PAM type: YTN; PAM sequence: CTT
gatattgactttctattcaa

SEQ ID NO: 200531 - DNA, 20 bp, Artificial Sequence
  Description of Artificial Sequence: Synthetic oligonucleotide
  Target: ATXN1; (-) strand; PAM type: YTN; PAM sequence: CTC
ttgatattgactttctattc

SEQ ID NO: 200532 - DNA, 20 bp, Artificial Sequence
  Description of Artificial Sequence: Synthetic oligonucleotide
  Target: ATXN1; (-) strand; PAM type: YTN; PAM sequence: TTC
tcttgatattgactttctat

SEQ ID NO: 200533 - DNA, 20 bp, Artificial Sequence
  Description of Artificial Sequence: Synthetic oligonucleotide
  Target: ATXN1; (-) strand; PAM type: YTN; PAM sequence: TTA
ttctcttgatattgactttc

SEQ ID NO: 200534 - DNA, 20 bp, Artificial Sequence
  Description of Artificial Sequence: Synthetic oligonucleotide
  Target: ATXN1; (-) strand; PAM type: YTN; PAM sequence: TTA
tagataaatatagaaagaat

SEQ ID NO: 200535 - DNA, 20 bp, Artificial Sequence
  Description of Artificial Sequence: Synthetic oligonucleotide
  Target: ATXN1; (-) strand; PAM type: YTN; PAM sequence: TTT
atagataaatatagaaagaa

SEQ ID NO: 200536 - DNA, 20 bp, Artificial Sequence
  Description of Artificial Sequence: Synthetic oligonucleotide
  Target: ATXN1; (-) strand; PAM type: YTN; PAM sequence: TTG
acatcatataagtttataga

SEQ ID NO: 200537 - DNA, 20 bp, Artificial Sequence
  Description of Artificial Sequence: Synthetic oligonucleotide
  Target: ATXN1; (-) strand; PAM type: YTN; PAM sequence: TTT
gacatcatataagtttatag

SEQ ID NO: 200538 - DNA, 20 bp, Artificial Sequence
  Description of Artificial Sequence: Synthetic oligonucleotide
  Target: ATXN1; (-) strand; PAM type: YTN; PAM sequence: TTT
tgacatcatataagtttata

SEQ ID NO: 200539 - DNA, 20 bp, Artificial Sequence
  Description of Artificial Sequence: Synthetic oligonucleotide
  Target: ATXN1; (-) strand; PAM type: YTN; PAM sequence: TTT
ttgacatcatataagtttat

SEQ ID NO: 200540 - DNA, 20 bp, Artificial Sequence
  Description of Artificial Sequence: Synthetic oligonucleotide
  Target: ATXN1; (-) strand; PAM type: YTN; PAM sequence: TTG
tatttttgacatcatataag

SEQ ID NO: 200541 - DNA, 20 bp, Artificial Sequence
  Description of Artificial Sequence: Synthetic oligonucleotide
  Target: ATXN1; (-) strand; PAM type: YTN; PAM sequence: TTT
gtatttttgacatcatataa

SEQ ID NO: 200542 - DNA, 20 bp, Artificial Sequence
  Description of Artificial Sequence: Synthetic oligonucleotide
  Target: ATXN1; (-) strand; PAM type: YTN; PAM sequence: CTA
atttgtatttttgacatcat

SEQ ID NO: 200543 - DNA, 20 bp, Artificial Sequence
  Description of Artificial Sequence: Synthetic oligonucleotide
  Target: ATXN1; (-) strand; PAM type: YTN; PAM sequence: TTC
taatttgtatttttgacatc

SEQ ID NO: 200544 - DNA, 20 bp, Artificial Sequence
  Description of Artificial Sequence: Synthetic oligonucleotide
  Target: ATXN1; (-) strand; PAM type: YTN; PAM sequence: TTT
ctaatttgtatttttgacat

SEQ ID NO: 200545 - DNA, 20 bp, Artificial Sequence
  Description of Artificial Sequence: Synthetic oligonucleotide
  Target: ATXN1; (-) strand; PAM type: YTN; PAM sequence: CTT
tctaatttgtatttttgaca

SEQ ID NO: 200546 - DNA, 20 bp, Artificial Sequence
  Description of Artificial Sequence: Synthetic oligonucleotide
  Target: ATXN1; (-) strand; PAM type: YTN; PAM sequence: TTA
gctttctaatttgtattttt

SEQ ID NO: 200547 - DNA, 20 bp, Artificial Sequence
  Description of Artificial Sequence: Synthetic oligonucleotide
  Target: ATXN1; (-) strand; PAM type: YTN; PAM sequence: TTC
agaattagctttctaatttg

SEQ ID NO: 200548 - DNA, 20 bp, Artificial Sequence
  Description of Artificial Sequence: Synthetic oligonucleotide
  Target: ATXN1; (-) strand; PAM type: YTN; PAM sequence: CTT
cagaattagctttctaattt

SEQ ID NO: 200549 - DNA, 20 bp, Artificial Sequence
  Description of Artificial Sequence: Synthetic oligonucleotide
  Target: ATXN1; (-) strand; PAM type: YTN; PAM sequence: TTC
cataggaacttcagaattag

SEQ ID NO: 200550 - DNA, 20 bp, Artificial Sequence
  Description of Artificial Sequence: Synthetic oligonucleotide
  Target: ATXN1; (-) strand; PAM type: YTN; PAM sequence: TTT
ccataggaacttcagaatta

SEQ ID NO: 200551 - DNA, 20 bp, Artificial Sequence
  Description of Artificial Sequence: Synthetic oligonucleotide
  Target: ATXN1; (-) strand; PAM type: YTN; PAM sequence: TTT
tccataggaacttcagaatt

SEQ ID NO: 200552 - DNA, 20 bp, Artificial Sequence
  Description of Artificial Sequence: Synthetic oligonucleotide
  Target: ATXN1; (-) strand; PAM type: YTN; PAM sequence: TTT
ttccataggaacttcagaat

SEQ ID NO: 200553 - DNA, 20 bp, Artificial Sequence
  Description of Artificial Sequence: Synthetic oligonucleotide
  Target: ATXN1; (-) strand; PAM type: YTN; PAM sequence: TTA
tttttccataggaacttcag

SEQ ID NO: 200554 - DNA, 20 bp, Artificial Sequence
  Description of Artificial Sequence: Synthetic oligonucleotide
  Target: ATXN1; (-) strand; PAM type: YTN; PAM sequence: TTT
atttttccataggaacttca

SEQ ID NO: 200555 - DNA, 20 bp, Artificial Sequence
  Description of Artificial Sequence: Synthetic oligonucleotide
  Target: ATXN1; (-) strand; PAM type: YTN; PAM sequence: CTG
tttatttttccataggaact

SEQ ID NO: 200556 - DNA, 20 bp, Artificial Sequence
  Description of Artificial Sequence: Synthetic oligonucleotide
  Target: ATXN1; (-) strand; PAM type: YTN; PAM sequence: TTC
ctgtttatttttccatagga

SEQ ID NO: 200557 - DNA, 20 bp, Artificial Sequence
  Description of Artificial Sequence: Synthetic oligonucleotide
  Target: ATXN1; (-) strand; PAM type: YTN; PAM sequence: TTT
cctgtttatttttccatagg

SEQ ID NO: 200558 - DNA, 20 bp, Artificial Sequence
  Description of Artificial Sequence: Synthetic oligonucleotide
  Target: ATXN1; (-) strand; PAM type: YTN; PAM sequence: CTT
tcctgtttatttttccatag

SEQ ID NO: 200559 - DNA, 20 bp, Artificial Sequence
  Description of Artificial Sequence: Synthetic oligonucleotide
  Target: ATXN1; (-) strand; PAM type: YTN; PAM sequence: TTC
tttcctgtttatttttccat

SEQ ID NO: 200560 - DNA, 20 bp, Artificial Sequence
  Description of Artificial Sequence: Synthetic oligonucleotide
  Target: ATXN1; (-) strand; PAM type: YTN; PAM sequence: TTA
tggccattctttcctgttta

SEQ ID NO: 200561 - DNA, 20 bp, Artificial Sequence
  Description of Artificial Sequence: Synthetic oligonucleotide
  Target: ATXN1; (-) strand; PAM type: YTN; PAM sequence: TTG
ttatggccattctttcctgt

SEQ ID NO: 200562 - DNA, 20 bp, Artificial Sequence
  Description of Artificial Sequence: Synthetic oligonucleotide
  Target: ATXN1; (-) strand; PAM type: YTN; PAM sequence: TTA
tatcattgttatggccattc

SEQ ID NO: 200563 - DNA, 20 bp, Artificial Sequence
  Description of Artificial Sequence: Synthetic oligonucleotide
  Target: ATXN1; (-) strand; PAM type: YTN; PAM sequence: TTT
atatcattgttatggccatt

SEQ ID NO: 200564 - DNA, 20 bp, Artificial Sequence
  Description of Artificial Sequence: Synthetic oligonucleotide
  Target: ATXN1; (-) strand; PAM type: YTN; PAM sequence: TTT
tatatcattgttatggccat

SEQ ID NO: 200565 - DNA, 20 bp, Artificial Sequence
  Description of Artificial Sequence: Synthetic oligonucleotide
  Target: ATXN1; (-) strand; PAM type: YTN; PAM sequence: TTT
ttatatcattgttatggcca

SEQ ID NO: 200566 - DNA, 20 bp, Artificial Sequence
  Description of Artificial Sequence: Synthetic oligonucleotide
  Target: ATXN1; (-) strand; PAM type: YTN; PAM sequence: CTT
tttatatcattgttatggcc

SEQ ID NO: 200567 - DNA, 20 bp, Artificial Sequence
  Description of Artificial Sequence: Synthetic oligonucleotide
  Target: ATXN1; (-) strand; PAM type: YTN; PAM sequence: TTC
tttttatatcattgttatgg

SEQ ID NO: 200568 - DNA, 20 bp, Artificial Sequence
  Description of Artificial Sequence: Synthetic oligonucleotide
  Target: ATXN1; (-) strand; PAM type: YTN; PAM sequence: TTT
ctttttatatcattgttatg

SEQ ID NO: 200569 - DNA, 20 bp, Artificial Sequence
  Description of Artificial Sequence: Synthetic oligonucleotide
  Target: ATXN1; (-) strand; PAM type: YTN; PAM sequence: TTA
tttctttttatatcattgtt

SEQ ID NO: 200570 - DNA, 20 bp, Artificial Sequence
  Description of Artificial Sequence: Synthetic oligonucleotide
  Target: ATXN1; (-) strand; PAM type: YTN; PAM sequence: CTT
atttctttttatatcattgt

SEQ ID NO: 200571 - DNA, 20 bp, Artificial Sequence
  Description of Artificial Sequence: Synthetic oligonucleotide
  Target: ATXN1; (-) strand; PAM type: YTN; PAM sequence: TTC
ttatttctttttatatcatt

SEQ ID NO: 200572 - DNA, 20 bp, Artificial Sequence
  Description of Artificial Sequence: Synthetic oligonucleotide
  Target: ATXN1; (-) strand; PAM type: YTN; PAM sequence: TTT
cttatttctttttatatcat

SEQ ID NO: 200573 - DNA, 20 bp, Artificial Sequence
  Description of Artificial Sequence: Synthetic oligonucleotide
  Target: ATXN1; (-) strand; PAM type: YTN; PAM sequence: TTT
tcttatttctttttatatca

SEQ ID NO: 200574 - DNA, 20 bp, Artificial Sequence
  Description of Artificial Sequence: Synthetic oligonucleotide
  Target: ATXN1; (-) strand; PAM type: YTN; PAM sequence: CTT
ttcttatttctttttatatc

SEQ ID NO: 200575 - DNA, 20 bp, Artificial Sequence
  Description of Artificial Sequence: Synthetic oligonucleotide
  Target: ATXN1; (-) strand; PAM type: YTN; PAM sequence: TTC
ttttcttatttctttttata

SEQ ID NO: 200576 - DNA, 20 bp, Artificial Sequence
  Description of Artificial Sequence: Synthetic oligonucleotide
  Target: ATXN1; (-) strand; PAM type: YTN; PAM sequence: TTA
atatcggtatggtattcttt

SEQ ID NO: 200577 - DNA, 20 bp, Artificial Sequence
  Description of Artificial Sequence: Synthetic oligonucleotide
  Target: ATXN1; (-) strand; PAM type: YTN; PAM sequence: TTT
aatatcggtatggtattctt

SEQ ID NO: 200578 - DNA, 20 bp, Artificial Sequence
  Description of Artificial Sequence: Synthetic oligonucleotide
  Target: ATXN1; (-) strand; PAM type: YTN; PAM sequence: TTT
taatatcggtatggtattct

SEQ ID NO: 200579 - DNA, 20 bp, Artificial Sequence
  Description of Artificial Sequence: Synthetic oligonucleotide
  Target: ATXN1; (-) strand; PAM type: YTN; PAM sequence: TTT
ttaatatcggtatggtattc

SEQ ID NO: 200580 - DNA, 20 bp, Artificial Sequence
  Description of Artificial Sequence: Synthetic oligonucleotide
  Target: ATXN1; (-) strand; PAM type: YTN; PAM sequence: TTA
taatatttttaatatcggta

SEQ ID NO: 200581 - DNA, 20 bp, Artificial Sequence
  Description of Artificial Sequence: Synthetic oligonucleotide
  Target: ATXN1; (-) strand; PAM type: YTN; PAM sequence: TTT
ataatatttttaatatcggt

SEQ ID NO: 200582 - DNA, 20 bp, Artificial Sequence
  Description of Artificial Sequence: Synthetic oligonucleotide
  Target: ATXN1; (-) strand; PAM type: YTN; PAM sequence: CTT
tataatatttttaatatcgg

SEQ ID NO: 200583 - DNA, 20 bp, Artificial Sequence
  Description of Artificial Sequence: Synthetic oligonucleotide
  Target: ATXN1; (-) strand; PAM type: YTN; PAM sequence: CTA
aggctttataatatttttaa

SEQ ID NO: 200584 - DNA, 20 bp, Artificial Sequence
  Description of Artificial Sequence: Synthetic oligonucleotide
  Target: ATXN1; (-) strand; PAM type: YTN; PAM sequence: TTC
taaggctttataatattttt

SEQ ID NO: 200585 - DNA, 20 bp, Artificial Sequence
  Description of Artificial Sequence: Synthetic oligonucleotide
  Target: ATXN1; (-) strand; PAM type: YTN; PAM sequence: TTT
ctaaggctttataatatttt

SEQ ID NO: 200586 - DNA, 20 bp, Artificial Sequence
  Description of Artificial Sequence: Synthetic oligonucleotide
  Target: ATXN1; (-) strand; PAM type: YTN; PAM sequence: CTT
tctaaggctttataatattt

SEQ ID NO: 200587 - DNA, 20 bp, Artificial Sequence
  Description of Artificial Sequence: Synthetic oligonucleotide
  Target: ATXN1; (-) strand; PAM type: YTN; PAM sequence: TTA
ctttctaaggctttataata

SEQ ID NO: 200588 - DNA, 20 bp, Artificial Sequence
  Description of Artificial Sequence: Synthetic oligonucleotide
  Target: ATXN1; (-) strand; PAM type: YTN; PAM sequence: TTT
actttctaaggctttataat

SEQ ID NO: 200589 - DNA, 20 bp, Artificial Sequence
  Description of Artificial Sequence: Synthetic oligonucleotide
  Target: ATXN1; (-) strand; PAM type: YTN; PAM sequence: TTT
tactttctaaggctttataa

SEQ ID NO: 200590 - DNA, 20 bp, Artificial Sequence
  Description of Artificial Sequence: Synthetic oligonucleotide
  Target: ATXN1; (-) strand; PAM type: YTN; PAM sequence: CTG
ttttactttctaaggcttta

SEQ ID NO: 200591 - DNA, 20 bp, Artificial Sequence
  Description of Artificial Sequence: Synthetic oligonucleotide
  Target: ATXN1; (-) strand; PAM type: YTN; PAM sequence: CTG
tgcccatgcacactgtttta

SEQ ID NO: 200592 - DNA, 20 bp, Artificial Sequence
  Description of Artificial Sequence: Synthetic oligonucleotide
  Target: ATXN1; (-) strand; PAM type: YTN; PAM sequence: TTC
ctgtgcccatgcacactgtt

SEQ ID NO: 200593 - DNA, 20 bp, Artificial Sequence
  Description of Artificial Sequence: Synthetic oligonucleotide
  Target: ATXN1; (-) strand; PAM type: YTN; PAM sequence: CTA
agtattcctgtgcccatgca

SEQ ID NO: 200594 - DNA, 20 bp, Artificial Sequence
  Description of Artificial Sequence: Synthetic oligonucleotide
  Target: ATXN1; (-) strand; PAM type: YTN; PAM sequence: TTG
ctaagtattcctgtgcccat

SEQ ID NO: 200595 - DNA, 20 bp, Artificial Sequence
  Description of Artificial Sequence: Synthetic oligonucleotide
  Target: ATXN1; (-) strand; PAM type: YTN; PAM sequence: CTT
gctaagtattcctgtgccca

SEQ ID NO: 200596 - DNA, 20 bp, Artificial Sequence
  Description of Artificial Sequence: Synthetic oligonucleotide
  Target: ATXN1; (-) strand; PAM type: YTN; PAM sequence: TTG
accttgctaagtattcctgt

SEQ ID NO: 200597 - DNA, 20 bp, Artificial Sequence
  Description of Artificial Sequence: Synthetic oligonucleotide
  Target: ATXN1; (-) strand; PAM type: YTN; PAM sequence: CTG
ttgaccttgctaagtattcc

SEQ ID NO: 200598 - DNA, 20 bp, Artificial Sequence
  Description of Artificial Sequence: Synthetic oligonucleotide
  Target: ATXN1; (-) strand; PAM type: YTN; PAM sequence: TTC
tgttgaccttgctaagtatt

SEQ ID NO: 200599 - DNA, 20 bp, Artificial Sequence
  Description of Artificial Sequence: Synthetic oligonucleotide
  Target: ATXN1; (-) strand; PAM type: YTN; PAM sequence: TTT
ctgttgaccttgctaagtat

SEQ ID NO: 200600 - DNA, 20 bp, Artificial Sequence
  Description of Artificial Sequence: Synthetic oligonucleotide
  Target: ATXN1; (-) strand; PAM type: YTN; PAM sequence: TTT
tctgttgaccttgctaagta

SEQ ID NO: 200601 - DNA, 20 bp, Artificial Sequence
  Description of Artificial Sequence: Synthetic oligonucleotide
  Target: ATXN1; (-) strand; PAM type: YTN; PAM sequence: CTT
ttctgttgaccttgctaagt

SEQ ID NO: 200602 - DNA, 20 bp, Artificial Sequence
  Description of Artificial Sequence: Synthetic oligonucleotide
  Target: ATXN1; (-) strand; PAM type: YTN; PAM sequence: CTC
ttttctgttgaccttgctaa

SEQ ID NO: 200603 - DNA, 20 bp, Artificial Sequence
  Description of Artificial Sequence: Synthetic oligonucleotide
  Target: ATXN1; (-) strand; PAM type: YTN; PAM sequence: TTG
gatcgacctcttttctgttg

SEQ ID NO: 200604 - DNA, 20 bp, Artificial Sequence
  Description of Artificial Sequence: Synthetic oligonucleotide
  Target: ATXN1; (-) strand; PAM type: YTN; PAM sequence: TTT
ggatcgacctcttttctgtt

SEQ ID NO: 200605 - DNA, 20 bp, Artificial Sequence
  Description of Artificial Sequence: Synthetic oligonucleotide
  Target: ATXN1; (-) strand; PAM type: YTN; PAM sequence: TTC
atttggatcgacctcttttc

SEQ ID NO: 200606 - DNA, 20 bp, Artificial Sequence
  Description of Artificial Sequence: Synthetic oligonucleotide
  Target: ATXN1; (-) strand; PAM type: YTN; PAM sequence: CTG
aagtccagtattcatttgga

SEQ ID NO: 200607 - DNA, 20 bp, Artificial Sequence
  Description of Artificial Sequence: Synthetic oligonucleotide
  Target: ATXN1; (-) strand; PAM type: YTN; PAM sequence: TTC
actgaagtccagtattcatt

SEQ ID NO: 200608 - DNA, 20 bp, Artificial Sequence
  Description of Artificial Sequence: Synthetic oligonucleotide
  Target: ATXN1; (-) strand; PAM type: YTN; PAM sequence: CTA
aagtgcagtgacacccatat

SEQ ID NO: 200609 - DNA, 20 bp, Artificial Sequence
  Description of Artificial Sequence: Synthetic oligonucleotide
  Target: ATXN1; (-) strand; PAM type: YTN; PAM sequence: CTC
ccactaaagtgcagtgacac

SEQ ID NO: 200610 - DNA, 20 bp, Artificial Sequence
  Description of Artificial Sequence: Synthetic oligonucleotide
  Target: ATXN1; (-) strand; PAM type: YTN; PAM sequence: TTC
ctcccactaaagtgcagtga

SEQ ID NO: 200611 - DNA, 20 bp, Artificial Sequence
  Description of Artificial Sequence: Synthetic oligonucleotide
  Target: ATXN1; (-) strand; PAM type: YTN; PAM sequence: CTT
cctcccactaaagtgcagtg

SEQ ID NO: 200612 - DNA, 20 bp, Artificial Sequence
  Description of Artificial Sequence: Synthetic oligonucleotide
  Target: ATXN1; (-) strand; PAM type: YTN; PAM sequence: TTG
gaagtccttcctcccactaa

SEQ ID NO: 200613 - DNA, 20 bp, Artificial Sequence
  Description of Artificial Sequence: Synthetic oligonucleotide
  Target: ATXN1; (-) strand; PAM type: YTN; PAM sequence: TTA
ttggaagtccttcctcccac

SEQ ID NO: 200614 - DNA, 20 bp, Artificial Sequence
  Description of Artificial Sequence: Synthetic oligonucleotide
  Target: ATXN1; (-) strand; PAM type: YTN; PAM sequence: TTA
ggtggccgtccaattattgg

SEQ ID NO: 200615 - DNA, 20 bp, Artificial Sequence
  Description of Artificial Sequence: Synthetic oligonucleotide
  Target: ATXN1; (-) strand; PAM type: YTN; PAM sequence: TTT
aggtggccgtccaattattg

SEQ ID NO: 200616 - DNA, 20 bp, Artificial Sequence
  Description of Artificial Sequence: Synthetic oligonucleotide
  Target: ATXN1; (-) strand; PAM type: YTN; PAM sequence: TTT
taggtggccgtccaattatt

SEQ ID NO: 200617 - DNA, 20 bp, Artificial Sequence
  Description of Artificial Sequence: Synthetic oligonucleotide
  Target: ATXN1; (-) strand; PAM type: YTN; PAM sequence: TTT
ttaggtggccgtccaattat

SEQ ID NO: 200618 - DNA, 20 bp, Artificial Sequence
  Description of Artificial Sequence: Synthetic oligonucleotide
  Target: ATXN1; (-) strand; PAM type: YTN; PAM sequence: TTT
tttaggtggccgtccaatta

SEQ ID NO: 200619 - DNA, 20 bp, Artificial Sequence
  Description of Artificial Sequence: Synthetic oligonucleotide
  Target: ATXN1; (-) strand; PAM type: YTN; PAM sequence: TTT
ttttaggtggccgtccaatt

SEQ ID NO: 200620 - DNA, 20 bp, Artificial Sequence
  Description of Artificial Sequence: Synthetic oligonucleotide
  Target: ATXN1; (-) strand; PAM type: YTN; PAM sequence: CTA
tatttttttaggtggccgtc

SEQ ID NO: 200621 - DNA, 20 bp, Artificial Sequence
  Description of Artificial Sequence: Synthetic oligonucleotide
  Target: ATXN1; (-) strand; PAM type: YTN; PAM sequence: TTA
gggatctatatttttttagg

SEQ ID NO: 200622 - DNA, 20 bp, Artificial Sequence
  Description of Artificial Sequence: Synthetic oligonucleotide
  Target: ATXN1; (-) strand; PAM type: YTN; PAM sequence: TTA
gtgcaggatgtgaattaggg

SEQ ID NO: 200623 - DNA, 20 bp, Artificial Sequence
  Description of Artificial Sequence: Synthetic oligonucleotide
  Target: ATXN1; (-) strand; PAM type: YTN; PAM sequence: TTT
agtgcaggatgtgaattagg

SEQ ID NO: 200624 - DNA, 20 bp, Artificial Sequence
  Description of Artificial Sequence: Synthetic oligonucleotide
  Target: ATXN1; (-) strand; PAM type: YTN; PAM sequence: TTT
tagtgcaggatgtgaattag

SEQ ID NO: 200625 - DNA, 20 bp, Artificial Sequence
  Description of Artificial Sequence: Synthetic oligonucleotide
  Target: ATXN1; (-) strand; PAM type: YTN; PAM sequence: TTA
ttttagtgcaggatgtgaat

SEQ ID NO: 200626 - DNA, 20 bp, Artificial Sequence
  Description of Artificial Sequence: Synthetic oligonucleotide
  Target: ATXN1; (-) strand; PAM type: YTN; PAM sequence: TTT
attttagtgcaggatgtgaa

SEQ ID NO: 200627 - DNA, 20 bp, Artificial Sequence
  Description of Artificial Sequence: Synthetic oligonucleotide
  Target: ATXN1; (-) strand; PAM type: YTN; PAM sequence: TTG
ggatttattttagtgcagga

SEQ ID NO: 200628 - DNA, 20 bp, Artificial Sequence
  Description of Artificial Sequence: Synthetic oligonucleotide
  Target: ATXN1; (-) strand; PAM type: YTN; PAM sequence: CTT
gggatttattttagtgcagg

SEQ ID NO: 200629 - DNA, 20 bp, Artificial Sequence
  Description of Artificial Sequence: Synthetic oligonucleotide
  Target: ATXN1; (-) strand; PAM type: YTN; PAM sequence: TTG
gtcaccttgggatttatttt

SEQ ID NO: 200630 - DNA, 20 bp, Artificial Sequence
  Description of Artificial Sequence: Synthetic oligonucleotide
  Target: ATXN1; (-) strand; PAM type: YTN; PAM sequence: TTT
ggtcaccttgggatttattt

SEQ ID NO: 200631 - DNA, 20 bp, Artificial Sequence
  Description of Artificial Sequence: Synthetic oligonucleotide
  Target: ATXN1; (-) strand; PAM type: YTN; PAM sequence: CTT
tggtcaccttgggatttatt

SEQ ID NO: 200632 - DNA, 20 bp, Artificial Sequence
  Description of Artificial Sequence: Synthetic oligonucleotide
  Target: ATXN1; (-) strand; PAM type: YTN; PAM sequence: TTC
aaatctttggtcaccttggg

SEQ ID NO: 200633 - DNA, 20 bp, Artificial Sequence
  Description of Artificial Sequence: Synthetic oligonucleotide
  Target: ATXN1; (-) strand; PAM type: YTN; PAM sequence: TTA
cgttcaaatctttggtcacc

SEQ ID NO: 200634 - DNA, 20 bp, Artificial Sequence
  Description of Artificial Sequence: Synthetic oligonucleotide
  Target: ATXN1; (-) strand; PAM type: YTN; PAM sequence: TTT
acgttcaaatctttggtcac

SEQ ID NO: 200635 - DNA, 20 bp, Artificial Sequence
  Description of Artificial Sequence: Synthetic oligonucleotide
  Target: ATXN1; (-) strand; PAM type: YTN; PAM sequence: TTT
tacgttcaaatctttggtca

SEQ ID NO: 200636 - DNA, 20 bp, Artificial Sequence
  Description of Artificial Sequence: Synthetic oligonucleotide
  Target: ATXN1; (-) strand; PAM type: YTN; PAM sequence: TTT
ttacgttcaaatctttggtc

SEQ ID NO: 200637 - DNA, 20 bp, Artificial Sequence
  Description of Artificial Sequence: Synthetic oligonucleotide
  Target: ATXN1; (-) strand; PAM type: YTN; PAM sequence: TTT
tttacgttcaaatctttggt

SEQ ID NO: 200638 - DNA, 20 bp, Artificial Sequence
  Description of Artificial Sequence: Synthetic oligonucleotide
  Target: ATXN1; (-) strand; PAM type: YTN; PAM sequence: TTC
attttttacgttcaaatctt

SEQ ID NO: 200639 - DNA, 20 bp, Artificial Sequence
  Description of Artificial Sequence: Synthetic oligonucleotide
  Target: ATXN1; (-) strand; PAM type: YTN; PAM sequence: TTT
cattttttacgttcaaatct

SEQ ID NO: 200640 - DNA, 20 bp, Artificial Sequence
  Description of Artificial Sequence: Synthetic oligonucleotide
  Target: ATXN1; (-) strand; PAM type: YTN; PAM sequence: CTT
tcattttttacgttcaaatc

SEQ ID NO: 200641 - DNA, 20 bp, Artificial Sequence
  Description of Artificial Sequence: Synthetic oligonucleotide
  Target: ATXN1; (-) strand; PAM type: YTN; PAM sequence: TTA
tgctttcattttttacgttc

SEQ ID NO: 200642 - DNA, 20 bp, Artificial Sequence
  Description of Artificial Sequence: Synthetic oligonucleotide
  Target: ATXN1; (-) strand; PAM type: YTN; PAM sequence: TTT
atgctttcattttttacgtt

SEQ ID NO: 200643 - DNA, 20 bp, Artificial Sequence
  Description of Artificial Sequence: Synthetic oligonucleotide
  Target: ATXN1; (-) strand; PAM type: YTN; PAM sequence: TTT
tatgctttcattttttacgt

SEQ ID NO: 200644 - DNA, 20 bp, Artificial Sequence
  Description of Artificial Sequence: Synthetic oligonucleotide
  Target: ATXN1; (-) strand; PAM type: YTN; PAM sequence: TTT
ttatgctttcattttttacg

SEQ ID NO: 200645 - DNA, 20 bp, Artificial Sequence
  Description of Artificial Sequence: Synthetic oligonucleotide
  Target: ATXN1; (-) strand; PAM type: YTN; PAM sequence: CTC
atatttttatgctttcattt

SEQ ID NO: 200646 - DNA, 20 bp, Artificial Sequence
  Description of Artificial Sequence: Synthetic oligonucleotide
  Target: ATXN1; (-) strand; PAM type: YTN; PAM sequence: TTC
tcatatttttatgctttcat

SEQ ID NO: 200647 - DNA, 20 bp, Artificial Sequence
  Description of Artificial Sequence: Synthetic oligonucleotide
  Target: ATXN1; (-) strand; PAM type: YTN; PAM sequence: TTT
ctcatatttttatgctttca

SEQ ID NO: 200648 - DNA, 20 bp, Artificial Sequence
  Description of Artificial Sequence: Synthetic oligonucleotide
  Target: ATXN1; (-) strand; PAM type: YTN; PAM sequence: CTT
tctcatatttttatgctttc

SEQ ID NO: 200649 - DNA, 20 bp, Artificial Sequence
  Description of Artificial Sequence: Synthetic oligonucleotide
  Target: ATXN1; (-) strand; PAM type: YTN; PAM sequence: TTC
tttctcatatttttatgctt

SEQ ID NO: 200650 - DNA, 20 bp, Artificial Sequence
  Description of Artificial Sequence: Synthetic oligonucleotide
  Target: ATXN1; (-) strand; PAM type: YTN; PAM sequence: TTC
aaggttctttctcatatttt

SEQ ID NO: 200651 - DNA, 20 bp, Artificial Sequence
  Description of Artificial Sequence: Synthetic oligonucleotide
  Target: ATXN1; (-) strand; PAM type: YTN; PAM sequence: TTT
caaggttctttctcatattt

SEQ ID NO: 200652 - DNA, 20 bp, Artificial Sequence
  Description of Artificial Sequence: Synthetic oligonucleotide
  Target: ATXN1; (-) strand; PAM type: YTN; PAM sequence: TTT
tcaaggttctttctcatatt

SEQ ID NO: 200653 - DNA, 20 bp, Artificial Sequence
  Description of Artificial Sequence: Synthetic oligonucleotide
  Target: ATXN1; (-) strand; PAM type: YTN; PAM sequence: TTA
gcgtaatgttttcaaggttc

SEQ ID NO: 200654 - DNA, 20 bp, Artificial Sequence
  Description of Artificial Sequence: Synthetic oligonucleotide
  Target: ATXN1; (-) strand; PAM type: YTN; PAM sequence: CTT
agcgtaatgttttcaaggtt

SEQ ID NO: 200655 - DNA, 20 bp, Artificial Sequence
  Description of Artificial Sequence: Synthetic oligonucleotide
  Target: ATXN1; (-) strand; PAM type: YTN; PAM sequence: TTC
cacttagcgtaatgttttca

SEQ ID NO: 200656 - DNA, 20 bp, Artificial Sequence
  Description of Artificial Sequence: Synthetic oligonucleotide
  Target: ATXN1; (-) strand; PAM type: YTN; PAM sequence: TTT
ccacttagcgtaatgttttc

SEQ ID NO: 200657 - DNA, 20 bp, Artificial Sequence
  Description of Artificial Sequence: Synthetic oligonucleotide
  Target: ATXN1; (-) strand; PAM type: YTN; PAM sequence: TTT
tccacttagcgtaatgtttt

SEQ ID NO: 200658 - DNA, 20 bp, Artificial Sequence
  Description of Artificial Sequence: Synthetic oligonucleotide
  Target: ATXN1; (-) strand; PAM type: YTN; PAM sequence: CTT
ttccacttagcgtaatgttt

SEQ ID NO: 200659 - DNA, 20 bp, Artificial Sequence
  Description of Artificial Sequence: Synthetic oligonucleotide
  Target: ATXN1; (-) strand; PAM type: YTN; PAM sequence: CTG
acttttccacttagcgtaat

SEQ ID NO: 200660 - DNA, 20 bp, Artificial Sequence
  Description of Artificial Sequence: Synthetic oligonucleotide
  Target: ATXN1; (-) strand; PAM type: YTN; PAM sequence: TTA
cacaactgacttttccactt

SEQ ID NO: 200661 - DNA, 20 bp, Artificial Sequence
  Description of Artificial Sequence: Synthetic oligonucleotide
  Target: ATXN1; (-) strand; PAM type: YTN; PAM sequence: CTT
acacaactgacttttccact

SEQ ID NO: 200662 - DNA, 20 bp, Artificial Sequence
  Description of Artificial Sequence: Synthetic oligonucleotide
  Target: ATXN1; (-) strand; PAM type: YTN; PAM sequence: CTC
atataaatggaaccatataa

SEQ ID NO: 200663 - DNA, 20 bp, Artificial Sequence
  Description of Artificial Sequence: Synthetic oligonucleotide
  Target: ATXN1; (-) strand; PAM type: YTN; PAM sequence: CTA
gacatctcatataaatggaa

SEQ ID NO: 200664 - DNA, 20 bp, Artificial Sequence
  Description of Artificial Sequence: Synthetic oligonucleotide
  Target: ATXN1; (-) strand; PAM type: YTN; PAM sequence: CTG
tcctagacatctcatataaa

SEQ ID NO: 200665 - DNA, 20 bp, Artificial Sequence
  Description of Artificial Sequence: Synthetic oligonucleotide
  Target: ATXN1; (-) strand; PAM type: YTN; PAM sequence: TTG
cctgtcctagacatctcata

SEQ ID NO: 200666 - DNA, 20 bp, Artificial Sequence
  Description of Artificial Sequence: Synthetic oligonucleotide
  Target: ATXN1; (-) strand; PAM type: YTN; PAM sequence: TTT
gcctgtcctagacatctcat

SEQ ID NO: 200667 - DNA, 20 bp, Artificial Sequence
  Description of Artificial Sequence: Synthetic oligonucleotide
  Target: ATXN1; (-) strand; PAM type: YTN; PAM sequence: CTA
tggatttgcctgtcctagac

SEQ ID NO: 200668 - DNA, 20 bp, Artificial Sequence
  Description of Artificial Sequence: Synthetic oligonucleotide
  Target: ATXN1; (-) strand; PAM type: YTN; PAM sequence: CTC
tatggatttgcctgtcctag

SEQ ID NO: 200669 - DNA, 20 bp, Artificial Sequence
  Description of Artificial Sequence: Synthetic oligonucleotide
  Target: ATXN1; (-) strand; PAM type: YTN; PAM sequence: TTA
tctctatggatttgcctgtc

SEQ ID NO: 200670 - DNA, 20 bp, Artificial Sequence
  Description of Artificial Sequence: Synthetic oligonucleotide
  Target: ATXN1; (-) strand; PAM type: YTN; PAM sequence: TTT
atctctatggatttgcctgt

SEQ ID NO: 200671 - DNA, 20 bp, Artificial Sequence
  Description of Artificial Sequence: Synthetic oligonucleotide
  Target: ATXN1; (-) strand; PAM type: YTN; PAM sequence: TTT
tatctctatggatttgcctg

SEQ ID NO: 200672 - DNA, 20 bp, Artificial Sequence
  Description of Artificial Sequence: Synthetic oligonucleotide
  Target: ATXN1; (-) strand; PAM type: YTN; PAM sequence: CTA
tgttttatctctatggattt

SEQ ID NO: 200673 - DNA, 20 bp, Artificial Sequence
  Description of Artificial Sequence: Synthetic oligonucleotide
  Target: ATXN1; (-) strand; PAM type: YTN; PAM sequence: TTA
atctatgttttatctctatg

SEQ ID NO: 200674 - DNA, 20 bp, Artificial Sequence
  Description of Artificial Sequence: Synthetic oligonucleotide
  Target: ATXN1; (-) strand; PAM type: YTN; PAM sequence: CTT
aatctatgttttatctctat

SEQ ID NO: 200675 - DNA, 20 bp, Artificial Sequence
  Description of Artificial Sequence: Synthetic oligonucleotide
  Target: ATXN1; (-) strand; PAM type: YTN; PAM sequence: CTG
gtatccacttaatctatgtt

SEQ ID NO: 200676 - DNA, 20 bp, Artificial Sequence
  Description of Artificial Sequence: Synthetic oligonucleotide
  Target: ATXN1; (-) strand; PAM type: YTN; PAM sequence: CTG
gcccctggtatccacttaat

SEQ ID NO: 200677 - DNA, 20 bp, Artificial Sequence
  Description of Artificial Sequence: Synthetic oligonucleotide
  Target: ATXN1; (-) strand; PAM type: YTN; PAM sequence: TTC
tggcccctggtatccactta

SEQ ID NO: 200678 - DNA, 20 bp, Artificial Sequence
  Description of Artificial Sequence: Synthetic oligonucleotide
  Target: ATXN1; (-) strand; PAM type: YTN; PAM sequence: CTT
ctggcccctggtatccactt

SEQ ID NO: 200679 - DNA, 20 bp, Artificial Sequence
  Description of Artificial Sequence: Synthetic oligonucleotide
  Target: ATXN1; (-) strand; PAM type: YTN; PAM sequence: CTA
ccttctggcccctggtatcc

SEQ ID NO: 200680 - DNA, 20 bp, Artificial Sequence
  Description of Artificial Sequence: Synthetic oligonucleotide
  Target: ATXN1; (-) strand; PAM type: YTN; PAM sequence: CTC
taccttctggcccctggtat

SEQ ID NO: 200681 - DNA, 20 bp, Artificial Sequence
  Description of Artificial Sequence: Synthetic oligonucleotide
  Target: ATXN1; (-) strand; PAM type: YTN; PAM sequence: TTC
ctctaccttctggcccctgg

SEQ ID NO: 200682 - DNA, 20 bp, Artificial Sequence
  Description of Artificial Sequence: Synthetic oligonucleotide
  Target: ATXN1; (-) strand; PAM type: YTN; PAM sequence: TTT
cctctaccttctggcccctg

SEQ ID NO: 200683 - DNA, 20 bp, Artificial Sequence
  Description of Artificial Sequence: Synthetic oligonucleotide
  Target: ATXN1; (-) strand; PAM type: YTN; PAM sequence: CTC
ccccatttcctctaccttct

SEQ ID NO: 200684 - DNA, 20 bp, Artificial Sequence
  Description of Artificial Sequence: Synthetic oligonucleotide
  Target: ATXN1; (-) strand; PAM type: YTN; PAM sequence: TTA
agcacccactcccccatttc

SEQ ID NO: 200685 - DNA, 20 bp, Artificial Sequence
  Description of Artificial Sequence: Synthetic oligonucleotide
  Target: ATXN1; (-) strand; PAM type: YTN; PAM sequence: TTA
cccattaagcacccactccc

SEQ ID NO: 200686 - DNA, 20 bp, Artificial Sequence
  Description of Artificial Sequence: Synthetic oligonucleotide
  Target: ATXN1; (-) strand; PAM type: YTN; PAM sequence: TTT
acccattaagcacccactcc

SEQ ID NO: 200687 - DNA, 20 bp, Artificial Sequence
  Description of Artificial Sequence: Synthetic oligonucleotide
  Target: ATXN1; (-) strand; PAM type: YTN; PAM sequence: CTT
tacccattaagcacccactc

SEQ ID NO: 200688 - DNA, 20 bp, Artificial Sequence
  Description of Artificial Sequence: Synthetic oligonucleotide
  Target: ATXN1; (-) strand; PAM type: YTN; PAM sequence: CTC
caaaaagaaaacctttaccc

SEQ ID NO: 200689 - DNA, 20 bp, Artificial Sequence
  Description of Artificial Sequence: Synthetic oligonucleotide
  Target: ATXN1; (-) strand; PAM type: YTN; PAM sequence: TTA
ctccaaaaagaaaaccttta

SEQ ID NO: 200690 - DNA, 20 bp, Artificial Sequence
  Description of Artificial Sequence: Synthetic oligonucleotide
  Target: ATXN1; (-) strand; PAM type: YTN; PAM sequence: TTC
attactccaaaaagaaaacc

SEQ ID NO: 200691 - DNA, 20 bp, Artificial Sequence
  Description of Artificial Sequence: Synthetic oligonucleotide
  Target: ATXN1; (-) strand; PAM type: YTN; PAM sequence: TTT
cattactccaaaaagaaaac

SEQ ID NO: 200692 - DNA, 20 bp, Artificial Sequence
  Description of Artificial Sequence: Synthetic oligonucleotide
  Target: ATXN1; (-) strand; PAM type: YTN; PAM sequence: TTT
tcattactccaaaaagaaaa

SEQ ID NO: 200693 - DNA, 20 bp, Artificial Sequence
  Description of Artificial Sequence: Synthetic oligonucleotide
  Target: ATXN1; (-) strand; PAM type: YTN; PAM sequence: TTA
cattttcattactccaaaaa

SEQ ID NO: 200694 - DNA, 20 bp, Artificial Sequence
  Description of Artificial Sequence: Synthetic oligonucleotide
  Target: ATXN1; (-) strand; PAM type: YTN; PAM sequence: TTT
acattttcattactccaaaa

SEQ ID NO: 200695 - DNA, 20 bp, Artificial Sequence
  Description of Artificial Sequence: Synthetic oligonucleotide
  Target: ATXN1; (-) strand; PAM type: YTN; PAM sequence: TTT
tacattttcattactccaaa

SEQ ID NO: 200696 - DNA, 20 bp, Artificial Sequence
  Description of Artificial Sequence: Synthetic oligonucleotide
  Target: ATXN1; (-) strand; PAM type: YTN; PAM sequence: CTA
attttacattttcattactc

SEQ ID NO: 200697 - DNA, 20 bp, Artificial Sequence
  Description of Artificial Sequence: Synthetic oligonucleotide
  Target: ATXN1; (-) strand; PAM type: YTN; PAM sequence: TTA
tacaatcatcatcaaaacct

SEQ ID NO: 200698 - DNA, 20 bp, Artificial Sequence
  Description of Artificial Sequence: Synthetic oligonucleotide
  Target: ATXN1; (-) strand; PAM type: YTN; PAM sequence: TTC
atagaattatacaatcatca

SEQ ID NO: 200699 - DNA, 20 bp, Artificial Sequence
  Description of Artificial Sequence: Synthetic oligonucleotide
  Target: ATXN1; (-) strand; PAM type: YTN; PAM sequence: CTA
ttcatagaattatacaatca

SEQ ID NO: 200700 - DNA, 20 bp, Artificial Sequence
  Description of Artificial Sequence: Synthetic oligonucleotide
  Target: ATXN1; (-) strand; PAM type: YTN; PAM sequence: TTA
atctattcatagaattatac

SEQ ID NO: 200701 - DNA, 20 bp, Artificial Sequence
  Description of Artificial Sequence: Synthetic oligonucleotide
  Target: ATXN1; (-) strand; PAM type: YTN; PAM sequence: TTT
aatctattcatagaattata

SEQ ID NO: 200702 - DNA, 20 bp, Artificial Sequence
  Description of Artificial Sequence: Synthetic oligonucleotide
  Target: ATXN1; (-) strand; PAM type: YTN; PAM sequence: TTT
taatctattcatagaattat

SEQ ID NO: 200703 - DNA, 20 bp, Artificial Sequence
  Description of Artificial Sequence: Synthetic oligonucleotide
  Target: ATXN1; (-) strand; PAM type: YTN; PAM sequence: TTT
ttaatctattcatagaatta

SEQ ID NO: 200704 - DNA, 20 bp, Artificial Sequence
  Description of Artificial Sequence: Synthetic oligonucleotide
  Target: ATXN1; (-) strand; PAM type: YTN; PAM sequence: TTA
ataaatgggtttttaatcta

SEQ ID NO: 200705 - DNA, 20 bp, Artificial Sequence
  Description of Artificial Sequence: Synthetic oligonucleotide
  Target: ATXN1; (-) strand; PAM type: YTN; PAM sequence: TTT
aataaatgggtttttaatct

SEQ ID NO: 200706 - DNA, 20 bp, Artificial Sequence
  Description of Artificial Sequence: Synthetic oligonucleotide
  Target: ATXN1; (-) strand; PAM type: YTN; PAM sequence: TTT
taataaatgggtttttaatc

SEQ ID NO: 200707 - DNA, 20 bp, Artificial Sequence
  Description of Artificial Sequence: Synthetic oligonucleotide
  Target: ATXN1; (-) strand; PAM type: YTN; PAM sequence: CTT
ttaataaatgggtttttaat

SEQ ID NO: 200708 - DNA, 20 bp, Artificial Sequence
  Description of Artificial Sequence: Synthetic oligonucleotide
  Target: ATXN1; (-) strand; PAM type: YTN; PAM sequence: CTG
tgcccagccacaatgcagtc

SEQ ID NO: 200709 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgtgcc

SEQ ID NO: 200710 - DNA, 20 bp, Artificial Sequence
  Description of Artificial Sequence: Synthetic oligonucleotide
  Target: ATXN1; (-) strand; PAM type: YTN; PAM sequence: CTA
ggattacaggtgtgagccac

SEQ ID NO: 200711 - DNA, 20 bp, Artificial Sequence
  Description of Artificial Sequence: Synthetic oligonucleotide
  Target: ATXN1; (-) strand; PAM type: YTN; PAM sequence: CTA
aagtgctaggattacaggtg

SEQ ID NO: 200712 - DNA, 20 bp, Artificial Sequence
  Description of Artificial Sequence: Synthetic oligonucleotide
  Target: ATXN1; (-) strand; PAM type: YTN; PAM sequence: TTC
taaagtgctaggattacagg

SEQ ID NO: 200713 - DNA, 20 bp, Artificial Sequence
  Description of Artificial Sequence: Synthetic oligonucleotide
  Target: ATXN1; (-) strand; PAM type: YTN; PAM sequence: CTT
ctaaagtgctaggattacag

SEQ ID NO: 200714 - DNA, 20 bp, Artificial Sequence
  Description of Artificial Sequence: Synthetic oligonucleotide
  Target: ATXN1; (-) strand; PAM type: YTN; PAM sequence: TTA
gccttctaaagtgctaggat

SEQ ID NO: 200715 - DNA, 20 bp, Artificial Sequence
  Description of Artificial Sequence: Synthetic oligonucleotide
  Target: ATXN1; (-) strand; PAM type: YTN; PAM sequence: CTT
agccttctaaagtgctagga

SEQ ID NO: 200716 - DNA, 20 bp, Artificial Sequence
  Description of Artificial Sequence: Synthetic oligonucleotide
  Target: ATXN1; (-) strand; PAM type: YTN; PAM sequence: CTG
ccttagccttctaaagtgct

SEQ ID NO: 200717 - DNA, 20 bp, Artificial Sequence
  Description of Artificial Sequence: Synthetic oligonucleotide
  Target: ATXN1; (-) strand; PAM type: YTN; PAM sequence: CTC
ctgccttagccttctaaagt

SEQ ID NO: 200718 - DNA, 20 bp, Artificial Sequence
  Description of Artificial Sequence: Synthetic oligonucleotide
  Target: ATXN1; (-) strand; PAM type: YTN; PAM sequence: CTC
aagcagcctcctgccttagc

SEQ ID NO: 200719 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcagcctcctgcc

SEQ ID NO: 200720 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcagcctcct

SEQ ID NO: 200721 - DNA, 20 bp, Artificial Sequence
  Description of Artificial Sequence: Synthetic oligonucleotide
  Target: ATXN1; (-) strand; PAM type: YTN; PAM sequence: CTG
gaactcctgggctcaagcag

SEQ ID NO: 200722 - DNA, 20 bp, Artificial Sequence
  Description of Artificial Sequence: Synthetic oligonucleotide
  Target: ATXN1; (-) strand; PAM type: YTN; PAM sequence: CTG
caacctggaactcctgggct

SEQ ID NO: 200723 - DNA, 20 bp, Artificial Sequence
  Description of Artificial Sequence: Synthetic oligonucleotide
  Target: ATXN1; (-) strand; PAM type: YTN; PAM sequence: TTA
ctgcaacctggaactcctgg

SEQ ID NO: 200724 - DNA, 20 bp, Artificial Sequence
  Description of Artificial Sequence: Synthetic oligonucleotide
  Target: ATXN1; (-) strand; PAM type: YTN; PAM sequence: CTT
actgcaacctggaactcctg

SEQ ID NO: 200725 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgcagtcac

SEQ ID NO: 200726 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 200727 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 200728 - DNA, 20 bp, Artificial Sequence
  Description of Artificial Sequence: Synthetic oligonucleotide
  Target: ATXN1; (-) strand; PAM type: YTN; PAM sequence: CTC
gctctgtcacccaggctgga

SEQ ID NO: 200729 - DNA, 20 bp, Artificial Sequence
  Description of Artificial Sequence: Synthetic oligonucleotide
  Target: ATXN1; (-) strand; PAM type: YTN; PAM sequence: TTG
acacaggatctcgctctgtc

SEQ ID NO: 200730 - DNA, 20 bp, Artificial Sequence
  Description of Artificial Sequence: Synthetic oligonucleotide
  Target: ATXN1; (-) strand; PAM type: YTN; PAM sequence: TTT
gacacaggatctcgctctgt

SEQ ID NO: 200731 - DNA, 20 bp, Artificial Sequence
  Description of Artificial Sequence: Synthetic oligonucleotide
  Target: ATXN1; (-) strand; PAM type: YTN; PAM sequence: TTT
tgacacaggatctcgctctg

SEQ ID NO: 200732 - DNA, 20 bp, Artificial Sequence
  Description of Artificial Sequence: Synthetic oligonucleotide
  Target: ATXN1; (-) strand; PAM type: YTN; PAM sequence: TTT
ttgacacaggatctcgctct

SEQ ID NO: 200733 - DNA, 20 bp, Artificial Sequence
  Description of Artificial Sequence: Synthetic oligonucleotide
  Target: ATXN1; (-) strand; PAM type: YTN; PAM sequence: TTT
tttgacacaggatctcgctc

SEQ ID NO: 200734 - DNA, 20 bp, Artificial Sequence
  Description of Artificial Sequence: Synthetic oligonucleotide
  Target: ATXN1; (-) strand; PAM type: YTN; PAM sequence: TTT
ttttgacacaggatctcgct

SEQ ID NO: 200735 - DNA, 20 bp, Artificial Sequence
  Description of Artificial Sequence: Synthetic oligonucleotide
  Target: ATXN1; (-) strand; PAM type: YTN; PAM sequence: TTT
tttttgacacaggatctcgc

SEQ ID NO: 200736 - DNA, 20 bp, Artificial Sequence
  Description of Artificial Sequence: Synthetic oligonucleotide
  Target: ATXN1; (-) strand; PAM type: YTN; PAM sequence: TTT
ttttttgacacaggatctcg

SEQ ID NO: 200737 - DNA, 20 bp, Artificial Sequence
  Description of Artificial Sequence: Synthetic oligonucleotide
  Target: ATXN1; (-) strand; PAM type: YTN; PAM sequence: TTT
tttttttgacacaggatctc

SEQ ID NO: 200738 - DNA, 20 bp, Artificial Sequence
  Description of Artificial Sequence: Synthetic oligonucleotide
  Target: ATXN1; (-) strand; PAM type: YTN; PAM sequence: TTT
ttttttttgacacaggatct

SEQ ID NO: 200739 - DNA, 20 bp, Artificial Sequence
  Description of Artificial Sequence: Synthetic oligonucleotide
  Target: ATXN1; (-) strand; PAM type: YTN; PAM sequence: TTT
tttttttttgacacaggatc

SEQ ID NO: 200740 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgacacaggat

SEQ ID NO: 200741 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgacacagga

SEQ ID NO: 200742 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgacacagg

SEQ ID NO: 200743 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgacacag

SEQ ID NO: 200744 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgacaca

SEQ ID NO: 200745 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgacac

SEQ ID NO: 200746 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttgaca

SEQ ID NO: 200747 - DNA, 20 bp, Artificial Sequence
  Description of Artificial Sequence: Synthetic oligonucleotide
  Target: ATXN1; (-) strand; PAM type: YTN; PAM sequence: TTC
ttttttttttttttttttga

SEQ ID NO: 200748 - DNA, 20 bp, Artificial Sequence
  Description of Artificial Sequence: Synthetic oligonucleotide
  Target: ATXN1; (-) strand; PAM type: YTN; PAM sequence: TTT
cttttttttttttttttttg

SEQ ID NO: 200749 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttttttttt

SEQ ID NO: 200750 - DNA, 20 bp, Artificial Sequence
  Description of Artificial Sequence: Synthetic oligonucleotide
  Target: ATXN1; (-) strand; PAM type: YTN; PAM sequence: TTT
ttcttttttttttttttttt

SEQ ID NO: 200751 - DNA, 20 bp, Artificial Sequence
  Description of Artificial Sequence: Synthetic oligonucleotide
  Target: ATXN1; (-) strand; PAM type: YTN; PAM sequence: TTT
tttctttttttttttttttt

SEQ ID NO: 200752 - DNA, 20 bp, Artificial Sequence
  Description of Artificial Sequence: Synthetic oligonucleotide
  Target: ATXN1; (-) strand; PAM type: YTN; PAM sequence: TTT
ttttcttttttttttttttt

SEQ ID NO: 200753 - DNA, 20 bp, Artificial Sequence
  Description of Artificial Sequence: Synthetic oligonucleotide
  Target: ATXN1; (-) strand; PAM type: YTN; PAM sequence: TTT
tttttctttttttttttttt

SEQ ID NO: 200754 - DNA, 20 bp, Artificial Sequence
  Description of Artificial Sequence: Synthetic oligonucleotide
  Target: ATXN1; (-) strand; PAM type: YTN; PAM sequence: TTT
ttttttcttttttttttttt

SEQ ID NO: 200755 - DNA, 20 bp, Artificial Sequence
  Description of Artificial Sequence: Synthetic oligonucleotide
  Target: ATXN1; (-) strand; PAM type: YTN; PAM sequence: TTT
tttttttctttttttttttt

SEQ ID NO: 200756 - DNA, 20 bp, Artificial Sequence
  Description of Artificial Sequence: Synthetic oligonucleotide
  Target: ATXN1; (-) strand; PAM type: YTN; PAM sequence: CTT
ttttttttcttttttttttt

SEQ ID NO: 200757 - DNA, 20 bp, Artificial Sequence
  Description of Artificial Sequence: Synthetic oligonucleotide
  Target: ATXN1; (-) strand; PAM type: YTN; PAM sequence: TTA
ccttttttttttcttttttt

SEQ ID NO: 200758 - DNA, 20 bp, Artificial Sequence
  Description of Artificial Sequence: Synthetic oligonucleotide
  Target: ATXN1; (-) strand; PAM type: YTN; PAM sequence: CTT
accttttttttttctttttt

SEQ ID NO: 200759 - DNA, 20 bp, Artificial Sequence
  Description of Artificial Sequence: Synthetic oligonucleotide
  Target: ATXN1; (-) strand; PAM type: YTN; PAM sequence: TTC
atatatcgtaaaacttacct

SEQ ID NO: 200760 - DNA, 20 bp, Artificial Sequence
  Description of Artificial Sequence: Synthetic oligonucleotide
  Target: ATXN1; (-) strand; PAM type: YTN; PAM sequence: TTG
agatatgattcatatatcgt

SEQ ID NO: 200761 - DNA, 20 bp, Artificial Sequence
  Description of Artificial Sequence: Synthetic oligonucleotide
  Target: ATXN1; (-) strand; PAM type: YTN; PAM sequence: TTA
ttgagatatgattcatatat

SEQ ID NO: 200762 - DNA, 20 bp, Artificial Sequence
  Description of Artificial Sequence: Synthetic oligonucleotide
  Target: ATXN1; (-) strand; PAM type: YTN; PAM sequence: TTT
attgagatatgattcatata

SEQ ID NO: 200763 - DNA, 20 bp, Artificial Sequence
  Description of Artificial Sequence: Synthetic oligonucleotide
  Target: ATXN1; (-) strand; PAM type: YTN; PAM sequence: TTT
tattgagatatgattcatat

SEQ ID NO: 200764 - DNA, 20 bp, Artificial Sequence
  Description of Artificial Sequence: Synthetic oligonucleotide
  Target: ATXN1; (-) strand; PAM type: YTN; PAM sequence: TTA
aaaaggttttattgagatat

SEQ ID NO: 200765 - DNA, 20 bp, Artificial Sequence
  Description of Artificial Sequence: Synthetic oligonucleotide
  Target: ATXN1; (-) strand; PAM type: YTN; PAM sequence: CTA
aaagaaaataaaaattaaaa

SEQ ID NO: 200766 - DNA, 20 bp, Artificial Sequence
  Description of Artificial Sequence: Synthetic oligonucleotide
  Target: ATXN1; (-) strand; PAM type: YTN; PAM sequence: CTC
taaaagaaaataaaaattaa

SEQ ID NO: 200767 - DNA, 20 bp, Artificial Sequence
  Description of Artificial Sequence: Synthetic oligonucleotide
  Target: ATXN1; (-) strand; PAM type: YTN; PAM sequence: CTG
tctctaaaagaaaataaaaa

SEQ ID NO: 200768 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagtgagaccctg

SEQ ID NO: 200769 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagtga

SEQ ID NO: 200770 - DNA, 20 bp, Artificial Sequence
  Description of Artificial Sequence: Synthetic oligonucleotide
  Target: ATXN1; (-) strand; PAM type: YTN; PAM sequence: CTA
cactccagcctgggtgacag

SEQ ID NO: 200771 - DNA, 20 bp, Artificial Sequence
  Description of Artificial Sequence: Synthetic oligonucleotide
  Target: ATXN1; (-) strand; PAM type: YTN; PAM sequence: CTA
ctacactccagcctgggtga

SEQ ID NO: 200772 - DNA, 20 bp, Artificial Sequence
  Description of Artificial Sequence: Synthetic oligonucleotide
  Target: ATXN1; (-) strand; PAM type: YTN; PAM sequence: TTA
tggtcgtgctactacactcc

SEQ ID NO: 200773 - DNA, 20 bp, Artificial Sequence
  Description of Artificial Sequence: Synthetic oligonucleotide
  Target: ATXN1; (-) strand; PAM type: YTN; PAM sequence: CTG
cagtgagttatggtcgtgct

SEQ ID NO: 200774 - DNA, 20 bp, Artificial Sequence
  Description of Artificial Sequence: Synthetic oligonucleotide
  Target: ATXN1; (-) strand; PAM type: YTN; PAM sequence: TTG
agactgcagtgagttatggt

SEQ ID NO: 200775 - DNA, 20 bp, Artificial Sequence
  Description of Artificial Sequence: Synthetic oligonucleotide
  Target: ATXN1; (-) strand; PAM type: YTN; PAM sequence: TTT
gagactgcagtgagttatgg

SEQ ID NO: 200776 - DNA, 20 bp, Artificial Sequence
  Description of Artificial Sequence: Synthetic oligonucleotide
  Target: ATXN1; (-) strand; PAM type: YTN; PAM sequence: TTG
agcccaggagtttgagactg

SEQ ID NO: 200777 - DNA, 20 bp, Artificial Sequence
  Description of Artificial Sequence: Synthetic oligonucleotide
  Target: ATXN1; (-) strand; PAM type: YTN; PAM sequence: TTT
gagcccaggagtttgagact

SEQ ID NO: 200778 - DNA, 20 bp, Artificial Sequence
  Description of Artificial Sequence: Synthetic oligonucleotide
  Target: ATXN1; (-) strand; PAM type: YTN; PAM sequence: TTG
tttgagcccaggagtttgag

SEQ ID NO: 200779 - DNA, 20 bp, Artificial Sequence
  Description of Artificial Sequence: Synthetic oligonucleotide
  Target: ATXN1; (-) strand; PAM type: YTN; PAM sequence: CTG
aggtggaaggattgtttgag

SEQ ID NO: 200780 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggtggaagga

SEQ ID NO: 200781 - DNA, 20 bp, Artificial Sequence
  Description of Artificial Sequence: Synthetic oligonucleotide
  Target: ATXN1; (-) strand; PAM type: YTN; PAM sequence: TTG
tactcgggaggctgaggtgg

SEQ ID NO: 200782 - DNA, 20 bp, Artificial Sequence
  Description of Artificial Sequence: Synthetic oligonucleotide
  Target: ATXN1; (-) strand; PAM type: YTN; PAM sequence: TTT
gtactcgggaggctgaggtg

SEQ ID NO: 200783 - DNA, 20 bp, Artificial Sequence
  Description of Artificial Sequence: Synthetic oligonucleotide
  Target: ATXN1; (-) strand; PAM type: YTN; PAM sequence: CTG
tttgtactcgggaggctgag

SEQ ID NO: 200784 - DNA, 20 bp, Artificial Sequence
  Description of Artificial Sequence: Synthetic oligonucleotide
  Target: ATXN1; (-) strand; PAM type: YTN; PAM sequence: TTA
cataataataataataaata

SEQ ID NO: 200785 - DNA, 20 bp, Artificial Sequence
  Description of Artificial Sequence: Synthetic oligonucleotide
  Target: ATXN1; (-) strand; PAM type: YTN; PAM sequence: TTT
acataataataataataaat

SEQ ID NO: 200786 - DNA, 20 bp, Artificial Sequence
  Description of Artificial Sequence: Synthetic oligonucleotide
  Target: ATXN1; (-) strand; PAM type: YTN; PAM sequence: TTT
tacataataataataataaa

SEQ ID NO: 200787 - DNA, 20 bp, Artificial Sequence
  Description of Artificial Sequence: Synthetic oligonucleotide
  Target: ATXN1; (-) strand; PAM type: YTN; PAM sequence: TTT
ttacataataataataataa

SEQ ID NO: 200788 - DNA, 20 bp, Artificial Sequence
  Description of Artificial Sequence: Synthetic oligonucleotide
  Target: ATXN1; (-) strand; PAM type: YTN; PAM sequence: CTG
tttttacataataataataa

SEQ ID NO: 200789 - DNA, 20 bp, Artificial Sequence
  Description of Artificial Sequence: Synthetic oligonucleotide
  Target: ATXN1; (-) strand; PAM type: YTN; PAM sequence: CTG
gacaacacagggagaccctg

SEQ ID NO: 200790 - DNA, 20 bp, Artificial Sequence
  Description of Artificial Sequence: Synthetic oligonucleotide
  Target: ATXN1; (-) strand; PAM type: YTN; PAM sequence: TTA
gagaccagtctggacaacac

SEQ ID NO: 200791 - DNA, 20 bp, Artificial Sequence
  Description of Artificial Sequence: Synthetic oligonucleotide
  Target: ATXN1; (-) strand; PAM type: YTN; PAM sequence: TTG
aggccaggagttagagacca

SEQ ID NO: 200792 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagttagagacc

SEQ ID NO: 200793 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaggcgagagcat

SEQ ID NO: 200794 - DNA, 20 bp, Artificial Sequence
  Description of Artificial Sequence: Synthetic oligonucleotide
  Target: ATXN1; (-) strand; PAM type: YTN; PAM sequence: TTT
gggaggccaaggcgagagca

SEQ ID NO: 200795 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaaggcgagagc

SEQ ID NO: 200796 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 200797 - DNA, 20 bp, Artificial Sequence
  Description of Artificial Sequence: Synthetic oligonucleotide
  Target: ATXN1; (-) strand; PAM type: YTN; PAM sequence: TTC
atgcctgtaatcccagcact

SEQ ID NO: 200798 - DNA, 20 bp, Artificial Sequence
  Description of Artificial Sequence: Synthetic oligonucleotide
  Target: ATXN1; (-) strand; PAM type: YTN; PAM sequence: TTG
gccaggcacaatggttcatg

SEQ ID NO: 200799 - DNA, 20 bp, Artificial Sequence
  Description of Artificial Sequence: Synthetic oligonucleotide
  Target: ATXN1; (-) strand; PAM type: YTN; PAM sequence: TTT
ggccaggcacaatggttcat

SEQ ID NO: 200800 - DNA, 20 bp, Artificial Sequence
  Description of Artificial Sequence: Synthetic oligonucleotide
  Target: ATXN1; (-) strand; PAM type: YTN; PAM sequence: TTT
tggccaggcacaatggttca

SEQ ID NO: 200801 - DNA, 20 bp, Artificial Sequence
  Description of Artificial Sequence: Synthetic oligonucleotide
  Target: ATXN1; (-) strand; PAM type: YTN; PAM sequence: TTA
aaaataatagttttggccag

SEQ ID NO: 200802 - DNA, 20 bp, Artificial Sequence
  Description of Artificial Sequence: Synthetic oligonucleotide
  Target: ATXN1; (-) strand; PAM type: YTN; PAM sequence: TTT
aaaaataatagttttggcca

SEQ ID NO: 200803 - DNA, 20 bp, Artificial Sequence
  Description of Artificial Sequence: Synthetic oligonucleotide
  Target: ATXN1; (-) strand; PAM type: YTN; PAM sequence: TTT
taaaaataatagttttggcc

SEQ ID NO: 200804 - DNA, 20 bp, Artificial Sequence
  Description of Artificial Sequence: Synthetic oligonucleotide
  Target: ATXN1; (-) strand; PAM type: YTN; PAM sequence: TTA
gtattttaaaaataatagtt

SEQ ID NO: 200805 - DNA, 20 bp, Artificial Sequence
  Description of Artificial Sequence: Synthetic oligonucleotide
  Target: ATXN1; (-) strand; PAM type: YTN; PAM sequence: TTA
ttagtattttaaaaataata

SEQ ID NO: 200806 - DNA, 20 bp, Artificial Sequence
  Description of Artificial Sequence: Synthetic oligonucleotide
  Target: ATXN1; (-) strand; PAM type: YTN; PAM sequence: TTT
attagtattttaaaaataat

SEQ ID NO: 200807 - DNA, 20 bp, Artificial Sequence
  Description of Artificial Sequence: Synthetic oligonucleotide
  Target: ATXN1; (-) strand; PAM type: YTN; PAM sequence: TTT
tattagtattttaaaaataa

SEQ ID NO: 200808 - DNA, 20 bp, Artificial Sequence
  Description of Artificial Sequence: Synthetic oligonucleotide
  Target: ATXN1; (-) strand; PAM type: YTN; PAM sequence: TTT
ttattagtattttaaaaata

SEQ ID NO: 200809 - DNA, 20 bp, Artificial Sequence
  Description of Artificial Sequence: Synthetic oligonucleotide
  Target: ATXN1; (-) strand; PAM type: YTN; PAM sequence: TTT
tttattagtattttaaaaat

SEQ ID NO: 200810 - DNA, 20 bp, Artificial Sequence
  Description of Artificial Sequence: Synthetic oligonucleotide
  Target: ATXN1; (-) strand; PAM type: YTN; PAM sequence: CTC
gtattttttattagtatttt

SEQ ID NO: 200811 - DNA, 20 bp, Artificial Sequence
  Description of Artificial Sequence: Synthetic oligonucleotide
  Target: ATXN1; (-) strand; PAM type: YTN; PAM sequence: TTG
tctcgtattttttattagta

SEQ ID NO: 200812 - DNA, 20 bp, Artificial Sequence
  Description of Artificial Sequence: Synthetic oligonucleotide
  Target: ATXN1; (-) strand; PAM type: YTN; PAM sequence: TTA
aattgtctcgtattttttat

SEQ ID NO: 200813 - DNA, 20 bp, Artificial Sequence
  Description of Artificial Sequence: Synthetic oligonucleotide
  Target: ATXN1; (-) strand; PAM type: YTN; PAM sequence: TTT
aaattgtctcgtatttttta

SEQ ID NO: 200814 - DNA, 20 bp, Artificial Sequence
  Description of Artificial Sequence: Synthetic oligonucleotide
  Target: ATXN1; (-) strand; PAM type: YTN; PAM sequence: TTT
taaattgtctcgtatttttt

SEQ ID NO: 200815 - DNA, 20 bp, Artificial Sequence
  Description of Artificial Sequence: Synthetic oligonucleotide
  Target: ATXN1; (-) strand; PAM type: YTN; PAM sequence: TTT
ttaaattgtctcgtattttt

SEQ ID NO: 200816 - DNA, 20 bp, Artificial Sequence
  Description of Artificial Sequence: Synthetic oligonucleotide
  Target: ATXN1; (-) strand; PAM type: YTN; PAM sequence: TTA
taatttttaaattgtctcgt

SEQ ID NO: 200817 - DNA, 20 bp, Artificial Sequence
  Description of Artificial Sequence: Synthetic oligonucleotide
  Target: ATXN1; (-) strand; PAM type: YTN; PAM sequence: CTA
cgcagtaattataattttta

SEQ ID NO: 200818 - DNA, 20 bp, Artificial Sequence
  Description of Artificial Sequence: Synthetic oligonucleotide
  Target: ATXN1; (-) strand; PAM type: YTN; PAM sequence: TTC
tacgcagtaattataatttt

SEQ ID NO: 200819 - DNA, 20 bp, Artificial Sequence
  Description of Artificial Sequence: Synthetic oligonucleotide
  Target: ATXN1; (-) strand; PAM type: YTN; PAM sequence: CTT
ctacgcagtaattataattt

SEQ ID NO: 200820 - DNA, 20 bp, Artificial Sequence
  Description of Artificial Sequence: Synthetic oligonucleotide
  Target: ATXN1; (-) strand; PAM type: YTN; PAM sequence: CTC
ttctacgcagtaattataat

SEQ ID NO: 200821 - DNA, 20 bp, Artificial Sequence
  Description of Artificial Sequence: Synthetic oligonucleotide
  Target: ATXN1; (-) strand; PAM type: YTN; PAM sequence: TTA
ggtctcttctacgcagtaat

SEQ ID NO: 200822 - DNA, 20 bp, Artificial Sequence
  Description of Artificial Sequence: Synthetic oligonucleotide
  Target: ATXN1; (-) strand; PAM type: YTN; PAM sequence: CTT
aggtctcttctacgcagtaa

SEQ ID NO: 200823 - DNA, 20 bp, Artificial Sequence
  Description of Artificial Sequence: Synthetic oligonucleotide
  Target: ATXN1; (-) strand; PAM type: YTN; PAM sequence: TTA
catacttaggtctcttctac

SEQ ID NO: 200824 - DNA, 20 bp, Artificial Sequence
  Description of Artificial Sequence: Synthetic oligonucleotide
  Target: ATXN1; (-) strand; PAM type: YTN; PAM sequence: TTT
acatacttaggtctcttcta

SEQ ID NO: 200825 - DNA, 20 bp, Artificial Sequence
  Description of Artificial Sequence: Synthetic oligonucleotide
  Target: ATXN1; (-) strand; PAM type: YTN; PAM sequence: TTT
tacatacttaggtctcttct

SEQ ID NO: 200826 - DNA, 20 bp, Artificial Sequence
  Description of Artificial Sequence: Synthetic oligonucleotide
  Target: ATXN1; (-) strand; PAM type: YTN; PAM sequence: TTT
ttacatacttaggtctcttc

SEQ ID NO: 200827 - DNA, 20 bp, Artificial Sequence
  Description of Artificial Sequence: Synthetic oligonucleotide
  Target: ATXN1; (-) strand; PAM type: YTN; PAM sequence: TTT
tttacatacttaggtctctt

SEQ ID NO: 200828 - DNA, 20 bp, Artificial Sequence
  Description of Artificial Sequence: Synthetic oligonucleotide
  Target: ATXN1; (-) strand; PAM type: YTN; PAM sequence: TTT
ttttacatacttaggtctct

SEQ ID NO: 200829 - DNA, 20 bp, Artificial Sequence
  Description of Artificial Sequence: Synthetic oligonucleotide
  Target: ATXN1; (-) strand; PAM type: YTN; PAM sequence: TTA
atttttttacatacttaggt

SEQ ID NO: 200830 - DNA, 20 bp, Artificial Sequence
  Description of Artificial Sequence: Synthetic oligonucleotide
  Target: ATXN1; (-) strand; PAM type: YTN; PAM sequence: TTT
aatttttttacatacttagg

SEQ ID NO: 200831 - DNA, 20 bp, Artificial Sequence
  Description of Artificial Sequence: Synthetic oligonucleotide
  Target: ATXN1; (-) strand; PAM type: YTN; PAM sequence: TTT
taatttttttacatacttag

SEQ ID NO: 200832 - DNA, 20 bp, Artificial Sequence
  Description of Artificial Sequence: Synthetic oligonucleotide
  Target: ATXN1; (-) strand; PAM type: YTN; PAM sequence: CTT
ttaatttttttacatactta

SEQ ID NO: 200833 - DNA, 20 bp, Artificial Sequence
  Description of Artificial Sequence: Synthetic oligonucleotide
  Target: ATXN1; (-) strand; PAM type: YTN; PAM sequence: TTG
gcttttaatttttttacata

SEQ ID NO: 200834 - DNA, 20 bp, Artificial Sequence
  Description of Artificial Sequence: Synthetic oligonucleotide
  Target: ATXN1; (-) strand; PAM type: YTN; PAM sequence: TTT
ggcttttaatttttttacat

SEQ ID NO: 200835 - DNA, 20 bp, Artificial Sequence
  Description of Artificial Sequence: Synthetic oligonucleotide
  Target: ATXN1; (-) strand; PAM type: YTN; PAM sequence: TTT
tggcttttaatttttttaca

SEQ ID NO: 200836 - DNA, 20 bp, Artificial Sequence
  Description of Artificial Sequence: Synthetic oligonucleotide
  Target: ATXN1; (-) strand; PAM type: YTN; PAM sequence: TTT
ttggcttttaatttttttac

SEQ ID NO: 200837 - DNA, 20 bp, Artificial Sequence
  Description of Artificial Sequence: Synthetic oligonucleotide
  Target: ATXN1; (-) strand; PAM type: YTN; PAM sequence: TTT
tttggcttttaattttttta

SEQ ID NO: 200838 - DNA, 20 bp, Artificial Sequence
  Description of Artificial Sequence: Synthetic oligonucleotide
  Target: ATXN1; (-) strand; PAM type: YTN; PAM sequence: TTA
ttttttggcttttaattttt

SEQ ID NO: 200839 - DNA, 20 bp, Artificial Sequence
  Description of Artificial Sequence: Synthetic oligonucleotide
  Target: ATXN1; (-) strand; PAM type: YTN; PAM sequence: TTT
attttttggcttttaatttt

SEQ ID NO: 200840 - DNA, 20 bp, Artificial Sequence
  Description of Artificial Sequence: Synthetic oligonucleotide
  Target: ATXN1; (-) strand; PAM type: YTN; PAM sequence: TTT
tattttttggcttttaattt

SEQ ID NO: 200841 - DNA, 20 bp, Artificial Sequence
  Description of Artificial Sequence: Synthetic oligonucleotide
  Target: ATXN1; (-) strand; PAM type: YTN; PAM sequence: TTT
ttattttttggcttttaatt

SEQ ID NO: 200842 - DNA, 20 bp, Artificial Sequence
  Description of Artificial Sequence: Synthetic oligonucleotide
  Target: ATXN1; (-) strand; PAM type: YTN; PAM sequence: TTA
tcagatttttattttttggc

SEQ ID NO: 200843 - DNA, 20 bp, Artificial Sequence
  Description of Artificial Sequence: Synthetic oligonucleotide
  Target: ATXN1; (-) strand; PAM type: YTN; PAM sequence: TTT
atcagatttttattttttgg

SEQ ID NO: 200844 - DNA, 20 bp, Artificial Sequence
  Description of Artificial Sequence: Synthetic oligonucleotide
  Target: ATXN1; (-) strand; PAM type: YTN; PAM sequence: TTA
tttatcagatttttattttt

SEQ ID NO: 200845 - DNA, 20 bp, Artificial Sequence
  Description of Artificial Sequence: Synthetic oligonucleotide
  Target: ATXN1; (-) strand; PAM type: YTN; PAM sequence: CTT
atttatcagatttttatttt

SEQ ID NO: 200846 - DNA, 20 bp, Artificial Sequence
  Description of Artificial Sequence: Synthetic oligonucleotide
  Target: ATXN1; (-) strand; PAM type: YTN; PAM sequence: TTA
aagtcatcttatttatcaga

SEQ ID NO: 200847 - DNA, 20 bp, Artificial Sequence
  Description of Artificial Sequence: Synthetic oligonucleotide
  Target: ATXN1; (-) strand; PAM type: YTN; PAM sequence: TTA
aaaaattaaagtcatcttat

SEQ ID NO: 200848 - DNA, 20 bp, Artificial Sequence
  Description of Artificial Sequence: Synthetic oligonucleotide
  Target: ATXN1; (-) strand; PAM type: YTN; PAM sequence: TTT
aaaaaattaaagtcatctta

SEQ ID NO: 200849 - DNA, 20 bp, Artificial Sequence
  Description of Artificial Sequence: Synthetic oligonucleotide
  Target: ATXN1; (-) strand; PAM type: YTN; PAM sequence: TTT
taaaaaattaaagtcatctt

SEQ ID NO: 200850 - DNA, 20 bp, Artificial Sequence
  Description of Artificial Sequence: Synthetic oligonucleotide
  Target: ATXN1; (-) strand; PAM type: YTN; PAM sequence: TTC
atgcagggttttaaaaaatt

SEQ ID NO: 200851 - DNA, 20 bp, Artificial Sequence
  Description of Artificial Sequence: Synthetic oligonucleotide
  Target: ATXN1; (-) strand; PAM type: YTN; PAM sequence: CTT
catgcagggttttaaaaaat

SEQ ID NO: 200852 - DNA, 20 bp, Artificial Sequence
  Description of Artificial Sequence: Synthetic oligonucleotide
  Target: ATXN1; (-) strand; PAM type: YTN; PAM sequence: TTC
ttcatgcagggttttaaaaa

SEQ ID NO: 200853 - DNA, 20 bp, Artificial Sequence
  Description of Artificial Sequence: Synthetic oligonucleotide
  Target: ATXN1; (-) strand; PAM type: YTN; PAM sequence: TTT
cttcatgcagggttttaaaa

SEQ ID NO: 200854 - DNA, 20 bp, Artificial Sequence
  Description of Artificial Sequence: Synthetic oligonucleotide
  Target: ATXN1; (-) strand; PAM type: YTN; PAM sequence: TTT
tcttcatgcagggttttaaa

SEQ ID NO: 200855 - DNA, 20 bp, Artificial Sequence
  Description of Artificial Sequence: Synthetic oligonucleotide
  Target: ATXN1; (-) strand; PAM type: YTN; PAM sequence: TTA
tgttttcttcatgcagggtt

SEQ ID NO: 200856 - DNA, 20 bp, Artificial Sequence
  Description of Artificial Sequence: Synthetic oligonucleotide
  Target: ATXN1; (-) strand; PAM type: YTN; PAM sequence: TTT
atgttttcttcatgcagggt

SEQ ID NO: 200857 - DNA, 20 bp, Artificial Sequence
  Description of Artificial Sequence: Synthetic oligonucleotide
  Target: ATXN1; (-) strand; PAM type: YTN; PAM sequence: CTT
tatgttttcttcatgcaggg

SEQ ID NO: 200858 - DNA, 20 bp, Artificial Sequence
  Description of Artificial Sequence: Synthetic oligonucleotide
  Target: ATXN1; (-) strand; PAM type: YTN; PAM sequence: TTG
actttatgttttcttcatgc

SEQ ID NO: 200859 - DNA, 20 bp, Artificial Sequence
  Description of Artificial Sequence: Synthetic oligonucleotide
  Target: ATXN1; (-) strand; PAM type: YTN; PAM sequence: TTT
gactttatgttttcttcatg

SEQ ID NO: 200860 - DNA, 20 bp, Artificial Sequence
  Description of Artificial Sequence: Synthetic oligonucleotide
  Target: ATXN1; (-) strand; PAM type: YTN; PAM sequence: TTT
tgactttatgttttcttcat

SEQ ID NO: 200861 - DNA, 20 bp, Artificial Sequence
  Description of Artificial Sequence: Synthetic oligonucleotide
  Target: ATXN1; (-) strand; PAM type: YTN; PAM sequence: CTT
ttgactttatgttttcttca

SEQ ID NO: 200862 - DNA, 20 bp, Artificial Sequence
  Description of Artificial Sequence: Synthetic oligonucleotide
  Target: ATXN1; (-) strand; PAM type: YTN; PAM sequence: TTG
tcttttgactttatgttttc

SEQ ID NO: 200863 - DNA, 20 bp, Artificial Sequence
  Description of Artificial Sequence: Synthetic oligonucleotide
  Target: ATXN1; (-) strand; PAM type: YTN; PAM sequence: TTT
gtcttttgactttatgtttt

SEQ ID NO: 200864 - DNA, 20 bp, Artificial Sequence
  Description of Artificial Sequence: Synthetic oligonucleotide
  Target: ATXN1; (-) strand; PAM type: YTN; PAM sequence: TTC
cgtttgtcttttgactttat

SEQ ID NO: 200865 - DNA, 20 bp, Artificial Sequence
  Description of Artificial Sequence: Synthetic oligonucleotide
  Target: ATXN1; (-) strand; PAM type: YTN; PAM sequence: TTT
ccgtttgtcttttgacttta

SEQ ID NO: 200866 - DNA, 20 bp, Artificial Sequence
  Description of Artificial Sequence: Synthetic oligonucleotide
  Target: ATXN1; (-) strand; PAM type: YTN; PAM sequence: TTT
tccgtttgtcttttgacttt

SEQ ID NO: 200867 - DNA, 20 bp, Artificial Sequence
  Description of Artificial Sequence: Synthetic oligonucleotide
  Target: ATXN1; (-) strand; PAM type: YTN; PAM sequence: TTT
ttccgtttgtcttttgactt

SEQ ID NO: 200868 - DNA, 20 bp, Artificial Sequence
  Description of Artificial Sequence: Synthetic oligonucleotide
  Target: ATXN1; (-) strand; PAM type: YTN; PAM sequence: TTA
aatttttccgtttgtctttt

SEQ ID NO: 200869 - DNA, 20 bp, Artificial Sequence
  Description of Artificial Sequence: Synthetic oligonucleotide
  Target: ATXN1; (-) strand; PAM type: YTN; PAM sequence: TTT
aaatttttccgtttgtcttt

SEQ ID NO: 200870 - DNA, 20 bp, Artificial Sequence
  Description of Artificial Sequence: Synthetic oligonucleotide
  Target: ATXN1; (-) strand; PAM type: YTN; PAM sequence: TTA
gtttaaatttttccgtttgt

SEQ ID NO: 200871 - DNA, 20 bp, Artificial Sequence
  Description of Artificial Sequence: Synthetic oligonucleotide
  Target: ATXN1; (-) strand; PAM type: YTN; PAM sequence: TTT
agtttaaatttttccgtttg

SEQ ID NO: 200872 - DNA, 20 bp, Artificial Sequence
  Description of Artificial Sequence: Synthetic oligonucleotide
  Target: ATXN1; (-) strand; PAM type: YTN; PAM sequence: TTT
tagtttaaatttttccgttt

SEQ ID NO: 200873 - DNA, 20 bp, Artificial Sequence
  Description of Artificial Sequence: Synthetic oligonucleotide
  Target: ATXN1; (-) strand; PAM type: YTN; PAM sequence: CTA
ttttagtttaaatttttccg

SEQ ID NO: 200874 - DNA, 20 bp, Artificial Sequence
  Description of Artificial Sequence: Synthetic oligonucleotide
  Target: ATXN1; (-) strand; PAM type: YTN; PAM sequence: TTA
tgctattttagtttaaattt

SEQ ID NO: 200875 - DNA, 20 bp, Artificial Sequence
  Description of Artificial Sequence: Synthetic oligonucleotide
  Target: ATXN1; (-) strand; PAM type: YTN; PAM sequence: CTT
atgctattttagtttaaatt

SEQ ID NO: 200876 - DNA, 20 bp, Artificial Sequence
  Description of Artificial Sequence: Synthetic oligonucleotide
  Target: ATXN1; (-) strand; PAM type: YTN; PAM sequence: TTG
tcttatgctattttagttta

SEQ ID NO: 200877 - DNA, 20 bp, Artificial Sequence
  Description of Artificial Sequence: Synthetic oligonucleotide
  Target: ATXN1; (-) strand; PAM type: YTN; PAM sequence: TTT
gtcttatgctattttagttt

SEQ ID NO: 200878 - DNA, 20 bp, Artificial Sequence
  Description of Artificial Sequence: Synthetic oligonucleotide
  Target: ATXN1; (-) strand; PAM type: YTN; PAM sequence: TTT
tgtcttatgctattttagtt

SEQ ID NO: 200879 - DNA, 20 bp, Artificial Sequence
  Description of Artificial Sequence: Synthetic oligonucleotide
  Target: ATXN1; (-) strand; PAM type: YTN; PAM sequence: CTT
ttgtcttatgctattttagt

SEQ ID NO: 200880 - DNA, 20 bp, Artificial Sequence
  Description of Artificial Sequence: Synthetic oligonucleotide
  Target: ATXN1; (-) strand; PAM type: YTN; PAM sequence: TTA
gtccttttgtcttatgctat

SEQ ID NO: 200881 - DNA, 20 bp, Artificial Sequence
  Description of Artificial Sequence: Synthetic oligonucleotide
  Target: ATXN1; (-) strand; PAM type: YTN; PAM sequence: CTA
aaaagattagtccttttgtc

SEQ ID NO: 200882 - DNA, 20 bp, Artificial Sequence
  Description of Artificial Sequence: Synthetic oligonucleotide
  Target: ATXN1; (-) strand; PAM type: YTN; PAM sequence: TTA
ggagcatgtaacagctaaaa

SEQ ID NO: 200883 - DNA, 20 bp, Artificial Sequence
  Description of Artificial Sequence: Synthetic oligonucleotide
  Target: ATXN1; (-) strand; PAM type: YTN; PAM sequence: TTT
aggagcatgtaacagctaaa

SEQ ID NO: 200884 - DNA, 20 bp, Artificial Sequence
  Description of Artificial Sequence: Synthetic oligonucleotide
  Target: ATXN1; (-) strand; PAM type: YTN; PAM sequence: TTT
taggagcatgtaacagctaa

SEQ ID NO: 200885 - DNA, 20 bp, Artificial Sequence
  Description of Artificial Sequence: Synthetic oligonucleotide
  Target: ATXN1; (-) strand; PAM type: YTN; PAM sequence: TTT
ttaggagcatgtaacagcta

SEQ ID NO: 200886 - DNA, 20 bp, Artificial Sequence
  Description of Artificial Sequence: Synthetic oligonucleotide
  Target: ATXN1; (-) strand; PAM type: YTN; PAM sequence: TTT
tttaggagcatgtaacagct

SEQ ID NO: 200887 - DNA, 20 bp, Artificial Sequence
  Description of Artificial Sequence: Synthetic oligonucleotide
  Target: ATXN1; (-) strand; PAM type: YTN; PAM sequence: TTT
ttttaggagcatgtaacagc

SEQ ID NO: 200888 - DNA, 20 bp, Artificial Sequence
  Description of Artificial Sequence: Synthetic oligonucleotide
  Target: ATXN1; (-) strand; PAM type: YTN; PAM sequence: TTT
tttttaggagcatgtaacag

SEQ ID NO: 200889 - DNA, 20 bp, Artificial Sequence
  Description of Artificial Sequence: Synthetic oligonucleotide
  Target: ATXN1; (-) strand; PAM type: YTN; PAM sequence: TTT
ttttttaggagcatgtaaca

SEQ ID NO: 200890 - DNA, 20 bp, Artificial Sequence
  Description of Artificial Sequence: Synthetic oligonucleotide
  Target: ATXN1; (-) strand; PAM type: YTN; PAM sequence: TTT
tttttttaggagcatgtaac

SEQ ID NO: 200891 - DNA, 20 bp, Artificial Sequence
  Description of Artificial Sequence: Synthetic oligonucleotide
  Target: ATXN1; (-) strand; PAM type: YTN; PAM sequence: CTT
ttttttttaggagcatgtaa

SEQ ID NO: 200892 - DNA, 20 bp, Artificial Sequence
  Description of Artificial Sequence: Synthetic oligonucleotide
  Target: ATXN1; (-) strand; PAM type: YTN; PAM sequence: TTG
acttttttttttaggagcat

SEQ ID NO: 200893 - DNA, 20 bp, Artificial Sequence
  Description of Artificial Sequence: Synthetic oligonucleotide
  Target: ATXN1; (-) strand; PAM type: YTN; PAM sequence: CTG
tgaattgactttttttttta

SEQ ID NO: 200894 - DNA, 20 bp, Artificial Sequence
  Description of Artificial Sequence: Synthetic oligonucleotide
  Target: ATXN1; (-) strand; PAM type: YTN; PAM sequence: TTA
tcctgtgaattgactttttt

SEQ ID NO: 200895 - DNA, 20 bp, Artificial Sequence
  Description of Artificial Sequence: Synthetic oligonucleotide
  Target: ATXN1; (-) strand; PAM type: YTN; PAM sequence: TTT
atcctgtgaattgacttttt

SEQ ID NO: 200896 - DNA, 20 bp, Artificial Sequence
  Description of Artificial Sequence: Synthetic oligonucleotide
  Target: ATXN1; (-) strand; PAM type: YTN; PAM sequence: TTG
gtttatcctgtgaattgact

SEQ ID NO: 200897 - DNA, 20 bp, Artificial Sequence
  Description of Artificial Sequence: Synthetic oligonucleotide
  Target: ATXN1; (-) strand; PAM type: YTN; PAM sequence: TTT
ggtttatcctgtgaattgac

SEQ ID NO: 200898 - DNA, 20 bp, Artificial Sequence
  Description of Artificial Sequence: Synthetic oligonucleotide
  Target: ATXN1; (-) strand; PAM type: YTN; PAM sequence: TTT
tggtttatcctgtgaattga

SEQ ID NO: 200899 - DNA, 20 bp, Artificial Sequence
  Description of Artificial Sequence: Synthetic oligonucleotide
  Target: ATXN1; (-) strand; PAM type: YTN; PAM sequence: TTT
ttggtttatcctgtgaattg

SEQ ID NO: 200900 - DNA, 20 bp, Artificial Sequence
  Description of Artificial Sequence: Synthetic oligonucleotide
  Target: ATXN1; (-) strand; PAM type: YTN; PAM sequence: CTA
cgtttttggtttatcctgtg

SEQ ID NO: 200901 - DNA, 20 bp, Artificial Sequence
  Description of Artificial Sequence: Synthetic oligonucleotide
  Target: ATXN1; (-) strand; PAM type: YTN; PAM sequence: CTA
ctacgtttttggtttatcct

SEQ ID NO: 200902 - DNA, 20 bp, Artificial Sequence
  Description of Artificial Sequence: Synthetic oligonucleotide
  Target: ATXN1; (-) strand; PAM type: YTN; PAM sequence: TTC
tactacgtttttggtttatc

SEQ ID NO: 200903 - DNA, 20 bp, Artificial Sequence
  Description of Artificial Sequence: Synthetic oligonucleotide
  Target: ATXN1; (-) strand; PAM type: YTN; PAM sequence: TTT
ctactacgtttttggtttat

SEQ ID NO: 200904 - DNA, 20 bp, Artificial Sequence
  Description of Artificial Sequence: Synthetic oligonucleotide
  Target: ATXN1; (-) strand; PAM type: YTN; PAM sequence: TTT
tctactacgtttttggttta

SEQ ID NO: 200905 - DNA, 20 bp, Artificial Sequence
  Description of Artificial Sequence: Synthetic oligonucleotide
  Target: ATXN1; (-) strand; PAM type: YTN; PAM sequence: TTT
ttctactacgtttttggttt

SEQ ID NO: 200906 - DNA, 20 bp, Artificial Sequence
  Description of Artificial Sequence: Synthetic oligonucleotide
  Target: ATXN1; (-) strand; PAM type: YTN; PAM sequence: TTG
cccatttttctactacgttt

SEQ ID NO: 200907 - DNA, 20 bp, Artificial Sequence
  Description of Artificial Sequence: Synthetic oligonucleotide
  Target: ATXN1; (-) strand; PAM type: YTN; PAM sequence: CTC
gttgcccatttttctactac

SEQ ID NO: 200908 - DNA, 20 bp, Artificial Sequence
  Description of Artificial Sequence: Synthetic oligonucleotide
  Target: ATXN1; (-) strand; PAM type: YTN; PAM sequence: TTC
atcctcgttgcccatttttc

SEQ ID NO: 200909 - DNA, 20 bp, Artificial Sequence
  Description of Artificial Sequence: Synthetic oligonucleotide
  Target: ATXN1; (-) strand; PAM type: YTN; PAM sequence: CTG
ggaaatgtatattcatcctc

SEQ ID NO: 200910 - DNA, 20 bp, Artificial Sequence
  Description of Artificial Sequence: Synthetic oligonucleotide
  Target: ATXN1; (-) strand; PAM type: YTN; PAM sequence: TTC
tgggaaatgtatattcatcc

SEQ ID NO: 200911 - DNA, 20 bp, Artificial Sequence
  Description of Artificial Sequence: Synthetic oligonucleotide
  Target: ATXN1; (-) strand; PAM type: YTN; PAM sequence: TTT
ctgggaaatgtatattcatc

SEQ ID NO: 200912 - DNA, 20 bp, Artificial Sequence
  Description of Artificial Sequence: Synthetic oligonucleotide
  Target: ATXN1; (-) strand; PAM type: YTN; PAM sequence: TTT
tctgggaaatgtatattcat

SEQ ID NO: 200913 - DNA, 20 bp, Artificial Sequence
  Description of Artificial Sequence: Synthetic oligonucleotide
  Target: ATXN1; (-) strand; PAM type: YTN; PAM sequence: CTT
ttctgggaaatgtatattca

SEQ ID NO: 200914 - DNA, 20 bp, Artificial Sequence
  Description of Artificial Sequence: Synthetic oligonucleotide
  Target: ATXN1; (-) strand; PAM type: YTN; PAM sequence: TTC
ttttctgggaaatgtatatt

SEQ ID NO: 200915 - DNA, 20 bp, Artificial Sequence
  Description of Artificial Sequence: Synthetic oligonucleotide
  Target: ATXN1; (-) strand; PAM type: YTN; PAM sequence: TTT
cttttctgggaaatgtatat

SEQ ID NO: 200916 - DNA, 20 bp, Artificial Sequence
  Description of Artificial Sequence: Synthetic oligonucleotide
  Target: ATXN1; (-) strand; PAM type: YTN; PAM sequence: TTT
tcttttctgggaaatgtata

SEQ ID NO: 200917 - DNA, 20 bp, Artificial Sequence
  Description of Artificial Sequence: Synthetic oligonucleotide
  Target: ATXN1; (-) strand; PAM type: YTN; PAM sequence: CTA
ttttcttttctgggaaatgt

SEQ ID NO: 200918 - DNA, 20 bp, Artificial Sequence
  Description of Artificial Sequence: Synthetic oligonucleotide
  Target: ATXN1; (-) strand; PAM type: YTN; PAM sequence: TTC
ctattttcttttctgggaaa

SEQ ID NO: 200919 - DNA, 20 bp, Artificial Sequence
  Description of Artificial Sequence: Synthetic oligonucleotide
  Target: ATXN1; (-) strand; PAM type: YTN; PAM sequence: TTA
aaagccgttcctattttctt

SEQ ID NO: 200920 - DNA, 20 bp, Artificial Sequence
  Description of Artificial Sequence: Synthetic oligonucleotide
  Target: ATXN1; (-) strand; PAM type: YTN; PAM sequence: TTT
aaaagccgttcctattttct

SEQ ID NO: 200921 - DNA, 20 bp, Artificial Sequence
  Description of Artificial Sequence: Synthetic oligonucleotide
  Target: ATXN1; (-) strand; PAM type: YTN; PAM sequence: TTC
atatgtttaaaagccgttcc

SEQ ID NO: 200922 - DNA, 20 bp, Artificial Sequence
  Description of Artificial Sequence: Synthetic oligonucleotide
  Target: ATXN1; (-) strand; PAM type: YTN; PAM sequence: TTT
catatgtttaaaagccgttc

SEQ ID NO: 200923 - DNA, 20 bp, Artificial Sequence
  Description of Artificial Sequence: Synthetic oligonucleotide
  Target: ATXN1; (-) strand; PAM type: YTN; PAM sequence: CTT
tcatatgtttaaaagccgtt

SEQ ID NO: 200924 - DNA, 20 bp, Artificial Sequence
  Description of Artificial Sequence: Synthetic oligonucleotide
  Target: ATXN1; (-) strand; PAM type: YTN; PAM sequence: TTG
aatatactttcatatgttta

SEQ ID NO: 200925 - DNA, 20 bp, Artificial Sequence
  Description of Artificial Sequence: Synthetic oligonucleotide
  Target: ATXN1; (-) strand; PAM type: YTN; PAM sequence: TTA
tagtggtggttgaatatact

SEQ ID NO: 200926 - DNA, 20 bp, Artificial Sequence
  Description of Artificial Sequence: Synthetic oligonucleotide
  Target: ATXN1; (-) strand; PAM type: YTN; PAM sequence: TTA
ttatagtggtggttgaatat

SEQ ID NO: 200927 - DNA, 20 bp, Artificial Sequence
  Description of Artificial Sequence: Synthetic oligonucleotide
  Target: ATXN1; (-) strand; PAM type: YTN; PAM sequence: CTG
ttattatagtggtggttgaa

SEQ ID NO: 200928 - DNA, 20 bp, Artificial Sequence
  Description of Artificial Sequence: Synthetic oligonucleotide
  Target: ATXN1; (-) strand; PAM type: YTN; PAM sequence: TTC
tgttattatagtggtggttg

SEQ ID NO: 200929 - DNA, 20 bp, Artificial Sequence
  Description of Artificial Sequence: Synthetic oligonucleotide
  Target: ATXN1; (-) strand; PAM type: YTN; PAM sequence: TTT
ctgttattatagtggtggtt

SEQ ID NO: 200930 - DNA, 20 bp, Artificial Sequence
  Description of Artificial Sequence: Synthetic oligonucleotide
  Target: ATXN1; (-) strand; PAM type: YTN; PAM sequence: TTA
atatgggtttctgttattat

SEQ ID NO: 200931 - DNA, 20 bp, Artificial Sequence
  Description of Artificial Sequence: Synthetic oligonucleotide
  Target: ATXN1; (-) strand; PAM type: YTN; PAM sequence: TTT
aatatgggtttctgttatta

SEQ ID NO: 200932 - DNA, 20 bp, Artificial Sequence
  Description of Artificial Sequence: Synthetic oligonucleotide
  Target: ATXN1; (-) strand; PAM type: YTN; PAM sequence: CTT
taatatgggtttctgttatt

SEQ ID NO: 200933 - DNA, 20 bp, Artificial Sequence
  Description of Artificial Sequence: Synthetic oligonucleotide
  Target: ATXN1; (-) strand; PAM type: YTN; PAM sequence: CTA
gtagctttaatatgggtttc

SEQ ID NO: 200934 - DNA, 20 bp, Artificial Sequence
  Description of Artificial Sequence: Synthetic oligonucleotide
  Target: ATXN1; (-) strand; PAM type: YTN; PAM sequence: TTC
tagtagctttaatatgggtt

SEQ ID NO: 200935 - DNA, 20 bp, Artificial Sequence
  Description of Artificial Sequence: Synthetic oligonucleotide
  Target: ATXN1; (-) strand; PAM type: YTN; PAM sequence: CTA
tattctagtagctttaatat

SEQ ID NO: 200936 - DNA, 20 bp, Artificial Sequence
  Description of Artificial Sequence: Synthetic oligonucleotide
  Target: ATXN1; (-) strand; PAM type: YTN; PAM sequence: CTA
ctatattctagtagctttaa

SEQ ID NO: 200937 - DNA, 20 bp, Artificial Sequence
  Description of Artificial Sequence: Synthetic oligonucleotide
  Target: ATXN1; (-) strand; PAM type: YTN; PAM sequence: CTG
agaggtgaaaactactatat

SEQ ID NO: 200938 - DNA, 20 bp, Artificial Sequence
  Description of Artificial Sequence: Synthetic oligonucleotide
  Target: ATXN1; (-) strand; PAM type: YTN; PAM sequence: TTG
ccaatctgagaggtgaaaac

SEQ ID NO: 200939 - DNA, 20 bp, Artificial Sequence
  Description of Artificial Sequence: Synthetic oligonucleotide
  Target: ATXN1; (-) strand; PAM type: YTN; PAM sequence: TTT
gccaatctgagaggtgaaaa

SEQ ID NO: 200940 - DNA, 20 bp, Artificial Sequence
  Description of Artificial Sequence: Synthetic oligonucleotide
  Target: ATXN1; (-) strand; PAM type: YTN; PAM sequence: CTT
tgccaatctgagaggtgaaa

SEQ ID NO: 200941 - DNA, 20 bp, Artificial Sequence
  Description of Artificial Sequence: Synthetic oligonucleotide
  Target: ATXN1; (-) strand; PAM type: YTN; PAM sequence: TTC
acgatctttgccaatctgag

SEQ ID NO: 200942 - DNA, 20 bp, Artificial Sequence
  Description of Artificial Sequence: Synthetic oligonucleotide
  Target: ATXN1; (-) strand; PAM type: YTN; PAM sequence: CTT
cacgatctttgccaatctga

SEQ ID NO: 200943 - DNA, 20 bp, Artificial Sequence
  Description of Artificial Sequence: Synthetic oligonucleotide
  Target: ATXN1; (-) strand; PAM type: YTN; PAM sequence: TTA
aacttcacgatctttgccaa

SEQ ID NO: 200944 - DNA, 20 bp, Artificial Sequence
  Description of Artificial Sequence: Synthetic oligonucleotide
  Target: ATXN1; (-) strand; PAM type: YTN; PAM sequence: TTT
aaacttcacgatctttgcca

SEQ ID NO: 200945 - DNA, 20 bp, Artificial Sequence
  Description of Artificial Sequence: Synthetic oligonucleotide
  Target: ATXN1; (-) strand; PAM type: YTN; PAM sequence: TTT
taaacttcacgatctttgcc

SEQ ID NO: 200946 - DNA, 20 bp, Artificial Sequence
  Description of Artificial Sequence: Synthetic oligonucleotide
  Target: ATXN1; (-) strand; PAM type: YTN; PAM sequence: TTT
ttaaacttcacgatctttgc

SEQ ID NO: 200947 - DNA, 20 bp, Artificial Sequence
  Description of Artificial Sequence: Synthetic oligonucleotide
  Target: ATXN1; (-) strand; PAM type: YTN; PAM sequence: CTC
cacagacgatgtttttaaac

SEQ ID NO: 200948 - DNA, 20 bp, Artificial Sequence
  Description of Artificial Sequence: Synthetic oligonucleotide
  Target: ATXN1; (-) strand; PAM type: YTN; PAM sequence: TTC
tccacagacgatgtttttaa

SEQ ID NO: 200949 - DNA, 20 bp, Artificial Sequence
  Description of Artificial Sequence: Synthetic oligonucleotide
  Target: ATXN1; (-) strand; PAM type: YTN; PAM sequence: TTT
ctccacagacgatgttttta

SEQ ID NO: 200950 - DNA, 20 bp, Artificial Sequence
  Description of Artificial Sequence: Synthetic oligonucleotide
  Target: ATXN1; (-) strand; PAM type: YTN; PAM sequence: TTT
tctccacagacgatgttttt

SEQ ID NO: 200951 - DNA, 20 bp, Artificial Sequence
  Description of Artificial Sequence: Synthetic oligonucleotide
  Target: ATXN1; (-) strand; PAM type: YTN; PAM sequence: CTT
ttctccacagacgatgtttt

SEQ ID NO: 200952 - DNA, 20 bp, Artificial Sequence
  Description of Artificial Sequence: Synthetic oligonucleotide
  Target: ATXN1; (-) strand; PAM type: YTN; PAM sequence: TTG
agtgtgcttttctccacaga

SEQ ID NO: 200953 - DNA, 20 bp, Artificial Sequence
  Description of Artificial Sequence: Synthetic oligonucleotide
  Target: ATXN1; (-) strand; PAM type: YTN; PAM sequence: TTT
gagtgtgcttttctccacag

SEQ ID NO: 200954 - DNA, 20 bp, Artificial Sequence
  Description of Artificial Sequence: Synthetic oligonucleotide
  Target: ATXN1; (-) strand; PAM type: YTN; PAM sequence: CTG
tttgagtgtgcttttctcca

SEQ ID NO: 200955 - DNA, 20 bp, Artificial Sequence
  Description of Artificial Sequence: Synthetic oligonucleotide
  Target: ATXN1; (-) strand; PAM type: YTN; PAM sequence: CTA
gcactgtttgagtgtgcttt

SEQ ID NO: 200956 - DNA, 20 bp, Artificial Sequence
  Description of Artificial Sequence: Synthetic oligonucleotide
  Target: ATXN1; (-) strand; PAM type: YTN; PAM sequence: CTG
ctagcactgtttgagtgtgc

SEQ ID NO: 200957 - DNA, 20 bp, Artificial Sequence
  Description of Artificial Sequence: Synthetic oligonucleotide
  Target: ATXN1; (-) strand; PAM type: YTN; PAM sequence: TTC
ctgctagcactgtttgagtg

SEQ ID NO: 200958 - DNA, 20 bp, Artificial Sequence
  Description of Artificial Sequence: Synthetic oligonucleotide
  Target: ATXN1; (-) strand; PAM type: YTN; PAM sequence: TTG
tatgttcctgctagcactgt

SEQ ID NO: 200959 - DNA, 20 bp, Artificial Sequence
  Description of Artificial Sequence: Synthetic oligonucleotide
  Target: ATXN1; (-) strand; PAM type: YTN; PAM sequence: CTA
ttgtatgttcctgctagcac

SEQ ID NO: 200960 - DNA, 20 bp, Artificial Sequence
  Description of Artificial Sequence: Synthetic oligonucleotide
  Target: ATXN1; (-) strand; PAM type: YTN; PAM sequence: TTC
gtcctattgtatgttcctgc

SEQ ID NO: 200961 - DNA, 20 bp, Artificial Sequence
  Description of Artificial Sequence: Synthetic oligonucleotide
  Target: ATXN1; (-) strand; PAM type: YTN; PAM sequence: TTG
gcattcgtcctattgtatgt

SEQ ID NO: 200962 - DNA, 20 bp, Artificial Sequence
  Description of Artificial Sequence: Synthetic oligonucleotide
  Target: ATXN1; (-) strand; PAM type: YTN; PAM sequence: TTT
ggcattcgtcctattgtatg

SEQ ID NO: 200963 - DNA, 20 bp, Artificial Sequence
  Description of Artificial Sequence: Synthetic oligonucleotide
  Target: ATXN1; (-) strand; PAM type: YTN; PAM sequence: CTC
caatttggcattcgtcctat

SEQ ID NO: 200964 - DNA, 20 bp, Artificial Sequence
  Description of Artificial Sequence: Synthetic oligonucleotide
  Target: ATXN1; (-) strand; PAM type: YTN; PAM sequence: TTG
ccctccaatttggcattcgt

SEQ ID NO: 200965 - DNA, 20 bp, Artificial Sequence
  Description of Artificial Sequence: Synthetic oligonucleotide
  Target: ATXN1; (-) strand; PAM type: YTN; PAM sequence: TTG
ccaaattgccctccaatttg

SEQ ID NO: 200966 - DNA, 20 bp, Artificial Sequence
  Description of Artificial Sequence: Synthetic oligonucleotide
  Target: ATXN1; (-) strand; PAM type: YTN; PAM sequence: CTT
gccaaattgccctccaattt

SEQ ID NO: 200967 - DNA, 20 bp, Artificial Sequence
  Description of Artificial Sequence: Synthetic oligonucleotide
  Target: ATXN1; (-) strand; PAM type: YTN; PAM sequence: TTG
gtaaaccttgccaaattgcc

SEQ ID NO: 200968 - DNA, 20 bp, Artificial Sequence
  Description of Artificial Sequence: Synthetic oligonucleotide
  Target: ATXN1; (-) strand; PAM type: YTN; PAM sequence: TTT
ggtaaaccttgccaaattgc

SEQ ID NO: 200969 - DNA, 20 bp, Artificial Sequence
  Description of Artificial Sequence: Synthetic oligonucleotide
  Target: ATXN1; (-) strand; PAM type: YTN; PAM sequence: TTT
tggtaaaccttgccaaattg

SEQ ID NO: 200970 - DNA, 20 bp, Artificial Sequence
  Description of Artificial Sequence: Synthetic oligonucleotide
  Target: ATXN1; (-) strand; PAM type: YTN; PAM sequence: TTA
attttggtaaaccttgccaa

SEQ ID NO: 200971 - DNA, 20 bp, Artificial Sequence
  Description of Artificial Sequence: Synthetic oligonucleotide
  Target: ATXN1; (-) strand; PAM type: YTN; PAM sequence: TTT
aattttggtaaaccttgcca

SEQ ID NO: 200972 - DNA, 20 bp, Artificial Sequence
  Description of Artificial Sequence: Synthetic oligonucleotide
  Target: ATXN1; (-) strand; PAM type: YTN; PAM sequence: TTT
taattttggtaaaccttgcc

SEQ ID NO: 200973 - DNA, 20 bp, Artificial Sequence
  Description of Artificial Sequence: Synthetic oligonucleotide
  Target: ATXN1; (-) strand; PAM type: YTN; PAM sequence: TTG
gatcaaaaggaatatgcagt

SEQ ID NO: 200974 - DNA, 20 bp, Artificial Sequence
  Description of Artificial Sequence: Synthetic oligonucleotide
  Target: ATXN1; (-) strand; PAM type: YTN; PAM sequence: TTG
ttggatcaaaaggaatatgc

SEQ ID NO: 200975 - DNA, 20 bp, Artificial Sequence
  Description of Artificial Sequence: Synthetic oligonucleotide
  Target: ATXN1; (-) strand; PAM type: YTN; PAM sequence: CTA
aaggggaattgttggatcaa

SEQ ID NO: 200976 - DNA, 20 bp, Artificial Sequence
  Description of Artificial Sequence: Synthetic oligonucleotide
  Target: ATXN1; (-) strand; PAM type: YTN; PAM sequence: TTA
ctaaaggggaattgttggat

SEQ ID NO: 200977 - DNA, 20 bp, Artificial Sequence
  Description of Artificial Sequence: Synthetic oligonucleotide
  Target: ATXN1; (-) strand; PAM type: YTN; PAM sequence: CTG
gaggagaaattactaaaggg

SEQ ID NO: 200978 - DNA, 20 bp, Artificial Sequence
  Description of Artificial Sequence: Synthetic oligonucleotide
  Target: ATXN1; (-) strand; PAM type: YTN; PAM sequence: CTC
tggaggagaaattactaaag

SEQ ID NO: 200979 - DNA, 20 bp, Artificial Sequence
  Description of Artificial Sequence: Synthetic oligonucleotide
  Target: ATXN1; (-) strand; PAM type: YTN; PAM sequence: TTG
tatgtcagcaaggatctctg

SEQ ID NO: 200980 - DNA, 20 bp, Artificial Sequence
  Description of Artificial Sequence: Synthetic oligonucleotide
  Target: ATXN1; (-) strand; PAM type: YTN; PAM sequence: CTA
taaatagcatgttgtatgtc

SEQ ID NO: 200981 - DNA, 20 bp, Artificial Sequence
  Description of Artificial Sequence: Synthetic oligonucleotide
  Target: ATXN1; (-) strand; PAM type: YTN; PAM sequence: CTC
tataaatagcatgttgtatg

SEQ ID NO: 200982 - DNA, 20 bp, Artificial Sequence
  Description of Artificial Sequence: Synthetic oligonucleotide
  Target: ATXN1; (-) strand; PAM type: YTN; PAM sequence: CTC
tctataaatagcatgttgta

SEQ ID NO: 200983 - DNA, 20 bp, Artificial Sequence
  Description of Artificial Sequence: Synthetic oligonucleotide
  Target: ATXN1; (-) strand; PAM type: YTN; PAM sequence: TTC
agtgaacaactctctataaa

SEQ ID NO: 200984 - DNA, 20 bp, Artificial Sequence
  Description of Artificial Sequence: Synthetic oligonucleotide
  Target: ATXN1; (-) strand; PAM type: YTN; PAM sequence: CTT
cagtgaacaactctctataa

SEQ ID NO: 200985 - DNA, 20 bp, Artificial Sequence
  Description of Artificial Sequence: Synthetic oligonucleotide
  Target: ATXN1; (-) strand; PAM type: YTN; PAM sequence: CTA
tgaacaatgcttcagtgaac

SEQ ID NO: 200986 - DNA, 20 bp, Artificial Sequence
  Description of Artificial Sequence: Synthetic oligonucleotide
  Target: ATXN1; (-) strand; PAM type: YTN; PAM sequence: CTA
ctatgaacaatgcttcagtg

SEQ ID NO: 200987 - DNA, 20 bp, Artificial Sequence
  Description of Artificial Sequence: Synthetic oligonucleotide
  Target: ATXN1; (-) strand; PAM type: YTN; PAM sequence: TTG
ctactatgaacaatgcttca

SEQ ID NO: 200988 - DNA, 20 bp, Artificial Sequence
  Description of Artificial Sequence: Synthetic oligonucleotide
  Target: ATXN1; (-) strand; PAM type: YTN; PAM sequence: CTT
gctactatgaacaatgcttc

SEQ ID NO: 200989 - DNA, 20 bp, Artificial Sequence
  Description of Artificial Sequence: Synthetic oligonucleotide
  Target: ATXN1; (-) strand; PAM type: YTN; PAM sequence: TTC
cagtcacttgctactatgaa

SEQ ID NO: 200990 - DNA, 20 bp, Artificial Sequence
  Description of Artificial Sequence: Synthetic oligonucleotide
  Target: ATXN1; (-) strand; PAM type: YTN; PAM sequence: TTT
ccagtcacttgctactatga

SEQ ID NO: 200991 - DNA, 20 bp, Artificial Sequence
  Description of Artificial Sequence: Synthetic oligonucleotide
  Target: ATXN1; (-) strand; PAM type: YTN; PAM sequence: TTG
tttccagtcacttgctacta

SEQ ID NO: 200992 - DNA, 20 bp, Artificial Sequence
  Description of Artificial Sequence: Synthetic oligonucleotide
  Target: ATXN1; (-) strand; PAM type: YTN; PAM sequence: TTG
gttgtttccagtcacttgct

SEQ ID NO: 200993 - DNA, 20 bp, Artificial Sequence
  Description of Artificial Sequence: Synthetic oligonucleotide
  Target: ATXN1; (-) strand; PAM type: YTN; PAM sequence: TTT
ggttgtttccagtcacttgc

SEQ ID NO: 200994 - DNA, 20 bp, Artificial Sequence
  Description of Artificial Sequence: Synthetic oligonucleotide
  Target: ATXN1; (-) strand; PAM type: YTN; PAM sequence: TTT
tggttgtttccagtcacttg

SEQ ID NO: 200995 - DNA, 20 bp, Artificial Sequence
  Description of Artificial Sequence: Synthetic oligonucleotide
  Target: ATXN1; (-) strand; PAM type: YTN; PAM sequence: TTT
ttggttgtttccagtcactt

SEQ ID NO: 200996 - DNA, 20 bp, Artificial Sequence
  Description of Artificial Sequence: Synthetic oligonucleotide
  Target: ATXN1; (-) strand; PAM type: YTN; PAM sequence: TTT
tttggttgtttccagtcact

SEQ ID NO: 200997 - DNA, 20 bp, Artificial Sequence
  Description of Artificial Sequence: Synthetic oligonucleotide
  Target: ATXN1; (-) strand; PAM type: YTN; PAM sequence: TTT
ttttggttgtttccagtcac

SEQ ID NO: 200998 - DNA, 20 bp, Artificial Sequence
  Description of Artificial Sequence: Synthetic oligonucleotide
  Target: ATXN1; (-) strand; PAM type: YTN; PAM sequence: TTT
tttttggttgtttccagtca

SEQ ID NO: 200999 - DNA, 20 bp, Artificial Sequence
  Description of Artificial Sequence: Synthetic oligonucleotide
  Target: ATXN1; (-) strand; PAM type: YTN; PAM sequence: TTT
ttttttggttgtttccagtc

SEQ ID NO: 201000 - DNA, 20 bp, Artificial Sequence
  Description of Artificial Sequence: Synthetic oligonucleotide
  Target: ATXN1; (-) strand; PAM type: YTN; PAM sequence: TTT
tttttttggttgtttccagt

SEQ ID NO: 201001 - DNA, 20 bp, Artificial Sequence
  Description of Artificial Sequence: Synthetic oligonucleotide
  Target: ATXN1; (-) strand; PAM type: YTN; PAM sequence: TTT
ttttttttggttgtttccag

SEQ ID NO: 201002 - DNA, 20 bp, Artificial Sequence
  Description of Artificial Sequence: Synthetic oligonucleotide
  Target: ATXN1; (-) strand; PAM type: YTN; PAM sequence: TTT
tttttttttggttgtttcca

SEQ ID NO: 201003 - DNA, 20 bp, Artificial Sequence
  Description of Artificial Sequence: Synthetic oligonucleotide
  Target: ATXN1; (-) strand; PAM type: YTN; PAM sequence: TTT
ttttttttttggttgtttcc

SEQ ID NO: 201004 - DNA, 20 bp, Artificial Sequence
  Description of Artificial Sequence: Synthetic oligonucleotide
  Target: ATXN1; (-) strand; PAM type: YTN; PAM sequence: TTT
tttttttttttggttgtttc

SEQ ID NO: 201005 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttggttgttt

SEQ ID NO: 201006 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttggttgtt

SEQ ID NO: 201007 - DNA, 20 bp, Artificial Sequence
  Description of Artificial Sequence: Synthetic oligonucleotide
  Target: ATXN1; (-) strand; PAM type: YTN; PAM sequence: TTG
atggactttttttttttttt

SEQ ID NO: 201008 - DNA, 20 bp, Artificial Sequence
  Description of Artificial Sequence: Synthetic oligonucleotide
  Target: ATXN1; (-) strand; PAM type: YTN; PAM sequence: TTC
agtcccacattgatggactt

SEQ ID NO: 201009 - DNA, 20 bp, Artificial Sequence
  Description of Artificial Sequence: Synthetic oligonucleotide
  Target: ATXN1; (-) strand; PAM type: YTN; PAM sequence: TTG
ccataaagtattcagtccca

SEQ ID NO: 201010 - DNA, 20 bp, Artificial Sequence
  Description of Artificial Sequence: Synthetic oligonucleotide
  Target: ATXN1; (-) strand; PAM type: YTN; PAM sequence: TTT
gccataaagtattcagtccc

SEQ ID NO: 201011 - DNA, 20 bp, Artificial Sequence
  Description of Artificial Sequence: Synthetic oligonucleotide
  Target: ATXN1; (-) strand; PAM type: YTN; PAM sequence: TTT
tgccataaagtattcagtcc

SEQ ID NO: 201012 - DNA, 20 bp, Artificial Sequence
  Description of Artificial Sequence: Synthetic oligonucleotide
  Target: ATXN1; (-) strand; PAM type: YTN; PAM sequence: TTG
tatgattttgccataaagta

SEQ ID NO: 201013 - DNA, 20 bp, Artificial Sequence
  Description of Artificial Sequence: Synthetic oligonucleotide
  Target: ATXN1; (-) strand; PAM type: YTN; PAM sequence: TTC
gattgtatgattttgccata

SEQ ID NO: 201014 - DNA, 20 bp, Artificial Sequence
  Description of Artificial Sequence: Synthetic oligonucleotide
  Target: ATXN1; (-) strand; PAM type: YTN; PAM sequence: CTA
aatagtattcgattgtatga

SEQ ID NO: 201015 - DNA, 20 bp, Artificial Sequence
  Description of Artificial Sequence: Synthetic oligonucleotide
  Target: ATXN1; (-) strand; PAM type: YTN; PAM sequence: TTA
gtatctaaatagtattcgat

SEQ ID NO: 201016 - DNA, 20 bp, Artificial Sequence
  Description of Artificial Sequence: Synthetic oligonucleotide
  Target: ATXN1; (-) strand; PAM type: YTN; PAM sequence: TTT
agtatctaaatagtattcga

SEQ ID NO: 201017 - DNA, 20 bp, Artificial Sequence
  Description of Artificial Sequence: Synthetic oligonucleotide
  Target: ATXN1; (-) strand; PAM type: YTN; PAM sequence: TTT
tagtatctaaatagtattcg

SEQ ID NO: 201018 - DNA, 20 bp, Artificial Sequence
  Description of Artificial Sequence: Synthetic oligonucleotide
  Target: ATXN1; (-) strand; PAM type: YTN; PAM sequence: TTT
ttagtatctaaatagtattc

SEQ ID NO: 201019 - DNA, 20 bp, Artificial Sequence
  Description of Artificial Sequence: Synthetic oligonucleotide
  Target: ATXN1; (-) strand; PAM type: YTN; PAM sequence: TTT
tttagtatctaaatagtatt

SEQ ID NO: 201020 - DNA, 20 bp, Artificial Sequence
  Description of Artificial Sequence: Synthetic oligonucleotide
  Target: ATXN1; (-) strand; PAM type: YTN; PAM sequence: CTT
ttttagtatctaaatagtat

SEQ ID NO: 201021 - DNA, 20 bp, Artificial Sequence
  Description of Artificial Sequence: Synthetic oligonucleotide
  Target: ATXN1; (-) strand; PAM type: YTN; PAM sequence: TTC
ttttttagtatctaaatagt

SEQ ID NO: 201022 - DNA, 20 bp, Artificial Sequence
  Description of Artificial Sequence: Synthetic oligonucleotide
  Target: ATXN1; (-) strand; PAM type: YTN; PAM sequence: TTA
ttcttttttagtatctaaat

SEQ ID NO: 201023 - DNA, 20 bp, Artificial Sequence
  Description of Artificial Sequence: Synthetic oligonucleotide
  Target: ATXN1; (-) strand; PAM type: YTN; PAM sequence: CTT
attcttttttagtatctaaa

SEQ ID NO: 201024 - DNA, 20 bp, Artificial Sequence
  Description of Artificial Sequence: Synthetic oligonucleotide
  Target: ATXN1; (-) strand; PAM type: YTN; PAM sequence: TTA
tcggaacatagaacagcctt

SEQ ID NO: 201025 - DNA, 20 bp, Artificial Sequence
  Description of Artificial Sequence: Synthetic oligonucleotide
  Target: ATXN1; (-) strand; PAM type: YTN; PAM sequence: CTT
atcggaacatagaacagcct

SEQ ID NO: 201026 - DNA, 20 bp, Artificial Sequence
  Description of Artificial Sequence: Synthetic oligonucleotide
  Target: ATXN1; (-) strand; PAM type: YTN; PAM sequence: TTC
ttatcggaacatagaacagc

SEQ ID NO: 201027 - DNA, 20 bp, Artificial Sequence
  Description of Artificial Sequence: Synthetic oligonucleotide
  Target: ATXN1; (-) strand; PAM type: YTN; PAM sequence: TTT
cttatcggaacatagaacag

SEQ ID NO: 201028 - DNA, 20 bp, Artificial Sequence
  Description of Artificial Sequence: Synthetic oligonucleotide
  Target: ATXN1; (-) strand; PAM type: YTN; PAM sequence: CTT
tcttatcggaacatagaaca

SEQ ID NO: 201029 - DNA, 20 bp, Artificial Sequence
  Description of Artificial Sequence: Synthetic oligonucleotide
  Target: ATXN1; (-) strand; PAM type: YTN; PAM sequence: CTG
gaaaacctttcttatcggaa

SEQ ID NO: 201030 - DNA, 20 bp, Artificial Sequence
  Description of Artificial Sequence: Synthetic oligonucleotide
  Target: ATXN1; (-) strand; PAM type: YTN; PAM sequence: CTA
acagtgtgtcctggaaaacc

SEQ ID NO: 201031 - DNA, 20 bp, Artificial Sequence
  Description of Artificial Sequence: Synthetic oligonucleotide
  Target: ATXN1; (-) strand; PAM type: YTN; PAM sequence: TTC
acctaacagtgtgtcctgga

SEQ ID NO: 201032 - DNA, 20 bp, Artificial Sequence
  Description of Artificial Sequence: Synthetic oligonucleotide
  Target: ATXN1; (-) strand; PAM type: YTN; PAM sequence: TTT
cacctaacagtgtgtcctgg

SEQ ID NO: 201033 - DNA, 20 bp, Artificial Sequence
  Description of Artificial Sequence: Synthetic oligonucleotide
  Target: ATXN1; (-) strand; PAM type: YTN; PAM sequence: TTT
tcacctaacagtgtgtcctg

SEQ ID NO: 201034 - DNA, 20 bp, Artificial Sequence
  Description of Artificial Sequence: Synthetic oligonucleotide
  Target: ATXN1; (-) strand; PAM type: YTN; PAM sequence: CTT
ttcacctaacagtgtgtcct

SEQ ID NO: 201035 - DNA, 20 bp, Artificial Sequence
  Description of Artificial Sequence: Synthetic oligonucleotide
  Target: ATXN1; (-) strand; PAM type: YTN; PAM sequence: CTC
ttttcacctaacagtgtgtc

SEQ ID NO: 201036 - DNA, 20 bp, Artificial Sequence
  Description of Artificial Sequence: Synthetic oligonucleotide
  Target: ATXN1; (-) strand; PAM type: YTN; PAM sequence: TTA
cctcttttcacctaacagtg

SEQ ID NO: 201037 - DNA, 20 bp, Artificial Sequence
  Description of Artificial Sequence: Synthetic oligonucleotide
  Target: ATXN1; (-) strand; PAM type: YTN; PAM sequence: TTT
acctcttttcacctaacagt

SEQ ID NO: 201038 - DNA, 20 bp, Artificial Sequence
  Description of Artificial Sequence: Synthetic oligonucleotide
  Target: ATXN1; (-) strand; PAM type: YTN; PAM sequence: CTT
tacctcttttcacctaacag

SEQ ID NO: 201039 - DNA, 20 bp, Artificial Sequence
  Description of Artificial Sequence: Synthetic oligonucleotide
  Target: ATXN1; (-) strand; PAM type: YTN; PAM sequence: CTG
ccctttacctcttttcacct

SEQ ID NO: 201040 - DNA, 20 bp, Artificial Sequence
  Description of Artificial Sequence: Synthetic oligonucleotide
  Target: ATXN1; (-) strand; PAM type: YTN; PAM sequence: TTC
tgccctttacctcttttcac

SEQ ID NO: 201041 - DNA, 20 bp, Artificial Sequence
  Description of Artificial Sequence: Synthetic oligonucleotide
  Target: ATXN1; (-) strand; PAM type: YTN; PAM sequence: CTA
ttctgccctttacctctttt

SEQ ID NO: 201042 - DNA, 20 bp, Artificial Sequence
  Description of Artificial Sequence: Synthetic oligonucleotide
  Target: ATXN1; (-) strand; PAM type: YTN; PAM sequence: TTA
caccccatacactattctgc

SEQ ID NO: 201043 - DNA, 20 bp, Artificial Sequence
  Description of Artificial Sequence: Synthetic oligonucleotide
  Target: ATXN1; (-) strand; PAM type: YTN; PAM sequence: TTT
acaccccatacactattctg

SEQ ID NO: 201044 - DNA, 20 bp, Artificial Sequence
  Description of Artificial Sequence: Synthetic oligonucleotide
  Target: ATXN1; (-) strand; PAM type: YTN; PAM sequence: TTA
aaacaatgtttacaccccat

SEQ ID NO: 201045 - DNA, 20 bp, Artificial Sequence
  Description of Artificial Sequence: Synthetic oligonucleotide
  Target: ATXN1; (-) strand; PAM type: YTN; PAM sequence: TTT
aaaacaatgtttacacccca

SEQ ID NO: 201046 - DNA, 20 bp, Artificial Sequence
  Description of Artificial Sequence: Synthetic oligonucleotide
  Target: ATXN1; (-) strand; PAM type: YTN; PAM sequence: TTT
taaaacaatgtttacacccc

SEQ ID NO: 201047 - DNA, 20 bp, Artificial Sequence
  Description of Artificial Sequence: Synthetic oligonucleotide
  Target: ATXN1; (-) strand; PAM type: YTN; PAM sequence: TTT
ttaaaacaatgtttacaccc

SEQ ID NO: 201048 - DNA, 20 bp, Artificial Sequence
  Description of Artificial Sequence: Synthetic oligonucleotide
  Target: ATXN1; (-) strand; PAM type: YTN; PAM sequence: TTT
tttaaaacaatgtttacacc

SEQ ID NO: 201049 - DNA, 20 bp, Artificial Sequence
  Description of Artificial Sequence: Synthetic oligonucleotide
  Target: ATXN1; (-) strand; PAM type: YTN; PAM sequence: TTA
tataagcaaaaatataggtt

SEQ ID NO: 201050 - DNA, 20 bp, Artificial Sequence
  Description of Artificial Sequence: Synthetic oligonucleotide
  Target: ATXN1; (-) strand; PAM type: YTN; PAM sequence: TTA
tgattatataagcaaaaata

SEQ ID NO: 201051 - DNA, 20 bp, Artificial Sequence
  Description of Artificial Sequence: Synthetic oligonucleotide
  Target: ATXN1; (-) strand; PAM type: YTN; PAM sequence: TTT
atgattatataagcaaaaat

SEQ ID NO: 201052 - DNA, 20 bp, Artificial Sequence
  Description of Artificial Sequence: Synthetic oligonucleotide
  Target: ATXN1; (-) strand; PAM type: YTN; PAM sequence: TTT
tatgattatataagcaaaaa

SEQ ID NO: 201053 - DNA, 20 bp, Artificial Sequence
  Description of Artificial Sequence: Synthetic oligonucleotide
  Target: ATXN1; (-) strand; PAM type: YTN; PAM sequence: TTA
aggatattttatgattatat

SEQ ID NO: 201054 - DNA, 20 bp, Artificial Sequence
  Description of Artificial Sequence: Synthetic oligonucleotide
  Target: ATXN1; (-) strand; PAM type: YTN; PAM sequence: TTT
aaggatattttatgattata

SEQ ID NO: 201055 - DNA, 20 bp, Artificial Sequence
  Description of Artificial Sequence: Synthetic oligonucleotide
  Target: ATXN1; (-) strand; PAM type: YTN; PAM sequence: TTT
taaggatattttatgattat

SEQ ID NO: 201056 - DNA, 20 bp, Artificial Sequence
  Description of Artificial Sequence: Synthetic oligonucleotide
  Target: ATXN1; (-) strand; PAM type: YTN; PAM sequence: CTT
ttaaggatattttatgatta

SEQ ID NO: 201057 - DNA, 20 bp, Artificial Sequence
  Description of Artificial Sequence: Synthetic oligonucleotide
  Target: ATXN1; (-) strand; PAM type: YTN; PAM sequence: TTG
tgagtccttttaaggatatt

SEQ ID NO: 201058 - DNA, 20 bp, Artificial Sequence
  Description of Artificial Sequence: Synthetic oligonucleotide
  Target: ATXN1; (-) strand; PAM type: YTN; PAM sequence: CTT
gtgagtccttttaaggatat

SEQ ID NO: 201059 - DNA, 20 bp, Artificial Sequence
  Description of Artificial Sequence: Synthetic oligonucleotide
  Target: ATXN1; (-) strand; PAM type: YTN; PAM sequence: TTC
ttgtgagtccttttaaggat

SEQ ID NO: 201060 - DNA, 20 bp, Artificial Sequence
  Description of Artificial Sequence: Synthetic oligonucleotide
  Target: ATXN1; (-) strand; PAM type: YTN; PAM sequence: TTT
cttgtgagtccttttaagga

SEQ ID NO: 201061 - DNA, 20 bp, Artificial Sequence
  Description of Artificial Sequence: Synthetic oligonucleotide
  Target: ATXN1; (-) strand; PAM type: YTN; PAM sequence: TTT
tcttgtgagtccttttaagg

SEQ ID NO: 201062 - DNA, 20 bp, Artificial Sequence
  Description of Artificial Sequence: Synthetic oligonucleotide
  Target: ATXN1; (-) strand; PAM type: YTN; PAM sequence: TTA
tcattttcttgtgagtcctt

SEQ ID NO: 201063 - DNA, 20 bp, Artificial Sequence
  Description of Artificial Sequence: Synthetic oligonucleotide
  Target: ATXN1; (-) strand; PAM type: YTN; PAM sequence: CTA
gaagcaagtaccattatcat

SEQ ID NO: 201064 - DNA, 20 bp, Artificial Sequence
  Description of Artificial Sequence: Synthetic oligonucleotide
  Target: ATXN1; (-) strand; PAM type: YTN; PAM sequence: CTC
acctagaagcaagtaccatt

SEQ ID NO: 201065 - DNA, 20 bp, Artificial Sequence
  Description of Artificial Sequence: Synthetic oligonucleotide
  Target: ATXN1; (-) strand; PAM type: YTN; PAM sequence: TTC
tcacctagaagcaagtacca

SEQ ID NO: 201066 - DNA, 20 bp, Artificial Sequence
  Description of Artificial Sequence: Synthetic oligonucleotide
  Target: ATXN1; (-) strand; PAM type: YTN; PAM sequence: TTG
aattctcacctagaagcaag

SEQ ID NO: 201067 - DNA, 20 bp, Artificial Sequence
  Description of Artificial Sequence: Synthetic oligonucleotide
  Target: ATXN1; (-) strand; PAM type: YTN; PAM sequence: CTT
gaattctcacctagaagcaa

SEQ ID NO: 201068 - DNA, 20 bp, Artificial Sequence
  Description of Artificial Sequence: Synthetic oligonucleotide
  Target: ATXN1; (-) strand; PAM type: YTN; PAM sequence: CTA
agtcacttgaattctcacct

SEQ ID NO: 201069 - DNA, 20 bp, Artificial Sequence
  Description of Artificial Sequence: Synthetic oligonucleotide
  Target: ATXN1; (-) strand; PAM type: YTN; PAM sequence: CTG
tgtctaagtcacttgaattc

SEQ ID NO: 201070 - DNA, 20 bp, Artificial Sequence
  Description of Artificial Sequence: Synthetic oligonucleotide
  Target: ATXN1; (-) strand; PAM type: YTN; PAM sequence: TTC
tgtgtctaagtcacttgaat

SEQ ID NO: 201071 - DNA, 20 bp, Artificial Sequence
  Description of Artificial Sequence: Synthetic oligonucleotide
  Target: ATXN1; (-) strand; PAM type: YTN; PAM sequence: TTT
ctgtgtctaagtcacttgaa

SEQ ID NO: 201072 - DNA, 20 bp, Artificial Sequence
  Description of Artificial Sequence: Synthetic oligonucleotide
  Target: ATXN1; (-) strand; PAM type: YTN; PAM sequence: TTA
tttctgtgtctaagtcactt

SEQ ID NO: 201073 - DNA, 20 bp, Artificial Sequence
  Description of Artificial Sequence: Synthetic oligonucleotide
  Target: ATXN1; (-) strand; PAM type: YTN; PAM sequence: CTT
atttctgtgtctaagtcact

SEQ ID NO: 201074 - DNA, 20 bp, Artificial Sequence
  Description of Artificial Sequence: Synthetic oligonucleotide
  Target: ATXN1; (-) strand; PAM type: YTN; PAM sequence: CTC
ttatttctgtgtctaagtca

SEQ ID NO: 201075 - DNA, 20 bp, Artificial Sequence
  Description of Artificial Sequence: Synthetic oligonucleotide
  Target: ATXN1; (-) strand; PAM type: YTN; PAM sequence: CTC
tcttatttctgtgtctaagt

SEQ ID NO: 201076 - DNA, 20 bp, Artificial Sequence
  Description of Artificial Sequence: Synthetic oligonucleotide
  Target: ATXN1; (-) strand; PAM type: YTN; PAM sequence: CTA
gatatacagaaggtacgata

SEQ ID NO: 201077 - DNA, 20 bp, Artificial Sequence
  Description of Artificial Sequence: Synthetic oligonucleotide
  Target: ATXN1; (-) strand; PAM type: YTN; PAM sequence: TTG
ctagatatacagaaggtacg

SEQ ID NO: 201078 - DNA, 20 bp, Artificial Sequence
  Description of Artificial Sequence: Synthetic oligonucleotide
  Target: ATXN1; (-) strand; PAM type: YTN; PAM sequence: TTG
aattgctagatatacagaag

SEQ ID NO: 201079 - DNA, 20 bp, Artificial Sequence
  Description of Artificial Sequence: Synthetic oligonucleotide
  Target: ATXN1; (-) strand; PAM type: YTN; PAM sequence: TTT
gaattgctagatatacagaa

SEQ ID NO: 201080 - DNA, 20 bp, Artificial Sequence
  Description of Artificial Sequence: Synthetic oligonucleotide
  Target: ATXN1; (-) strand; PAM type: YTN; PAM sequence: TTT
tgaattgctagatatacaga

SEQ ID NO: 201081 - DNA, 20 bp, Artificial Sequence
  Description of Artificial Sequence: Synthetic oligonucleotide
  Target: ATXN1; (-) strand; PAM type: YTN; PAM sequence: TTG
ttttgaattgctagatatac

SEQ ID NO: 201082 - DNA, 20 bp, Artificial Sequence
  Description of Artificial Sequence: Synthetic oligonucleotide
  Target: ATXN1; (-) strand; PAM type: YTN; PAM sequence: TTA
atattgttttgaattgctag

SEQ ID NO: 201083 - DNA, 20 bp, Artificial Sequence
  Description of Artificial Sequence: Synthetic oligonucleotide
  Target: ATXN1; (-) strand; PAM type: YTN; PAM sequence: TTG
aagcattaatattgttttga

SEQ ID NO: 201084 - DNA, 20 bp, Artificial Sequence
  Description of Artificial Sequence: Synthetic oligonucleotide
  Target: ATXN1; (-) strand; PAM type: YTN; PAM sequence: TTT
gaagcattaatattgttttg

SEQ ID NO: 201085 - DNA, 20 bp, Artificial Sequence
  Description of Artificial Sequence: Synthetic oligonucleotide
  Target: ATXN1; (-) strand; PAM type: YTN; PAM sequence: TTT
tgaagcattaatattgtttt

SEQ ID NO: 201086 - DNA, 20 bp, Artificial Sequence
  Description of Artificial Sequence: Synthetic oligonucleotide
  Target: ATXN1; (-) strand; PAM type: YTN; PAM sequence: TTT
ttgaagcattaatattgttt

SEQ ID NO: 201087 - DNA, 20 bp, Artificial Sequence
  Description of Artificial Sequence: Synthetic oligonucleotide
  Target: ATXN1; (-) strand; PAM type: YTN; PAM sequence: CTT
tttgaagcattaatattgtt

SEQ ID NO: 201088 - DNA, 20 bp, Artificial Sequence
  Description of Artificial Sequence: Synthetic oligonucleotide
  Target: ATXN1; (-) strand; PAM type: YTN; PAM sequence: TTC
tttttgaagcattaatattg

SEQ ID NO: 201089 - DNA, 20 bp, Artificial Sequence
  Description of Artificial Sequence: Synthetic oligonucleotide
  Target: ATXN1; (-) strand; PAM type: YTN; PAM sequence: TTT
ctttttgaagcattaatatt

SEQ ID NO: 201090 - DNA, 20 bp, Artificial Sequence
  Description of Artificial Sequence: Synthetic oligonucleotide
  Target: ATXN1; (-) strand; PAM type: YTN; PAM sequence: CTT
tctttttgaagcattaatat

SEQ ID NO: 201091 - DNA, 20 bp, Artificial Sequence
  Description of Artificial Sequence: Synthetic oligonucleotide
  Target: ATXN1; (-) strand; PAM type: YTN; PAM sequence: TTC
tttctttttgaagcattaat

SEQ ID NO: 201092 - DNA, 20 bp, Artificial Sequence
  Description of Artificial Sequence: Synthetic oligonucleotide
  Target: ATXN1; (-) strand; PAM type: YTN; PAM sequence: TTT
ctttctttttgaagcattaa

SEQ ID NO: 201093 - DNA, 20 bp, Artificial Sequence
  Description of Artificial Sequence: Synthetic oligonucleotide
  Target: ATXN1; (-) strand; PAM type: YTN; PAM sequence: TTT
tctttctttttgaagcatta

SEQ ID NO: 201094 - DNA, 20 bp, Artificial Sequence
  Description of Artificial Sequence: Synthetic oligonucleotide
  Target: ATXN1; (-) strand; PAM type: YTN; PAM sequence: CTT
ttctttctttttgaagcatt

SEQ ID NO: 201095 - DNA, 20 bp, Artificial Sequence
  Description of Artificial Sequence: Synthetic oligonucleotide
  Target: ATXN1; (-) strand; PAM type: YTN; PAM sequence: TTC
ttttctttctttttgaagca

SEQ ID NO: 201096 - DNA, 20 bp, Artificial Sequence
  Description of Artificial Sequence: Synthetic oligonucleotide
  Target: ATXN1; (-) strand; PAM type: YTN; PAM sequence: TTT
cttttctttctttttgaagc

SEQ ID NO: 201097 - DNA, 20 bp, Artificial Sequence
  Description of Artificial Sequence: Synthetic oligonucleotide
  Target: ATXN1; (-) strand; PAM type: YTN; PAM sequence: TTG
gtttcttttctttctttttg

SEQ ID NO: 201098 - DNA, 20 bp, Artificial Sequence
  Description of Artificial Sequence: Synthetic oligonucleotide
  Target: ATXN1; (-) strand; PAM type: YTN; PAM sequence: CTT
ggtttcttttctttcttttt

SEQ ID NO: 201099 - DNA, 20 bp, Artificial Sequence
  Description of Artificial Sequence: Synthetic oligonucleotide
  Target: ATXN1; (-) strand; PAM type: YTN; PAM sequence: TTG
gtatgcttggtttcttttct

SEQ ID NO: 201100 - DNA, 20 bp, Artificial Sequence
  Description of Artificial Sequence: Synthetic oligonucleotide
  Target: ATXN1; (-) strand; PAM type: YTN; PAM sequence: CTT
ggtatgcttggtttcttttc

SEQ ID NO: 201101 - DNA, 20 bp, Artificial Sequence
  Description of Artificial Sequence: Synthetic oligonucleotide
  Target: ATXN1; (-) strand; PAM type: YTN; PAM sequence: TTC
agtgtccttggtatgcttgg

SEQ ID NO: 201102 - DNA, 20 bp, Artificial Sequence
  Description of Artificial Sequence: Synthetic oligonucleotide
  Target: ATXN1; (-) strand; PAM type: YTN; PAM sequence: TTT
cagtgtccttggtatgcttg

SEQ ID NO: 201103 - DNA, 20 bp, Artificial Sequence
  Description of Artificial Sequence: Synthetic oligonucleotide
  Target: ATXN1; (-) strand; PAM type: YTN; PAM sequence: TTA
tatttcagtgtccttggtat

SEQ ID NO: 201104 - DNA, 20 bp, Artificial Sequence
  Description of Artificial Sequence: Synthetic oligonucleotide
  Target: ATXN1; (-) strand; PAM type: YTN; PAM sequence: TTT
atatttcagtgtccttggta

SEQ ID NO: 201105 - DNA, 20 bp, Artificial Sequence
  Description of Artificial Sequence: Synthetic oligonucleotide
  Target: ATXN1; (-) strand; PAM type: YTN; PAM sequence: TTT
tatatttcagtgtccttggt

SEQ ID NO: 201106 - DNA, 20 bp, Artificial Sequence
  Description of Artificial Sequence: Synthetic oligonucleotide
  Target: ATXN1; (-) strand; PAM type: YTN; PAM sequence: CTT
ttatatttcagtgtccttgg

SEQ ID NO: 201107 - DNA, 20 bp, Artificial Sequence
  Description of Artificial Sequence: Synthetic oligonucleotide
  Target: ATXN1; (-) strand; PAM type: YTN; PAM sequence: CTC
cttttatatttcagtgtcct

SEQ ID NO: 201108 - DNA, 20 bp, Artificial Sequence
  Description of Artificial Sequence: Synthetic oligonucleotide
  Target: ATXN1; (-) strand; PAM type: YTN; PAM sequence: TTG
ctccttttatatttcagtgt

SEQ ID NO: 201109 - DNA, 20 bp, Artificial Sequence
  Description of Artificial Sequence: Synthetic oligonucleotide
  Target: ATXN1; (-) strand; PAM type: YTN; PAM sequence: TTT
gctccttttatatttcagtg

SEQ ID NO: 201110 - DNA, 20 bp, Artificial Sequence
  Description of Artificial Sequence: Synthetic oligonucleotide
  Target: ATXN1; (-) strand; PAM type: YTN; PAM sequence: CTT
tgctccttttatatttcagt

SEQ ID NO: 201111 - DNA, 20 bp, Artificial Sequence
  Description of Artificial Sequence: Synthetic oligonucleotide
  Target: ATXN1; (-) strand; PAM type: YTN; PAM sequence: TTA
gaccacgtactttgctcctt

SEQ ID NO: 201112 - DNA, 20 bp, Artificial Sequence
  Description of Artificial Sequence: Synthetic oligonucleotide
  Target: ATXN1; (-) strand; PAM type: YTN; PAM sequence: CTA
tccaaaattagaccacgtac

SEQ ID NO: 201113 - DNA, 20 bp, Artificial Sequence
  Description of Artificial Sequence: Synthetic oligonucleotide
  Target: ATXN1; (-) strand; PAM type: YTN; PAM sequence: CTA
aaaataacaaagctatccaa

SEQ ID NO: 201114 - DNA, 20 bp, Artificial Sequence
  Description of Artificial Sequence: Synthetic oligonucleotide
  Target: ATXN1; (-) strand; PAM type: YTN; PAM sequence: TTA
aacatactaaaaataacaaa

SEQ ID NO: 201115 - DNA, 20 bp, Artificial Sequence
  Description of Artificial Sequence: Synthetic oligonucleotide
  Target: ATXN1; (-) strand; PAM type: YTN; PAM sequence: TTA
ttaaacatactaaaaataac

SEQ ID NO: 201116 - DNA, 20 bp, Artificial Sequence
  Description of Artificial Sequence: Synthetic oligonucleotide
  Target: ATXN1; (-) strand; PAM type: YTN; PAM sequence: TTT
attaaacatactaaaaataa

SEQ ID NO: 201117 - DNA, 20 bp, Artificial Sequence
  Description of Artificial Sequence: Synthetic oligonucleotide
  Target: ATXN1; (-) strand; PAM type: YTN; PAM sequence: TTT
tattaaacatactaaaaata

SEQ ID NO: 201118 - DNA, 20 bp, Artificial Sequence
  Description of Artificial Sequence: Synthetic oligonucleotide
  Target: ATXN1; (-) strand; PAM type: YTN; PAM sequence: TTT
ttattaaacatactaaaaat

SEQ ID NO: 201119 - DNA, 20 bp, Artificial Sequence
  Description of Artificial Sequence: Synthetic oligonucleotide
  Target: ATXN1; (-) strand; PAM type: YTN; PAM sequence: TTT
tttattaaacatactaaaaa

SEQ ID NO: 201120 - DNA, 20 bp, Artificial Sequence
  Description of Artificial Sequence: Synthetic oligonucleotide
  Target: ATXN1; (-) strand; PAM type: YTN; PAM sequence: TTT
ttttattaaacatactaaaa

SEQ ID NO: 201121 - DNA, 20 bp, Artificial Sequence
  Description of Artificial Sequence: Synthetic oligonucleotide
  Target: ATXN1; (-) strand; PAM type: YTN; PAM sequence: TTT
tttttattaaacatactaaa

SEQ ID NO: 201122 - DNA, 20 bp, Artificial Sequence
  Description of Artificial Sequence: Synthetic oligonucleotide
  Target: ATXN1; (-) strand; PAM type: YTN; PAM sequence: TTT
ttttttattaaacatactaa

SEQ ID NO: 201123 - DNA, 20 bp, Artificial Sequence
  Description of Artificial Sequence: Synthetic oligonucleotide
  Target: ATXN1; (-) strand; PAM type: YTN; PAM sequence: TTT
tttttttattaaacatacta

SEQ ID NO: 201124 - DNA, 20 bp, Artificial Sequence
  Description of Artificial Sequence: Synthetic oligonucleotide
  Target: ATXN1; (-) strand; PAM type: YTN; PAM sequence: TTA
ttttttttttattaaacata

SEQ ID NO: 201125 - DNA, 20 bp, Artificial Sequence
  Description of Artificial Sequence: Synthetic oligonucleotide
  Target: ATXN1; (-) strand; PAM type: YTN; PAM sequence: TTT
attttttttttattaaacat

SEQ ID NO: 201126 - DNA, 20 bp, Artificial Sequence
  Description of Artificial Sequence: Synthetic oligonucleotide
  Target: ATXN1; (-) strand; PAM type: YTN; PAM sequence: CTT
tattttttttttattaaaca

SEQ ID NO: 201127 - DNA, 20 bp, Artificial Sequence
  Description of Artificial Sequence: Synthetic oligonucleotide
  Target: ATXN1; (-) strand; PAM type: YTN; PAM sequence: TTA
aaaaactttatttttttttt

SEQ ID NO: 201128 - DNA, 20 bp, Artificial Sequence
  Description of Artificial Sequence: Synthetic oligonucleotide
  Target: ATXN1; (-) strand; PAM type: YTN; PAM sequence: TTT
aaaaaactttattttttttt

SEQ ID NO: 201129 - DNA, 20 bp, Artificial Sequence
  Description of Artificial Sequence: Synthetic oligonucleotide
  Target: ATXN1; (-) strand; PAM type: YTN; PAM sequence: TTG
agggtttaaaaaactttatt

SEQ ID NO: 201130 - DNA, 20 bp, Artificial Sequence
  Description of Artificial Sequence: Synthetic oligonucleotide
  Target: ATXN1; (-) strand; PAM type: YTN; PAM sequence: TTT
gagggtttaaaaaactttat

SEQ ID NO: 201131 - DNA, 20 bp, Artificial Sequence
  Description of Artificial Sequence: Synthetic oligonucleotide
  Target: ATXN1; (-) strand; PAM type: YTN; PAM sequence: TTT
tgagggtttaaaaaacttta

SEQ ID NO: 201132 - DNA, 20 bp, Artificial Sequence
  Description of Artificial Sequence: Synthetic oligonucleotide
  Target: ATXN1; (-) strand; PAM type: YTN; PAM sequence: CTG
ggcagtcaattttgagggtt

SEQ ID NO: 201133 - DNA, 20 bp, Artificial Sequence
  Description of Artificial Sequence: Synthetic oligonucleotide
  Target: ATXN1; (-) strand; PAM type: YTN; PAM sequence: TTC
ctgggcagtcaattttgagg

SEQ ID NO: 201134 - DNA, 20 bp, Artificial Sequence
  Description of Artificial Sequence: Synthetic oligonucleotide
  Target: ATXN1; (-) strand; PAM type: YTN; PAM sequence: TTT
cctgggcagtcaattttgag

SEQ ID NO: 201135 - DNA, 20 bp, Artificial Sequence
  Description of Artificial Sequence: Synthetic oligonucleotide
  Target: ATXN1; (-) strand; PAM type: YTN; PAM sequence: TTG
aaatcagtttcctgggcagt

SEQ ID NO: 201136 - DNA, 20 bp, Artificial Sequence
  Description of Artificial Sequence: Synthetic oligonucleotide
  Target: ATXN1; (-) strand; PAM type: YTN; PAM sequence: TTG
ggaaaagttgaaatcagttt

SEQ ID NO: 201137 - DNA, 20 bp, Artificial Sequence
  Description of Artificial Sequence: Synthetic oligonucleotide
  Target: ATXN1; (-) strand; PAM type: YTN; PAM sequence: TTT
gggaaaagttgaaatcagtt

SEQ ID NO: 201138 - DNA, 20 bp, Artificial Sequence
  Description of Artificial Sequence: Synthetic oligonucleotide
  Target: ATXN1; (-) strand; PAM type: YTN; PAM sequence: CTA
tttgggaaaagttgaaatca

SEQ ID NO: 201139 - DNA, 20 bp, Artificial Sequence
  Description of Artificial Sequence: Synthetic oligonucleotide
  Target: ATXN1; (-) strand; PAM type: YTN; PAM sequence: CTC
tatttgggaaaagttgaaat

SEQ ID NO: 201140 - DNA, 20 bp, Artificial Sequence
  Description of Artificial Sequence: Synthetic oligonucleotide
  Target: ATXN1; (-) strand; PAM type: YTN; PAM sequence: TTA
gccaaatgcctctatttggg

SEQ ID NO: 201141 - DNA, 20 bp, Artificial Sequence
  Description of Artificial Sequence: Synthetic oligonucleotide
  Target: ATXN1; (-) strand; PAM type: YTN; PAM sequence: CTT
agccaaatgcctctatttgg

SEQ ID NO: 201142 - DNA, 20 bp, Artificial Sequence
  Description of Artificial Sequence: Synthetic oligonucleotide
  Target: ATXN1; (-) strand; PAM type: YTN; PAM sequence: CTG
tgatggtggggtggggaggc

SEQ ID NO: 201143 - DNA, 20 bp, Artificial Sequence
  Description of Artificial Sequence: Synthetic oligonucleotide
  Target: ATXN1; (-) strand; PAM type: YTN; PAM sequence: CTC
ctgtgatggtggggtgggga

SEQ ID NO: 201144 - DNA, 20 bp, Artificial Sequence
  Description of Artificial Sequence: Synthetic oligonucleotide
  Target: ATXN1; (-) strand; PAM type: YTN; PAM sequence: TTG
gaggtggtcccgtctcctgt

SEQ ID NO: 201145 - DNA, 20 bp, Artificial Sequence
  Description of Artificial Sequence: Synthetic oligonucleotide
  Target: ATXN1; (-) strand; PAM type: YTN; PAM sequence: CTT
ggaggtggtcccgtctcctg

SEQ ID NO: 201146 - DNA, 20 bp, Artificial Sequence
  Description of Artificial Sequence: Synthetic oligonucleotide
  Target: ATXN1; (-) strand; PAM type: YTN; PAM sequence: TTG
gtcttggaggtggtcccgtc

SEQ ID NO: 201147 - DNA, 20 bp, Artificial Sequence
  Description of Artificial Sequence: Synthetic oligonucleotide
  Target: ATXN1; (-) strand; PAM type: YTN; PAM sequence: CTT
ggtcttggaggtggtcccgt

SEQ ID NO: 201148 - DNA, 20 bp, Artificial Sequence
  Description of Artificial Sequence: Synthetic oligonucleotide
  Target: ATXN1; (-) strand; PAM type: YTN; PAM sequence: TTA
tccacttggtcttggaggtg

SEQ ID NO: 201149 - DNA, 20 bp, Artificial Sequence
  Description of Artificial Sequence: Synthetic oligonucleotide
  Target: ATXN1; (-) strand; PAM type: YTN; PAM sequence: TTG
aattatccacttggtcttgg

SEQ ID NO: 201150 - DNA, 20 bp, Artificial Sequence
  Description of Artificial Sequence: Synthetic oligonucleotide
  Target: ATXN1; (-) strand; PAM type: YTN; PAM sequence: TTA
tgaagattgaattatccact

SEQ ID NO: 201151 - DNA, 20 bp, Artificial Sequence
  Description of Artificial Sequence: Synthetic oligonucleotide
  Target: ATXN1; (-) strand; PAM type: YTN; PAM sequence: TTG
aatggattatgaagattgaa

SEQ ID NO: 201152 - DNA, 20 bp, Artificial Sequence
  Description of Artificial Sequence: Synthetic oligonucleotide
  Target: ATXN1; (-) strand; PAM type: YTN; PAM sequence: TTT
gaatggattatgaagattga

SEQ ID NO: 201153 - DNA, 20 bp, Artificial Sequence
  Description of Artificial Sequence: Synthetic oligonucleotide
  Target: ATXN1; (-) strand; PAM type: YTN; PAM sequence: CTA
caacagagggcaaatttgaa

SEQ ID NO: 201154 - DNA, 20 bp, Artificial Sequence
  Description of Artificial Sequence: Synthetic oligonucleotide
  Target: ATXN1; (-) strand; PAM type: YTN; PAM sequence: CTC
cagctacaacagagggcaaa

SEQ ID NO: 201155 - DNA, 20 bp, Artificial Sequence
  Description of Artificial Sequence: Synthetic oligonucleotide
  Target: ATXN1; (-) strand; PAM type: YTN; PAM sequence: TTG
gcatatctccagctacaaca

SEQ ID NO: 201156 - DNA, 20 bp, Artificial Sequence
  Description of Artificial Sequence: Synthetic oligonucleotide
  Target: ATXN1; (-) strand; PAM type: YTN; PAM sequence: CTC
gttggcatatctccagctac

SEQ ID NO: 201157 - DNA, 20 bp, Artificial Sequence
  Description of Artificial Sequence: Synthetic oligonucleotide
  Target: ATXN1; (-) strand; PAM type: YTN; PAM sequence: CTC
tcgttggcatatctccagct

SEQ ID NO: 201158 - DNA, 20 bp, Artificial Sequence
  Description of Artificial Sequence: Synthetic oligonucleotide
  Target: ATXN1; (-) strand; PAM type: YTN; PAM sequence: CTA
aacaaacccctctcgttggc

SEQ ID NO: 201159 - DNA, 20 bp, Artificial Sequence
  Description of Artificial Sequence: Synthetic oligonucleotide
  Target: ATXN1; (-) strand; PAM type: YTN; PAM sequence: CTG
aggataaatctaaacaaacc

SEQ ID NO: 201160 - DNA, 20 bp, Artificial Sequence
  Description of Artificial Sequence: Synthetic oligonucleotide
  Target: ATXN1; (-) strand; PAM type: YTN; PAM sequence: TTG
catcctgaggataaatctaa

SEQ ID NO: 201161 - DNA, 20 bp, Artificial Sequence
  Description of Artificial Sequence: Synthetic oligonucleotide
  Target: ATXN1; (-) strand; PAM type: YTN; PAM sequence: TTT
gcatcctgaggataaatcta

SEQ ID NO: 201162 - DNA, 20 bp, Artificial Sequence
  Description of Artificial Sequence: Synthetic oligonucleotide
  Target: ATXN1; (-) strand; PAM type: YTN; PAM sequence: CTT
tgcatcctgaggataaatct

SEQ ID NO: 201163 - DNA, 20 bp, Artificial Sequence
  Description of Artificial Sequence: Synthetic oligonucleotide
  Target: ATXN1; (-) strand; PAM type: YTN; PAM sequence: TTC
tttgcatcctgaggataaat

SEQ ID NO: 201164 - DNA, 20 bp, Artificial Sequence
  Description of Artificial Sequence: Synthetic oligonucleotide
  Target: ATXN1; (-) strand; PAM type: YTN; PAM sequence: TTT
ctttgcatcctgaggataaa

SEQ ID NO: 201165 - DNA, 20 bp, Artificial Sequence
  Description of Artificial Sequence: Synthetic oligonucleotide
  Target: ATXN1; (-) strand; PAM type: YTN; PAM sequence: TTT
tctttgcatcctgaggataa

SEQ ID NO: 201166 - DNA, 20 bp, Artificial Sequence
  Description of Artificial Sequence: Synthetic oligonucleotide
  Target: ATXN1; (-) strand; PAM type: YTN; PAM sequence: TTT
ttctttgcatcctgaggata

SEQ ID NO: 201167 - DNA, 20 bp, Artificial Sequence
  Description of Artificial Sequence: Synthetic oligonucleotide
  Target: ATXN1; (-) strand; PAM type: YTN; PAM sequence: CTT
tttctttgcatcctgaggat

SEQ ID NO: 201168 - DNA, 20 bp, Artificial Sequence
  Description of Artificial Sequence: Synthetic oligonucleotide
  Target: ATXN1; (-) strand; PAM type: YTN; PAM sequence: TTG
gtctttttctttgcatcctg

SEQ ID NO: 201169 - DNA, 20 bp, Artificial Sequence
  Description of Artificial Sequence: Synthetic oligonucleotide
  Target: ATXN1; (-) strand; PAM type: YTN; PAM sequence: CTA
cgcagaataagtaaaattgg

SEQ ID NO: 201170 - DNA, 20 bp, Artificial Sequence
  Description of Artificial Sequence: Synthetic oligonucleotide
  Target: ATXN1; (-) strand; PAM type: YTN; PAM sequence: TTC
agctacgcagaataagtaaa

SEQ ID NO: 201171 - DNA, 20 bp, Artificial Sequence
  Description of Artificial Sequence: Synthetic oligonucleotide
  Target: ATXN1; (-) strand; PAM type: YTN; PAM sequence: CTA
aaaattcagctacgcagaat

SEQ ID NO: 201172 - DNA, 20 bp, Artificial Sequence
  Description of Artificial Sequence: Synthetic oligonucleotide
  Target: ATXN1; (-) strand; PAM type: YTN; PAM sequence: TTG
gaagacctaaaaattcagct

SEQ ID NO: 201173 - DNA, 20 bp, Artificial Sequence
  Description of Artificial Sequence: Synthetic oligonucleotide
  Target: ATXN1; (-) strand; PAM type: YTN; PAM sequence: CTG
atgaccattggaagacctaa

SEQ ID NO: 201174 - DNA, 20 bp, Artificial Sequence
  Description of Artificial Sequence: Synthetic oligonucleotide
  Target: ATXN1; (-) strand; PAM type: YTN; PAM sequence: CTA
actgatgaccattggaagac

SEQ ID NO: 201175 - DNA, 20 bp, Artificial Sequence
  Description of Artificial Sequence: Synthetic oligonucleotide
  Target: ATXN1; (-) strand; PAM type: YTN; PAM sequence: CTA
accctaactgatgaccattg

SEQ ID NO: 201176 - DNA, 20 bp, Artificial Sequence
  Description of Artificial Sequence: Synthetic oligonucleotide
  Target: ATXN1; (-) strand; PAM type: YTN; PAM sequence: TTC
taaccctaactgatgaccat

SEQ ID NO: 201177 - DNA, 20 bp, Artificial Sequence
  Description of Artificial Sequence: Synthetic oligonucleotide
  Target: ATXN1; (-) strand; PAM type: YTN; PAM sequence: TTC
gttctaaccctaactgatga

SEQ ID NO: 201178 - DNA, 20 bp, Artificial Sequence
  Description of Artificial Sequence: Synthetic oligonucleotide
  Target: ATXN1; (-) strand; PAM type: YTN; PAM sequence: TTT
cgttctaaccctaactgatg

SEQ ID NO: 201179 - DNA, 20 bp, Artificial Sequence
  Description of Artificial Sequence: Synthetic oligonucleotide
  Target: ATXN1; (-) strand; PAM type: YTN; PAM sequence: TTT
tcgttctaaccctaactgat

SEQ ID NO: 201180 - DNA, 20 bp, Artificial Sequence
  Description of Artificial Sequence: Synthetic oligonucleotide
  Target: ATXN1; (-) strand; PAM type: YTN; PAM sequence: CTG
ttttcgttctaaccctaact

SEQ ID NO: 201181 - DNA, 20 bp, Artificial Sequence
  Description of Artificial Sequence: Synthetic oligonucleotide
  Target: ATXN1; (-) strand; PAM type: YTN; PAM sequence: TTA
cagctgttttcgttctaacc

SEQ ID NO: 201182 - DNA, 20 bp, Artificial Sequence
  Description of Artificial Sequence: Synthetic oligonucleotide
  Target: ATXN1; (-) strand; PAM type: YTN; PAM sequence: TTT
acagctgttttcgttctaac

SEQ ID NO: 201183 - DNA, 20 bp, Artificial Sequence
  Description of Artificial Sequence: Synthetic oligonucleotide
  Target: ATXN1; (-) strand; PAM type: YTN; PAM sequence: TTT
tacagctgttttcgttctaa

SEQ ID NO: 201184 - DNA, 20 bp, Artificial Sequence
  Description of Artificial Sequence: Synthetic oligonucleotide
  Target: ATXN1; (-) strand; PAM type: YTN; PAM sequence: TTT
ttacagctgttttcgttcta

SEQ ID NO: 201185 - DNA, 20 bp, Artificial Sequence
  Description of Artificial Sequence: Synthetic oligonucleotide
  Target: ATXN1; (-) strand; PAM type: YTN; PAM sequence: CTG
tcaggacatttttacagctg

SEQ ID NO: 201186 - DNA, 20 bp, Artificial Sequence
  Description of Artificial Sequence: Synthetic oligonucleotide
  Target: ATXN1; (-) strand; PAM type: YTN; PAM sequence: CTC
ctgtcaggacatttttacag

SEQ ID NO: 201187 - DNA, 20 bp, Artificial Sequence
  Description of Artificial Sequence: Synthetic oligonucleotide
  Target: ATXN1; (-) strand; PAM type: YTN; PAM sequence: CTC
cagctcctgtcaggacattt

SEQ ID NO: 201188 - DNA, 20 bp, Artificial Sequence
  Description of Artificial Sequence: Synthetic oligonucleotide
  Target: ATXN1; (-) strand; PAM type: YTN; PAM sequence: CTG
gtctccagctcctgtcagga

SEQ ID NO: 201189 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctccagctc

SEQ ID NO: 201190 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctggt

SEQ ID NO: 201191 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctgg

SEQ ID NO: 201192 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcacca

SEQ ID NO: 201193 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcacc

SEQ ID NO: 201194 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 201195 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 201196 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 201197 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 201198 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 201199 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 201200 - DNA, 20 bp, Artificial Sequence
  Description of Artificial Sequence: Synthetic oligonucleotide
  Target: ATXN1; (-) strand; PAM type: YTN; PAM sequence: CTG
ccaccatgcccagcaaattt

SEQ ID NO: 201201 - DNA, 20 bp, Artificial Sequence
  Description of Artificial Sequence: Synthetic oligonucleotide
  Target: ATXN1; (-) strand; PAM type: YTN; PAM sequence: TTA
caagcacctgccaccatgcc

SEQ ID NO: 201202 - DNA, 20 bp, Artificial Sequence
  Description of Artificial Sequence: Synthetic oligonucleotide
  Target: ATXN1; (-) strand; PAM type: YTN; PAM sequence: CTG
ggattacaagcacctgccac

SEQ ID NO: 201203 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggattacaa

SEQ ID NO: 201204 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 201205 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 201206 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 201207 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 201208 - DNA, 20 bp, Artificial Sequence
  Description of Artificial Sequence: Synthetic oligonucleotide
  Target: ATXN1; (-) strand; PAM type: YTN; PAM sequence: TTA
aacgattctcctgcctcagc

SEQ ID NO: 201209 - DNA, 20 bp, Artificial Sequence
  Description of Artificial Sequence: Synthetic oligonucleotide
  Target: ATXN1; (-) strand; PAM type: YTN; PAM sequence: TTT
aaacgattctcctgcctcag

SEQ ID NO: 201210 - DNA, 20 bp, Artificial Sequence
  Description of Artificial Sequence: Synthetic oligonucleotide
  Target: ATXN1; (-) strand; PAM type: YTN; PAM sequence: CTC
cccgtttaaacgattctcct

SEQ ID NO: 201211 - DNA, 20 bp, Artificial Sequence
  Description of Artificial Sequence: Synthetic oligonucleotide
  Target: ATXN1; (-) strand; PAM type: YTN; PAM sequence: CTC
cgcctccccgtttaaacgat

SEQ ID NO: 201212 - DNA, 20 bp, Artificial Sequence
  Description of Artificial Sequence: Synthetic oligonucleotide
  Target: ATXN1; (-) strand; PAM type: YTN; PAM sequence: CTG
caacctccgcctccccgttt

SEQ ID NO: 201213 - DNA, 20 bp, Artificial Sequence
  Description of Artificial Sequence: Synthetic oligonucleotide
  Target: ATXN1; (-) strand; PAM type: YTN; PAM sequence: CTC
ggtgcactgcaacctccgcc

SEQ ID NO: 201214 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatggtgtgatctc

SEQ ID NO: 201215 - DNA, 20 bp, Artificial Sequence
  Description of Artificial Sequence: Synthetic oligonucleotide
  Target: ATXN1; (-) strand; PAM type: YTN; PAM sequence: CTA
tccaaactggagtgcaatgg

SEQ ID NO: 201216 - DNA, 20 bp, Artificial Sequence
  Description of Artificial Sequence: Synthetic oligonucleotide
  Target: ATXN1; (-) strand; PAM type: YTN; PAM sequence: TTG
ctatccaaactggagtgcaa

SEQ ID NO: 201217 - DNA, 20 bp, Artificial Sequence
  Description of Artificial Sequence: Synthetic oligonucleotide
  Target: ATXN1; (-) strand; PAM type: YTN; PAM sequence: CTT
gctatccaaactggagtgca

SEQ ID NO: 201218 - DNA, 20 bp, Artificial Sequence
  Description of Artificial Sequence: Synthetic oligonucleotide
  Target: ATXN1; (-) strand; PAM type: YTN; PAM sequence: CTC
ttgctatccaaactggagtg

SEQ ID NO: 201219 - DNA, 20 bp, Artificial Sequence
  Description of Artificial Sequence: Synthetic oligonucleotide
  Target: ATXN1; (-) strand; PAM type: YTN; PAM sequence: TTC
gctcttgctatccaaactgg

SEQ ID NO: 201220 - DNA, 20 bp, Artificial Sequence
  Description of Artificial Sequence: Synthetic oligonucleotide
  Target: ATXN1; (-) strand; PAM type: YTN; PAM sequence: TTT
cgctcttgctatccaaactg

SEQ ID NO: 201221 - DNA, 20 bp, Artificial Sequence
  Description of Artificial Sequence: Synthetic oligonucleotide
  Target: ATXN1; (-) strand; PAM type: YTN; PAM sequence: TTG
aggtggagtttcgctcttgc

SEQ ID NO: 201222 - DNA, 20 bp, Artificial Sequence
  Description of Artificial Sequence: Synthetic oligonucleotide
  Target: ATXN1; (-) strand; PAM type: YTN; PAM sequence: TTT
gaggtggagtttcgctcttg

SEQ ID NO: 201223 - DNA, 20 bp, Artificial Sequence
  Description of Artificial Sequence: Synthetic oligonucleotide
  Target: ATXN1; (-) strand; PAM type: YTN; PAM sequence: TTT
tgaggtggagtttcgctctt

SEQ ID NO: 201224 - DNA, 20 bp, Artificial Sequence
  Description of Artificial Sequence: Synthetic oligonucleotide
  Target: ATXN1; (-) strand; PAM type: YTN; PAM sequence: TTT
ttgaggtggagtttcgctct

SEQ ID NO: 201225 - DNA, 20 bp, Artificial Sequence
  Description of Artificial Sequence: Synthetic oligonucleotide
  Target: ATXN1; (-) strand; PAM type: YTN; PAM sequence: TTA
tttttgaggtggagtttcgc

SEQ ID NO: 201226 - DNA, 20 bp, Artificial Sequence
  Description of Artificial Sequence: Synthetic oligonucleotide
  Target: ATXN1; (-) strand; PAM type: YTN; PAM sequence: TTT
atttttgaggtggagtttcg

SEQ ID NO: 201227 - DNA, 20 bp, Artificial Sequence
  Description of Artificial Sequence: Synthetic oligonucleotide
  Target: ATXN1; (-) strand; PAM type: YTN; PAM sequence: TTT
tatttttgaggtggagtttc

SEQ ID NO: 201228 - DNA, 20 bp, Artificial Sequence
  Description of Artificial Sequence: Synthetic oligonucleotide
  Target: ATXN1; (-) strand; PAM type: YTN; PAM sequence: TTT
ttatttttgaggtggagttt

SEQ ID NO: 201229 - DNA, 20 bp, Artificial Sequence
  Description of Artificial Sequence: Synthetic oligonucleotide
  Target: ATXN1; (-) strand; PAM type: YTN; PAM sequence: TTA
tttttatttttgaggtggag

SEQ ID NO: 201230 - DNA, 20 bp, Artificial Sequence
  Description of Artificial Sequence: Synthetic oligonucleotide
  Target: ATXN1; (-) strand; PAM type: YTN; PAM sequence: TTT
atttttatttttgaggtgga

SEQ ID NO: 201231 - DNA, 20 bp, Artificial Sequence
  Description of Artificial Sequence: Synthetic oligonucleotide
  Target: ATXN1; (-) strand; PAM type: YTN; PAM sequence: TTT
tatttttatttttgaggtgg

SEQ ID NO: 201232 - DNA, 20 bp, Artificial Sequence
  Description of Artificial Sequence: Synthetic oligonucleotide
  Target: ATXN1; (-) strand; PAM type: YTN; PAM sequence: TTT
ttatttttatttttgaggtg

SEQ ID NO: 201233 - DNA, 20 bp, Artificial Sequence
  Description of Artificial Sequence: Synthetic oligonucleotide
  Target: ATXN1; (-) strand; PAM type: YTN; PAM sequence: TTT
tttatttttatttttgaggt

SEQ ID NO: 201234 - DNA, 20 bp, Artificial Sequence
  Description of Artificial Sequence: Synthetic oligonucleotide
  Target: ATXN1; (-) strand; PAM type: YTN; PAM sequence: TTT
ttttatttttatttttgagg

SEQ ID NO: 201235 - DNA, 20 bp, Artificial Sequence
  Description of Artificial Sequence: Synthetic oligonucleotide
  Target: ATXN1; (-) strand; PAM type: YTN; PAM sequence: TTA
tttttttatttttatttttg

SEQ ID NO: 201236 - DNA, 20 bp, Artificial Sequence
  Description of Artificial Sequence: Synthetic oligonucleotide
  Target: ATXN1; (-) strand; PAM type: YTN; PAM sequence: TTT
atttttttatttttattttt

SEQ ID NO: 201237 - DNA, 20 bp, Artificial Sequence
  Description of Artificial Sequence: Synthetic oligonucleotide
  Target: ATXN1; (-) strand; PAM type: YTN; PAM sequence: TTT
tatttttttatttttatttt

SEQ ID NO: 201238 - DNA, 20 bp, Artificial Sequence
  Description of Artificial Sequence: Synthetic oligonucleotide
  Target: ATXN1; (-) strand; PAM type: YTN; PAM sequence: TTT
ttatttttttatttttattt

SEQ ID NO: 201239 - DNA, 20 bp, Artificial Sequence
  Description of Artificial Sequence: Synthetic oligonucleotide
  Target: ATXN1; (-) strand; PAM type: YTN; PAM sequence: TTT
tttatttttttatttttatt

SEQ ID NO: 201240 - DNA, 20 bp, Artificial Sequence
  Description of Artificial Sequence: Synthetic oligonucleotide
  Target: ATXN1; (-) strand; PAM type: YTN; PAM sequence: TTA
ttttttatttttttattttt

SEQ ID NO: 201241 - DNA, 20 bp, Artificial Sequence
  Description of Artificial Sequence: Synthetic oligonucleotide
  Target: ATXN1; (-) strand; PAM type: YTN; PAM sequence: TTT
attttttatttttttatttt

SEQ ID NO: 201242 - DNA, 20 bp, Artificial Sequence
  Description of Artificial Sequence: Synthetic oligonucleotide
  Target: ATXN1; (-) strand; PAM type: YTN; PAM sequence: TTT
tattttttatttttttattt

SEQ ID NO: 201243 - DNA, 20 bp, Artificial Sequence
  Description of Artificial Sequence: Synthetic oligonucleotide
  Target: ATXN1; (-) strand; PAM type: YTN; PAM sequence: TTG
tcaggacattttatttttta

SEQ ID NO: 201244 - DNA, 20 bp, Artificial Sequence
  Description of Artificial Sequence: Synthetic oligonucleotide
  Target: ATXN1; (-) strand; PAM type: YTN; PAM sequence: TTT
gtcaggacattttatttttt

SEQ ID NO: 201245 - DNA, 20 bp, Artificial Sequence
  Description of Artificial Sequence: Synthetic oligonucleotide
  Target: ATXN1; (-) strand; PAM type: YTN; PAM sequence: CTT
tgtcaggacattttattttt

SEQ ID NO: 201246 - DNA, 20 bp, Artificial Sequence
  Description of Artificial Sequence: Synthetic oligonucleotide
  Target: ATXN1; (-) strand; PAM type: YTN; PAM sequence: CTA
tagtctttgtcaggacattt

SEQ ID NO: 201247 - DNA, 20 bp, Artificial Sequence
  Description of Artificial Sequence: Synthetic oligonucleotide
  Target: ATXN1; (-) strand; PAM type: YTN; PAM sequence: CTC
actatagtctttgtcaggac

SEQ ID NO: 201248 - DNA, 20 bp, Artificial Sequence
  Description of Artificial Sequence: Synthetic oligonucleotide
  Target: ATXN1; (-) strand; PAM type: YTN; PAM sequence: CTG
atgagctcactatagtcttt

SEQ ID NO: 201249 - DNA, 20 bp, Artificial Sequence
  Description of Artificial Sequence: Synthetic oligonucleotide
  Target: ATXN1; (-) strand; PAM type: YTN; PAM sequence: TTA
aaggaatgtctgatgagctc

SEQ ID NO: 201250 - DNA, 20 bp, Artificial Sequence
  Description of Artificial Sequence: Synthetic oligonucleotide
  Target: ATXN1; (-) strand; PAM type: YTN; PAM sequence: TTA
gaacaagcatattaaaggaa

SEQ ID NO: 201251 - DNA, 20 bp, Artificial Sequence
  Description of Artificial Sequence: Synthetic oligonucleotide
  Target: ATXN1; (-) strand; PAM type: YTN; PAM sequence: TTT
agaacaagcatattaaagga

SEQ ID NO: 201252 - DNA, 20 bp, Artificial Sequence
  Description of Artificial Sequence: Synthetic oligonucleotide
  Target: ATXN1; (-) strand; PAM type: YTN; PAM sequence: CTT
tagaacaagcatattaaagg

SEQ ID NO: 201253 - DNA, 20 bp, Artificial Sequence
  Description of Artificial Sequence: Synthetic oligonucleotide
  Target: ATXN1; (-) strand; PAM type: YTN; PAM sequence: CTG
ccccctttagaacaagcata

SEQ ID NO: 201254 - DNA, 20 bp, Artificial Sequence
  Description of Artificial Sequence: Synthetic oligonucleotide
  Target: ATXN1; (-) strand; PAM type: YTN; PAM sequence: CTC
cacccctgccccctttagaa

SEQ ID NO: 201255 - DNA, 20 bp, Artificial Sequence
  Description of Artificial Sequence: Synthetic oligonucleotide
  Target: ATXN1; (-) strand; PAM type: YTN; PAM sequence: CTC
tccacccctgccccctttag

SEQ ID NO: 201256 - DNA, 20 bp, Artificial Sequence
  Description of Artificial Sequence: Synthetic oligonucleotide
  Target: ATXN1; (-) strand; PAM type: YTN; PAM sequence: CTC
tctccacccctgcccccttt

SEQ ID NO: 201257 - DNA, 20 bp, Artificial Sequence
  Description of Artificial Sequence: Synthetic oligonucleotide
  Target: ATXN1; (-) strand; PAM type: YTN; PAM sequence: TTC
tctctccacccctgccccct

SEQ ID NO: 201258 - DNA, 20 bp, Artificial Sequence
  Description of Artificial Sequence: Synthetic oligonucleotide
  Target: ATXN1; (-) strand; PAM type: YTN; PAM sequence: CTT
ctctctccacccctgccccc

SEQ ID NO: 201259 - DNA, 20 bp, Artificial Sequence
  Description of Artificial Sequence: Synthetic oligonucleotide
  Target: ATXN1; (-) strand; PAM type: YTN; PAM sequence: CTA
gtcttctctctccacccctg

SEQ ID NO: 201260 - DNA, 20 bp, Artificial Sequence
  Description of Artificial Sequence: Synthetic oligonucleotide
  Target: ATXN1; (-) strand; PAM type: YTN; PAM sequence: TTC
tagtcttctctctccacccc

SEQ ID NO: 201261 - DNA, 20 bp, Artificial Sequence
  Description of Artificial Sequence: Synthetic oligonucleotide
  Target: ATXN1; (-) strand; PAM type: YTN; PAM sequence: CTG
cagaccaattctagtcttct

SEQ ID NO: 201262 - DNA, 20 bp, Artificial Sequence
  Description of Artificial Sequence: Synthetic oligonucleotide
  Target: ATXN1; (-) strand; PAM type: YTN; PAM sequence: CTG
ggccctgcagaccaattcta

SEQ ID NO: 201263 - DNA, 20 bp, Artificial Sequence
  Description of Artificial Sequence: Synthetic oligonucleotide
  Target: ATXN1; (-) strand; PAM type: YTN; PAM sequence: CTG
agaggagctgggccctgcag

SEQ ID NO: 201264 - DNA, 20 bp, Artificial Sequence
  Description of Artificial Sequence: Synthetic oligonucleotide
  Target: ATXN1; (-) strand; PAM type: YTN; PAM sequence: CTC
caagacgggtgtctgagagg

SEQ ID NO: 201265 - DNA, 20 bp, Artificial Sequence
  Description of Artificial Sequence: Synthetic oligonucleotide
  Target: ATXN1; (-) strand; PAM type: YTN; PAM sequence: CTC
ctccaagacgggtgtctgag

SEQ ID NO: 201266 - DNA, 20 bp, Artificial Sequence
  Description of Artificial Sequence: Synthetic oligonucleotide
  Target: ATXN1; (-) strand; PAM type: YTN; PAM sequence: CTA
acctcctccaagacgggtgt

SEQ ID NO: 201267 - DNA, 20 bp, Artificial Sequence
  Description of Artificial Sequence: Synthetic oligonucleotide
  Target: ATXN1; (-) strand; PAM type: YTN; PAM sequence: TTC
taacctcctccaagacgggt

SEQ ID NO: 201268 - DNA, 20 bp, Artificial Sequence
  Description of Artificial Sequence: Synthetic oligonucleotide
  Target: ATXN1; (-) strand; PAM type: YTN; PAM sequence: CTT
ctaacctcctccaagacggg

SEQ ID NO: 201269 - DNA, 20 bp, Artificial Sequence
  Description of Artificial Sequence: Synthetic oligonucleotide
  Target: ATXN1; (-) strand; PAM type: YTN; PAM sequence: CTC
ttctaacctcctccaagacg

SEQ ID NO: 201270 - DNA, 20 bp, Artificial Sequence
  Description of Artificial Sequence: Synthetic oligonucleotide
  Target: ATXN1; (-) strand; PAM type: YTN; PAM sequence: CTG
aacactcttctaacctcctc

SEQ ID NO: 201271 - DNA, 20 bp, Artificial Sequence
  Description of Artificial Sequence: Synthetic oligonucleotide
  Target: ATXN1; (-) strand; PAM type: YTN; PAM sequence: TTA
ccctgaacactcttctaacc

SEQ ID NO: 201272 - DNA, 20 bp, Artificial Sequence
  Description of Artificial Sequence: Synthetic oligonucleotide
  Target: ATXN1; (-) strand; PAM type: YTN; PAM sequence: CTG
gcccattaccctgaacactc

SEQ ID NO: 201273 - DNA, 20 bp, Artificial Sequence
  Description of Artificial Sequence: Synthetic oligonucleotide
  Target: ATXN1; (-) strand; PAM type: YTN; PAM sequence: TTG
ctggcccattaccctgaaca

SEQ ID NO: 201274 - DNA, 20 bp, Artificial Sequence
  Description of Artificial Sequence: Synthetic oligonucleotide
  Target: ATXN1; (-) strand; PAM type: YTN; PAM sequence: TTA
gtgttgctggcccattaccc

SEQ ID NO: 201275 - DNA, 20 bp, Artificial Sequence
  Description of Artificial Sequence: Synthetic oligonucleotide
  Target: ATXN1; (-) strand; PAM type: YTN; PAM sequence: TTT
agtgttgctggcccattacc

SEQ ID NO: 201276 - DNA, 20 bp, Artificial Sequence
  Description of Artificial Sequence: Synthetic oligonucleotide
  Target: ATXN1; (-) strand; PAM type: YTN; PAM sequence: TTT
tagtgttgctggcccattac

SEQ ID NO: 201277 - DNA, 20 bp, Artificial Sequence
  Description of Artificial Sequence: Synthetic oligonucleotide
  Target: ATXN1; (-) strand; PAM type: YTN; PAM sequence: CTG
ggacattttagtgttgctgg

SEQ ID NO: 201278 - DNA, 20 bp, Artificial Sequence
  Description of Artificial Sequence: Synthetic oligonucleotide
  Target: ATXN1; (-) strand; PAM type: YTN; PAM sequence: TTG
gagtctgggacattttagtg

SEQ ID NO: 201279 - DNA, 20 bp, Artificial Sequence
  Description of Artificial Sequence: Synthetic oligonucleotide
  Target: ATXN1; (-) strand; PAM type: YTN; PAM sequence: TTC
attggagtctgggacatttt

SEQ ID NO: 201280 - DNA, 20 bp, Artificial Sequence
  Description of Artificial Sequence: Synthetic oligonucleotide
  Target: ATXN1; (-) strand; PAM type: YTN; PAM sequence: CTT
cattggagtctgggacattt

SEQ ID NO: 201281 - DNA, 20 bp, Artificial Sequence
  Description of Artificial Sequence: Synthetic oligonucleotide
  Target: ATXN1; (-) strand; PAM type: YTN; PAM sequence: CTG
caggagtggtagaatgagaa

SEQ ID NO: 201282 - DNA, 20 bp, Artificial Sequence
  Description of Artificial Sequence: Synthetic oligonucleotide
  Target: ATXN1; (-) strand; PAM type: YTN; PAM sequence: CTC
tgcaggagtggtagaatgag

SEQ ID NO: 201283 - DNA, 20 bp, Artificial Sequence
  Description of Artificial Sequence: Synthetic oligonucleotide
  Target: ATXN1; (-) strand; PAM type: YTN; PAM sequence: CTA
caagaatctctgcaggagtg

SEQ ID NO: 201284 - DNA, 20 bp, Artificial Sequence
  Description of Artificial Sequence: Synthetic oligonucleotide
  Target: ATXN1; (-) strand; PAM type: YTN; PAM sequence: TTG
ctacaagaatctctgcagga

SEQ ID NO: 201285 - DNA, 20 bp, Artificial Sequence
  Description of Artificial Sequence: Synthetic oligonucleotide
  Target: ATXN1; (-) strand; PAM type: YTN; PAM sequence: TTT
gctacaagaatctctgcagg

SEQ ID NO: 201286 - DNA, 20 bp, Artificial Sequence
  Description of Artificial Sequence: Synthetic oligonucleotide
  Target: ATXN1; (-) strand; PAM type: YTN; PAM sequence: TTG
acaggcaaggtgaaaaaccc

SEQ ID NO: 201287 - DNA, 20 bp, Artificial Sequence
  Description of Artificial Sequence: Synthetic oligonucleotide
  Target: ATXN1; (-) strand; PAM type: YTN; PAM sequence: CTT
gacaggcaaggtgaaaaacc

SEQ ID NO: 201288 - DNA, 20 bp, Artificial Sequence
  Description of Artificial Sequence: Synthetic oligonucleotide
  Target: ATXN1; (-) strand; PAM type: YTN; PAM sequence: TTG
tgcttgacaggcaaggtgaa

SEQ ID NO: 201289 - DNA, 20 bp, Artificial Sequence
  Description of Artificial Sequence: Synthetic oligonucleotide
  Target: ATXN1; (-) strand; PAM type: YTN; PAM sequence: TTC
aagggaatcaaaaaagttgt

SEQ ID NO: 201290 - DNA, 20 bp, Artificial Sequence
  Description of Artificial Sequence: Synthetic oligonucleotide
  Target: ATXN1; (-) strand; PAM type: YTN; PAM sequence: CTT
caagggaatcaaaaaagttg

SEQ ID NO: 201291 - DNA, 20 bp, Artificial Sequence
  Description of Artificial Sequence: Synthetic oligonucleotide
  Target: ATXN1; (-) strand; PAM type: YTN; PAM sequence: CTG
aatgtgtcttcaagggaatc

SEQ ID NO: 201292 - DNA, 20 bp, Artificial Sequence
  Description of Artificial Sequence: Synthetic oligonucleotide
  Target: ATXN1; (-) strand; PAM type: YTN; PAM sequence: TTG
tgatgctgaatgtgtcttca

SEQ ID NO: 201293 - DNA, 20 bp, Artificial Sequence
  Description of Artificial Sequence: Synthetic oligonucleotide
  Target: ATXN1; (-) strand; PAM type: YTN; PAM sequence: TTT
gtgatgctgaatgtgtcttc

SEQ ID NO: 201294 - DNA, 20 bp, Artificial Sequence
  Description of Artificial Sequence: Synthetic oligonucleotide
  Target: ATXN1; (-) strand; PAM type: YTN; PAM sequence: TTT
tgtgatgctgaatgtgtctt

SEQ ID NO: 201295 - DNA, 20 bp, Artificial Sequence
  Description of Artificial Sequence: Synthetic oligonucleotide
  Target: ATXN1; (-) strand; PAM type: YTN; PAM sequence: CTT
ttgtgatgctgaatgtgtct

SEQ ID NO: 201296 - DNA, 20 bp, Artificial Sequence
  Description of Artificial Sequence: Synthetic oligonucleotide
  Target: ATXN1; (-) strand; PAM type: YTN; PAM sequence: CTC
ttttgtgatgctgaatgtgt

SEQ ID NO: 201297 - DNA, 20 bp, Artificial Sequence
  Description of Artificial Sequence: Synthetic oligonucleotide
  Target: ATXN1; (-) strand; PAM type: YTN; PAM sequence: TTA
ccacctcttttgtgatgctg

SEQ ID NO: 201298 - DNA, 20 bp, Artificial Sequence
  Description of Artificial Sequence: Synthetic oligonucleotide
  Target: ATXN1; (-) strand; PAM type: YTN; PAM sequence: TTT
accacctcttttgtgatgct

SEQ ID NO: 201299 - DNA, 20 bp, Artificial Sequence
  Description of Artificial Sequence: Synthetic oligonucleotide
  Target: ATXN1; (-) strand; PAM type: YTN; PAM sequence: CTT
taccacctcttttgtgatgc

SEQ ID NO: 201300 - DNA, 20 bp, Artificial Sequence
  Description of Artificial Sequence: Synthetic oligonucleotide
  Target: ATXN1; (-) strand; PAM type: YTN; PAM sequence: TTG
ggggaaagtaagctttacca

SEQ ID NO: 201301 - DNA, 20 bp, Artificial Sequence
  Description of Artificial Sequence: Synthetic oligonucleotide
  Target: ATXN1; (-) strand; PAM type: YTN; PAM sequence: CTA
aaaatggtcataattggggg

SEQ ID NO: 201302 - DNA, 20 bp, Artificial Sequence
  Description of Artificial Sequence: Synthetic oligonucleotide
  Target: ATXN1; (-) strand; PAM type: YTN; PAM sequence: CTG
tgatgctaaaaatggtcata

SEQ ID NO: 201303 - DNA, 20 bp, Artificial Sequence
  Description of Artificial Sequence: Synthetic oligonucleotide
  Target: ATXN1; (-) strand; PAM type: YTN; PAM sequence: TTG
actgtgatgctaaaaatggt

SEQ ID NO: 201304 - DNA, 20 bp, Artificial Sequence
  Description of Artificial Sequence: Synthetic oligonucleotide
  Target: ATXN1; (-) strand; PAM type: YTN; PAM sequence: CTC
cggtccatcaggtggacagt

SEQ ID NO: 201305 - DNA, 20 bp, Artificial Sequence
  Description of Artificial Sequence: Synthetic oligonucleotide
  Target: ATXN1; (-) strand; PAM type: YTN; PAM sequence: TTG
ccctccggtccatcaggtgg

SEQ ID NO: 201306 - DNA, 20 bp, Artificial Sequence
  Description of Artificial Sequence: Synthetic oligonucleotide
  Target: ATXN1; (-) strand; PAM type: YTN; PAM sequence: TTT
gccctccggtccatcaggtg

SEQ ID NO: 201307 - DNA, 20 bp, Artificial Sequence
  Description of Artificial Sequence: Synthetic oligonucleotide
  Target: ATXN1; (-) strand; PAM type: YTN; PAM sequence: CTT
tgccctccggtccatcaggt

SEQ ID NO: 201308 - DNA, 20 bp, Artificial Sequence
  Description of Artificial Sequence: Synthetic oligonucleotide
  Target: ATXN1; (-) strand; PAM type: YTN; PAM sequence: TTC
agccagctttgccctccggt

SEQ ID NO: 201309 - DNA, 20 bp, Artificial Sequence
  Description of Artificial Sequence: Synthetic oligonucleotide
  Target: ATXN1; (-) strand; PAM type: YTN; PAM sequence: TTT
cagccagctttgccctccgg

SEQ ID NO: 201310 - DNA, 20 bp, Artificial Sequence
  Description of Artificial Sequence: Synthetic oligonucleotide
  Target: ATXN1; (-) strand; PAM type: YTN; PAM sequence: CTG
tgaatttcagccagctttgc

SEQ ID NO: 201311 - DNA, 20 bp, Artificial Sequence
  Description of Artificial Sequence: Synthetic oligonucleotide
  Target: ATXN1; (-) strand; PAM type: YTN; PAM sequence: TTA
cctgtgaatttcagccagct

SEQ ID NO: 201312 - DNA, 20 bp, Artificial Sequence
  Description of Artificial Sequence: Synthetic oligonucleotide
  Target: ATXN1; (-) strand; PAM type: YTN; PAM sequence: TTG
ggattacctgtgaatttcag

SEQ ID NO: 201313 - DNA, 20 bp, Artificial Sequence
  Description of Artificial Sequence: Synthetic oligonucleotide
  Target: ATXN1; (-) strand; PAM type: YTN; PAM sequence: CTA
aaataaagttgggattacct

SEQ ID NO: 201314 - DNA, 20 bp, Artificial Sequence
  Description of Artificial Sequence: Synthetic oligonucleotide
  Target: ATXN1; (-) strand; PAM type: YTN; PAM sequence: TTG
actaaaataaagttgggatt

SEQ ID NO: 201315 - DNA, 20 bp, Artificial Sequence
  Description of Artificial Sequence: Synthetic oligonucleotide
  Target: ATXN1; (-) strand; PAM type: YTN; PAM sequence: TTT
gactaaaataaagttgggat

SEQ ID NO: 201316 - DNA, 20 bp, Artificial Sequence
  Description of Artificial Sequence: Synthetic oligonucleotide
  Target: ATXN1; (-) strand; PAM type: YTN; PAM sequence: TTG
atatgtttgactaaaataaa

SEQ ID NO: 201317 - DNA, 20 bp, Artificial Sequence
  Description of Artificial Sequence: Synthetic oligonucleotide
  Target: ATXN1; (-) strand; PAM type: YTN; PAM sequence: TTG
aagaggcaaggttgatatgt

SEQ ID NO: 201318 - DNA, 20 bp, Artificial Sequence
  Description of Artificial Sequence: Synthetic oligonucleotide
  Target: ATXN1; (-) strand; PAM type: YTN; PAM sequence: TTT
gaagaggcaaggttgatatg

SEQ ID NO: 201319 - DNA, 20 bp, Artificial Sequence
  Description of Artificial Sequence: Synthetic oligonucleotide
  Target: ATXN1; (-) strand; PAM type: YTN; PAM sequence: TTT
tgaagaggcaaggttgatat

SEQ ID NO: 201320 - DNA, 20 bp, Artificial Sequence
  Description of Artificial Sequence: Synthetic oligonucleotide
  Target: ATXN1; (-) strand; PAM type: YTN; PAM sequence: TTC
attttgaagaggcaaggttg

SEQ ID NO: 201321 - DNA, 20 bp, Artificial Sequence
  Description of Artificial Sequence: Synthetic oligonucleotide
  Target: ATXN1; (-) strand; PAM type: YTN; PAM sequence: TTT
cattttgaagaggcaaggtt

SEQ ID NO: 201322 - DNA, 20 bp, Artificial Sequence
  Description of Artificial Sequence: Synthetic oligonucleotide
  Target: ATXN1; (-) strand; PAM type: YTN; PAM sequence: TTT
tcattttgaagaggcaaggt

SEQ ID NO: 201323 - DNA, 20 bp, Artificial Sequence
  Description of Artificial Sequence: Synthetic oligonucleotide
  Target: ATXN1; (-) strand; PAM type: YTN; PAM sequence: TTT
ttcattttgaagaggcaagg

SEQ ID NO: 201324 - DNA, 20 bp, Artificial Sequence
  Description of Artificial Sequence: Synthetic oligonucleotide
  Target: ATXN1; (-) strand; PAM type: YTN; PAM sequence: TTT
tttcattttgaagaggcaag

SEQ ID NO: 201325 - DNA, 20 bp, Artificial Sequence
  Description of Artificial Sequence: Synthetic oligonucleotide
  Target: ATXN1; (-) strand; PAM type: YTN; PAM sequence: TTG
ttttttcattttgaagaggc

SEQ ID NO: 201326 - DNA, 20 bp, Artificial Sequence
  Description of Artificial Sequence: Synthetic oligonucleotide
  Target: ATXN1; (-) strand; PAM type: YTN; PAM sequence: CTA
tgaacaaagaagaaaggaac

SEQ ID NO: 201327 - DNA, 20 bp, Artificial Sequence
  Description of Artificial Sequence: Synthetic oligonucleotide
  Target: ATXN1; (-) strand; PAM type: YTN; PAM sequence: CTC
ctatgaacaaagaagaaagg

SEQ ID NO: 201328 - DNA, 20 bp, Artificial Sequence
  Description of Artificial Sequence: Synthetic oligonucleotide
  Target: ATXN1; (-) strand; PAM type: YTN; PAM sequence: TTC
tcctatgaacaaagaagaaa

SEQ ID NO: 201329 - DNA, 20 bp, Artificial Sequence
  Description of Artificial Sequence: Synthetic oligonucleotide
  Target: ATXN1; (-) strand; PAM type: YTN; PAM sequence: TTG
ttctcctatgaacaaagaag

SEQ ID NO: 201330 - DNA, 20 bp, Artificial Sequence
  Description of Artificial Sequence: Synthetic oligonucleotide
  Target: ATXN1; (-) strand; PAM type: YTN; PAM sequence: TTT
gttctcctatgaacaaagaa

SEQ ID NO: 201331 - DNA, 20 bp, Artificial Sequence
  Description of Artificial Sequence: Synthetic oligonucleotide
  Target: ATXN1; (-) strand; PAM type: YTN; PAM sequence: TTT
tgttctcctatgaacaaaga

SEQ ID NO: 201332 - DNA, 20 bp, Artificial Sequence
  Description of Artificial Sequence: Synthetic oligonucleotide
  Target: ATXN1; (-) strand; PAM type: YTN; PAM sequence: CTC
ccattttgttctcctatgaa

SEQ ID NO: 201333 - DNA, 20 bp, Artificial Sequence
  Description of Artificial Sequence: Synthetic oligonucleotide
  Target: ATXN1; (-) strand; PAM type: YTN; PAM sequence: TTA
catcactcccattttgttct

SEQ ID NO: 201334 - DNA, 20 bp, Artificial Sequence
  Description of Artificial Sequence: Synthetic oligonucleotide
  Target: ATXN1; (-) strand; PAM type: YTN; PAM sequence: CTA
attacatcactcccattttg

SEQ ID NO: 201335 - DNA, 20 bp, Artificial Sequence
  Description of Artificial Sequence: Synthetic oligonucleotide
  Target: ATXN1; (-) strand; PAM type: YTN; PAM sequence: CTC
cactaattacatcactccca

SEQ ID NO: 201336 - DNA, 20 bp, Artificial Sequence
  Description of Artificial Sequence: Synthetic oligonucleotide
  Target: ATXN1; (-) strand; PAM type: YTN; PAM sequence: TTG
tctccactaattacatcact

SEQ ID NO: 201337 - DNA, 20 bp, Artificial Sequence
  Description of Artificial Sequence: Synthetic oligonucleotide
  Target: ATXN1; (-) strand; PAM type: YTN; PAM sequence: CTC
ccattgtctccactaattac

SEQ ID NO: 201338 - DNA, 20 bp, Artificial Sequence
  Description of Artificial Sequence: Synthetic oligonucleotide
  Target: ATXN1; (-) strand; PAM type: YTN; PAM sequence: CTC
actcccattgtctccactaa

SEQ ID NO: 201339 - DNA, 20 bp, Artificial Sequence
  Description of Artificial Sequence: Synthetic oligonucleotide
  Target: ATXN1; (-) strand; PAM type: YTN; PAM sequence: TTA
ctcactcccattgtctccac

SEQ ID NO: 201340 - DNA, 20 bp, Artificial Sequence
  Description of Artificial Sequence: Synthetic oligonucleotide
  Target: ATXN1; (-) strand; PAM type: YTN; PAM sequence: CTA
attactcactcccattgtct

SEQ ID NO: 201341 - DNA, 20 bp, Artificial Sequence
  Description of Artificial Sequence: Synthetic oligonucleotide
  Target: ATXN1; (-) strand; PAM type: YTN; PAM sequence: TTG
tatacaaagcacactaatta

SEQ ID NO: 201342 - DNA, 20 bp, Artificial Sequence
  Description of Artificial Sequence: Synthetic oligonucleotide
  Target: ATXN1; (-) strand; PAM type: YTN; PAM sequence: CTA
cattgtatacaaagcacact

SEQ ID NO: 201343 - DNA, 20 bp, Artificial Sequence
  Description of Artificial Sequence: Synthetic oligonucleotide
  Target: ATXN1; (-) strand; PAM type: YTN; PAM sequence: CTC
tacattgtatacaaagcaca

SEQ ID NO: 201344 - DNA, 20 bp, Artificial Sequence
  Description of Artificial Sequence: Synthetic oligonucleotide
  Target: ATXN1; (-) strand; PAM type: YTN; PAM sequence: TTC
tctacattgtatacaaagca

SEQ ID NO: 201345 - DNA, 20 bp, Artificial Sequence
  Description of Artificial Sequence: Synthetic oligonucleotide
  Target: ATXN1; (-) strand; PAM type: YTN; PAM sequence: TTT
ctctacattgtatacaaagc

SEQ ID NO: 201346 - DNA, 20 bp, Artificial Sequence
  Description of Artificial Sequence: Synthetic oligonucleotide
  Target: ATXN1; (-) strand; PAM type: YTN; PAM sequence: TTC
aatagtttctctacattgta

SEQ ID NO: 201347 - DNA, 20 bp, Artificial Sequence
  Description of Artificial Sequence: Synthetic oligonucleotide
  Target: ATXN1; (-) strand; PAM type: YTN; PAM sequence: TTT
caatagtttctctacattgt

SEQ ID NO: 201348 - DNA, 20 bp, Artificial Sequence
  Description of Artificial Sequence: Synthetic oligonucleotide
  Target: ATXN1; (-) strand; PAM type: YTN; PAM sequence: TTT
tcaatagtttctctacattg

SEQ ID NO: 201349 - DNA, 20 bp, Artificial Sequence
  Description of Artificial Sequence: Synthetic oligonucleotide
  Target: ATXN1; (-) strand; PAM type: YTN; PAM sequence: TTT
ttcaatagtttctctacatt

SEQ ID NO: 201350 - DNA, 20 bp, Artificial Sequence
  Description of Artificial Sequence: Synthetic oligonucleotide
  Target: ATXN1; (-) strand; PAM type: YTN; PAM sequence: TTA
tttttcaatagtttctctac

SEQ ID NO: 201351 - DNA, 20 bp, Artificial Sequence
  Description of Artificial Sequence: Synthetic oligonucleotide
  Target: ATXN1; (-) strand; PAM type: YTN; PAM sequence: TTT
atttttcaatagtttctcta

SEQ ID NO: 201352 - DNA, 20 bp, Artificial Sequence
  Description of Artificial Sequence: Synthetic oligonucleotide
  Target: ATXN1; (-) strand; PAM type: YTN; PAM sequence: TTT
tatttttcaatagtttctct

SEQ ID NO: 201353 - DNA, 20 bp, Artificial Sequence
  Description of Artificial Sequence: Synthetic oligonucleotide
  Target: ATXN1; (-) strand; PAM type: YTN; PAM sequence: TTA
ttttatttttcaatagtttc

SEQ ID NO: 201354 - DNA, 20 bp, Artificial Sequence
  Description of Artificial Sequence: Synthetic oligonucleotide
  Target: ATXN1; (-) strand; PAM type: YTN; PAM sequence: TTT
attttatttttcaatagttt

SEQ ID NO: 201355 - DNA, 20 bp, Artificial Sequence
  Description of Artificial Sequence: Synthetic oligonucleotide
  Target: ATXN1; (-) strand; PAM type: YTN; PAM sequence: TTT
tattttatttttcaatagtt

SEQ ID NO: 201356 - DNA, 20 bp, Artificial Sequence
  Description of Artificial Sequence: Synthetic oligonucleotide
  Target: ATXN1; (-) strand; PAM type: YTN; PAM sequence: TTT
ttattttatttttcaatagt

SEQ ID NO: 201357 - DNA, 20 bp, Artificial Sequence
  Description of Artificial Sequence: Synthetic oligonucleotide
  Target: ATXN1; (-) strand; PAM type: YTN; PAM sequence: CTT
tttattttatttttcaatag

SEQ ID NO: 201358 - DNA, 20 bp, Artificial Sequence
  Description of Artificial Sequence: Synthetic oligonucleotide
  Target: ATXN1; (-) strand; PAM type: YTN; PAM sequence: TTC
tttttattttatttttcaat

SEQ ID NO: 201359 - DNA, 20 bp, Artificial Sequence
  Description of Artificial Sequence: Synthetic oligonucleotide
  Target: ATXN1; (-) strand; PAM type: YTN; PAM sequence: TTC
ataaaattctttttatttta

SEQ ID NO: 201360 - DNA, 20 bp, Artificial Sequence
  Description of Artificial Sequence: Synthetic oligonucleotide
  Target: ATXN1; (-) strand; PAM type: YTN; PAM sequence: TTT
cataaaattctttttatttt

SEQ ID NO: 201361 - DNA, 20 bp, Artificial Sequence
  Description of Artificial Sequence: Synthetic oligonucleotide
  Target: ATXN1; (-) strand; PAM type: YTN; PAM sequence: TTA
tagaatatttcataaaattc

SEQ ID NO: 201362 - DNA, 20 bp, Artificial Sequence
  Description of Artificial Sequence: Synthetic oligonucleotide
  Target: ATXN1; (-) strand; PAM type: YTN; PAM sequence: TTT
atagaatatttcataaaatt

SEQ ID NO: 201363 - DNA, 20 bp, Artificial Sequence
  Description of Artificial Sequence: Synthetic oligonucleotide
  Target: ATXN1; (-) strand; PAM type: YTN; PAM sequence: TTT
tatagaatatttcataaaat

SEQ ID NO: 201364 - DNA, 20 bp, Artificial Sequence
  Description of Artificial Sequence: Synthetic oligonucleotide
  Target: ATXN1; (-) strand; PAM type: YTN; PAM sequence: CTT
ttatagaatatttcataaaa

SEQ ID NO: 201365 - DNA, 20 bp, Artificial Sequence
  Description of Artificial Sequence: Synthetic oligonucleotide
  Target: ATXN1; (-) strand; PAM type: YTN; PAM sequence: CTG
acttttatagaatatttcat

SEQ ID NO: 201366 - DNA, 20 bp, Artificial Sequence
  Description of Artificial Sequence: Synthetic oligonucleotide
  Target: ATXN1; (-) strand; PAM type: YTN; PAM sequence: CTG
ggtaggaagcctgactttta

SEQ ID NO: 201367 - DNA, 20 bp, Artificial Sequence
  Description of Artificial Sequence: Synthetic oligonucleotide
  Target: ATXN1; (-) strand; PAM type: YTN; PAM sequence: TTC
cgaaggtcatctgggtagga

SEQ ID NO: 201368 - DNA, 20 bp, Artificial Sequence
  Description of Artificial Sequence: Synthetic oligonucleotide
  Target: ATXN1; (-) strand; PAM type: YTN; PAM sequence: TTT
ccgaaggtcatctgggtagg

SEQ ID NO: 201369 - DNA, 20 bp, Artificial Sequence
  Description of Artificial Sequence: Synthetic oligonucleotide
  Target: ATXN1; (-) strand; PAM type: YTN; PAM sequence: TTT
tccgaaggtcatctgggtag

SEQ ID NO: 201370 - DNA, 20 bp, Artificial Sequence
  Description of Artificial Sequence: Synthetic oligonucleotide
  Target: ATXN1; (-) strand; PAM type: YTN; PAM sequence: TTT
ttccgaaggtcatctgggta

SEQ ID NO: 201371 - DNA, 20 bp, Artificial Sequence
  Description of Artificial Sequence: Synthetic oligonucleotide
  Target: ATXN1; (-) strand; PAM type: YTN; PAM sequence: TTC
agagaaatttttccgaaggt

SEQ ID NO: 201372 - DNA, 20 bp, Artificial Sequence
  Description of Artificial Sequence: Synthetic oligonucleotide
  Target: ATXN1; (-) strand; PAM type: YTN; PAM sequence: CTG
gatacccaaggcatcaggga

SEQ ID NO: 201373 - DNA, 20 bp, Artificial Sequence
  Description of Artificial Sequence: Synthetic oligonucleotide
  Target: ATXN1; (-) strand; PAM type: YTN; PAM sequence: CTG
catactggatacccaaggca

SEQ ID NO: 201374 - DNA, 20 bp, Artificial Sequence
  Description of Artificial Sequence: Synthetic oligonucleotide
  Target: ATXN1; (-) strand; PAM type: YTN; PAM sequence: TTG
tatcagatatactgcatact

SEQ ID NO: 201375 - DNA, 20 bp, Artificial Sequence
  Description of Artificial Sequence: Synthetic oligonucleotide
  Target: ATXN1; (-) strand; PAM type: YTN; PAM sequence: CTT
gtatcagatatactgcatac

SEQ ID NO: 201376 - DNA, 20 bp, Artificial Sequence
  Description of Artificial Sequence: Synthetic oligonucleotide
  Target: ATXN1; (-) strand; PAM type: YTN; PAM sequence: CTC
ttgtatcagatatactgcat

SEQ ID NO: 201377 - DNA, 20 bp, Artificial Sequence
  Description of Artificial Sequence: Synthetic oligonucleotide
  Target: ATXN1; (-) strand; PAM type: YTN; PAM sequence: CTC
caatctcttgtatcagatat

SEQ ID NO: 201378 - DNA, 20 bp, Artificial Sequence
  Description of Artificial Sequence: Synthetic oligonucleotide
  Target: ATXN1; (-) strand; PAM type: YTN; PAM sequence: CTC
atggatcctccaatctcttg

SEQ ID NO: 201379 - DNA, 20 bp, Artificial Sequence
  Description of Artificial Sequence: Synthetic oligonucleotide
  Target: ATXN1; (-) strand; PAM type: YTN; PAM sequence: CTA
tacagcccagaatgaactca

SEQ ID NO: 201380 - DNA, 20 bp, Artificial Sequence
  Description of Artificial Sequence: Synthetic oligonucleotide
  Target: ATXN1; (-) strand; PAM type: YTN; PAM sequence: TTA
tggcatcactatacagccca

SEQ ID NO: 201381 - DNA, 20 bp, Artificial Sequence
  Description of Artificial Sequence: Synthetic oligonucleotide
  Target: ATXN1; (-) strand; PAM type: YTN; PAM sequence: TTG
gaaaatagcaatgagtgtta

SEQ ID NO: 201382 - DNA, 20 bp, Artificial Sequence
  Description of Artificial Sequence: Synthetic oligonucleotide
  Target: ATXN1; (-) strand; PAM type: YTN; PAM sequence: CTT
ggaaaatagcaatgagtgtt

SEQ ID NO: 201383 - DNA, 20 bp, Artificial Sequence
  Description of Artificial Sequence: Synthetic oligonucleotide
  Target: ATXN1; (-) strand; PAM type: YTN; PAM sequence: CTC
aagcttggaaaatagcaatg

SEQ ID NO: 201384 - DNA, 20 bp, Artificial Sequence
  Description of Artificial Sequence: Synthetic oligonucleotide
  Target: ATXN1; (-) strand; PAM type: YTN; PAM sequence: TTC
tcaagcttggaaaatagcaa

SEQ ID NO: 201385 - DNA, 20 bp, Artificial Sequence
  Description of Artificial Sequence: Synthetic oligonucleotide
  Target: ATXN1; (-) strand; PAM type: YTN; PAM sequence: TTA
aatgattctcaagcttggaa

SEQ ID NO: 201386 - DNA, 20 bp, Artificial Sequence
  Description of Artificial Sequence: Synthetic oligonucleotide
  Target: ATXN1; (-) strand; PAM type: YTN; PAM sequence: TTA
gggaaatattaaatgattct

SEQ ID NO: 201387 - DNA, 20 bp, Artificial Sequence
  Description of Artificial Sequence: Synthetic oligonucleotide
  Target: ATXN1; (-) strand; PAM type: YTN; PAM sequence: TTT
agggaaatattaaatgattc

SEQ ID NO: 201388 - DNA, 20 bp, Artificial Sequence
  Description of Artificial Sequence: Synthetic oligonucleotide
  Target: ATXN1; (-) strand; PAM type: YTN; PAM sequence: TTT
tagggaaatattaaatgatt

SEQ ID NO: 201389 - DNA, 20 bp, Artificial Sequence
  Description of Artificial Sequence: Synthetic oligonucleotide
  Target: ATXN1; (-) strand; PAM type: YTN; PAM sequence: TTA
atcagatagttttagggaaa

SEQ ID NO: 201390 - DNA, 20 bp, Artificial Sequence
  Description of Artificial Sequence: Synthetic oligonucleotide
  Target: ATXN1; (-) strand; PAM type: YTN; PAM sequence: TTG
cagttaatcagatagtttta

SEQ ID NO: 201391 - DNA, 20 bp, Artificial Sequence
  Description of Artificial Sequence: Synthetic oligonucleotide
  Target: ATXN1; (-) strand; PAM type: YTN; PAM sequence: TTT
gcagttaatcagatagtttt

SEQ ID NO: 201392 - DNA, 20 bp, Artificial Sequence
  Description of Artificial Sequence: Synthetic oligonucleotide
  Target: ATXN1; (-) strand; PAM type: YTN; PAM sequence: TTT
tgcagttaatcagatagttt

SEQ ID NO: 201393 - DNA, 20 bp, Artificial Sequence
  Description of Artificial Sequence: Synthetic oligonucleotide
  Target: ATXN1; (-) strand; PAM type: YTN; PAM sequence: CTC
agtgcaccattttgcagtta

SEQ ID NO: 201394 - DNA, 20 bp, Artificial Sequence
  Description of Artificial Sequence: Synthetic oligonucleotide
  Target: ATXN1; (-) strand; PAM type: YTN; PAM sequence: TTG
ctcagtgcaccattttgcag

SEQ ID NO: 201395 - DNA, 20 bp, Artificial Sequence
  Description of Artificial Sequence: Synthetic oligonucleotide
  Target: ATXN1; (-) strand; PAM type: YTN; PAM sequence: TTA
tcattgctcagtgcaccatt

SEQ ID NO: 201396 - DNA, 20 bp, Artificial Sequence
  Description of Artificial Sequence: Synthetic oligonucleotide
  Target: ATXN1; (-) strand; PAM type: YTN; PAM sequence: TTG
caaaaatattatcattgctc

SEQ ID NO: 201397 - DNA, 20 bp, Artificial Sequence
  Description of Artificial Sequence: Synthetic oligonucleotide
  Target: ATXN1; (-) strand; PAM type: YTN; PAM sequence: CTG
taattgcaaaaatattatca

SEQ ID NO: 201398 - DNA, 20 bp, Artificial Sequence
  Description of Artificial Sequence: Synthetic oligonucleotide
  Target: ATXN1; (-) strand; PAM type: YTN; PAM sequence: CTC
ctgtaattgcaaaaatatta

SEQ ID NO: 201399 - DNA, 20 bp, Artificial Sequence
  Description of Artificial Sequence: Synthetic oligonucleotide
  Target: ATXN1; (-) strand; PAM type: YTN; PAM sequence: TTA
actcctgtaattgcaaaaat

SEQ ID NO: 201400 - DNA, 20 bp, Artificial Sequence
  Description of Artificial Sequence: Synthetic oligonucleotide
  Target: ATXN1; (-) strand; PAM type: YTN; PAM sequence: CTG
aaccaaaataattaactcct

SEQ ID NO: 201401 - DNA, 20 bp, Artificial Sequence
  Description of Artificial Sequence: Synthetic oligonucleotide
  Target: ATXN1; (-) strand; PAM type: YTN; PAM sequence: TTG
tatagtctgaaccaaaataa

SEQ ID NO: 201402 - DNA, 20 bp, Artificial Sequence
  Description of Artificial Sequence: Synthetic oligonucleotide
  Target: ATXN1; (-) strand; PAM type: YTN; PAM sequence: TTG
ttgtatagtctgaaccaaaa

SEQ ID NO: 201403 - DNA, 20 bp, Artificial Sequence
  Description of Artificial Sequence: Synthetic oligonucleotide
  Target: ATXN1; (-) strand; PAM type: YTN; PAM sequence: CTG
tggagaggtgggtgggagag

SEQ ID NO: 201404 - DNA, 20 bp, Artificial Sequence
  Description of Artificial Sequence: Synthetic oligonucleotide
  Target: ATXN1; (-) strand; PAM type: YTN; PAM sequence: TTA
gcaaaatgtatctgtggaga

SEQ ID NO: 201405 - DNA, 20 bp, Artificial Sequence
  Description of Artificial Sequence: Synthetic oligonucleotide
  Target: ATXN1; (-) strand; PAM type: YTN; PAM sequence: CTT
agcaaaatgtatctgtggag

SEQ ID NO: 201406 - DNA, 20 bp, Artificial Sequence
  Description of Artificial Sequence: Synthetic oligonucleotide
  Target: ATXN1; (-) strand; PAM type: YTN; PAM sequence: TTA
ccaatgaagaaaagcaaaac

SEQ ID NO: 201407 - DNA, 20 bp, Artificial Sequence
  Description of Artificial Sequence: Synthetic oligonucleotide
  Target: ATXN1; (-) strand; PAM type: YTN; PAM sequence: TTT
accaatgaagaaaagcaaaa

SEQ ID NO: 201408 - DNA, 20 bp, Artificial Sequence
  Description of Artificial Sequence: Synthetic oligonucleotide
  Target: ATXN1; (-) strand; PAM type: YTN; PAM sequence: TTA
tttaccaatgaagaaaagca

SEQ ID NO: 201409 - DNA, 20 bp, Artificial Sequence
  Description of Artificial Sequence: Synthetic oligonucleotide
  Target: ATXN1; (-) strand; PAM type: YTN; PAM sequence: TTT
atttaccaatgaagaaaagc

SEQ ID NO: 201410 - DNA, 20 bp, Artificial Sequence
  Description of Artificial Sequence: Synthetic oligonucleotide
  Target: ATXN1; (-) strand; PAM type: YTN; PAM sequence: TTT
tatttaccaatgaagaaaag

SEQ ID NO: 201411 - DNA, 20 bp, Artificial Sequence
  Description of Artificial Sequence: Synthetic oligonucleotide
  Target: ATXN1; (-) strand; PAM type: YTN; PAM sequence: TTT
ttatttaccaatgaagaaaa

SEQ ID NO: 201412 - DNA, 20 bp, Artificial Sequence
  Description of Artificial Sequence: Synthetic oligonucleotide
  Target: ATXN1; (-) strand; PAM type: YTN; PAM sequence: TTG
gtgaatgtcccatttttatt

SEQ ID NO: 201413 - DNA, 20 bp, Artificial Sequence
  Description of Artificial Sequence: Synthetic oligonucleotide
  Target: ATXN1; (-) strand; PAM type: YTN; PAM sequence: TTG
ttggtgaatgtcccattttt

SEQ ID NO: 201414 - DNA, 20 bp, Artificial Sequence
  Description of Artificial Sequence: Synthetic oligonucleotide
  Target: ATXN1; (-) strand; PAM type: YTN; PAM sequence: CTT
gttggtgaatgtcccatttt

SEQ ID NO: 201415 - DNA, 20 bp, Artificial Sequence
  Description of Artificial Sequence: Synthetic oligonucleotide
  Target: ATXN1; (-) strand; PAM type: YTN; PAM sequence: CTA
tgggaacttgttggtgaatg

SEQ ID NO: 201416 - DNA, 20 bp, Artificial Sequence
  Description of Artificial Sequence: Synthetic oligonucleotide
  Target: ATXN1; (-) strand; PAM type: YTN; PAM sequence: CTC
tatgggaacttgttggtgaa

SEQ ID NO: 201417 - DNA, 20 bp, Artificial Sequence
  Description of Artificial Sequence: Synthetic oligonucleotide
  Target: ATXN1; (-) strand; PAM type: YTN; PAM sequence: CTA
aatgaaaggagtgaaaagta

SEQ ID NO: 201418 - DNA, 20 bp, Artificial Sequence
  Description of Artificial Sequence: Synthetic oligonucleotide
  Target: ATXN1; (-) strand; PAM type: YTN; PAM sequence: TTG
ctaaatgaaaggagtgaaaa

SEQ ID NO: 201419 - DNA, 20 bp, Artificial Sequence
  Description of Artificial Sequence: Synthetic oligonucleotide
  Target: ATXN1; (-) strand; PAM type: YTN; PAM sequence: TTT
gctaaatgaaaggagtgaaa

SEQ ID NO: 201420 - DNA, 20 bp, Artificial Sequence
  Description of Artificial Sequence: Synthetic oligonucleotide
  Target: ATXN1; (-) strand; PAM type: YTN; PAM sequence: TTG
tgtcaatgtttgctaaatga

SEQ ID NO: 201421 - DNA, 20 bp, Artificial Sequence
  Description of Artificial Sequence: Synthetic oligonucleotide
  Target: ATXN1; (-) strand; PAM type: YTN; PAM sequence: TTA
aacacagtaaatattgtgtc

SEQ ID NO: 201422 - DNA, 20 bp, Artificial Sequence
  Description of Artificial Sequence: Synthetic oligonucleotide
  Target: ATXN1; (-) strand; PAM type: YTN; PAM sequence: CTT
aaacacagtaaatattgtgt

SEQ ID NO: 201423 - DNA, 20 bp, Artificial Sequence
  Description of Artificial Sequence: Synthetic oligonucleotide
  Target: ATXN1; (-) strand; PAM type: YTN; PAM sequence: CTG
tccttaaacacagtaaatat

SEQ ID NO: 201424 - DNA, 20 bp, Artificial Sequence
  Description of Artificial Sequence: Synthetic oligonucleotide
  Target: ATXN1; (-) strand; PAM type: YTN; PAM sequence: TTA
acccctgtccttaaacacag

SEQ ID NO: 201425 - DNA, 20 bp, Artificial Sequence
  Description of Artificial Sequence: Synthetic oligonucleotide
  Target: ATXN1; (-) strand; PAM type: YTN; PAM sequence: TTT
aacccctgtccttaaacaca

SEQ ID NO: 201426 - DNA, 20 bp, Artificial Sequence
  Description of Artificial Sequence: Synthetic oligonucleotide
  Target: ATXN1; (-) strand; PAM type: YTN; PAM sequence: TTG
agaatttaacccctgtcctt

SEQ ID NO: 201427 - DNA, 20 bp, Artificial Sequence
  Description of Artificial Sequence: Synthetic oligonucleotide
  Target: ATXN1; (-) strand; PAM type: YTN; PAM sequence: CTC
atgagacagtatattgagaa

SEQ ID NO: 201428 - DNA, 20 bp, Artificial Sequence
  Description of Artificial Sequence: Synthetic oligonucleotide
  Target: ATXN1; (-) strand; PAM type: YTN; PAM sequence: CTA
tgtactcatgagacagtata

SEQ ID NO: 201429 - DNA, 20 bp, Artificial Sequence
  Description of Artificial Sequence: Synthetic oligonucleotide
  Target: ATXN1; (-) strand; PAM type: YTN; PAM sequence: TTA
aactatgtactcatgagaca

SEQ ID NO: 201430 - DNA, 20 bp, Artificial Sequence
  Description of Artificial Sequence: Synthetic oligonucleotide
  Target: ATXN1; (-) strand; PAM type: YTN; PAM sequence: TTT
aaactatgtactcatgagac

SEQ ID NO: 201431 - DNA, 20 bp, Artificial Sequence
  Description of Artificial Sequence: Synthetic oligonucleotide
  Target: ATXN1; (-) strand; PAM type: YTN; PAM sequence: TTT
taaactatgtactcatgaga

SEQ ID NO: 201432 - DNA, 20 bp, Artificial Sequence
  Description of Artificial Sequence: Synthetic oligonucleotide
  Target: ATXN1; (-) strand; PAM type: YTN; PAM sequence: CTT
ttaaactatgtactcatgag

SEQ ID NO: 201433 - DNA, 20 bp, Artificial Sequence
  Description of Artificial Sequence: Synthetic oligonucleotide
  Target: ATXN1; (-) strand; PAM type: YTN; PAM sequence: TTC
ttttaaactatgtactcatg

SEQ ID NO: 201434 - DNA, 20 bp, Artificial Sequence
  Description of Artificial Sequence: Synthetic oligonucleotide
  Target: ATXN1; (-) strand; PAM type: YTN; PAM sequence: TTT
cttttaaactatgtactcat

SEQ ID NO: 201435 - DNA, 20 bp, Artificial Sequence
  Description of Artificial Sequence: Synthetic oligonucleotide
  Target: ATXN1; (-) strand; PAM type: YTN; PAM sequence: TTG
aaacacatttcttttaaact

SEQ ID NO: 201436 - DNA, 20 bp, Artificial Sequence
  Description of Artificial Sequence: Synthetic oligonucleotide
  Target: ATXN1; (-) strand; PAM type: YTN; PAM sequence: TTG
ttgaaacacatttcttttaa

SEQ ID NO: 201437 - DNA, 20 bp, Artificial Sequence
  Description of Artificial Sequence: Synthetic oligonucleotide
  Target: ATXN1; (-) strand; PAM type: YTN; PAM sequence: TTT
gttgaaacacatttctttta

SEQ ID NO: 201438 - DNA, 20 bp, Artificial Sequence
  Description of Artificial Sequence: Synthetic oligonucleotide
  Target: ATXN1; (-) strand; PAM type: YTN; PAM sequence: TTA
tttgttgaaacacatttctt

SEQ ID NO: 201439 - DNA, 20 bp, Artificial Sequence
  Description of Artificial Sequence: Synthetic oligonucleotide
  Target: ATXN1; (-) strand; PAM type: YTN; PAM sequence: TTC
aaattatttgttgaaacaca

SEQ ID NO: 201440 - DNA, 20 bp, Artificial Sequence
  Description of Artificial Sequence: Synthetic oligonucleotide
  Target: ATXN1; (-) strand; PAM type: YTN; PAM sequence: TTT
caaattatttgttgaaacac

SEQ ID NO: 201441 - DNA, 20 bp, Artificial Sequence
  Description of Artificial Sequence: Synthetic oligonucleotide
  Target: ATXN1; (-) strand; PAM type: YTN; PAM sequence: TTT
tcaaattatttgttgaaaca

SEQ ID NO: 201442 - DNA, 20 bp, Artificial Sequence
  Description of Artificial Sequence: Synthetic oligonucleotide
  Target: ATXN1; (-) strand; PAM type: YTN; PAM sequence: TTG
gttttcaaattatttgttga

SEQ ID NO: 201443 - DNA, 20 bp, Artificial Sequence
  Description of Artificial Sequence: Synthetic oligonucleotide
  Target: ATXN1; (-) strand; PAM type: YTN; PAM sequence: CTT
ggttttcaaattatttgttg

SEQ ID NO: 201444 - DNA, 20 bp, Artificial Sequence
  Description of Artificial Sequence: Synthetic oligonucleotide
  Target: ATXN1; (-) strand; PAM type: YTN; PAM sequence: TTA
cttggttttcaaattatttg

SEQ ID NO: 201445 - DNA, 20 bp, Artificial Sequence
  Description of Artificial Sequence: Synthetic oligonucleotide
  Target: ATXN1; (-) strand; PAM type: YTN; PAM sequence: TTT
acttggttttcaaattattt

SEQ ID NO: 201446 - DNA, 20 bp, Artificial Sequence
  Description of Artificial Sequence: Synthetic oligonucleotide
  Target: ATXN1; (-) strand; PAM type: YTN; PAM sequence: TTT
tacttggttttcaaattatt

SEQ ID NO: 201447 - DNA, 20 bp, Artificial Sequence
  Description of Artificial Sequence: Synthetic oligonucleotide
  Target: ATXN1; (-) strand; PAM type: YTN; PAM sequence: CTT
ttacttggttttcaaattat

SEQ ID NO: 201448 - DNA, 20 bp, Artificial Sequence
  Description of Artificial Sequence: Synthetic oligonucleotide
  Target: ATXN1; (-) strand; PAM type: YTN; PAM sequence: TTA
cttttacttggttttcaaat

SEQ ID NO: 201449 - DNA, 20 bp, Artificial Sequence
  Description of Artificial Sequence: Synthetic oligonucleotide
  Target: ATXN1; (-) strand; PAM type: YTN; PAM sequence: CTT
acttttacttggttttcaaa

SEQ ID NO: 201450 - DNA, 20 bp, Artificial Sequence
  Description of Artificial Sequence: Synthetic oligonucleotide
  Target: ATXN1; (-) strand; PAM type: YTN; PAM sequence: TTC
ttacttttacttggttttca

SEQ ID NO: 201451 - DNA, 20 bp, Artificial Sequence
  Description of Artificial Sequence: Synthetic oligonucleotide
  Target: ATXN1; (-) strand; PAM type: YTN; PAM sequence: TTT
cttacttttacttggttttc

SEQ ID NO: 201452 - DNA, 20 bp, Artificial Sequence
  Description of Artificial Sequence: Synthetic oligonucleotide
  Target: ATXN1; (-) strand; PAM type: YTN; PAM sequence: CTT
tcttacttttacttggtttt

SEQ ID NO: 201453 - DNA, 20 bp, Artificial Sequence
  Description of Artificial Sequence: Synthetic oligonucleotide
  Target: ATXN1; (-) strand; PAM type: YTN; PAM sequence: TTA
atgggacctttcttactttt

SEQ ID NO: 201454 - DNA, 20 bp, Artificial Sequence
  Description of Artificial Sequence: Synthetic oligonucleotide
  Target: ATXN1; (-) strand; PAM type: YTN; PAM sequence: TTT
aatgggacctttcttacttt

SEQ ID NO: 201455 - DNA, 20 bp, Artificial Sequence
  Description of Artificial Sequence: Synthetic oligonucleotide
  Target: ATXN1; (-) strand; PAM type: YTN; PAM sequence: TTT
taatgggacctttcttactt

SEQ ID NO: 201456 - DNA, 20 bp, Artificial Sequence
  Description of Artificial Sequence: Synthetic oligonucleotide
  Target: ATXN1; (-) strand; PAM type: YTN; PAM sequence: TTT
ttaatgggacctttcttact

SEQ ID NO: 201457 - DNA, 20 bp, Artificial Sequence
  Description of Artificial Sequence: Synthetic oligonucleotide
  Target: ATXN1; (-) strand; PAM type: YTN; PAM sequence: TTG
gtccacatttttaatgggac

SEQ ID NO: 201458 - DNA, 20 bp, Artificial Sequence
  Description of Artificial Sequence: Synthetic oligonucleotide
  Target: ATXN1; (-) strand; PAM type: YTN; PAM sequence: TTT
ggtccacatttttaatggga

SEQ ID NO: 201459 - DNA, 20 bp, Artificial Sequence
  Description of Artificial Sequence: Synthetic oligonucleotide
  Target: ATXN1; (-) strand; PAM type: YTN; PAM sequence: TTT
tggtccacatttttaatggg

SEQ ID NO: 201460 - DNA, 20 bp, Artificial Sequence
  Description of Artificial Sequence: Synthetic oligonucleotide
  Target: ATXN1; (-) strand; PAM type: YTN; PAM sequence: TTT
ttggtccacatttttaatgg

SEQ ID NO: 201461 - DNA, 20 bp, Artificial Sequence
  Description of Artificial Sequence: Synthetic oligonucleotide
  Target: ATXN1; (-) strand; PAM type: YTN; PAM sequence: TTT
tttggtccacatttttaatg

SEQ ID NO: 201462 - DNA, 20 bp, Artificial Sequence
  Description of Artificial Sequence: Synthetic oligonucleotide
  Target: ATXN1; (-) strand; PAM type: YTN; PAM sequence: TTT
ttttggtccacatttttaat

SEQ ID NO: 201463 - DNA, 20 bp, Artificial Sequence
  Description of Artificial Sequence: Synthetic oligonucleotide
  Target: ATXN1; (-) strand; PAM type: YTN; PAM sequence: TTT
tttttggtccacatttttaa

SEQ ID NO: 201464 - DNA, 20 bp, Artificial Sequence
  Description of Artificial Sequence: Synthetic oligonucleotide
  Target: ATXN1; (-) strand; PAM type: YTN; PAM sequence: CTT
ttttttggtccacattttta

SEQ ID NO: 201465 - DNA, 20 bp, Artificial Sequence
  Description of Artificial Sequence: Synthetic oligonucleotide
  Target: ATXN1; (-) strand; PAM type: YTN; PAM sequence: TTA
tcttttttttggtccacatt

SEQ ID NO: 201466 - DNA, 20 bp, Artificial Sequence
  Description of Artificial Sequence: Synthetic oligonucleotide
  Target: ATXN1; (-) strand; PAM type: YTN; PAM sequence: CTC
aaatgaccccaggaagttat

SEQ ID NO: 201467 - DNA, 20 bp, Artificial Sequence
  Description of Artificial Sequence: Synthetic oligonucleotide
  Target: ATXN1; (-) strand; PAM type: YTN; PAM sequence: TTA
tgacataatctcaaatgacc

SEQ ID NO: 201468 - DNA, 20 bp, Artificial Sequence
  Description of Artificial Sequence: Synthetic oligonucleotide
  Target: ATXN1; (-) strand; PAM type: YTN; PAM sequence: CTT
atgacataatctcaaatgac

SEQ ID NO: 201469 - DNA, 20 bp, Artificial Sequence
  Description of Artificial Sequence: Synthetic oligonucleotide
  Target: ATXN1; (-) strand; PAM type: YTN; PAM sequence: CTC
cttatgacataatctcaaat

SEQ ID NO: 201470 - DNA, 20 bp, Artificial Sequence
  Description of Artificial Sequence: Synthetic oligonucleotide
  Target: ATXN1; (-) strand; PAM type: YTN; PAM sequence: TTC
tccttatgacataatctcaa

SEQ ID NO: 201471 - DNA, 20 bp, Artificial Sequence
  Description of Artificial Sequence: Synthetic oligonucleotide
  Target: ATXN1; (-) strand; PAM type: YTN; PAM sequence: CTG
tgttctccttatgacataat

SEQ ID NO: 201472 - DNA, 20 bp, Artificial Sequence
  Description of Artificial Sequence: Synthetic oligonucleotide
  Target: ATXN1; (-) strand; PAM type: YTN; PAM sequence: TTC
tgtgttctccttatgacata

SEQ ID NO: 201473 - DNA, 20 bp, Artificial Sequence
  Description of Artificial Sequence: Synthetic oligonucleotide
  Target: ATXN1; (-) strand; PAM type: YTN; PAM sequence: TTC
caggaccacatcaaattctg

SEQ ID NO: 201474 - DNA, 20 bp, Artificial Sequence
  Description of Artificial Sequence: Synthetic oligonucleotide
  Target: ATXN1; (-) strand; PAM type: YTN; PAM sequence: TTT
ccaggaccacatcaaattct

SEQ ID NO: 201475 - DNA, 20 bp, Artificial Sequence
  Description of Artificial Sequence: Synthetic oligonucleotide
  Target: ATXN1; (-) strand; PAM type: YTN; PAM sequence: TTT
tccaggaccacatcaaattc

SEQ ID NO: 201476 - DNA, 20 bp, Artificial Sequence
  Description of Artificial Sequence: Synthetic oligonucleotide
  Target: ATXN1; (-) strand; PAM type: YTN; PAM sequence: CTT
ttccaggaccacatcaaatt

SEQ ID NO: 201477 - DNA, 20 bp, Artificial Sequence
  Description of Artificial Sequence: Synthetic oligonucleotide
  Target: ATXN1; (-) strand; PAM type: YTN; PAM sequence: TTC
ttttccaggaccacatcaaa

SEQ ID NO: 201478 - DNA, 20 bp, Artificial Sequence
  Description of Artificial Sequence: Synthetic oligonucleotide
  Target: ATXN1; (-) strand; PAM type: YTN; PAM sequence: CTA
tatattcttttccaggacca

SEQ ID NO: 201479 - DNA, 20 bp, Artificial Sequence
  Description of Artificial Sequence: Synthetic oligonucleotide
  Target: ATXN1; (-) strand; PAM type: YTN; PAM sequence: TTC
tatatattcttttccaggac

SEQ ID NO: 201480 - DNA, 20 bp, Artificial Sequence
  Description of Artificial Sequence: Synthetic oligonucleotide
  Target: ATXN1; (-) strand; PAM type: YTN; PAM sequence: TTT
ctatatattcttttccagga

SEQ ID NO: 201481 - DNA, 20 bp, Artificial Sequence
  Description of Artificial Sequence: Synthetic oligonucleotide
  Target: ATXN1; (-) strand; PAM type: YTN; PAM sequence: CTG
catttctatatattcttttc

SEQ ID NO: 201482 - DNA, 20 bp, Artificial Sequence
  Description of Artificial Sequence: Synthetic oligonucleotide
  Target: ATXN1; (-) strand; PAM type: YTN; PAM sequence: CTC
tgcatttctatatattcttt

SEQ ID NO: 201483 - DNA, 20 bp, Artificial Sequence
  Description of Artificial Sequence: Synthetic oligonucleotide
  Target: ATXN1; (-) strand; PAM type: YTN; PAM sequence: CTC
tctgcatttctatatattct

SEQ ID NO: 201484 - DNA, 20 bp, Artificial Sequence
  Description of Artificial Sequence: Synthetic oligonucleotide
  Target: ATXN1; (-) strand; PAM type: YTN; PAM sequence: CTC
ccctctctgcatttctatat

SEQ ID NO: 201485 - DNA, 20 bp, Artificial Sequence
  Description of Artificial Sequence: Synthetic oligonucleotide
  Target: ATXN1; (-) strand; PAM type: YTN; PAM sequence: CTG
cctcccctctctgcatttct

SEQ ID NO: 201486 - DNA, 20 bp, Artificial Sequence
  Description of Artificial Sequence: Synthetic oligonucleotide
  Target: ATXN1; (-) strand; PAM type: YTN; PAM sequence: CTC
ctgcctcccctctctgcatt

SEQ ID NO: 201487 - DNA, 20 bp, Artificial Sequence
  Description of Artificial Sequence: Synthetic oligonucleotide
  Target: ATXN1; (-) strand; PAM type: YTN; PAM sequence: CTA
ggatcatcctcctgcctccc

SEQ ID NO: 201488 - DNA, 20 bp, Artificial Sequence
  Description of Artificial Sequence: Synthetic oligonucleotide
  Target: ATXN1; (-) strand; PAM type: YTN; PAM sequence: TTC
acctaggatcatcctcctgc

SEQ ID NO: 201489 - DNA, 20 bp, Artificial Sequence
  Description of Artificial Sequence: Synthetic oligonucleotide
  Target: ATXN1; (-) strand; PAM type: YTN; PAM sequence: TTT
cacctaggatcatcctcctg

SEQ ID NO: 201490 - DNA, 20 bp, Artificial Sequence
  Description of Artificial Sequence: Synthetic oligonucleotide
  Target: ATXN1; (-) strand; PAM type: YTN; PAM sequence: CTT
tcacctaggatcatcctcct

SEQ ID NO: 201491 - DNA, 20 bp, Artificial Sequence
  Description of Artificial Sequence: Synthetic oligonucleotide
  Target: ATXN1; (-) strand; PAM type: YTN; PAM sequence: TTC
tttcacctaggatcatcctc

SEQ ID NO: 201492 - DNA, 20 bp, Artificial Sequence
  Description of Artificial Sequence: Synthetic oligonucleotide
  Target: ATXN1; (-) strand; PAM type: YTN; PAM sequence: TTT
ctttcacctaggatcatcct

SEQ ID NO: 201493 - DNA, 20 bp, Artificial Sequence
  Description of Artificial Sequence: Synthetic oligonucleotide
  Target: ATXN1; (-) strand; PAM type: YTN; PAM sequence: CTG
gtttctttcacctaggatca

SEQ ID NO: 201494 - DNA, 20 bp, Artificial Sequence
  Description of Artificial Sequence: Synthetic oligonucleotide
  Target: ATXN1; (-) strand; PAM type: YTN; PAM sequence: CTC
tggtttctttcacctaggat

SEQ ID NO: 201495 - DNA, 20 bp, Artificial Sequence
  Description of Artificial Sequence: Synthetic oligonucleotide
  Target: ATXN1; (-) strand; PAM type: YTN; PAM sequence: TTG
catctctggtttctttcacc

SEQ ID NO: 201496 - DNA, 20 bp, Artificial Sequence
  Description of Artificial Sequence: Synthetic oligonucleotide
  Target: ATXN1; (-) strand; PAM type: YTN; PAM sequence: CTG
ttgcatctctggtttctttc

SEQ ID NO: 201497 - DNA, 20 bp, Artificial Sequence
  Description of Artificial Sequence: Synthetic oligonucleotide
  Target: ATXN1; (-) strand; PAM type: YTN; PAM sequence: TTC
tgttgcatctctggtttctt

SEQ ID NO: 201498 - DNA, 20 bp, Artificial Sequence
  Description of Artificial Sequence: Synthetic oligonucleotide
  Target: ATXN1; (-) strand; PAM type: YTN; PAM sequence: CTT
ctgttgcatctctggtttct

SEQ ID NO: 201499 - DNA, 20 bp, Artificial Sequence
  Description of Artificial Sequence: Synthetic oligonucleotide
  Target: ATXN1; (-) strand; PAM type: YTN; PAM sequence: CTG
cttctgttgcatctctggtt

SEQ ID NO: 201500 - DNA, 20 bp, Artificial Sequence
  Description of Artificial Sequence: Synthetic oligonucleotide
  Target: ATXN1; (-) strand; PAM type: YTN; PAM sequence: TTC
tgcttctgttgcatctctgg

SEQ ID NO: 201501 - DNA, 20 bp, Artificial Sequence
  Description of Artificial Sequence: Synthetic oligonucleotide
  Target: ATXN1; (-) strand; PAM type: YTN; PAM sequence: TTT
ctgcttctgttgcatctctg

SEQ ID NO: 201502 - DNA, 20 bp, Artificial Sequence
  Description of Artificial Sequence: Synthetic oligonucleotide
  Target: ATXN1; (-) strand; PAM type: YTN; PAM sequence: TTT
tctgcttctgttgcatctct

SEQ ID NO: 201503 - DNA, 20 bp, Artificial Sequence
  Description of Artificial Sequence: Synthetic oligonucleotide
  Target: ATXN1; (-) strand; PAM type: YTN; PAM sequence: TTG
gttttctgcttctgttgcat

SEQ ID NO: 201504 - DNA, 20 bp, Artificial Sequence
  Description of Artificial Sequence: Synthetic oligonucleotide
  Target: ATXN1; (-) strand; PAM type: YTN; PAM sequence: CTT
ggttttctgcttctgttgca

SEQ ID NO: 201505 - DNA, 20 bp, Artificial Sequence
  Description of Artificial Sequence: Synthetic oligonucleotide
  Target: ATXN1; (-) strand; PAM type: YTN; PAM sequence: CTC
ccttggttttctgcttctgt

SEQ ID NO: 201506 - DNA, 20 bp, Artificial Sequence
  Description of Artificial Sequence: Synthetic oligonucleotide
  Target: ATXN1; (-) strand; PAM type: YTN; PAM sequence: CTC
aagctcccttggttttctgc

SEQ ID NO: 201507 - DNA, 20 bp, Artificial Sequence
  Description of Artificial Sequence: Synthetic oligonucleotide
  Target: ATXN1; (-) strand; PAM type: YTN; PAM sequence: CTC
acacctcaagctcccttggt

SEQ ID NO: 201508 - DNA, 20 bp, Artificial Sequence
  Description of Artificial Sequence: Synthetic oligonucleotide
  Target: ATXN1; (-) strand; PAM type: YTN; PAM sequence: CTC
tcacacctcaagctcccttg

SEQ ID NO: 201509 - DNA, 20 bp, Artificial Sequence
  Description of Artificial Sequence: Synthetic oligonucleotide
  Target: ATXN1; (-) strand; PAM type: YTN; PAM sequence: TTC
ctctcacacctcaagctccc

SEQ ID NO: 201510 - DNA, 20 bp, Artificial Sequence
  Description of Artificial Sequence: Synthetic oligonucleotide
  Target: ATXN1; (-) strand; PAM type: YTN; PAM sequence: TTA
tatacatgttcctctcacac

SEQ ID NO: 201511 - DNA, 20 bp, Artificial Sequence
  Description of Artificial Sequence: Synthetic oligonucleotide
  Target: ATXN1; (-) strand; PAM type: YTN; PAM sequence: TTC
cccataattatatacatgtt

SEQ ID NO: 201512 - DNA, 20 bp, Artificial Sequence
  Description of Artificial Sequence: Synthetic oligonucleotide
  Target: ATXN1; (-) strand; PAM type: YTN; PAM sequence: CTT
ccccataattatatacatgt

SEQ ID NO: 201513 - DNA, 20 bp, Artificial Sequence
  Description of Artificial Sequence: Synthetic oligonucleotide
  Target: ATXN1; (-) strand; PAM type: YTN; PAM sequence: TTG
cagcccaggcttccccataa

SEQ ID NO: 201514 - DNA, 20 bp, Artificial Sequence
  Description of Artificial Sequence: Synthetic oligonucleotide
  Target: ATXN1; (-) strand; PAM type: YTN; PAM sequence: CTC
attgcagcccaggcttcccc

SEQ ID NO: 201515 - DNA, 20 bp, Artificial Sequence
  Description of Artificial Sequence: Synthetic oligonucleotide
  Target: ATXN1; (-) strand; PAM type: YTN; PAM sequence: TTA
ctcattgcagcccaggcttc

SEQ ID NO: 201516 - DNA, 20 bp, Artificial Sequence
  Description of Artificial Sequence: Synthetic oligonucleotide
  Target: ATXN1; (-) strand; PAM type: YTN; PAM sequence: CTT
actcattgcagcccaggctt

SEQ ID NO: 201517 - DNA, 20 bp, Artificial Sequence
  Description of Artificial Sequence: Synthetic oligonucleotide
  Target: ATXN1; (-) strand; PAM type: YTN; PAM sequence: CTA
accttactcattgcagccca

SEQ ID NO: 201518 - DNA, 20 bp, Artificial Sequence
  Description of Artificial Sequence: Synthetic oligonucleotide
  Target: ATXN1; (-) strand; PAM type: YTN; PAM sequence: TTC
ctaaccttactcattgcagc

SEQ ID NO: 201519 - DNA, 20 bp, Artificial Sequence
  Description of Artificial Sequence: Synthetic oligonucleotide
  Target: ATXN1; (-) strand; PAM type: YTN; PAM sequence: CTT
cctaaccttactcattgcag

SEQ ID NO: 201520 - DNA, 20 bp, Artificial Sequence
  Description of Artificial Sequence: Synthetic oligonucleotide
  Target: ATXN1; (-) strand; PAM type: YTN; PAM sequence: CTA
ccttcctaaccttactcatt

SEQ ID NO: 201521 - DNA, 20 bp, Artificial Sequence
  Description of Artificial Sequence: Synthetic oligonucleotide
  Target: ATXN1; (-) strand; PAM type: YTN; PAM sequence: TTA
cagcctaccttcctaacctt

SEQ ID NO: 201522 - DNA, 20 bp, Artificial Sequence
  Description of Artificial Sequence: Synthetic oligonucleotide
  Target: ATXN1; (-) strand; PAM type: YTN; PAM sequence: TTG
gttacagcctaccttcctaa

SEQ ID NO: 201523 - DNA, 20 bp, Artificial Sequence
  Description of Artificial Sequence: Synthetic oligonucleotide
  Target: ATXN1; (-) strand; PAM type: YTN; PAM sequence: CTT
ggttacagcctaccttccta

SEQ ID NO: 201524 - DNA, 20 bp, Artificial Sequence
  Description of Artificial Sequence: Synthetic oligonucleotide
  Target: ATXN1; (-) strand; PAM type: YTN; PAM sequence: TTG
tgacttggttacagcctacc

SEQ ID NO: 201525 - DNA, 20 bp, Artificial Sequence
  Description of Artificial Sequence: Synthetic oligonucleotide
  Target: ATXN1; (-) strand; PAM type: YTN; PAM sequence: CTG
agggagtgttgtgacttggt

SEQ ID NO: 201526 - DNA, 20 bp, Artificial Sequence
  Description of Artificial Sequence: Synthetic oligonucleotide
  Target: ATXN1; (-) strand; PAM type: YTN; PAM sequence: TTC
caggtcctgagggagtgttg

SEQ ID NO: 201527 - DNA, 20 bp, Artificial Sequence
  Description of Artificial Sequence: Synthetic oligonucleotide
  Target: ATXN1; (-) strand; PAM type: YTN; PAM sequence: CTT
ccaggtcctgagggagtgtt

SEQ ID NO: 201528 - DNA, 20 bp, Artificial Sequence
  Description of Artificial Sequence: Synthetic oligonucleotide
  Target: ATXN1; (-) strand; PAM type: YTN; PAM sequence: TTA
catcttccaggtcctgaggg

SEQ ID NO: 201529 - DNA, 20 bp, Artificial Sequence
  Description of Artificial Sequence: Synthetic oligonucleotide
  Target: ATXN1; (-) strand; PAM type: YTN; PAM sequence: TTT
acatcttccaggtcctgagg

SEQ ID NO: 201530 - DNA, 20 bp, Artificial Sequence
  Description of Artificial Sequence: Synthetic oligonucleotide
  Target: ATXN1; (-) strand; PAM type: YTN; PAM sequence: TTG
tttacatcttccaggtcctg

SEQ ID NO: 201531 - DNA, 20 bp, Artificial Sequence
  Description of Artificial Sequence: Synthetic oligonucleotide
  Target: ATXN1; (-) strand; PAM type: YTN; PAM sequence: CTT
gtttacatcttccaggtcct

SEQ ID NO: 201532 - DNA, 20 bp, Artificial Sequence
  Description of Artificial Sequence: Synthetic oligonucleotide
  Target: ATXN1; (-) strand; PAM type: YTN; PAM sequence: TTC
cttgtttacatcttccaggt

SEQ ID NO: 201533 - DNA, 20 bp, Artificial Sequence
  Description of Artificial Sequence: Synthetic oligonucleotide
  Target: ATXN1; (-) strand; PAM type: YTN; PAM sequence: CTT
ccttgtttacatcttccagg

SEQ ID NO: 201534 - DNA, 20 bp, Artificial Sequence
  Description of Artificial Sequence: Synthetic oligonucleotide
  Target: ATXN1; (-) strand; PAM type: YTN; PAM sequence: TTC
ttccttgtttacatcttcca

SEQ ID NO: 201535 - DNA, 20 bp, Artificial Sequence
  Description of Artificial Sequence: Synthetic oligonucleotide
  Target: ATXN1; (-) strand; PAM type: YTN; PAM sequence: TTT
cttccttgtttacatcttcc

SEQ ID NO: 201536 - DNA, 20 bp, Artificial Sequence
  Description of Artificial Sequence: Synthetic oligonucleotide
  Target: ATXN1; (-) strand; PAM type: YTN; PAM sequence: TTT
tcttccttgtttacatcttc

SEQ ID NO: 201537 - DNA, 20 bp, Artificial Sequence
  Description of Artificial Sequence: Synthetic oligonucleotide
  Target: ATXN1; (-) strand; PAM type: YTN; PAM sequence: CTT
ttcttccttgtttacatctt

SEQ ID NO: 201538 - DNA, 20 bp, Artificial Sequence
  Description of Artificial Sequence: Synthetic oligonucleotide
  Target: ATXN1; (-) strand; PAM type: YTN; PAM sequence: CTA
agtgtgtataaccacttttc

SEQ ID NO: 201539 - DNA, 20 bp, Artificial Sequence
  Description of Artificial Sequence: Synthetic oligonucleotide
  Target: ATXN1; (-) strand; PAM type: YTN; PAM sequence: CTG
cctaagtgtgtataaccact

SEQ ID NO: 201540 - DNA, 20 bp, Artificial Sequence
  Description of Artificial Sequence: Synthetic oligonucleotide
  Target: ATXN1; (-) strand; PAM type: YTN; PAM sequence: TTC
tgcctaagtgtgtataacca

SEQ ID NO: 201541 - DNA, 20 bp, Artificial Sequence
  Description of Artificial Sequence: Synthetic oligonucleotide
  Target: ATXN1; (-) strand; PAM type: YTN; PAM sequence: TTA
aaagtagattctgcctaagt

SEQ ID NO: 201542 - DNA, 20 bp, Artificial Sequence
  Description of Artificial Sequence: Synthetic oligonucleotide
  Target: ATXN1; (-) strand; PAM type: YTN; PAM sequence: CTT
aaaagtagattctgcctaag

SEQ ID NO: 201543 - DNA, 20 bp, Artificial Sequence
  Description of Artificial Sequence: Synthetic oligonucleotide
  Target: ATXN1; (-) strand; PAM type: YTN; PAM sequence: TTC
ttaaaagtagattctgccta

SEQ ID NO: 201544 - DNA, 20 bp, Artificial Sequence
  Description of Artificial Sequence: Synthetic oligonucleotide
  Target: ATXN1; (-) strand; PAM type: YTN; PAM sequence: TTA
ttcttaaaagtagattctgc

SEQ ID NO: 201545 - DNA, 20 bp, Artificial Sequence
  Description of Artificial Sequence: Synthetic oligonucleotide
  Target: ATXN1; (-) strand; PAM type: YTN; PAM sequence: CTT
attcttaaaagtagattctg

SEQ ID NO: 201546 - DNA, 20 bp, Artificial Sequence
  Description of Artificial Sequence: Synthetic oligonucleotide
  Target: ATXN1; (-) strand; PAM type: YTN; PAM sequence: TTC
gtacttattcttaaaagtag

SEQ ID NO: 201547 - DNA, 20 bp, Artificial Sequence
  Description of Artificial Sequence: Synthetic oligonucleotide
  Target: ATXN1; (-) strand; PAM type: YTN; PAM sequence: TTT
cgtacttattcttaaaagta

SEQ ID NO: 201548 - DNA, 20 bp, Artificial Sequence
  Description of Artificial Sequence: Synthetic oligonucleotide
  Target: ATXN1; (-) strand; PAM type: YTN; PAM sequence: TTT
tcgtacttattcttaaaagt

SEQ ID NO: 201549 - DNA, 20 bp, Artificial Sequence
  Description of Artificial Sequence: Synthetic oligonucleotide
  Target: ATXN1; (-) strand; PAM type: YTN; PAM sequence: CTT
ttcgtacttattcttaaaag

SEQ ID NO: 201550 - DNA, 20 bp, Artificial Sequence
  Description of Artificial Sequence: Synthetic oligonucleotide
  Target: ATXN1; (-) strand; PAM type: YTN; PAM sequence: TTG
tcccttttcgtacttattct

SEQ ID NO: 201551 - DNA, 20 bp, Artificial Sequence
  Description of Artificial Sequence: Synthetic oligonucleotide
  Target: ATXN1; (-) strand; PAM type: YTN; PAM sequence: TTT
gtcccttttcgtacttattc

SEQ ID NO: 201552 - DNA, 20 bp, Artificial Sequence
  Description of Artificial Sequence: Synthetic oligonucleotide
  Target: ATXN1; (-) strand; PAM type: YTN; PAM sequence: TTT
tgtcccttttcgtacttatt

SEQ ID NO: 201553 - DNA, 20 bp, Artificial Sequence
  Description of Artificial Sequence: Synthetic oligonucleotide
  Target: ATXN1; (-) strand; PAM type: YTN; PAM sequence: CTT
ttgtcccttttcgtacttat

SEQ ID NO: 201554 - DNA, 20 bp, Artificial Sequence
  Description of Artificial Sequence: Synthetic oligonucleotide
  Target: ATXN1; (-) strand; PAM type: YTN; PAM sequence: TTC
ttttgtcccttttcgtactt

SEQ ID NO: 201555 - DNA, 20 bp, Artificial Sequence
  Description of Artificial Sequence: Synthetic oligonucleotide
  Target: ATXN1; (-) strand; PAM type: YTN; PAM sequence: CTT
cttttgtcccttttcgtact

SEQ ID NO: 201556 - DNA, 20 bp, Artificial Sequence
  Description of Artificial Sequence: Synthetic oligonucleotide
  Target: ATXN1; (-) strand; PAM type: YTN; PAM sequence: TTC
cttcttttgtcccttttcgt

SEQ ID NO: 201557 - DNA, 20 bp, Artificial Sequence
  Description of Artificial Sequence: Synthetic oligonucleotide
  Target: ATXN1; (-) strand; PAM type: YTN; PAM sequence: CTT
ccttcttttgtcccttttcg

SEQ ID NO: 201558 - DNA, 20 bp, Artificial Sequence
  Description of Artificial Sequence: Synthetic oligonucleotide
  Target: ATXN1; (-) strand; PAM type: YTN; PAM sequence: TTA
tgtcttccttcttttgtccc

SEQ ID NO: 201559 - DNA, 20 bp, Artificial Sequence
  Description of Artificial Sequence: Synthetic oligonucleotide
  Target: ATXN1; (-) strand; PAM type: YTN; PAM sequence: TTT
atgtcttccttcttttgtcc

SEQ ID NO: 201560 - DNA, 20 bp, Artificial Sequence
  Description of Artificial Sequence: Synthetic oligonucleotide
  Target: ATXN1; (-) strand; PAM type: YTN; PAM sequence: CTT
tatgtcttccttcttttgtc

SEQ ID NO: 201561 - DNA, 20 bp, Artificial Sequence
  Description of Artificial Sequence: Synthetic oligonucleotide
  Target: ATXN1; (-) strand; PAM type: YTN; PAM sequence: TTC
tttatgtcttccttcttttg

SEQ ID NO: 201562 - DNA, 20 bp, Artificial Sequence
  Description of Artificial Sequence: Synthetic oligonucleotide
  Target: ATXN1; (-) strand; PAM type: YTN; PAM sequence: CTT
ctttatgtcttccttctttt

SEQ ID NO: 201563 - DNA, 20 bp, Artificial Sequence
  Description of Artificial Sequence: Synthetic oligonucleotide
  Target: ATXN1; (-) strand; PAM type: YTN; PAM sequence: TTC
ttctttatgtcttccttctt

SEQ ID NO: 201564 - DNA, 20 bp, Artificial Sequence
  Description of Artificial Sequence: Synthetic oligonucleotide
  Target: ATXN1; (-) strand; PAM type: YTN; PAM sequence: TTT
cttctttatgtcttccttct

SEQ ID NO: 201565 - DNA, 20 bp, Artificial Sequence
  Description of Artificial Sequence: Synthetic oligonucleotide
  Target: ATXN1; (-) strand; PAM type: YTN; PAM sequence: CTG
atcatttcttctttatgtct

SEQ ID NO: 201566 - DNA, 20 bp, Artificial Sequence
  Description of Artificial Sequence: Synthetic oligonucleotide
  Target: ATXN1; (-) strand; PAM type: YTN; PAM sequence: CTC
tgatcatttcttctttatgt

SEQ ID NO: 201567 - DNA, 20 bp, Artificial Sequence
  Description of Artificial Sequence: Synthetic oligonucleotide
  Target: ATXN1; (-) strand; PAM type: YTN; PAM sequence: CTG
ctctgatcatttcttcttta

SEQ ID NO: 201568 - DNA, 20 bp, Artificial Sequence
  Description of Artificial Sequence: Synthetic oligonucleotide
  Target: ATXN1; (-) strand; PAM type: YTN; PAM sequence: CTA
ctgctctgatcatttcttct

SEQ ID NO: 201569 - DNA, 20 bp, Artificial Sequence
  Description of Artificial Sequence: Synthetic oligonucleotide
  Target: ATXN1; (-) strand; PAM type: YTN; PAM sequence: CTC
tactgctctgatcatttctt

SEQ ID NO: 201570 - DNA, 20 bp, Artificial Sequence
  Description of Artificial Sequence: Synthetic oligonucleotide
  Target: ATXN1; (-) strand; PAM type: YTN; PAM sequence: TTA
ccctctactgctctgatcat

SEQ ID NO: 201571 - DNA, 20 bp, Artificial Sequence
  Description of Artificial Sequence: Synthetic oligonucleotide
  Target: ATXN1; (-) strand; PAM type: YTN; PAM sequence: CTT
accctctactgctctgatca

SEQ ID NO: 201572 - DNA, 20 bp, Artificial Sequence
  Description of Artificial Sequence: Synthetic oligonucleotide
  Target: ATXN1; (-) strand; PAM type: YTN; PAM sequence: CTC
ttaccctctactgctctgat

SEQ ID NO: 201573 - DNA, 20 bp, Artificial Sequence
  Description of Artificial Sequence: Synthetic oligonucleotide
  Target: ATXN1; (-) strand; PAM type: YTN; PAM sequence: TTC
tcttaccctctactgctctg

SEQ ID NO: 201574 - DNA, 20 bp, Artificial Sequence
  Description of Artificial Sequence: Synthetic oligonucleotide
  Target: ATXN1; (-) strand; PAM type: YTN; PAM sequence: TTT
ctcttaccctctactgctct

SEQ ID NO: 201575 - DNA, 20 bp, Artificial Sequence
  Description of Artificial Sequence: Synthetic oligonucleotide
  Target: ATXN1; (-) strand; PAM type: YTN; PAM sequence: TTT
tctcttaccctctactgctc

SEQ ID NO: 201576 - DNA, 20 bp, Artificial Sequence
  Description of Artificial Sequence: Synthetic oligonucleotide
  Target: ATXN1; (-) strand; PAM type: YTN; PAM sequence: TTA
ttttctcttaccctctactg

SEQ ID NO: 201577 - DNA, 20 bp, Artificial Sequence
  Description of Artificial Sequence: Synthetic oligonucleotide
  Target: ATXN1; (-) strand; PAM type: YTN; PAM sequence: TTT
attttctcttaccctctact

SEQ ID NO: 201578 - DNA, 20 bp, Artificial Sequence
  Description of Artificial Sequence: Synthetic oligonucleotide
  Target: ATXN1; (-) strand; PAM type: YTN; PAM sequence: CTT
tattttctcttaccctctac

SEQ ID NO: 201579 - DNA, 20 bp, Artificial Sequence
  Description of Artificial Sequence: Synthetic oligonucleotide
  Target: ATXN1; (-) strand; PAM type: YTN; PAM sequence: CTG
cctttattttctcttaccct

SEQ ID NO: 201580 - DNA, 20 bp, Artificial Sequence
  Description of Artificial Sequence: Synthetic oligonucleotide
  Target: ATXN1; (-) strand; PAM type: YTN; PAM sequence: TTA
tctgcctttattttctctta

SEQ ID NO: 201581 - DNA, 20 bp, Artificial Sequence
  Description of Artificial Sequence: Synthetic oligonucleotide
  Target: ATXN1; (-) strand; PAM type: YTN; PAM sequence: TTT
atctgcctttattttctctt

SEQ ID NO: 201582 - DNA, 20 bp, Artificial Sequence
  Description of Artificial Sequence: Synthetic oligonucleotide
  Target: ATXN1; (-) strand; PAM type: YTN; PAM sequence: CTT
tatctgcctttattttctct

SEQ ID NO: 201583 - DNA, 20 bp, Artificial Sequence
  Description of Artificial Sequence: Synthetic oligonucleotide
  Target: ATXN1; (-) strand; PAM type: YTN; PAM sequence: CTC
tttatctgcctttattttct

SEQ ID NO: 201584 - DNA, 20 bp, Artificial Sequence
  Description of Artificial Sequence: Synthetic oligonucleotide
  Target: ATXN1; (-) strand; PAM type: YTN; PAM sequence: CTG
aaaacactctttatctgcct

SEQ ID NO: 201585 - DNA, 20 bp, Artificial Sequence
  Description of Artificial Sequence: Synthetic oligonucleotide
  Target: ATXN1; (-) strand; PAM type: YTN; PAM sequence: TTC
tgaaaacactctttatctgc

SEQ ID NO: 201586 - DNA, 20 bp, Artificial Sequence
  Description of Artificial Sequence: Synthetic oligonucleotide
  Target: ATXN1; (-) strand; PAM type: YTN; PAM sequence: TTT
ctgaaaacactctttatctg

SEQ ID NO: 201587 - DNA, 20 bp, Artificial Sequence
  Description of Artificial Sequence: Synthetic oligonucleotide
  Target: ATXN1; (-) strand; PAM type: YTN; PAM sequence: TTG
tttctgaaaacactctttat

SEQ ID NO: 201588 - DNA, 20 bp, Artificial Sequence
  Description of Artificial Sequence: Synthetic oligonucleotide
  Target: ATXN1; (-) strand; PAM type: YTN; PAM sequence: TTT
gtttctgaaaacactcttta

SEQ ID NO: 201589 - DNA, 20 bp, Artificial Sequence
  Description of Artificial Sequence: Synthetic oligonucleotide
  Target: ATXN1; (-) strand; PAM type: YTN; PAM sequence: CTA
tttgtttctgaaaacactct

SEQ ID NO: 201590 - DNA, 20 bp, Artificial Sequence
  Description of Artificial Sequence: Synthetic oligonucleotide
  Target: ATXN1; (-) strand; PAM type: YTN; PAM sequence: CTG
catcagcctatttgtttctg

SEQ ID NO: 201591 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccactgcatc

SEQ ID NO: 201592 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgagccac

SEQ ID NO: 201593 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 201594 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagtgctggga

SEQ ID NO: 201595 - DNA, 20 bp, Artificial Sequence
  Description of Artificial Sequence: Synthetic oligonucleotide
  Target: ATXN1; (-) strand; PAM type: YTN; PAM sequence: CTG
cctcggcctcccaaagtgct

SEQ ID NO: 201596 - DNA, 20 bp, Artificial Sequence
  Description of Artificial Sequence: Synthetic oligonucleotide
  Target: ATXN1; (-) strand; PAM type: YTN; PAM sequence: CTC
aagcaatccgcctgcctcgg

SEQ ID NO: 201597 - DNA, 20 bp, Artificial Sequence
  Description of Artificial Sequence: Synthetic oligonucleotide
  Target: ATXN1; (-) strand; PAM type: YTN; PAM sequence: CTG
agctcaagcaatccgcctgc

SEQ ID NO: 201598 - DNA, 20 bp, Artificial Sequence
  Description of Artificial Sequence: Synthetic oligonucleotide
  Target: ATXN1; (-) strand; PAM type: YTN; PAM sequence: CTC
tgagctcaagcaatccgcct

SEQ ID NO: 201599 - DNA, 20 bp, Artificial Sequence
  Description of Artificial Sequence: Synthetic oligonucleotide
  Target: ATXN1; (-) strand; PAM type: YTN; PAM sequence: CTC
caactctgagctcaagcaat

SEQ ID NO: 201600 - DNA, 20 bp, Artificial Sequence
  Description of Artificial Sequence: Synthetic oligonucleotide
  Target: ATXN1; (-) strand; PAM type: YTN; PAM sequence: CTG
gtctccaactctgagctcaa

SEQ ID NO: 201601 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtctccaactc

SEQ ID NO: 201602 - DNA, 20 bp, Artificial Sequence
  Description of Artificial Sequence: Synthetic oligonucleotide
  Target: ATXN1; (-) strand; PAM type: YTN; PAM sequence: CTG
tgttgcccaggctggtctcc

SEQ ID NO: 201603 - DNA, 20 bp, Artificial Sequence
  Description of Artificial Sequence: Synthetic oligonucleotide
  Target: ATXN1; (-) strand; PAM type: YTN; PAM sequence: TTG
ctgtgttgcccaggctggtc

SEQ ID NO: 201604 - DNA, 20 bp, Artificial Sequence
  Description of Artificial Sequence: Synthetic oligonucleotide
  Target: ATXN1; (-) strand; PAM type: YTN; PAM sequence: TTT
gctgtgttgcccaggctggt

SEQ ID NO: 201605 - DNA, 20 bp, Artificial Sequence
  Description of Artificial Sequence: Synthetic oligonucleotide
  Target: ATXN1; (-) strand; PAM type: YTN; PAM sequence: TTT
tgctgtgttgcccaggctgg

SEQ ID NO: 201606 - DNA, 20 bp, Artificial Sequence
  Description of Artificial Sequence: Synthetic oligonucleotide
  Target: ATXN1; (-) strand; PAM type: YTN; PAM sequence: TTG
tagaggcagggttttgctgt

SEQ ID NO: 201607 - DNA, 20 bp, Artificial Sequence
  Description of Artificial Sequence: Synthetic oligonucleotide
  Target: ATXN1; (-) strand; PAM type: YTN; PAM sequence: TTT
gtagaggcagggttttgctg

SEQ ID NO: 201608 - DNA, 20 bp, Artificial Sequence
  Description of Artificial Sequence: Synthetic oligonucleotide
  Target: ATXN1; (-) strand; PAM type: YTN; PAM sequence: TTT
tgtagaggcagggttttgct

SEQ ID NO: 201609 - DNA, 20 bp, Artificial Sequence
  Description of Artificial Sequence: Synthetic oligonucleotide
  Target: ATXN1; (-) strand; PAM type: YTN; PAM sequence: TTT
ttgtagaggcagggttttgc

SEQ ID NO: 201610 - DNA, 20 bp, Artificial Sequence
  Description of Artificial Sequence: Synthetic oligonucleotide
  Target: ATXN1; (-) strand; PAM type: YTN; PAM sequence: TTT
tttgtagaggcagggttttg

SEQ ID NO: 201611 - DNA, 20 bp, Artificial Sequence
  Description of Artificial Sequence: Synthetic oligonucleotide
  Target: ATXN1; (-) strand; PAM type: YTN; PAM sequence: TTG
tattttttgtagaggcaggg

SEQ ID NO: 201612 - DNA, 20 bp, Artificial Sequence
  Description of Artificial Sequence: Synthetic oligonucleotide
  Target: ATXN1; (-) strand; PAM type: YTN; PAM sequence: TTT
gtattttttgtagaggcagg

SEQ ID NO: 201613 - DNA, 20 bp, Artificial Sequence
  Description of Artificial Sequence: Synthetic oligonucleotide
  Target: ATXN1; (-) strand; PAM type: YTN; PAM sequence: TTT
tgtattttttgtagaggcag

SEQ ID NO: 201614 - DNA, 20 bp, Artificial Sequence
  Description of Artificial Sequence: Synthetic oligonucleotide
  Target: ATXN1; (-) strand; PAM type: YTN; PAM sequence: TTT
ttgtattttttgtagaggca

SEQ ID NO: 201615 - DNA, 20 bp, Artificial Sequence
  Description of Artificial Sequence: Synthetic oligonucleotide
  Target: ATXN1; (-) strand; PAM type: YTN; PAM sequence: CTA
atttttgtattttttgtaga

SEQ ID NO: 201616 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtattttttg

SEQ ID NO: 201617 - DNA, 20 bp, Artificial Sequence
  Description of Artificial Sequence: Synthetic oligonucleotide
  Target: ATXN1; (-) strand; PAM type: YTN; PAM sequence: CTA
caggtgcaggccaccacacc

SEQ ID NO: 201618 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcaggccac

SEQ ID NO: 201619 - DNA, 20 bp, Artificial Sequence
  Description of Artificial Sequence: Synthetic oligonucleotide
  Target: ATXN1; (-) strand; PAM type: YTN; PAM sequence: CTC
ccaaatagctgggactacag

SEQ ID NO: 201620 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaatagctggga

SEQ ID NO: 201621 - DNA, 20 bp, Artificial Sequence
  Description of Artificial Sequence: Synthetic oligonucleotide
  Target: ATXN1; (-) strand; PAM type: YTN; PAM sequence: TTC
ccatctcagcctcccaaata

SEQ ID NO: 201622 - DNA, 20 bp, Artificial Sequence
  Description of Artificial Sequence: Synthetic oligonucleotide
  Target: ATXN1; (-) strand; PAM type: YTN; PAM sequence: CTT
cccatctcagcctcccaaat

SEQ ID NO: 201623 - DNA, 20 bp, Artificial Sequence
  Description of Artificial Sequence: Synthetic oligonucleotide
  Target: ATXN1; (-) strand; PAM type: YTN; PAM sequence: CTC
aagtgatcttcccatctcag

SEQ ID NO: 201624 - DNA, 20 bp, Artificial Sequence
  Description of Artificial Sequence: Synthetic oligonucleotide
  Target: ATXN1; (-) strand; PAM type: YTN; PAM sequence: CTC
ccgggctcaagtgatcttcc

SEQ ID NO: 201625 - DNA, 20 bp, Artificial Sequence
  Description of Artificial Sequence: Synthetic oligonucleotide
  Target: ATXN1; (-) strand; PAM type: YTN; PAM sequence: CTG
cctcccgggctcaagtgatc

SEQ ID NO: 201626 - DNA, 20 bp, Artificial Sequence
  Description of Artificial Sequence: Synthetic oligonucleotide
  Target: ATXN1; (-) strand; PAM type: YTN; PAM sequence: CTC
tgcctcccgggctcaagtga

SEQ ID NO: 201627 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccgggct

SEQ ID NO: 201628 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctcccg

SEQ ID NO: 201629 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaacctctgcct

SEQ ID NO: 201630 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaacctctgcc

SEQ ID NO: 201631 - DNA, 20 bp, Artificial Sequence
  Description of Artificial Sequence: Synthetic oligonucleotide
  Target: ATXN1; (-) strand; PAM type: YTN; PAM sequence: CTG
gagtacagtggggtgatctt

SEQ ID NO: 201632 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtacagtgg

SEQ ID NO: 201633 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtacag

SEQ ID NO: 201634 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtac

SEQ ID NO: 201635 - DNA, 20 bp, Artificial Sequence
  Description of Artificial Sequence: Synthetic oligonucleotide
  Target: ATXN1; (-) strand; PAM type: YTN; PAM sequence: CTA
gctctgttgcccaggctgga

SEQ ID NO: 201636 - DNA, 20 bp, Artificial Sequence
  Description of Artificial Sequence: Synthetic oligonucleotide
  Target: ATXN1; (-) strand; PAM type: YTN; PAM sequence: TTG
agacaagatctagctctgtt

SEQ ID NO: 201637 - DNA, 20 bp, Artificial Sequence
  Description of Artificial Sequence: Synthetic oligonucleotide
  Target: ATXN1; (-) strand; PAM type: YTN; PAM sequence: TTT
gagacaagatctagctctgt

SEQ ID NO: 201638 - DNA, 20 bp, Artificial Sequence
  Description of Artificial Sequence: Synthetic oligonucleotide
  Target: ATXN1; (-) strand; PAM type: YTN; PAM sequence: TTT
tgagacaagatctagctctg

SEQ ID NO: 201639 - DNA, 20 bp, Artificial Sequence
  Description of Artificial Sequence: Synthetic oligonucleotide
  Target: ATXN1; (-) strand; PAM type: YTN; PAM sequence: TTT
ttgagacaagatctagctct

SEQ ID NO: 201640 - DNA, 20 bp, Artificial Sequence
  Description of Artificial Sequence: Synthetic oligonucleotide
  Target: ATXN1; (-) strand; PAM type: YTN; PAM sequence: TTT
tttgagacaagatctagctc

SEQ ID NO: 201641 - DNA, 20 bp, Artificial Sequence
  Description of Artificial Sequence: Synthetic oligonucleotide
  Target: ATXN1; (-) strand; PAM type: YTN; PAM sequence: TTT
ttttgagacaagatctagct

SEQ ID NO: 201642 - DNA, 20 bp, Artificial Sequence
  Description of Artificial Sequence: Synthetic oligonucleotide
  Target: ATXN1; (-) strand; PAM type: YTN; PAM sequence: TTT
tttttgagacaagatctagc

SEQ ID NO: 201643 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacaagatctag

SEQ ID NO: 201644 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacaagatcta

SEQ ID NO: 201645 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacaagatct

SEQ ID NO: 201646 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacaagatc

SEQ ID NO: 201647 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacaagat

SEQ ID NO: 201648 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacaaga

SEQ ID NO: 201649 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaag

SEQ ID NO: 201650 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttgagacaa

SEQ ID NO: 201651 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttgagac

SEQ ID NO: 201652 - DNA, 20 bp, Artificial Sequence
  Description of Artificial Sequence: Synthetic oligonucleotide
  Target: ATXN1; (-) strand; PAM type: YTN; PAM sequence: CTT
ctttttttttttttttgaga

SEQ ID NO: 201653 - DNA, 20 bp, Artificial Sequence
  Description of Artificial Sequence: Synthetic oligonucleotide
  Target: ATXN1; (-) strand; PAM type: YTN; PAM sequence: TTC
ttctttttttttttttttga

SEQ ID NO: 201654 - DNA, 20 bp, Artificial Sequence
  Description of Artificial Sequence: Synthetic oligonucleotide
  Target: ATXN1; (-) strand; PAM type: YTN; PAM sequence: CTT
cttctttttttttttttttg

SEQ ID NO: 201655 - DNA, 20 bp, Artificial Sequence
  Description of Artificial Sequence: Synthetic oligonucleotide
  Target: ATXN1; (-) strand; PAM type: YTN; PAM sequence: TTC
ttcttctttttttttttttt

SEQ ID NO: 201656 - DNA, 20 bp, Artificial Sequence
  Description of Artificial Sequence: Synthetic oligonucleotide
  Target: ATXN1; (-) strand; PAM type: YTN; PAM sequence: CTT
cttcttcttttttttttttt

SEQ ID NO: 201657 - DNA, 20 bp, Artificial Sequence
  Description of Artificial Sequence: Synthetic oligonucleotide
  Target: ATXN1; (-) strand; PAM type: YTN; PAM sequence: TTC
ttcttcttcttttttttttt

SEQ ID NO: 201658 - DNA, 20 bp, Artificial Sequence
  Description of Artificial Sequence: Synthetic oligonucleotide
  Target: ATXN1; (-) strand; PAM type: YTN; PAM sequence: TTT
cttcttcttctttttttttt

SEQ ID NO: 201659 - DNA, 20 bp, Artificial Sequence
  Description of Artificial Sequence: Synthetic oligonucleotide
  Target: ATXN1; (-) strand; PAM type: YTN; PAM sequence: CTT
tcttcttcttcttttttttt

SEQ ID NO: 201660 - DNA, 20 bp, Artificial Sequence
  Description of Artificial Sequence: Synthetic oligonucleotide
  Target: ATXN1; (-) strand; PAM type: YTN; PAM sequence: TTC
tttcttcttcttcttttttt

SEQ ID NO: 201661 - DNA, 20 bp, Artificial Sequence
  Description of Artificial Sequence: Synthetic oligonucleotide
  Target: ATXN1; (-) strand; PAM type: YTN; PAM sequence: CTT
ctttcttcttcttctttttt

SEQ ID NO: 201662 - DNA, 20 bp, Artificial Sequence
  Description of Artificial Sequence: Synthetic oligonucleotide
  Target: ATXN1; (-) strand; PAM type: YTN; PAM sequence: TTC
ttctttcttcttcttctttt

SEQ ID NO: 201663 - DNA, 20 bp, Artificial Sequence
  Description of Artificial Sequence: Synthetic oligonucleotide
  Target: ATXN1; (-) strand; PAM type: YTN; PAM sequence: TTT
cttctttcttcttcttcttt

SEQ ID NO: 201664 - DNA, 20 bp, Artificial Sequence
  Description of Artificial Sequence: Synthetic oligonucleotide
  Target: ATXN1; (-) strand; PAM type: YTN; PAM sequence: CTT
tcttctttcttcttcttctt

SEQ ID NO: 201665 - DNA, 20 bp, Artificial Sequence
  Description of Artificial Sequence: Synthetic oligonucleotide
  Target: ATXN1; (-) strand; PAM type: YTN; PAM sequence: TTC
tttcttctttcttcttcttc

SEQ ID NO: 201666 - DNA, 20 bp, Artificial Sequence
  Description of Artificial Sequence: Synthetic oligonucleotide
  Target: ATXN1; (-) strand; PAM type: YTN; PAM sequence: CTT
ctttcttctttcttcttctt

SEQ ID NO: 201667 - DNA, 20 bp, Artificial Sequence
  Description of Artificial Sequence: Synthetic oligonucleotide
  Target: ATXN1; (-) strand; PAM type: YTN; PAM sequence: TTC
cccttctttcttctttcttc

SEQ ID NO: 201668 - DNA, 20 bp, Artificial Sequence
  Description of Artificial Sequence: Synthetic oligonucleotide
  Target: ATXN1; (-) strand; PAM type: YTN; PAM sequence: TTC
cccattccccttctttcttc

SEQ ID NO: 201669 - DNA, 20 bp, Artificial Sequence
  Description of Artificial Sequence: Synthetic oligonucleotide
  Target: ATXN1; (-) strand; PAM type: YTN; PAM sequence: CTT
ccccattccccttctttctt

SEQ ID NO: 201670 - DNA, 20 bp, Artificial Sequence
  Description of Artificial Sequence: Synthetic oligonucleotide
  Target: ATXN1; (-) strand; PAM type: YTN; PAM sequence: TTC
cccttccccattccccttct

SEQ ID NO: 201671 - DNA, 20 bp, Artificial Sequence
  Description of Artificial Sequence: Synthetic oligonucleotide
  Target: ATXN1; (-) strand; PAM type: YTN; PAM sequence: CTT
ccccttccccattccccttc

SEQ ID NO: 201672 - DNA, 20 bp, Artificial Sequence
  Description of Artificial Sequence: Synthetic oligonucleotide
  Target: ATXN1; (-) strand; PAM type: YTN; PAM sequence: CTC
cttccccttccccattcccc

SEQ ID NO: 201673 - DNA, 20 bp, Artificial Sequence
  Description of Artificial Sequence: Synthetic oligonucleotide
  Target: ATXN1; (-) strand; PAM type: YTN; PAM sequence: TTC
tccttccccttccccattcc

SEQ ID NO: 201674 - DNA, 20 bp, Artificial Sequence
  Description of Artificial Sequence: Synthetic oligonucleotide
  Target: ATXN1; (-) strand; PAM type: YTN; PAM sequence: CTT
ctccttccccttccccattc

SEQ ID NO: 201675 - DNA, 20 bp, Artificial Sequence
  Description of Artificial Sequence: Synthetic oligonucleotide
  Target: ATXN1; (-) strand; PAM type: YTN; PAM sequence: TTC
ttctccttccccttccccat

SEQ ID NO: 201676 - DNA, 20 bp, Artificial Sequence
  Description of Artificial Sequence: Synthetic oligonucleotide
  Target: ATXN1; (-) strand; PAM type: YTN; PAM sequence: TTT
cttctccttccccttcccca

SEQ ID NO: 201677 - DNA, 20 bp, Artificial Sequence
  Description of Artificial Sequence: Synthetic oligonucleotide
  Target: ATXN1; (-) strand; PAM type: YTN; PAM sequence: TTT
tcttctccttccccttcccc

SEQ ID NO: 201678 - DNA, 20 bp, Artificial Sequence
  Description of Artificial Sequence: Synthetic oligonucleotide
  Target: ATXN1; (-) strand; PAM type: YTN; PAM sequence: CTT
ttcttctccttccccttccc

SEQ ID NO: 201679 - DNA, 20 bp, Artificial Sequence
  Description of Artificial Sequence: Synthetic oligonucleotide
  Target: ATXN1; (-) strand; PAM type: YTN; PAM sequence: TTC
ttttcttctccttccccttc

SEQ ID NO: 201680 - DNA, 20 bp, Artificial Sequence
  Description of Artificial Sequence: Synthetic oligonucleotide
  Target: ATXN1; (-) strand; PAM type: YTN; PAM sequence: TTT
cttttcttctccttcccctt

SEQ ID NO: 201681 - DNA, 20 bp, Artificial Sequence
  Description of Artificial Sequence: Synthetic oligonucleotide
  Target: ATXN1; (-) strand; PAM type: YTN; PAM sequence: TTT
tcttttcttctccttcccct

SEQ ID NO: 201682 - DNA, 20 bp, Artificial Sequence
  Description of Artificial Sequence: Synthetic oligonucleotide
  Target: ATXN1; (-) strand; PAM type: YTN; PAM sequence: CTT
ttcttttcttctccttcccc

SEQ ID NO: 201683 - DNA, 20 bp, Artificial Sequence
  Description of Artificial Sequence: Synthetic oligonucleotide
  Target: ATXN1; (-) strand; PAM type: YTN; PAM sequence: TTC
ttttcttttcttctccttcc

SEQ ID NO: 201684 - DNA, 20 bp, Artificial Sequence
  Description of Artificial Sequence: Synthetic oligonucleotide
  Target: ATXN1; (-) strand; PAM type: YTN; PAM sequence: TTT
cttttcttttcttctccttc

SEQ ID NO: 201685 - DNA, 20 bp, Artificial Sequence
  Description of Artificial Sequence: Synthetic oligonucleotide
  Target: ATXN1; (-) strand; PAM type: YTN; PAM sequence: CTT
tcttttcttttcttctcctt

SEQ ID NO: 201686 - DNA, 20 bp, Artificial Sequence
  Description of Artificial Sequence: Synthetic oligonucleotide
  Target: ATXN1; (-) strand; PAM type: YTN; PAM sequence: TTC
tttcttttcttttcttctcc

SEQ ID NO: 201687 - DNA, 20 bp, Artificial Sequence
  Description of Artificial Sequence: Synthetic oligonucleotide
  Target: ATXN1; (-) strand; PAM type: YTN; PAM sequence: TTT
ctttcttttcttttcttctc

SEQ ID NO: 201688 - DNA, 20 bp, Artificial Sequence
  Description of Artificial Sequence: Synthetic oligonucleotide
  Target: ATXN1; (-) strand; PAM type: YTN; PAM sequence: TTT
tctttcttttcttttcttct

SEQ ID NO: 201689 - DNA, 20 bp, Artificial Sequence
  Description of Artificial Sequence: Synthetic oligonucleotide
  Target: ATXN1; (-) strand; PAM type: YTN; PAM sequence: CTT
ttctttcttttcttttcttc

SEQ ID NO: 201690 - DNA, 20 bp, Artificial Sequence
  Description of Artificial Sequence: Synthetic oligonucleotide
  Target: ATXN1; (-) strand; PAM type: YTN; PAM sequence: CTC
cttttctttcttttcttttc

SEQ ID NO: 201691 - DNA, 20 bp, Artificial Sequence
  Description of Artificial Sequence: Synthetic oligonucleotide
  Target: ATXN1; (-) strand; PAM type: YTN; PAM sequence: CTC
tccttttctttcttttcttt

SEQ ID NO: 201692 - DNA, 20 bp, Artificial Sequence
  Description of Artificial Sequence: Synthetic oligonucleotide
  Target: ATXN1; (-) strand; PAM type: YTN; PAM sequence: CTC
ctctccttttctttcttttc

SEQ ID NO: 201693 - DNA, 20 bp, Artificial Sequence
  Description of Artificial Sequence: Synthetic oligonucleotide
  Target: ATXN1; (-) strand; PAM type: YTN; PAM sequence: CTC
tcctctccttttctttcttt

SEQ ID NO: 201694 - DNA, 20 bp, Artificial Sequence
  Description of Artificial Sequence: Synthetic oligonucleotide
  Target: ATXN1; (-) strand; PAM type: YTN; PAM sequence: CTC
ctctcctctccttttctttc

SEQ ID NO: 201695 - DNA, 20 bp, Artificial Sequence
  Description of Artificial Sequence: Synthetic oligonucleotide
  Target: ATXN1; (-) strand; PAM type: YTN; PAM sequence: CTC
tcctctcctctccttttctt

SEQ ID NO: 201696 - DNA, 20 bp, Artificial Sequence
  Description of Artificial Sequence: Synthetic oligonucleotide
  Target: ATXN1; (-) strand; PAM type: YTN; PAM sequence: CTC
ctctcctctcctctcctttt

SEQ ID NO: 201697 - DNA, 20 bp, Artificial Sequence
  Description of Artificial Sequence: Synthetic oligonucleotide
  Target: ATXN1; (-) strand; PAM type: YTN; PAM sequence: CTC
tcctctcctctcctctcctt

SEQ ID NO: 201698 - DNA, 20 bp, Artificial Sequence
  Description of Artificial Sequence: Synthetic oligonucleotide
  Target: ATXN1; (-) strand; PAM type: YTN; PAM sequence: CTC
ctctcctctcctctcctctc

SEQ ID NO: 201699 - DNA, 20 bp, Artificial Sequence
  Description of Artificial Sequence: Synthetic oligonucleotide
  Target: ATXN1; (-) strand; PAM type: YTN; PAM sequence: CTC
tcctctcctctcctctcctc

SEQ ID NO: 201700 - DNA, 20 bp, Artificial Sequence
  Description of Artificial Sequence: Synthetic oligonucleotide
  Target: ATXN1; (-) strand; PAM type: YTN; PAM sequence: CTC
ctctcctctcctctcctctc

SEQ ID NO: 201701 - DNA, 20 bp, Artificial Sequence
  Description of Artificial Sequence: Synthetic oligonucleotide
  Target: ATXN1; (-) strand; PAM type: YTN; PAM sequence: CTC
tcctctcctctcctctcctc

SEQ ID NO: 201702 - DNA, 20 bp, Artificial Sequence
  Description of Artificial Sequence: Synthetic oligonucleotide
  Target: ATXN1; (-) strand; PAM type: YTN; PAM sequence: TTC
ctctcctctcctctcctctc

SEQ ID NO: 201703 - DNA, 20 bp, Artificial Sequence
  Description of Artificial Sequence: Synthetic oligonucleotide
  Target: ATXN1; (-) strand; PAM type: YTN; PAM sequence: TTT
cctctcctctcctctcctct

SEQ ID NO: 201704 - DNA, 20 bp, Artificial Sequence
  Description of Artificial Sequence: Synthetic oligonucleotide
  Target: ATXN1; (-) strand; PAM type: YTN; PAM sequence: CTT
tcctctcctctcctctcctc

SEQ ID NO: 201705 - DNA, 20 bp, Artificial Sequence
  Description of Artificial Sequence: Synthetic oligonucleotide
  Target: ATXN1; (-) strand; PAM type: YTN; PAM sequence: TTC
ctttcctctcctctcctctc

SEQ ID NO: 201706 - DNA, 20 bp, Artificial Sequence
  Description of Artificial Sequence: Synthetic oligonucleotide
  Target: ATXN1; (-) strand; PAM type: YTN; PAM sequence: TTT
cctttcctctcctctcctct

SEQ ID NO: 201707 - DNA, 20 bp, Artificial Sequence
  Description of Artificial Sequence: Synthetic oligonucleotide
  Target: ATXN1; (-) strand; PAM type: YTN; PAM sequence: CTT
tcctttcctctcctctcctc

SEQ ID NO: 201708 - DNA, 20 bp, Artificial Sequence
  Description of Artificial Sequence: Synthetic oligonucleotide
  Target: ATXN1; (-) strand; PAM type: YTN; PAM sequence: TTC
ctttcctttcctctcctctc

SEQ ID NO: 201709 - DNA, 20 bp, Artificial Sequence
  Description of Artificial Sequence: Synthetic oligonucleotide
  Target: ATXN1; (-) strand; PAM type: YTN; PAM sequence: TTT
cctttcctttcctctcctct

SEQ ID NO: 201710 - DNA, 20 bp, Artificial Sequence
  Description of Artificial Sequence: Synthetic oligonucleotide
  Target: ATXN1; (-) strand; PAM type: YTN; PAM sequence: CTT
tcctttcctttcctctcctc

SEQ ID NO: 201711 - DNA, 20 bp, Artificial Sequence
  Description of Artificial Sequence: Synthetic oligonucleotide
  Target: ATXN1; (-) strand; PAM type: YTN; PAM sequence: TTC
ctttcctttcctttcctctc

SEQ ID NO: 201712 - DNA, 20 bp, Artificial Sequence
  Description of Artificial Sequence: Synthetic oligonucleotide
  Target: ATXN1; (-) strand; PAM type: YTN; PAM sequence: TTT
cctttcctttcctttcctct

SEQ ID NO: 201713 - DNA, 20 bp, Artificial Sequence
  Description of Artificial Sequence: Synthetic oligonucleotide
  Target: ATXN1; (-) strand; PAM type: YTN; PAM sequence: CTT
tcctttcctttcctttcctc

SEQ ID NO: 201714 - DNA, 20 bp, Artificial Sequence
  Description of Artificial Sequence: Synthetic oligonucleotide
  Target: ATXN1; (-) strand; PAM type: YTN; PAM sequence: TTC
ctttcctttcctttcctttc

SEQ ID NO: 201715 - DNA, 20 bp, Artificial Sequence
  Description of Artificial Sequence: Synthetic oligonucleotide
  Target: ATXN1; (-) strand; PAM type: YTN; PAM sequence: TTT
cctttcctttcctttccttt

SEQ ID NO: 201716 - DNA, 20 bp, Artificial Sequence
  Description of Artificial Sequence: Synthetic oligonucleotide
  Target: ATXN1; (-) strand; PAM type: YTN; PAM sequence: TTT
tcctttcctttcctttcctt

SEQ ID NO: 201717 - DNA, 20 bp, Artificial Sequence
  Description of Artificial Sequence: Synthetic oligonucleotide
  Target: ATXN1; (-) strand; PAM type: YTN; PAM sequence: TTT
ttcctttcctttcctttcct

SEQ ID NO: 201718 - DNA, 20 bp, Artificial Sequence
  Description of Artificial Sequence: Synthetic oligonucleotide
  Target: ATXN1; (-) strand; PAM type: YTN; PAM sequence: CTT
tttcctttcctttcctttcc

SEQ ID NO: 201719 - DNA, 20 bp, Artificial Sequence
  Description of Artificial Sequence: Synthetic oligonucleotide
  Target: ATXN1; (-) strand; PAM type: YTN; PAM sequence: TTC
tttttcctttcctttccttt

SEQ ID NO: 201720 - DNA, 20 bp, Artificial Sequence
  Description of Artificial Sequence: Synthetic oligonucleotide
  Target: ATXN1; (-) strand; PAM type: YTN; PAM sequence: TTT
ctttttcctttcctttcctt

SEQ ID NO: 201721 - DNA, 20 bp, Artificial Sequence
  Description of Artificial Sequence: Synthetic oligonucleotide
  Target: ATXN1; (-) strand; PAM type: YTN; PAM sequence: TTT
tctttttcctttcctttcct

SEQ ID NO: 201722 - DNA, 20 bp, Artificial Sequence
  Description of Artificial Sequence: Synthetic oligonucleotide
  Target: ATXN1; (-) strand; PAM type: YTN; PAM sequence: CTT
ttctttttcctttcctttcc

SEQ ID NO: 201723 - DNA, 20 bp, Artificial Sequence
  Description of Artificial Sequence: Synthetic oligonucleotide
  Target: ATXN1; (-) strand; PAM type: YTN; PAM sequence: TTC
ttttctttttcctttccttt

SEQ ID NO: 201724 - DNA, 20 bp, Artificial Sequence
  Description of Artificial Sequence: Synthetic oligonucleotide
  Target: ATXN1; (-) strand; PAM type: YTN; PAM sequence: TTT
cttttctttttcctttcctt

SEQ ID NO: 201725 - DNA, 20 bp, Artificial Sequence
  Description of Artificial Sequence: Synthetic oligonucleotide
  Target: ATXN1; (-) strand; PAM type: YTN; PAM sequence: TTT
tcttttctttttcctttcct

SEQ ID NO: 201726 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttttcctttcc

SEQ ID NO: 201727 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttttccttt

SEQ ID NO: 201728 - DNA, 20 bp, Artificial Sequence
  Description of Artificial Sequence: Synthetic oligonucleotide
  Target: ATXN1; (-) strand; PAM type: YTN; PAM sequence: TTT
cttttcttttctttttcctt

SEQ ID NO: 201729 - DNA, 20 bp, Artificial Sequence
  Description of Artificial Sequence: Synthetic oligonucleotide
  Target: ATXN1; (-) strand; PAM type: YTN; PAM sequence: TTG
tttcttttcttttctttttc

SEQ ID NO: 201730 - DNA, 20 bp, Artificial Sequence
  Description of Artificial Sequence: Synthetic oligonucleotide
  Target: ATXN1; (-) strand; PAM type: YTN; PAM sequence: TTT
gtttcttttcttttcttttt

SEQ ID NO: 201731 - DNA, 20 bp, Artificial Sequence
  Description of Artificial Sequence: Synthetic oligonucleotide
  Target: ATXN1; (-) strand; PAM type: YTN; PAM sequence: TTT
tgtttcttttcttttctttt

SEQ ID NO: 201732 - DNA, 20 bp, Artificial Sequence
  Description of Artificial Sequence: Synthetic oligonucleotide
  Target: ATXN1; (-) strand; PAM type: YTN; PAM sequence: CTT
ttgtttcttttcttttcttt

SEQ ID NO: 201733 - DNA, 20 bp, Artificial Sequence
  Description of Artificial Sequence: Synthetic oligonucleotide
  Target: ATXN1; (-) strand; PAM type: YTN; PAM sequence: TTC
ttttgtttcttttcttttct

SEQ ID NO: 201734 - DNA, 20 bp, Artificial Sequence
  Description of Artificial Sequence: Synthetic oligonucleotide
  Target: ATXN1; (-) strand; PAM type: YTN; PAM sequence: TTT
cttttgtttcttttcttttc

SEQ ID NO: 201735 - DNA, 20 bp, Artificial Sequence
  Description of Artificial Sequence: Synthetic oligonucleotide
  Target: ATXN1; (-) strand; PAM type: YTN; PAM sequence: TTT
tcttttgtttcttttctttt

SEQ ID NO: 201736 - DNA, 20 bp, Artificial Sequence
  Description of Artificial Sequence: Synthetic oligonucleotide
  Target: ATXN1; (-) strand; PAM type: YTN; PAM sequence: TTT
ttcttttgtttcttttcttt

SEQ ID NO: 201737 - DNA, 20 bp, Artificial Sequence
  Description of Artificial Sequence: Synthetic oligonucleotide
  Target: ATXN1; (-) strand; PAM type: YTN; PAM sequence: CTT
tttcttttgtttcttttctt

SEQ ID NO: 201738 - DNA, 20 bp, Artificial Sequence
  Description of Artificial Sequence: Synthetic oligonucleotide
  Target: ATXN1; (-) strand; PAM type: YTN; PAM sequence: TTC
tttttcttttgtttcttttc

SEQ ID NO: 201739 - DNA, 20 bp, Artificial Sequence
  Description of Artificial Sequence: Synthetic oligonucleotide
  Target: ATXN1; (-) strand; PAM type: YTN; PAM sequence: TTT
ctttttcttttgtttctttt

SEQ ID NO: 201740 - DNA, 20 bp, Artificial Sequence
  Description of Artificial Sequence: Synthetic oligonucleotide
  Target: ATXN1; (-) strand; PAM type: YTN; PAM sequence: TTT
tctttttcttttgtttcttt

SEQ ID NO: 201741 - DNA, 20 bp, Artificial Sequence
  Description of Artificial Sequence: Synthetic oligonucleotide
  Target: ATXN1; (-) strand; PAM type: YTN; PAM sequence: CTT
ttctttttcttttgtttctt

SEQ ID NO: 201742 - DNA, 20 bp, Artificial Sequence
  Description of Artificial Sequence: Synthetic oligonucleotide
  Target: ATXN1; (-) strand; PAM type: YTN; PAM sequence: TTC
ttttctttttcttttgtttc

SEQ ID NO: 201743 - DNA, 20 bp, Artificial Sequence
  Description of Artificial Sequence: Synthetic oligonucleotide
  Target: ATXN1; (-) strand; PAM type: YTN; PAM sequence: TTT
cttttctttttcttttgttt

SEQ ID NO: 201744 - DNA, 20 bp, Artificial Sequence
  Description of Artificial Sequence: Synthetic oligonucleotide
  Target: ATXN1; (-) strand; PAM type: YTN; PAM sequence: TTT
tcttttctttttcttttgtt

SEQ ID NO: 201745 - DNA, 20 bp, Artificial Sequence
  Description of Artificial Sequence: Synthetic oligonucleotide
  Target: ATXN1; (-) strand; PAM type: YTN; PAM sequence: CTT
ttcttttctttttcttttgt

SEQ ID NO: 201746 - DNA, 20 bp, Artificial Sequence
  Description of Artificial Sequence: Synthetic oligonucleotide
  Target: ATXN1; (-) strand; PAM type: YTN; PAM sequence: TTC
ttttcttttctttttctttt

SEQ ID NO: 201747 - DNA, 20 bp, Artificial Sequence
  Description of Artificial Sequence: Synthetic oligonucleotide
  Target: ATXN1; (-) strand; PAM type: YTN; PAM sequence: TTT
cttttcttttctttttcttt

SEQ ID NO: 201748 - DNA, 20 bp, Artificial Sequence
  Description of Artificial Sequence: Synthetic oligonucleotide
  Target: ATXN1; (-) strand; PAM type: YTN; PAM sequence: TTC
atttcttttcttttcttttt

SEQ ID NO: 201749 - DNA, 20 bp, Artificial Sequence
  Description of Artificial Sequence: Synthetic oligonucleotide
  Target: ATXN1; (-) strand; PAM type: YTN; PAM sequence: TTT
catttcttttcttttctttt

SEQ ID NO: 201750 - DNA, 20 bp, Artificial Sequence
  Description of Artificial Sequence: Synthetic oligonucleotide
  Target: ATXN1; (-) strand; PAM type: YTN; PAM sequence: CTG
ccagccatttcatttctttt

SEQ ID NO: 201751 - DNA, 20 bp, Artificial Sequence
  Description of Artificial Sequence: Synthetic oligonucleotide
  Target: ATXN1; (-) strand; PAM type: YTN; PAM sequence: CTG
ctgccagccatttcatttct

SEQ ID NO: 201752 - DNA, 20 bp, Artificial Sequence
  Description of Artificial Sequence: Synthetic oligonucleotide
  Target: ATXN1; (-) strand; PAM type: YTN; PAM sequence: CTA
cggtggctgctgccagccat

SEQ ID NO: 201753 - DNA, 20 bp, Artificial Sequence
  Description of Artificial Sequence: Synthetic oligonucleotide
  Target: ATXN1; (-) strand; PAM type: YTN; PAM sequence: TTC
ctacggtggctgctgccagc

SEQ ID NO: 201754 - DNA, 20 bp, Artificial Sequence
  Description of Artificial Sequence: Synthetic oligonucleotide
  Target: ATXN1; (-) strand; PAM type: YTN; PAM sequence: TTT
cctacggtggctgctgccag

SEQ ID NO: 201755 - DNA, 20 bp, Artificial Sequence
  Description of Artificial Sequence: Synthetic oligonucleotide
  Target: ATXN1; (-) strand; PAM type: YTN; PAM sequence: CTG
tatttcctacggtggctgct

SEQ ID NO: 201756 - DNA, 20 bp, Artificial Sequence
  Description of Artificial Sequence: Synthetic oligonucleotide
  Target: ATXN1; (-) strand; PAM type: YTN; PAM sequence: CTG
ggctgtatttcctacggtgg

SEQ ID NO: 201757 - DNA, 20 bp, Artificial Sequence
  Description of Artificial Sequence: Synthetic oligonucleotide
  Target: ATXN1; (-) strand; PAM type: YTN; PAM sequence: CTC
tgggctgtatttcctacggt

SEQ ID NO: 201758 - DNA, 20 bp, Artificial Sequence
  Description of Artificial Sequence: Synthetic oligonucleotide
  Target: ATXN1; (-) strand; PAM type: YTN; PAM sequence: CTA
gacctctgggctgtatttcc

SEQ ID NO: 201759 - DNA, 20 bp, Artificial Sequence
  Description of Artificial Sequence: Synthetic oligonucleotide
  Target: ATXN1; (-) strand; PAM type: YTN; PAM sequence: CTC
ctagacctctgggctgtatt

SEQ ID NO: 201760 - DNA, 20 bp, Artificial Sequence
  Description of Artificial Sequence: Synthetic oligonucleotide
  Target: ATXN1; (-) strand; PAM type: YTN; PAM sequence: TTA
ctcctagacctctgggctgt

SEQ ID NO: 201761 - DNA, 20 bp, Artificial Sequence
  Description of Artificial Sequence: Synthetic oligonucleotide
  Target: ATXN1; (-) strand; PAM type: YTN; PAM sequence: TTC
agtggttactcctagacctc

SEQ ID NO: 201762 - DNA, 20 bp, Artificial Sequence
  Description of Artificial Sequence: Synthetic oligonucleotide
  Target: ATXN1; (-) strand; PAM type: YTN; PAM sequence: TTA
ttcagtggttactcctagac

SEQ ID NO: 201763 - DNA, 20 bp, Artificial Sequence
  Description of Artificial Sequence: Synthetic oligonucleotide
  Target: ATXN1; (-) strand; PAM type: YTN; PAM sequence: TTT
attcagtggttactcctaga

SEQ ID NO: 201764 - DNA, 20 bp, Artificial Sequence
  Description of Artificial Sequence: Synthetic oligonucleotide
  Target: ATXN1; (-) strand; PAM type: YTN; PAM sequence: TTT
tattcagtggttactcctag

SEQ ID NO: 201765 - DNA, 20 bp, Artificial Sequence
  Description of Artificial Sequence: Synthetic oligonucleotide
  Target: ATXN1; (-) strand; PAM type: YTN; PAM sequence: CTT
ttattcagtggttactccta

SEQ ID NO: 201766 - DNA, 20 bp, Artificial Sequence
  Description of Artificial Sequence: Synthetic oligonucleotide
  Target: ATXN1; (-) strand; PAM type: YTN; PAM sequence: CTA
gtaagcttttattcagtggt

SEQ ID NO: 201767 - DNA, 20 bp, Artificial Sequence
  Description of Artificial Sequence: Synthetic oligonucleotide
  Target: ATXN1; (-) strand; PAM type: YTN; PAM sequence: CTC
aaactagtaagcttttattc

SEQ ID NO: 201768 - DNA, 20 bp, Artificial Sequence
  Description of Artificial Sequence: Synthetic oligonucleotide
  Target: ATXN1; (-) strand; PAM type: YTN; PAM sequence: CTA
agatggactcaaactagtaa

SEQ ID NO: 201769 - DNA, 20 bp, Artificial Sequence
  Description of Artificial Sequence: Synthetic oligonucleotide
  Target: ATXN1; (-) strand; PAM type: YTN; PAM sequence: CTG
gcctaagatggactcaaact

SEQ ID NO: 201770 - DNA, 20 bp, Artificial Sequence
  Description of Artificial Sequence: Synthetic oligonucleotide
  Target: ATXN1; (-) strand; PAM type: YTN; PAM sequence: TTC
actggcctaagatggactca

SEQ ID NO: 201771 - DNA, 20 bp, Artificial Sequence
  Description of Artificial Sequence: Synthetic oligonucleotide
  Target: ATXN1; (-) strand; PAM type: YTN; PAM sequence: CTT
cactggcctaagatggactc

SEQ ID NO: 201772 - DNA, 20 bp, Artificial Sequence
  Description of Artificial Sequence: Synthetic oligonucleotide
  Target: ATXN1; (-) strand; PAM type: YTN; PAM sequence: CTC
ggcccaatgtcttcactggc

SEQ ID NO: 201773 - DNA, 20 bp, Artificial Sequence
  Description of Artificial Sequence: Synthetic oligonucleotide
  Target: ATXN1; (-) strand; PAM type: YTN; PAM sequence: TTC
tcggcccaatgtcttcactg

SEQ ID NO: 201774 - DNA, 20 bp, Artificial Sequence
  Description of Artificial Sequence: Synthetic oligonucleotide
  Target: ATXN1; (-) strand; PAM type: YTN; PAM sequence: CTT
ctcggcccaatgtcttcact

SEQ ID NO: 201775 - DNA, 20 bp, Artificial Sequence
  Description of Artificial Sequence: Synthetic oligonucleotide
  Target: ATXN1; (-) strand; PAM type: YTN; PAM sequence: CTG
gaaacttctcggcccaatgt

SEQ ID NO: 201776 - DNA, 20 bp, Artificial Sequence
  Description of Artificial Sequence: Synthetic oligonucleotide
  Target: ATXN1; (-) strand; PAM type: YTN; PAM sequence: CTG
tcatccaagcactggaaact

SEQ ID NO: 201777 - DNA, 20 bp, Artificial Sequence
  Description of Artificial Sequence: Synthetic oligonucleotide
  Target: ATXN1; (-) strand; PAM type: YTN; PAM sequence: CTC
tgtcatccaagcactggaaa

SEQ ID NO: 201778 - DNA, 20 bp, Artificial Sequence
  Description of Artificial Sequence: Synthetic oligonucleotide
  Target: ATXN1; (-) strand; PAM type: YTN; PAM sequence: TTC
tctgtcatccaagcactgga

SEQ ID NO: 201779 - DNA, 20 bp, Artificial Sequence
  Description of Artificial Sequence: Synthetic oligonucleotide
  Target: ATXN1; (-) strand; PAM type: YTN; PAM sequence: CTT
ctctgtcatccaagcactgg

SEQ ID NO: 201780 - DNA, 20 bp, Artificial Sequence
  Description of Artificial Sequence: Synthetic oligonucleotide
  Target: ATXN1; (-) strand; PAM type: YTN; PAM sequence: TTC
ttctctgtcatccaagcact

SEQ ID NO: 201781 - DNA, 20 bp, Artificial Sequence
  Description of Artificial Sequence: Synthetic oligonucleotide
  Target: ATXN1; (-) strand; PAM type: YTN; PAM sequence: TTA
gtcaccagttcttctctgtc

SEQ ID NO: 201782 - DNA, 20 bp, Artificial Sequence
  Description of Artificial Sequence: Synthetic oligonucleotide
  Target: ATXN1; (-) strand; PAM type: YTN; PAM sequence: CTT
agtcaccagttcttctctgt

SEQ ID NO: 201783 - DNA, 20 bp, Artificial Sequence
  Description of Artificial Sequence: Synthetic oligonucleotide
  Target: ATXN1; (-) strand; PAM type: YTN; PAM sequence: CTG
aagtcttagtcaccagttct

SEQ ID NO: 201784 - DNA, 20 bp, Artificial Sequence
  Description of Artificial Sequence: Synthetic oligonucleotide
  Target: ATXN1; (-) strand; PAM type: YTN; PAM sequence: TTA
ccacccactgaagtcttagt

SEQ ID NO: 201785 - DNA, 20 bp, Artificial Sequence
  Description of Artificial Sequence: Synthetic oligonucleotide
  Target: ATXN1; (-) strand; PAM type: YTN; PAM sequence: TTA
ttaccacccactgaagtctt

SEQ ID NO: 201786 - DNA, 20 bp, Artificial Sequence
  Description of Artificial Sequence: Synthetic oligonucleotide
  Target: ATXN1; (-) strand; PAM type: YTN; PAM sequence: TTC
atccagattattaccaccca

SEQ ID NO: 201787 - DNA, 20 bp, Artificial Sequence
  Description of Artificial Sequence: Synthetic oligonucleotide
  Target: ATXN1; (-) strand; PAM type: YTN; PAM sequence: CTA
ttcatccagattattaccac

SEQ ID NO: 201788 - DNA, 20 bp, Artificial Sequence
  Description of Artificial Sequence: Synthetic oligonucleotide
  Target: ATXN1; (-) strand; PAM type: YTN; PAM sequence: TTC
tattcatccagattattacc

SEQ ID NO: 201789 - DNA, 20 bp, Artificial Sequence
  Description of Artificial Sequence: Synthetic oligonucleotide
  Target: ATXN1; (-) strand; PAM type: YTN; PAM sequence: CTG
tgttctattcatccagatta

SEQ ID NO: 201790 - DNA, 20 bp, Artificial Sequence
  Description of Artificial Sequence: Synthetic oligonucleotide
  Target: ATXN1; (-) strand; PAM type: YTN; PAM sequence: TTG
aaaacatagtctgtgttcta

SEQ ID NO: 201791 - DNA, 20 bp, Artificial Sequence
  Description of Artificial Sequence: Synthetic oligonucleotide
  Target: ATXN1; (-) strand; PAM type: YTN; PAM sequence: TTT
gaaaacatagtctgtgttct

SEQ ID NO: 201792 - DNA, 20 bp, Artificial Sequence
  Description of Artificial Sequence: Synthetic oligonucleotide
  Target: ATXN1; (-) strand; PAM type: YTN; PAM sequence: TTT
tgaaaacatagtctgtgttc

SEQ ID NO: 201793 - DNA, 20 bp, Artificial Sequence
  Description of Artificial Sequence: Synthetic oligonucleotide
  Target: ATXN1; (-) strand; PAM type: YTN; PAM sequence: CTC
aacatgttttgaaaacatag

SEQ ID NO: 201794 - DNA, 20 bp, Artificial Sequence
  Description of Artificial Sequence: Synthetic oligonucleotide
  Target: ATXN1; (-) strand; PAM type: YTN; PAM sequence: TTA
acctcaacatgttttgaaaa

SEQ ID NO: 201795 - DNA, 20 bp, Artificial Sequence
  Description of Artificial Sequence: Synthetic oligonucleotide
  Target: ATXN1; (-) strand; PAM type: YTN; PAM sequence: TTT
aacctcaacatgttttgaaa

SEQ ID NO: 201796 - DNA, 20 bp, Artificial Sequence
  Description of Artificial Sequence: Synthetic oligonucleotide
  Target: ATXN1; (-) strand; PAM type: YTN; PAM sequence: CTT
taacctcaacatgttttgaa

SEQ ID NO: 201797 - DNA, 20 bp, Artificial Sequence
  Description of Artificial Sequence: Synthetic oligonucleotide
  Target: ATXN1; (-) strand; PAM type: YTN; PAM sequence: TTC
tttaacctcaacatgttttg

SEQ ID NO: 201798 - DNA, 20 bp, Artificial Sequence
  Description of Artificial Sequence: Synthetic oligonucleotide
  Target: ATXN1; (-) strand; PAM type: YTN; PAM sequence: TTT
ctttaacctcaacatgtttt

SEQ ID NO: 201799 - DNA, 20 bp, Artificial Sequence
  Description of Artificial Sequence: Synthetic oligonucleotide
  Target: ATXN1; (-) strand; PAM type: YTN; PAM sequence: CTT
tctttaacctcaacatgttt

SEQ ID NO: 201800 - DNA, 20 bp, Artificial Sequence
  Description of Artificial Sequence: Synthetic oligonucleotide
  Target: ATXN1; (-) strand; PAM type: YTN; PAM sequence: TTC
tttctttaacctcaacatgt

SEQ ID NO: 201801 - DNA, 20 bp, Artificial Sequence
  Description of Artificial Sequence: Synthetic oligonucleotide
  Target: ATXN1; (-) strand; PAM type: YTN; PAM sequence: CTA
ttctttctttaacctcaaca

SEQ ID NO: 201802 - DNA, 20 bp, Artificial Sequence
  Description of Artificial Sequence: Synthetic oligonucleotide
  Target: ATXN1; (-) strand; PAM type: YTN; PAM sequence: CTC
tattctttctttaacctcaa

SEQ ID NO: 201803 - DNA, 20 bp, Artificial Sequence
  Description of Artificial Sequence: Synthetic oligonucleotide
  Target: ATXN1; (-) strand; PAM type: YTN; PAM sequence: TTC
tctattctttctttaacctc

SEQ ID NO: 201804 - DNA, 20 bp, Artificial Sequence
  Description of Artificial Sequence: Synthetic oligonucleotide
  Target: ATXN1; (-) strand; PAM type: YTN; PAM sequence: TTT
ctctattctttctttaacct

SEQ ID NO: 201805 - DNA, 20 bp, Artificial Sequence
  Description of Artificial Sequence: Synthetic oligonucleotide
  Target: ATXN1; (-) strand; PAM type: YTN; PAM sequence: TTC
catttctctattctttcttt

SEQ ID NO: 201806 - DNA, 20 bp, Artificial Sequence
  Description of Artificial Sequence: Synthetic oligonucleotide
  Target: ATXN1; (-) strand; PAM type: YTN; PAM sequence: TTT
ccatttctctattctttctt

SEQ ID NO: 201807 - DNA, 20 bp, Artificial Sequence
  Description of Artificial Sequence: Synthetic oligonucleotide
  Target: ATXN1; (-) strand; PAM type: YTN; PAM sequence: CTC
aggcaatttccatttctcta

SEQ ID NO: 201808 - DNA, 20 bp, Artificial Sequence
  Description of Artificial Sequence: Synthetic oligonucleotide
  Target: ATXN1; (-) strand; PAM type: YTN; PAM sequence: CTC
ctcaggcaatttccatttct

SEQ ID NO: 201809 - DNA, 20 bp, Artificial Sequence
  Description of Artificial Sequence: Synthetic oligonucleotide
  Target: ATXN1; (-) strand; PAM type: YTN; PAM sequence: TTC
tcctcaggcaatttccattt

SEQ ID NO: 201810 - DNA, 20 bp, Artificial Sequence
  Description of Artificial Sequence: Synthetic oligonucleotide
  Target: ATXN1; (-) strand; PAM type: YTN; PAM sequence: TTG
ttctcctcaggcaatttcca

SEQ ID NO: 201811 - DNA, 20 bp, Artificial Sequence
  Description of Artificial Sequence: Synthetic oligonucleotide
  Target: ATXN1; (-) strand; PAM type: YTN; PAM sequence: CTT
gttctcctcaggcaatttcc

SEQ ID NO: 201812 - DNA, 20 bp, Artificial Sequence
  Description of Artificial Sequence: Synthetic oligonucleotide
  Target: ATXN1; (-) strand; PAM type: YTN; PAM sequence: TTG
accttgttctcctcaggcaa

SEQ ID NO: 201813 - DNA, 20 bp, Artificial Sequence
  Description of Artificial Sequence: Synthetic oligonucleotide
  Target: ATXN1; (-) strand; PAM type: YTN; PAM sequence: TTT
gaccttgttctcctcaggca

SEQ ID NO: 201814 - DNA, 20 bp, Artificial Sequence
  Description of Artificial Sequence: Synthetic oligonucleotide
  Target: ATXN1; (-) strand; PAM type: YTN; PAM sequence: TTT
tgaccttgttctcctcaggc

SEQ ID NO: 201815 - DNA, 20 bp, Artificial Sequence
  Description of Artificial Sequence: Synthetic oligonucleotide
  Target: ATXN1; (-) strand; PAM type: YTN; PAM sequence: TTA
ttttgaccttgttctcctca

SEQ ID NO: 201816 - DNA, 20 bp, Artificial Sequence
  Description of Artificial Sequence: Synthetic oligonucleotide
  Target: ATXN1; (-) strand; PAM type: YTN; PAM sequence: CTT
attttgaccttgttctcctc

SEQ ID NO: 201817 - DNA, 20 bp, Artificial Sequence
  Description of Artificial Sequence: Synthetic oligonucleotide
  Target: ATXN1; (-) strand; PAM type: YTN; PAM sequence: CTA
aaggagcccttattttgacc

SEQ ID NO: 201818 - DNA, 20 bp, Artificial Sequence
  Description of Artificial Sequence: Synthetic oligonucleotide
  Target: ATXN1; (-) strand; PAM type: YTN; PAM sequence: TTA
aaaactaaaggagcccttat

SEQ ID NO: 201819 - DNA, 20 bp, Artificial Sequence
  Description of Artificial Sequence: Synthetic oligonucleotide
  Target: ATXN1; (-) strand; PAM type: YTN; PAM sequence: TTT
aaaaactaaaggagccctta

SEQ ID NO: 201820 - DNA, 20 bp, Artificial Sequence
  Description of Artificial Sequence: Synthetic oligonucleotide
  Target: ATXN1; (-) strand; PAM type: YTN; PAM sequence: TTT
taaaaactaaaggagccctt

SEQ ID NO: 201821 - DNA, 20 bp, Artificial Sequence
  Description of Artificial Sequence: Synthetic oligonucleotide
  Target: ATXN1; (-) strand; PAM type: YTN; PAM sequence: CTT
ttaaaaactaaaggagccct

SEQ ID NO: 201822 - DNA, 20 bp, Artificial Sequence
  Description of Artificial Sequence: Synthetic oligonucleotide
  Target: ATXN1; (-) strand; PAM type: YTN; PAM sequence: CTG
tcttttaaaaactaaaggag

SEQ ID NO: 201823 - DNA, 20 bp, Artificial Sequence
  Description of Artificial Sequence: Synthetic oligonucleotide
  Target: ATXN1; (-) strand; PAM type: YTN; PAM sequence: CTA
gtggtgtggcctgtctttta

SEQ ID NO: 201824 - DNA, 20 bp, Artificial Sequence
  Description of Artificial Sequence: Synthetic oligonucleotide
  Target: ATXN1; (-) strand; PAM type: YTN; PAM sequence: CTA
tgaatgtgcctagtggtgtg

SEQ ID NO: 201825 - DNA, 20 bp, Artificial Sequence
  Description of Artificial Sequence: Synthetic oligonucleotide
  Target: ATXN1; (-) strand; PAM type: YTN; PAM sequence: TTC
agtctatgaatgtgcctagt

SEQ ID NO: 201826 - DNA, 20 bp, Artificial Sequence
  Description of Artificial Sequence: Synthetic oligonucleotide
  Target: ATXN1; (-) strand; PAM type: YTN; PAM sequence: CTT
cagtctatgaatgtgcctag

SEQ ID NO: 201827 - DNA, 20 bp, Artificial Sequence
  Description of Artificial Sequence: Synthetic oligonucleotide
  Target: ATXN1; (-) strand; PAM type: YTN; PAM sequence: CTC
ttcagtctatgaatgtgcct

SEQ ID NO: 201828 - DNA, 20 bp, Artificial Sequence
  Description of Artificial Sequence: Synthetic oligonucleotide
  Target: ATXN1; (-) strand; PAM type: YTN; PAM sequence: TTC
tcttcagtctatgaatgtgc

SEQ ID NO: 201829 - DNA, 20 bp, Artificial Sequence
  Description of Artificial Sequence: Synthetic oligonucleotide
  Target: ATXN1; (-) strand; PAM type: YTN; PAM sequence: CTT
ctcttcagtctatgaatgtg

SEQ ID NO: 201830 - DNA, 20 bp, Artificial Sequence
  Description of Artificial Sequence: Synthetic oligonucleotide
  Target: ATXN1; (-) strand; PAM type: YTN; PAM sequence: TTA
accaaaaccttctcttcagt

SEQ ID NO: 201831 - DNA, 20 bp, Artificial Sequence
  Description of Artificial Sequence: Synthetic oligonucleotide
  Target: ATXN1; (-) strand; PAM type: YTN; PAM sequence: CTT
aaccaaaaccttctcttcag

SEQ ID NO: 201832 - DNA, 20 bp, Artificial Sequence
  Description of Artificial Sequence: Synthetic oligonucleotide
  Target: ATXN1; (-) strand; PAM type: YTN; PAM sequence: TTC
atcttaaccaaaaccttctc

SEQ ID NO: 201833 - DNA, 20 bp, Artificial Sequence
  Description of Artificial Sequence: Synthetic oligonucleotide
  Target: ATXN1; (-) strand; PAM type: YTN; PAM sequence: CTT
catcttaaccaaaaccttct

SEQ ID NO: 201834 - DNA, 20 bp, Artificial Sequence
  Description of Artificial Sequence: Synthetic oligonucleotide
  Target: ATXN1; (-) strand; PAM type: YTN; PAM sequence: TTA
tcttcatcttaaccaaaacc

SEQ ID NO: 201835 - DNA, 20 bp, Artificial Sequence
  Description of Artificial Sequence: Synthetic oligonucleotide
  Target: ATXN1; (-) strand; PAM type: YTN; PAM sequence: TTC
attatcttcatcttaaccaa

SEQ ID NO: 201836 - DNA, 20 bp, Artificial Sequence
  Description of Artificial Sequence: Synthetic oligonucleotide
  Target: ATXN1; (-) strand; PAM type: YTN; PAM sequence: TTT
cattatcttcatcttaacca

SEQ ID NO: 201837 - DNA, 20 bp, Artificial Sequence
  Description of Artificial Sequence: Synthetic oligonucleotide
  Target: ATXN1; (-) strand; PAM type: YTN; PAM sequence: CTT
tcattatcttcatcttaacc

SEQ ID NO: 201838 - DNA, 20 bp, Artificial Sequence
  Description of Artificial Sequence: Synthetic oligonucleotide
  Target: ATXN1; (-) strand; PAM type: YTN; PAM sequence: TTG
atctttcattatcttcatct

SEQ ID NO: 201839 - DNA, 20 bp, Artificial Sequence
  Description of Artificial Sequence: Synthetic oligonucleotide
  Target: ATXN1; (-) strand; PAM type: YTN; PAM sequence: CTT
gatctttcattatcttcatc

SEQ ID NO: 201840 - DNA, 20 bp, Artificial Sequence
  Description of Artificial Sequence: Synthetic oligonucleotide
  Target: ATXN1; (-) strand; PAM type: YTN; PAM sequence: CTG
cttgatctttcattatcttc

SEQ ID NO: 201841 - DNA, 20 bp, Artificial Sequence
  Description of Artificial Sequence: Synthetic oligonucleotide
  Target: ATXN1; (-) strand; PAM type: YTN; PAM sequence: CTC
ctgcttgatctttcattatc

SEQ ID NO: 201842 - DNA, 20 bp, Artificial Sequence
  Description of Artificial Sequence: Synthetic oligonucleotide
  Target: ATXN1; (-) strand; PAM type: YTN; PAM sequence: CTC
tcctgcttgatctttcatta

SEQ ID NO: 201843 - DNA, 20 bp, Artificial Sequence
  Description of Artificial Sequence: Synthetic oligonucleotide
  Target: ATXN1; (-) strand; PAM type: YTN; PAM sequence: CTC
cctctcctgcttgatctttc

SEQ ID NO: 201844 - DNA, 20 bp, Artificial Sequence
  Description of Artificial Sequence: Synthetic oligonucleotide
  Target: ATXN1; (-) strand; PAM type: YTN; PAM sequence: TTA
tctccctctcctgcttgatc

SEQ ID NO: 201845 - DNA, 20 bp, Artificial Sequence
  Description of Artificial Sequence: Synthetic oligonucleotide
  Target: ATXN1; (-) strand; PAM type: YTN; PAM sequence: CTA
ggttatctccctctcctgct

SEQ ID NO: 201846 - DNA, 20 bp, Artificial Sequence
  Description of Artificial Sequence: Synthetic oligonucleotide
  Target: ATXN1; (-) strand; PAM type: YTN; PAM sequence: TTG
tcacctaggttatctccctc

SEQ ID NO: 201847 - DNA, 20 bp, Artificial Sequence
  Description of Artificial Sequence: Synthetic oligonucleotide
  Target: ATXN1; (-) strand; PAM type: YTN; PAM sequence: TTT
gtcacctaggttatctccct

SEQ ID NO: 201848 - DNA, 20 bp, Artificial Sequence
  Description of Artificial Sequence: Synthetic oligonucleotide
  Target: ATXN1; (-) strand; PAM type: YTN; PAM sequence: CTT
tgtcacctaggttatctccc

SEQ ID NO: 201849 - DNA, 20 bp, Artificial Sequence
  Description of Artificial Sequence: Synthetic oligonucleotide
  Target: ATXN1; (-) strand; PAM type: YTN; PAM sequence: CTG
aggctttgtcacctaggtta

SEQ ID NO: 201850 - DNA, 20 bp, Artificial Sequence
  Description of Artificial Sequence: Synthetic oligonucleotide
  Target: ATXN1; (-) strand; PAM type: YTN; PAM sequence: CTC
tgaggctttgtcacctaggt

SEQ ID NO: 201851 - DNA, 20 bp, Artificial Sequence
  Description of Artificial Sequence: Synthetic oligonucleotide
  Target: ATXN1; (-) strand; PAM type: YTN; PAM sequence: TTC
tctgaggctttgtcacctag

SEQ ID NO: 201852 - DNA, 20 bp, Artificial Sequence
  Description of Artificial Sequence: Synthetic oligonucleotide
  Target: ATXN1; (-) strand; PAM type: YTN; PAM sequence: CTT
ctctgaggctttgtcaccta

SEQ ID NO: 201853 - DNA, 20 bp, Artificial Sequence
  Description of Artificial Sequence: Synthetic oligonucleotide
  Target: ATXN1; (-) strand; PAM type: YTN; PAM sequence: CTG
acttctctgaggctttgtca

SEQ ID NO: 201854 - DNA, 20 bp, Artificial Sequence
  Description of Artificial Sequence: Synthetic oligonucleotide
  Target: ATXN1; (-) strand; PAM type: YTN; PAM sequence: CTA
ccctgacttctctgaggctt

SEQ ID NO: 201855 - DNA, 20 bp, Artificial Sequence
  Description of Artificial Sequence: Synthetic oligonucleotide
  Target: ATXN1; (-) strand; PAM type: YTN; PAM sequence: CTC
taccctgacttctctgaggc

SEQ ID NO: 201856 - DNA, 20 bp, Artificial Sequence
  Description of Artificial Sequence: Synthetic oligonucleotide
  Target: ATXN1; (-) strand; PAM type: YTN; PAM sequence: CTC
tctaccctgacttctctgag

SEQ ID NO: 201857 - DNA, 20 bp, Artificial Sequence
  Description of Artificial Sequence: Synthetic oligonucleotide
  Target: ATXN1; (-) strand; PAM type: YTN; PAM sequence: CTG
gatccctctctaccctgact

SEQ ID NO: 201858 - DNA, 20 bp, Artificial Sequence
  Description of Artificial Sequence: Synthetic oligonucleotide
  Target: ATXN1; (-) strand; PAM type: YTN; PAM sequence: TTC
tggatccctctctaccctga

SEQ ID NO: 201859 - DNA, 20 bp, Artificial Sequence
  Description of Artificial Sequence: Synthetic oligonucleotide
  Target: ATXN1; (-) strand; PAM type: YTN; PAM sequence: TTT
ctggatccctctctaccctg

SEQ ID NO: 201860 - DNA, 20 bp, Artificial Sequence
  Description of Artificial Sequence: Synthetic oligonucleotide
  Target: ATXN1; (-) strand; PAM type: YTN; PAM sequence: TTT
tctggatccctctctaccct

SEQ ID NO: 201861 - DNA, 20 bp, Artificial Sequence
  Description of Artificial Sequence: Synthetic oligonucleotide
  Target: ATXN1; (-) strand; PAM type: YTN; PAM sequence: CTC
gttttctggatccctctcta

SEQ ID NO: 201862 - DNA, 20 bp, Artificial Sequence
  Description of Artificial Sequence: Synthetic oligonucleotide
  Target: ATXN1; (-) strand; PAM type: YTN; PAM sequence: CTC
caagacccctcgttttctgg

SEQ ID NO: 201863 - DNA, 20 bp, Artificial Sequence
  Description of Artificial Sequence: Synthetic oligonucleotide
  Target: ATXN1; (-) strand; PAM type: YTN; PAM sequence: CTC
cgcaaggctccaagacccct

SEQ ID NO: 201864 - DNA, 20 bp, Artificial Sequence
  Description of Artificial Sequence: Synthetic oligonucleotide
  Target: ATXN1; (-) strand; PAM type: YTN; PAM sequence: CTC
ccactccgcaaggctccaag

SEQ ID NO: 201865 - DNA, 20 bp, Artificial Sequence
  Description of Artificial Sequence: Synthetic oligonucleotide
  Target: ATXN1; (-) strand; PAM type: YTN; PAM sequence: CTC
acgcatcccagaggagcaag

SEQ ID NO: 201866 - DNA, 20 bp, Artificial Sequence
  Description of Artificial Sequence: Synthetic oligonucleotide
  Target: ATXN1; (-) strand; PAM type: YTN; PAM sequence: CTG
tgctcacgcatcccagagga

SEQ ID NO: 201867 - DNA, 20 bp, Artificial Sequence
  Description of Artificial Sequence: Synthetic oligonucleotide
  Target: ATXN1; (-) strand; PAM type: YTN; PAM sequence: TTG
catgctgtgctcacgcatcc

SEQ ID NO: 201868 - DNA, 20 bp, Artificial Sequence
  Description of Artificial Sequence: Synthetic oligonucleotide
  Target: ATXN1; (-) strand; PAM type: YTN; PAM sequence: TTG
cagacaagtgttgcatgctg

SEQ ID NO: 201869 - DNA, 20 bp, Artificial Sequence
  Description of Artificial Sequence: Synthetic oligonucleotide
  Target: ATXN1; (-) strand; PAM type: YTN; PAM sequence: CTC
acagttgcagacaagtgttg

SEQ ID NO: 201870 - DNA, 20 bp, Artificial Sequence
  Description of Artificial Sequence: Synthetic oligonucleotide
  Target: ATXN1; (-) strand; PAM type: YTN; PAM sequence: CTG
tctcacagttgcagacaagt

SEQ ID NO: 201871 - DNA, 20 bp, Artificial Sequence
  Description of Artificial Sequence: Synthetic oligonucleotide
  Target: ATXN1; (-) strand; PAM type: YTN; PAM sequence: CTC
ctgtctcacagttgcagaca

SEQ ID NO: 201872 - DNA, 20 bp, Artificial Sequence
  Description of Artificial Sequence: Synthetic oligonucleotide
  Target: ATXN1; (-) strand; PAM type: YTN; PAM sequence: TTG
ctcctgtctcacagttgcag

SEQ ID NO: 201873 - DNA, 20 bp, Artificial Sequence
  Description of Artificial Sequence: Synthetic oligonucleotide
  Target: ATXN1; (-) strand; PAM type: YTN; PAM sequence: CTG
tccgttgctcctgtctcaca

SEQ ID NO: 201874 - DNA, 20 bp, Artificial Sequence
  Description of Artificial Sequence: Synthetic oligonucleotide
  Target: ATXN1; (-) strand; PAM type: YTN; PAM sequence: TTC
tgtccgttgctcctgtctca

SEQ ID NO: 201875 - DNA, 20 bp, Artificial Sequence
  Description of Artificial Sequence: Synthetic oligonucleotide
  Target: ATXN1; (-) strand; PAM type: YTN; PAM sequence: TTA
attctgtccgttgctcctgt

SEQ ID NO: 201876 - DNA, 20 bp, Artificial Sequence
  Description of Artificial Sequence: Synthetic oligonucleotide
  Target: ATXN1; (-) strand; PAM type: YTN; PAM sequence: TTT
aattctgtccgttgctcctg

SEQ ID NO: 201877 - DNA, 20 bp, Artificial Sequence
  Description of Artificial Sequence: Synthetic oligonucleotide
  Target: ATXN1; (-) strand; PAM type: YTN; PAM sequence: CTT
taattctgtccgttgctcct

SEQ ID NO: 201878 - DNA, 20 bp, Artificial Sequence
  Description of Artificial Sequence: Synthetic oligonucleotide
  Target: ATXN1; (-) strand; PAM type: YTN; PAM sequence: TTC
cctttaattctgtccgttgc

SEQ ID NO: 201879 - DNA, 20 bp, Artificial Sequence
  Description of Artificial Sequence: Synthetic oligonucleotide
  Target: ATXN1; (-) strand; PAM type: YTN; PAM sequence: TTT
ccctttaattctgtccgttg

SEQ ID NO: 201880 - DNA, 20 bp, Artificial Sequence
  Description of Artificial Sequence: Synthetic oligonucleotide
  Target: ATXN1; (-) strand; PAM type: YTN; PAM sequence: TTT
tccctttaattctgtccgtt

SEQ ID NO: 201881 - DNA, 20 bp, Artificial Sequence
  Description of Artificial Sequence: Synthetic oligonucleotide
  Target: ATXN1; (-) strand; PAM type: YTN; PAM sequence: TTT
ttccctttaattctgtccgt

SEQ ID NO: 201882 - DNA, 20 bp, Artificial Sequence
  Description of Artificial Sequence: Synthetic oligonucleotide
  Target: ATXN1; (-) strand; PAM type: YTN; PAM sequence: CTT
tttccctttaattctgtccg

SEQ ID NO: 201883 - DNA, 20 bp, Artificial Sequence
  Description of Artificial Sequence: Synthetic oligonucleotide
  Target: ATXN1; (-) strand; PAM type: YTN; PAM sequence: CTC
tttttccctttaattctgtc

SEQ ID NO: 201884 - DNA, 20 bp, Artificial Sequence
  Description of Artificial Sequence: Synthetic oligonucleotide
  Target: ATXN1; (-) strand; PAM type: YTN; PAM sequence: CTC
tctttttccctttaattctg

SEQ ID NO: 201885 - DNA, 20 bp, Artificial Sequence
  Description of Artificial Sequence: Synthetic oligonucleotide
  Target: ATXN1; (-) strand; PAM type: YTN; PAM sequence: CTA
ctctctttttccctttaatt

SEQ ID NO: 201886 - DNA, 20 bp, Artificial Sequence
  Description of Artificial Sequence: Synthetic oligonucleotide
  Target: ATXN1; (-) strand; PAM type: YTN; PAM sequence: TTC
tactctctttttccctttaa

SEQ ID NO: 201887 - DNA, 20 bp, Artificial Sequence
  Description of Artificial Sequence: Synthetic oligonucleotide
  Target: ATXN1; (-) strand; PAM type: YTN; PAM sequence: CTT
ctactctctttttcccttta

SEQ ID NO: 201888 - DNA, 20 bp, Artificial Sequence
  Description of Artificial Sequence: Synthetic oligonucleotide
  Target: ATXN1; (-) strand; PAM type: YTN; PAM sequence: TTG
aagaatccaggcatgaatcc

SEQ ID NO: 201889 - DNA, 20 bp, Artificial Sequence
  Description of Artificial Sequence: Synthetic oligonucleotide
  Target: ATXN1; (-) strand; PAM type: YTN; PAM sequence: CTT
gaagaatccaggcatgaatc

SEQ ID NO: 201890 - DNA, 20 bp, Artificial Sequence
  Description of Artificial Sequence: Synthetic oligonucleotide
  Target: ATXN1; (-) strand; PAM type: YTN; PAM sequence: TTA
aaatcttgaagaatccaggc

SEQ ID NO: 201891 - DNA, 20 bp, Artificial Sequence
  Description of Artificial Sequence: Synthetic oligonucleotide
  Target: ATXN1; (-) strand; PAM type: YTN; PAM sequence: TTT
aaaatcttgaagaatccagg

SEQ ID NO: 201892 - DNA, 20 bp, Artificial Sequence
  Description of Artificial Sequence: Synthetic oligonucleotide
  Target: ATXN1; (-) strand; PAM type: YTN; PAM sequence: TTT
taaaatcttgaagaatccag

SEQ ID NO: 201893 - DNA, 20 bp, Artificial Sequence
  Description of Artificial Sequence: Synthetic oligonucleotide
  Target: ATXN1; (-) strand; PAM type: YTN; PAM sequence: TTT
ttaaaatcttgaagaatcca

SEQ ID NO: 201894 - DNA, 20 bp, Artificial Sequence
  Description of Artificial Sequence: Synthetic oligonucleotide
  Target: ATXN1; (-) strand; PAM type: YTN; PAM sequence: TTT
tttaaaatcttgaagaatcc

SEQ ID NO: 201895 - DNA, 20 bp, Artificial Sequence
  Description of Artificial Sequence: Synthetic oligonucleotide
  Target: ATXN1; (-) strand; PAM type: YTN; PAM sequence: CTT
ttttaaaatcttgaagaatc

SEQ ID NO: 201896 - DNA, 20 bp, Artificial Sequence
  Description of Artificial Sequence: Synthetic oligonucleotide
  Target: ATXN1; (-) strand; PAM type: YTN; PAM sequence: TTG
cttttttaaaatcttgaaga

SEQ ID NO: 201897 - DNA, 20 bp, Artificial Sequence
  Description of Artificial Sequence: Synthetic oligonucleotide
  Target: ATXN1; (-) strand; PAM type: YTN; PAM sequence: CTT
gcttttttaaaatcttgaag

SEQ ID NO: 201898 - DNA, 20 bp, Artificial Sequence
  Description of Artificial Sequence: Synthetic oligonucleotide
  Target: ATXN1; (-) strand; PAM type: YTN; PAM sequence: TTC
atcttgcttttttaaaatct

SEQ ID NO: 201899 - DNA, 20 bp, Artificial Sequence
  Description of Artificial Sequence: Synthetic oligonucleotide
  Target: ATXN1; (-) strand; PAM type: YTN; PAM sequence: TTA
ttcatcttgcttttttaaaa

SEQ ID NO: 201900 - DNA, 20 bp, Artificial Sequence
  Description of Artificial Sequence: Synthetic oligonucleotide
  Target: ATXN1; (-) strand; PAM type: YTN; PAM sequence: TTT
attcatcttgcttttttaaa

SEQ ID NO: 201901 - DNA, 20 bp, Artificial Sequence
  Description of Artificial Sequence: Synthetic oligonucleotide
  Target: ATXN1; (-) strand; PAM type: YTN; PAM sequence: TTG
gtagaggaccatttattcat

SEQ ID NO: 201902 - DNA, 20 bp, Artificial Sequence
  Description of Artificial Sequence: Synthetic oligonucleotide
  Target: ATXN1; (-) strand; PAM type: YTN; PAM sequence: TTT
ggtagaggaccatttattca

SEQ ID NO: 201903 - DNA, 20 bp, Artificial Sequence
  Description of Artificial Sequence: Synthetic oligonucleotide
  Target: ATXN1; (-) strand; PAM type: YTN; PAM sequence: CTT
tggtagaggaccatttattc

SEQ ID NO: 201904 - DNA, 20 bp, Artificial Sequence
  Description of Artificial Sequence: Synthetic oligonucleotide
  Target: ATXN1; (-) strand; PAM type: YTN; PAM sequence: CTC
actttggtagaggaccattt

SEQ ID NO: 201905 - DNA, 20 bp, Artificial Sequence
  Description of Artificial Sequence: Synthetic oligonucleotide
  Target: ATXN1; (-) strand; PAM type: YTN; PAM sequence: CTC
accctcactttggtagagga

SEQ ID NO: 201906 - DNA, 20 bp, Artificial Sequence
  Description of Artificial Sequence: Synthetic oligonucleotide
  Target: ATXN1; (-) strand; PAM type: YTN; PAM sequence: TTA
ccctcaccctcactttggta

SEQ ID NO: 201907 - DNA, 20 bp, Artificial Sequence
  Description of Artificial Sequence: Synthetic oligonucleotide
  Target: ATXN1; (-) strand; PAM type: YTN; PAM sequence: CTT
accctcaccctcactttggt

SEQ ID NO: 201908 - DNA, 20 bp, Artificial Sequence
  Description of Artificial Sequence: Synthetic oligonucleotide
  Target: ATXN1; (-) strand; PAM type: YTN; PAM sequence: TTC
aaaacttaccctcaccctca

SEQ ID NO: 201909 - DNA, 20 bp, Artificial Sequence
  Description of Artificial Sequence: Synthetic oligonucleotide
  Target: ATXN1; (-) strand; PAM type: YTN; PAM sequence: CTT
caaaacttaccctcaccctc

SEQ ID NO: 201910 - DNA, 20 bp, Artificial Sequence
  Description of Artificial Sequence: Synthetic oligonucleotide
  Target: ATXN1; (-) strand; PAM type: YTN; PAM sequence: CTC
ttcaaaacttaccctcaccc

SEQ ID NO: 201911 - DNA, 20 bp, Artificial Sequence
  Description of Artificial Sequence: Synthetic oligonucleotide
  Target: ATXN1; (-) strand; PAM type: YTN; PAM sequence: TTC
cagtctcttcaaaacttacc

SEQ ID NO: 201912 - DNA, 20 bp, Artificial Sequence
  Description of Artificial Sequence: Synthetic oligonucleotide
  Target: ATXN1; (-) strand; PAM type: YTN; PAM sequence: TTT
ccagtctcttcaaaacttac

SEQ ID NO: 201913 - DNA, 20 bp, Artificial Sequence
  Description of Artificial Sequence: Synthetic oligonucleotide
  Target: ATXN1; (-) strand; PAM type: YTN; PAM sequence: TTT
tccagtctcttcaaaactta

SEQ ID NO: 201914 - DNA, 20 bp, Artificial Sequence
  Description of Artificial Sequence: Synthetic oligonucleotide
  Target: ATXN1; (-) strand; PAM type: YTN; PAM sequence: CTT
ttccagtctcttcaaaactt

SEQ ID NO: 201915 - DNA, 20 bp, Artificial Sequence
  Description of Artificial Sequence: Synthetic oligonucleotide
  Target: ATXN1; (-) strand; PAM type: YTN; PAM sequence: TTC
caaacttttccagtctcttc

SEQ ID NO: 201916 - DNA, 20 bp, Artificial Sequence
  Description of Artificial Sequence: Synthetic oligonucleotide
  Target: ATXN1; (-) strand; PAM type: YTN; PAM sequence: CTA
ttccaaacttttccagtctc

SEQ ID NO: 201917 - DNA, 20 bp, Artificial Sequence
  Description of Artificial Sequence: Synthetic oligonucleotide
  Target: ATXN1; (-) strand; PAM type: YTN; PAM sequence: TTA
tgggatctattccaaacttt

SEQ ID NO: 201918 - DNA, 20 bp, Artificial Sequence
  Description of Artificial Sequence: Synthetic oligonucleotide
  Target: ATXN1; (-) strand; PAM type: YTN; PAM sequence: CTT
atgggatctattccaaactt

SEQ ID NO: 201919 - DNA, 20 bp, Artificial Sequence
  Description of Artificial Sequence: Synthetic oligonucleotide
  Target: ATXN1; (-) strand; PAM type: YTN; PAM sequence: TTC
ttatgggatctattccaaac

SEQ ID NO: 201920 - DNA, 20 bp, Artificial Sequence
  Description of Artificial Sequence: Synthetic oligonucleotide
  Target: ATXN1; (-) strand; PAM type: YTN; PAM sequence: TTT
cttatgggatctattccaaa

SEQ ID NO: 201921 - DNA, 20 bp, Artificial Sequence
  Description of Artificial Sequence: Synthetic oligonucleotide
  Target: ATXN1; (-) strand; PAM type: YTN; PAM sequence: CTC
atagtcacatttcttatggg

SEQ ID NO: 201922 - DNA, 20 bp, Artificial Sequence
  Description of Artificial Sequence: Synthetic oligonucleotide
  Target: ATXN1; (-) strand; PAM type: YTN; PAM sequence: CTA
gtgggctcatagtcacattt

SEQ ID NO: 201923 - DNA, 20 bp, Artificial Sequence
  Description of Artificial Sequence: Synthetic oligonucleotide
  Target: ATXN1; (-) strand; PAM type: YTN; PAM sequence: TTC
tagtgggctcatagtcacat

SEQ ID NO: 201924 - DNA, 20 bp, Artificial Sequence
  Description of Artificial Sequence: Synthetic oligonucleotide
  Target: ATXN1; (-) strand; PAM type: YTN; PAM sequence: TTT
ctagtgggctcatagtcaca

SEQ ID NO: 201925 - DNA, 20 bp, Artificial Sequence
  Description of Artificial Sequence: Synthetic oligonucleotide
  Target: ATXN1; (-) strand; PAM type: YTN; PAM sequence: TTT
tctagtgggctcatagtcac

SEQ ID NO: 201926 - DNA, 20 bp, Artificial Sequence
  Description of Artificial Sequence: Synthetic oligonucleotide
  Target: ATXN1; (-) strand; PAM type: YTN; PAM sequence: CTT
ttctagtgggctcatagtca

SEQ ID NO: 201927 - DNA, 20 bp, Artificial Sequence
  Description of Artificial Sequence: Synthetic oligonucleotide
  Target: ATXN1; (-) strand; PAM type: YTN; PAM sequence: TTG
cttttctagtgggctcatag

SEQ ID NO: 201928 - DNA, 20 bp, Artificial Sequence
  Description of Artificial Sequence: Synthetic oligonucleotide
  Target: ATXN1; (-) strand; PAM type: YTN; PAM sequence: CTG
aggagagtcatcattgcttt

SEQ ID NO: 201929 - DNA, 20 bp, Artificial Sequence
  Description of Artificial Sequence: Synthetic oligonucleotide
  Target: ATXN1; (-) strand; PAM type: YTN; PAM sequence: TTA
atctgaggagagtcatcatt

SEQ ID NO: 201930 - DNA, 20 bp, Artificial Sequence
  Description of Artificial Sequence: Synthetic oligonucleotide
  Target: ATXN1; (-) strand; PAM type: YTN; PAM sequence: CTG
ttaatctgaggagagtcatc

SEQ ID NO: 201931 - DNA, 20 bp, Artificial Sequence
  Description of Artificial Sequence: Synthetic oligonucleotide
  Target: ATXN1; (-) strand; PAM type: YTN; PAM sequence: TTA
ctgttaatctgaggagagtc

SEQ ID NO: 201932 - DNA, 20 bp, Artificial Sequence
  Description of Artificial Sequence: Synthetic oligonucleotide
  Target: ATXN1; (-) strand; PAM type: YTN; PAM sequence: CTT
actgttaatctgaggagagt

SEQ ID NO: 201933 - DNA, 20 bp, Artificial Sequence
  Description of Artificial Sequence: Synthetic oligonucleotide
  Target: ATXN1; (-) strand; PAM type: YTN; PAM sequence: TTC
ttactgttaatctgaggaga

SEQ ID NO: 201934 - DNA, 20 bp, Artificial Sequence
  Description of Artificial Sequence: Synthetic oligonucleotide
  Target: ATXN1; (-) strand; PAM type: YTN; PAM sequence: CTG
atgtaaattcttactgttaa

SEQ ID NO: 201935 - DNA, 20 bp, Artificial Sequence
  Description of Artificial Sequence: Synthetic oligonucleotide
  Target: ATXN1; (-) strand; PAM type: YTN; PAM sequence: CTG
atgggtcctgatgtaaattc

SEQ ID NO: 201936 - DNA, 20 bp, Artificial Sequence
  Description of Artificial Sequence: Synthetic oligonucleotide
  Target: ATXN1; (-) strand; PAM type: YTN; PAM sequence: TTA
gaggcccccaaacccaactg

SEQ ID NO: 201937 - DNA, 20 bp, Artificial Sequence
  Description of Artificial Sequence: Synthetic oligonucleotide
  Target: ATXN1; (-) strand; PAM type: YTN; PAM sequence: CTT
agaggcccccaaacccaact

SEQ ID NO: 201938 - DNA, 20 bp, Artificial Sequence
  Description of Artificial Sequence: Synthetic oligonucleotide
  Target: ATXN1; (-) strand; PAM type: YTN; PAM sequence: CTG
cttagaggcccccaaaccca

SEQ ID NO: 201939 - DNA, 20 bp, Artificial Sequence
  Description of Artificial Sequence: Synthetic oligonucleotide
  Target: ATXN1; (-) strand; PAM type: YTN; PAM sequence: CTG
cacagctgcttagaggcccc

SEQ ID NO: 201940 - DNA, 20 bp, Artificial Sequence
  Description of Artificial Sequence: Synthetic oligonucleotide
  Target: ATXN1; (-) strand; PAM type: YTN; PAM sequence: CTG
catgatccccatcacctgca

SEQ ID NO: 201941 - DNA, 20 bp, Artificial Sequence
  Description of Artificial Sequence: Synthetic oligonucleotide
  Target: ATXN1; (-) strand; PAM type: YTN; PAM sequence: TTC
caggcaccaatcctgcatga

SEQ ID NO: 201942 - DNA, 20 bp, Artificial Sequence
  Description of Artificial Sequence: Synthetic oligonucleotide
  Target: ATXN1; (-) strand; PAM type: YTN; PAM sequence: TTT
ccaggcaccaatcctgcatg

SEQ ID NO: 201943 - DNA, 20 bp, Artificial Sequence
  Description of Artificial Sequence: Synthetic oligonucleotide
  Target: ATXN1; (-) strand; PAM type: YTN; PAM sequence: CTT
tccaggcaccaatcctgcat

SEQ ID NO: 201944 - DNA, 20 bp, Artificial Sequence
  Description of Artificial Sequence: Synthetic oligonucleotide
  Target: ATXN1; (-) strand; PAM type: YTN; PAM sequence: TTC
ctttccaggcaccaatcctg

SEQ ID NO: 201945 - DNA, 20 bp, Artificial Sequence
  Description of Artificial Sequence: Synthetic oligonucleotide
  Target: ATXN1; (-) strand; PAM type: YTN; PAM sequence: TTA
gtgccatgcattcctttcca

SEQ ID NO: 201946 - DNA, 20 bp, Artificial Sequence
  Description of Artificial Sequence: Synthetic oligonucleotide
  Target: ATXN1; (-) strand; PAM type: YTN; PAM sequence: CTT
agtgccatgcattcctttcc

SEQ ID NO: 201947 - DNA, 20 bp, Artificial Sequence
  Description of Artificial Sequence: Synthetic oligonucleotide
  Target: ATXN1; (-) strand; PAM type: YTN; PAM sequence: CTG
tgcatgcccaatagcttagt

SEQ ID NO: 201948 - DNA, 20 bp, Artificial Sequence
  Description of Artificial Sequence: Synthetic oligonucleotide
  Target: ATXN1; (-) strand; PAM type: YTN; PAM sequence: TTA
actgtgcatgcccaatagct

SEQ ID NO: 201949 - DNA, 20 bp, Artificial Sequence
  Description of Artificial Sequence: Synthetic oligonucleotide
  Target: ATXN1; (-) strand; PAM type: YTN; PAM sequence: TTT
aactgtgcatgcccaatagc

SEQ ID NO: 201950 - DNA, 20 bp, Artificial Sequence
  Description of Artificial Sequence: Synthetic oligonucleotide
  Target: ATXN1; (-) strand; PAM type: YTN; PAM sequence: TTG
aaagtttaactgtgcatgcc

SEQ ID NO: 201951 - DNA, 20 bp, Artificial Sequence
  Description of Artificial Sequence: Synthetic oligonucleotide
  Target: ATXN1; (-) strand; PAM type: YTN; PAM sequence: CTT
gaaagtttaactgtgcatgc

SEQ ID NO: 201952 - DNA, 20 bp, Artificial Sequence
  Description of Artificial Sequence: Synthetic oligonucleotide
  Target: ATXN1; (-) strand; PAM type: YTN; PAM sequence: CTC
atggcttgaaagtttaactg

SEQ ID NO: 201953 - DNA, 20 bp, Artificial Sequence
  Description of Artificial Sequence: Synthetic oligonucleotide
  Target: ATXN1; (-) strand; PAM type: YTN; PAM sequence: CTA
gacctcatggcttgaaagtt

SEQ ID NO: 201954 - DNA, 20 bp, Artificial Sequence
  Description of Artificial Sequence: Synthetic oligonucleotide
  Target: ATXN1; (-) strand; PAM type: YTN; PAM sequence: CTA
accagcctagacctcatggc

SEQ ID NO: 201955 - DNA, 20 bp, Artificial Sequence
  Description of Artificial Sequence: Synthetic oligonucleotide
  Target: ATXN1; (-) strand; PAM type: YTN; PAM sequence: CTG
ccccctaaccagcctagacc

SEQ ID NO: 201956 - DNA, 20 bp, Artificial Sequence
  Description of Artificial Sequence: Synthetic oligonucleotide
  Target: ATXN1; (-) strand; PAM type: YTN; PAM sequence: TTC
ctgccccctaaccagcctag

SEQ ID NO: 201957 - DNA, 20 bp, Artificial Sequence
  Description of Artificial Sequence: Synthetic oligonucleotide
  Target: ATXN1; (-) strand; PAM type: YTN; PAM sequence: CTC
cgtattcctgccccctaacc

SEQ ID NO: 201958 - DNA, 20 bp, Artificial Sequence
  Description of Artificial Sequence: Synthetic oligonucleotide
  Target: ATXN1; (-) strand; PAM type: YTN; PAM sequence: TTC
aggctccgtattcctgcccc

SEQ ID NO: 201959 - DNA, 20 bp, Artificial Sequence
  Description of Artificial Sequence: Synthetic oligonucleotide
  Target: ATXN1; (-) strand; PAM type: YTN; PAM sequence: CTT
caggctccgtattcctgccc

SEQ ID NO: 201960 - DNA, 20 bp, Artificial Sequence
  Description of Artificial Sequence: Synthetic oligonucleotide
  Target: ATXN1; (-) strand; PAM type: YTN; PAM sequence: TTC
ttcaggctccgtattcctgc

SEQ ID NO: 201961 - DNA, 20 bp, Artificial Sequence
  Description of Artificial Sequence: Synthetic oligonucleotide
  Target: ATXN1; (-) strand; PAM type: YTN; PAM sequence: TTT
cttcaggctccgtattcctg

SEQ ID NO: 201962 - DNA, 20 bp, Artificial Sequence
  Description of Artificial Sequence: Synthetic oligonucleotide
  Target: ATXN1; (-) strand; PAM type: YTN; PAM sequence: CTT
tcttcaggctccgtattcct

SEQ ID NO: 201963 - DNA, 20 bp, Artificial Sequence
  Description of Artificial Sequence: Synthetic oligonucleotide
  Target: ATXN1; (-) strand; PAM type: YTN; PAM sequence: CTA
tagccactttcttcaggctc

SEQ ID NO: 201964 - DNA, 20 bp, Artificial Sequence
  Description of Artificial Sequence: Synthetic oligonucleotide
  Target: ATXN1; (-) strand; PAM type: YTN; PAM sequence: TTG
gtcactatagccactttctt

SEQ ID NO: 201965 - DNA, 20 bp, Artificial Sequence
  Description of Artificial Sequence: Synthetic oligonucleotide
  Target: ATXN1; (-) strand; PAM type: YTN; PAM sequence: CTT
ggtcactatagccactttct

SEQ ID NO: 201966 - DNA, 20 bp, Artificial Sequence
  Description of Artificial Sequence: Synthetic oligonucleotide
  Target: ATXN1; (-) strand; PAM type: YTN; PAM sequence: CTC
ttggtcactatagccacttt

SEQ ID NO: 201967 - DNA, 20 bp, Artificial Sequence
  Description of Artificial Sequence: Synthetic oligonucleotide
  Target: ATXN1; (-) strand; PAM type: YTN; PAM sequence: CTC
atcccccactcttggtcact

SEQ ID NO: 201968 - DNA, 20 bp, Artificial Sequence
  Description of Artificial Sequence: Synthetic oligonucleotide
  Target: ATXN1; (-) strand; PAM type: YTN; PAM sequence: CTG
actcatcccccactcttggt

SEQ ID NO: 201969 - DNA, 20 bp, Artificial Sequence
  Description of Artificial Sequence: Synthetic oligonucleotide
  Target: ATXN1; (-) strand; PAM type: YTN; PAM sequence: TTG
tgagccctgactcatccccc

SEQ ID NO: 201970 - DNA, 20 bp, Artificial Sequence
  Description of Artificial Sequence: Synthetic oligonucleotide
  Target: ATXN1; (-) strand; PAM type: YTN; PAM sequence: TTA
ttgtgagccctgactcatcc

SEQ ID NO: 201971 - DNA, 20 bp, Artificial Sequence
  Description of Artificial Sequence: Synthetic oligonucleotide
  Target: ATXN1; (-) strand; PAM type: YTN; PAM sequence: CTT
attgtgagccctgactcatc

SEQ ID NO: 201972 - DNA, 20 bp, Artificial Sequence
  Description of Artificial Sequence: Synthetic oligonucleotide
  Target: ATXN1; (-) strand; PAM type: YTN; PAM sequence: CTC
cttattgtgagccctgactc

SEQ ID NO: 201973 - DNA, 20 bp, Artificial Sequence
  Description of Artificial Sequence: Synthetic oligonucleotide
  Target: ATXN1; (-) strand; PAM type: YTN; PAM sequence: TTG
tctccttattgtgagccctg

SEQ ID NO: 201974 - DNA, 20 bp, Artificial Sequence
  Description of Artificial Sequence: Synthetic oligonucleotide
  Target: ATXN1; (-) strand; PAM type: YTN; PAM sequence: CTC
agttgtctccttattgtgag

SEQ ID NO: 201975 - DNA, 20 bp, Artificial Sequence
  Description of Artificial Sequence: Synthetic oligonucleotide
  Target: ATXN1; (-) strand; PAM type: YTN; PAM sequence: CTC
agaactcagttgtctcctta

SEQ ID NO: 201976 - DNA, 20 bp, Artificial Sequence
  Description of Artificial Sequence: Synthetic oligonucleotide
  Target: ATXN1; (-) strand; PAM type: YTN; PAM sequence: TTC
ctcagaactcagttgtctcc

SEQ ID NO: 201977 - DNA, 20 bp, Artificial Sequence
  Description of Artificial Sequence: Synthetic oligonucleotide
  Target: ATXN1; (-) strand; PAM type: YTN; PAM sequence: CTT
cctcagaactcagttgtctc

SEQ ID NO: 201978 - DNA, 20 bp, Artificial Sequence
  Description of Artificial Sequence: Synthetic oligonucleotide
  Target: ATXN1; (-) strand; PAM type: YTN; PAM sequence: CTC
ttcctcagaactcagttgtc

SEQ ID NO: 201979 - DNA, 20 bp, Artificial Sequence
  Description of Artificial Sequence: Synthetic oligonucleotide
  Target: ATXN1; (-) strand; PAM type: YTN; PAM sequence: CTC
tcttcctcagaactcagttg

SEQ ID NO: 201980 - DNA, 20 bp, Artificial Sequence
  Description of Artificial Sequence: Synthetic oligonucleotide
  Target: ATXN1; (-) strand; PAM type: YTN; PAM sequence: TTC
cctctcttcctcagaactca

SEQ ID NO: 201981 - DNA, 20 bp, Artificial Sequence
  Description of Artificial Sequence: Synthetic oligonucleotide
  Target: ATXN1; (-) strand; PAM type: YTN; PAM sequence: TTT
ccctctcttcctcagaactc

SEQ ID NO: 201982 - DNA, 20 bp, Artificial Sequence
  Description of Artificial Sequence: Synthetic oligonucleotide
  Target: ATXN1; (-) strand; PAM type: YTN; PAM sequence: CTT
tccctctcttcctcagaact

SEQ ID NO: 201983 - DNA, 20 bp, Artificial Sequence
  Description of Artificial Sequence: Synthetic oligonucleotide
  Target: ATXN1; (-) strand; PAM type: YTN; PAM sequence: TTG
ctttccctctcttcctcaga

SEQ ID NO: 201984 - DNA, 20 bp, Artificial Sequence
  Description of Artificial Sequence: Synthetic oligonucleotide
  Target: ATXN1; (-) strand; PAM type: YTN; PAM sequence: CTT
gctttccctctcttcctcag

SEQ ID NO: 201985 - DNA, 20 bp, Artificial Sequence
  Description of Artificial Sequence: Synthetic oligonucleotide
  Target: ATXN1; (-) strand; PAM type: YTN; PAM sequence: CTG
acccccttgctttccctctc

SEQ ID NO: 201986 - DNA, 20 bp, Artificial Sequence
  Description of Artificial Sequence: Synthetic oligonucleotide
  Target: ATXN1; (-) strand; PAM type: YTN; PAM sequence: CTC
ctgacccccttgctttccct

SEQ ID NO: 201987 - DNA, 20 bp, Artificial Sequence
  Description of Artificial Sequence: Synthetic oligonucleotide
  Target: ATXN1; (-) strand; PAM type: YTN; PAM sequence: CTG
ggcatagcctcctgaccccc

SEQ ID NO: 201988 - DNA, 20 bp, Artificial Sequence
  Description of Artificial Sequence: Synthetic oligonucleotide
  Target: ATXN1; (-) strand; PAM type: YTN; PAM sequence: CTC
tgggcatagcctcctgaccc

SEQ ID NO: 201989 - DNA, 20 bp, Artificial Sequence
  Description of Artificial Sequence: Synthetic oligonucleotide
  Target: ATXN1; (-) strand; PAM type: YTN; PAM sequence: CTC
tctgggcatagcctcctgac

SEQ ID NO: 201990 - DNA, 20 bp, Artificial Sequence
  Description of Artificial Sequence: Synthetic oligonucleotide
  Target: ATXN1; (-) strand; PAM type: YTN; PAM sequence: TTC
tctctgggcatagcctcctg

SEQ ID NO: 201991 - DNA, 20 bp, Artificial Sequence
  Description of Artificial Sequence: Synthetic oligonucleotide
  Target: ATXN1; (-) strand; PAM type: YTN; PAM sequence: CTG
tagttctctctgggcatagc

SEQ ID NO: 201992 - DNA, 20 bp, Artificial Sequence
  Description of Artificial Sequence: Synthetic oligonucleotide
  Target: ATXN1; (-) strand; PAM type: YTN; PAM sequence: CTC
tgtagttctctctgggcata

SEQ ID NO: 201993 - DNA, 20 bp, Artificial Sequence
  Description of Artificial Sequence: Synthetic oligonucleotide
  Target: ATXN1; (-) strand; PAM type: YTN; PAM sequence: CTC
agactctgtagttctctctg

SEQ ID NO: 201994 - DNA, 20 bp, Artificial Sequence
  Description of Artificial Sequence: Synthetic oligonucleotide
  Target: ATXN1; (-) strand; PAM type: YTN; PAM sequence: TTA
aaatctcagactctgtagtt

SEQ ID NO: 201995 - DNA, 20 bp, Artificial Sequence
  Description of Artificial Sequence: Synthetic oligonucleotide
  Target: ATXN1; (-) strand; PAM type: YTN; PAM sequence: CTT
aaaatctcagactctgtagt

SEQ ID NO: 201996 - DNA, 20 bp, Artificial Sequence
  Description of Artificial Sequence: Synthetic oligonucleotide
  Target: ATXN1; (-) strand; PAM type: YTN; PAM sequence: CTA
aatcttaaaatctcagactc

SEQ ID NO: 201997 - DNA, 20 bp, Artificial Sequence
  Description of Artificial Sequence: Synthetic oligonucleotide
  Target: ATXN1; (-) strand; PAM type: YTN; PAM sequence: TTC
taaatcttaaaatctcagac

SEQ ID NO: 201998 - DNA, 20 bp, Artificial Sequence
  Description of Artificial Sequence: Synthetic oligonucleotide
  Target: ATXN1; (-) strand; PAM type: YTN; PAM sequence: TTT
ctaaatcttaaaatctcaga

SEQ ID NO: 201999 - DNA, 20 bp, Artificial Sequence
  Description of Artificial Sequence: Synthetic oligonucleotide
  Target: ATXN1; (-) strand; PAM type: YTN; PAM sequence: CTT
tctaaatcttaaaatctcag

SEQ ID NO: 202000 - DNA, 20 bp, Artificial Sequence
  Description of Artificial Sequence: Synthetic oligonucleotide
  Target: ATXN1; (-) strand; PAM type: YTN; PAM sequence: TTG
gacctttctaaatcttaaaa

SEQ ID NO: 202001 - DNA, 20 bp, Artificial Sequence
  Description of Artificial Sequence: Synthetic oligonucleotide
  Target: ATXN1; (-) strand; PAM type: YTN; PAM sequence: CTT
ggacctttctaaatcttaaa

SEQ ID NO: 202002 - DNA, 20 bp, Artificial Sequence
  Description of Artificial Sequence: Synthetic oligonucleotide
  Target: ATXN1; (-) strand; PAM type: YTN; PAM sequence: CTC
acaccccccaacttggacct

SEQ ID NO: 202003 - DNA, 20 bp, Artificial Sequence
  Description of Artificial Sequence: Synthetic oligonucleotide
  Target: ATXN1; (-) strand; PAM type: YTN; PAM sequence: TTG
aaccctcacaccccccaact

SEQ ID NO: 202004 - DNA, 20 bp, Artificial Sequence
  Description of Artificial Sequence: Synthetic oligonucleotide
  Target: ATXN1; (-) strand; PAM type: YTN; PAM sequence: CTT
gaaccctcacaccccccaac

SEQ ID NO: 202005 - DNA, 20 bp, Artificial Sequence
  Description of Artificial Sequence: Synthetic oligonucleotide
  Target: ATXN1; (-) strand; PAM type: YTN; PAM sequence: CTG
tgtatcaacttgaaccctca

SEQ ID NO: 202006 - DNA, 20 bp, Artificial Sequence
  Description of Artificial Sequence: Synthetic oligonucleotide
  Target: ATXN1; (-) strand; PAM type: YTN; PAM sequence: CTG
ccacaccccggacctgtgta

SEQ ID NO: 202007 - DNA, 20 bp, Artificial Sequence
  Description of Artificial Sequence: Synthetic oligonucleotide
  Target: ATXN1; (-) strand; PAM type: YTN; PAM sequence: TTC
ccagagatactgccacaccc

SEQ ID NO: 202008 - DNA, 20 bp, Artificial Sequence
  Description of Artificial Sequence: Synthetic oligonucleotide
  Target: ATXN1; (-) strand; PAM type: YTN; PAM sequence: CTT
cccagagatactgccacacc

SEQ ID NO: 202009 - DNA, 20 bp, Artificial Sequence
  Description of Artificial Sequence: Synthetic oligonucleotide
  Target: ATXN1; (-) strand; PAM type: YTN; PAM sequence: TTC
agcttcccagagatactgcc

SEQ ID NO: 202010 - DNA, 20 bp, Artificial Sequence
  Description of Artificial Sequence: Synthetic oligonucleotide
  Target: ATXN1; (-) strand; PAM type: YTN; PAM sequence: TTT
cagcttcccagagatactgc

SEQ ID NO: 202011 - DNA, 20 bp, Artificial Sequence
  Description of Artificial Sequence: Synthetic oligonucleotide
  Target: ATXN1; (-) strand; PAM type: YTN; PAM sequence: TTC
atttcagcttcccagagata

SEQ ID NO: 202012 - DNA, 20 bp, Artificial Sequence
  Description of Artificial Sequence: Synthetic oligonucleotide
  Target: ATXN1; (-) strand; PAM type: YTN; PAM sequence: CTT
catttcagcttcccagagat

SEQ ID NO: 202013 - DNA, 20 bp, Artificial Sequence
  Description of Artificial Sequence: Synthetic oligonucleotide
  Target: ATXN1; (-) strand; PAM type: YTN; PAM sequence: TTC
cttcatttcagcttcccaga

SEQ ID NO: 202014 - DNA, 20 bp, Artificial Sequence
  Description of Artificial Sequence: Synthetic oligonucleotide
  Target: ATXN1; (-) strand; PAM type: YTN; PAM sequence: TTT
ccttcatttcagcttcccag

SEQ ID NO: 202015 - DNA, 20 bp, Artificial Sequence
  Description of Artificial Sequence: Synthetic oligonucleotide
  Target: ATXN1; (-) strand; PAM type: YTN; PAM sequence: CTT
tccttcatttcagcttccca

SEQ ID NO: 202016 - DNA, 20 bp, Artificial Sequence
  Description of Artificial Sequence: Synthetic oligonucleotide
  Target: ATXN1; (-) strand; PAM type: YTN; PAM sequence: TTC
acctttccttcatttcagct

SEQ ID NO: 202017 - DNA, 20 bp, Artificial Sequence
  Description of Artificial Sequence: Synthetic oligonucleotide
  Target: ATXN1; (-) strand; PAM type: YTN; PAM sequence: CTT
cacctttccttcatttcagc

SEQ ID NO: 202018 - DNA, 20 bp, Artificial Sequence
  Description of Artificial Sequence: Synthetic oligonucleotide
  Target: ATXN1; (-) strand; PAM type: YTN; PAM sequence: TTA
agacttcacctttccttcat

SEQ ID NO: 202019 - DNA, 20 bp, Artificial Sequence
  Description of Artificial Sequence: Synthetic oligonucleotide
  Target: ATXN1; (-) strand; PAM type: YTN; PAM sequence: CTT
aagacttcacctttccttca

SEQ ID NO: 202020 - DNA, 20 bp, Artificial Sequence
  Description of Artificial Sequence: Synthetic oligonucleotide
  Target: ATXN1; (-) strand; PAM type: YTN; PAM sequence: CTC
accttaagacttcacctttc

SEQ ID NO: 202021 - DNA, 20 bp, Artificial Sequence
  Description of Artificial Sequence: Synthetic oligonucleotide
  Target: ATXN1; (-) strand; PAM type: YTN; PAM sequence: CTC
ctcaccttaagacttcacct

SEQ ID NO: 202022 - DNA, 20 bp, Artificial Sequence
  Description of Artificial Sequence: Synthetic oligonucleotide
  Target: ATXN1; (-) strand; PAM type: YTN; PAM sequence: TTC
atctcctcaccttaagactt

SEQ ID NO: 202023 - DNA, 20 bp, Artificial Sequence
  Description of Artificial Sequence: Synthetic oligonucleotide
  Target: ATXN1; (-) strand; PAM type: YTN; PAM sequence: CTT
catctcctcaccttaagact

SEQ ID NO: 202024 - DNA, 20 bp, Artificial Sequence
  Description of Artificial Sequence: Synthetic oligonucleotide
  Target: ATXN1; (-) strand; PAM type: YTN; PAM sequence: TTG
cttcatctcctcaccttaag

SEQ ID NO: 202025 - DNA, 20 bp, Artificial Sequence
  Description of Artificial Sequence: Synthetic oligonucleotide
  Target: ATXN1; (-) strand; PAM type: YTN; PAM sequence: CTG
cagttgcttcatctcctcac

SEQ ID NO: 202026 - DNA, 20 bp, Artificial Sequence
  Description of Artificial Sequence: Synthetic oligonucleotide
  Target: ATXN1; (-) strand; PAM type: YTN; PAM sequence: CTG
ccctgcagttgcttcatctc

SEQ ID NO: 202027 - DNA, 20 bp, Artificial Sequence
  Description of Artificial Sequence: Synthetic oligonucleotide
  Target: ATXN1; (-) strand; PAM type: YTN; PAM sequence: CTC
tgccctgcagttgcttcatc

SEQ ID NO: 202028 - DNA, 20 bp, Artificial Sequence
  Description of Artificial Sequence: Synthetic oligonucleotide
  Target: ATXN1; (-) strand; PAM type: YTN; PAM sequence: CTC
tctgccctgcagttgcttca

SEQ ID NO: 202029 - DNA, 20 bp, Artificial Sequence
  Description of Artificial Sequence: Synthetic oligonucleotide
  Target: ATXN1; (-) strand; PAM type: YTN; PAM sequence: TTC
tctctgccctgcagttgctt

SEQ ID NO: 202030 - DNA, 20 bp, Artificial Sequence
  Description of Artificial Sequence: Synthetic oligonucleotide
  Target: ATXN1; (-) strand; PAM type: YTN; PAM sequence: CTT
ctctctgccctgcagttgct

SEQ ID NO: 202031 - DNA, 20 bp, Artificial Sequence
  Description of Artificial Sequence: Synthetic oligonucleotide
  Target: ATXN1; (-) strand; PAM type: YTN; PAM sequence: CTG
acccttctctctgccctgca

SEQ ID NO: 202032 - DNA, 20 bp, Artificial Sequence
  Description of Artificial Sequence: Synthetic oligonucleotide
  Target: ATXN1; (-) strand; PAM type: YTN; PAM sequence: TTA
acctgacccttctctctgcc

SEQ ID NO: 202033 - DNA, 20 bp, Artificial Sequence
  Description of Artificial Sequence: Synthetic oligonucleotide
  Target: ATXN1; (-) strand; PAM type: YTN; PAM sequence: TTT
aacctgacccttctctctgc

SEQ ID NO: 202034 - DNA, 20 bp, Artificial Sequence
  Description of Artificial Sequence: Synthetic oligonucleotide
  Target: ATXN1; (-) strand; PAM type: YTN; PAM sequence: TTA
agtttaacctgacccttctc

SEQ ID NO: 202035 - DNA, 20 bp, Artificial Sequence
  Description of Artificial Sequence: Synthetic oligonucleotide
  Target: ATXN1; (-) strand; PAM type: YTN; PAM sequence: CTG
agtgcagcggcgtcatggac

SEQ ID NO: 202036 - DNA, 20 bp, Artificial Sequence
  Description of Artificial Sequence: Synthetic oligonucleotide
  Target: ATXN1; (-) strand; PAM type: YTN; PAM sequence: CTG
tgtctgagtgcagcggcgtc

SEQ ID NO: 202037 - DNA, 20 bp, Artificial Sequence
  Description of Artificial Sequence: Synthetic oligonucleotide
  Target: ATXN1; (-) strand; PAM type: YTN; PAM sequence: CTC
tgtgtctgagtgcagcggcg

SEQ ID NO: 202038 - DNA, 20 bp, Artificial Sequence
  Description of Artificial Sequence: Synthetic oligonucleotide
  Target: ATXN1; (-) strand; PAM type: YTN; PAM sequence: TTC
ctctgtgtctgagtgcagcg

SEQ ID NO: 202039 - DNA, 20 bp, Artificial Sequence
  Description of Artificial Sequence: Synthetic oligonucleotide
  Target: ATXN1; (-) strand; PAM type: YTN; PAM sequence: CTT
cctctgtgtctgagtgcagc

SEQ ID NO: 202040 - DNA, 20 bp, Artificial Sequence
  Description of Artificial Sequence: Synthetic oligonucleotide
  Target: ATXN1; (-) strand; PAM type: YTN; PAM sequence: TTG
acaaaaagatgatgaaatac

SEQ ID NO: 202041 - DNA, 20 bp, Artificial Sequence
  Description of Artificial Sequence: Synthetic oligonucleotide
  Target: ATXN1; (-) strand; PAM type: YTN; PAM sequence: TTC
cccgttgacaaaaagatgat

SEQ ID NO: 202042 - DNA, 20 bp, Artificial Sequence
  Description of Artificial Sequence: Synthetic oligonucleotide
  Target: ATXN1; (-) strand; PAM type: YTN; PAM sequence: TTG
tgttccccgttgacaaaaag

SEQ ID NO: 202043 - DNA, 20 bp, Artificial Sequence
  Description of Artificial Sequence: Synthetic oligonucleotide
  Target: ATXN1; (-) strand; PAM type: YTN; PAM sequence: TTT
gtgttccccgttgacaaaaa

SEQ ID NO: 202044 - DNA, 20 bp, Artificial Sequence
  Description of Artificial Sequence: Synthetic oligonucleotide
  Target: ATXN1; (-) strand; PAM type: YTN; PAM sequence: CTG
gagcgggcatttgtgttccc

SEQ ID NO: 202045 - DNA, 20 bp, Artificial Sequence
  Description of Artificial Sequence: Synthetic oligonucleotide
  Target: ATXN1; (-) strand; PAM type: YTN; PAM sequence: TTG
gacctggagcgggcatttgt

SEQ ID NO: 202046 - DNA, 20 bp, Artificial Sequence
  Description of Artificial Sequence: Synthetic oligonucleotide
  Target: ATXN1; (-) strand; PAM type: YTN; PAM sequence: CTT
ggacctggagcgggcatttg

SEQ ID NO: 202047 - DNA, 20 bp, Artificial Sequence
  Description of Artificial Sequence: Synthetic oligonucleotide
  Target: ATXN1; (-) strand; PAM type: YTN; PAM sequence: CTA
agcccttggacctggagcgg

SEQ ID NO: 202048 - DNA, 20 bp, Artificial Sequence
  Description of Artificial Sequence: Synthetic oligonucleotide
  Target: ATXN1; (-) strand; PAM type: YTN; PAM sequence: CTC
cgtcctaagcccttggacct

SEQ ID NO: 202049 - DNA, 20 bp, Artificial Sequence
  Description of Artificial Sequence: Synthetic oligonucleotide
  Target: ATXN1; (-) strand; PAM type: YTN; PAM sequence: CTA
aaaagtaaggaatataaatc

SEQ ID NO: 202050 - DNA, 20 bp, Artificial Sequence
  Description of Artificial Sequence: Synthetic oligonucleotide
  Target: ATXN1; (-) strand; PAM type: YTN; PAM sequence: TTG
tatcctaaaaagtaaggaat

SEQ ID NO: 202051 - DNA, 20 bp, Artificial Sequence
  Description of Artificial Sequence: Synthetic oligonucleotide
  Target: ATXN1; (-) strand; PAM type: YTN; PAM sequence: CTC
ccaattgtatcctaaaaagt

SEQ ID NO: 202052 - DNA, 20 bp, Artificial Sequence
  Description of Artificial Sequence: Synthetic oligonucleotide
  Target: ATXN1; (-) strand; PAM type: YTN; PAM sequence: TTC
tcccaattgtatcctaaaaa

SEQ ID NO: 202053 - DNA, 20 bp, Artificial Sequence
  Description of Artificial Sequence: Synthetic oligonucleotide
  Target: ATXN1; (-) strand; PAM type: YTN; PAM sequence: CTT
ctcccaattgtatcctaaaa

SEQ ID NO: 202054 - DNA, 20 bp, Artificial Sequence
  Description of Artificial Sequence: Synthetic oligonucleotide
  Target: ATXN1; (-) strand; PAM type: YTN; PAM sequence: TTC
gtgagcttctcccaattgta

SEQ ID NO: 202055 - DNA, 20 bp, Artificial Sequence
  Description of Artificial Sequence: Synthetic oligonucleotide
  Target: ATXN1; (-) strand; PAM type: YTN; PAM sequence: CTA
ttcgtgagcttctcccaatt

SEQ ID NO: 202056 - DNA, 20 bp, Artificial Sequence
  Description of Artificial Sequence: Synthetic oligonucleotide
  Target: ATXN1; (-) strand; PAM type: YTN; PAM sequence: TTC
tattcgtgagcttctcccaa

SEQ ID NO: 202057 - DNA, 20 bp, Artificial Sequence
  Description of Artificial Sequence: Synthetic oligonucleotide
  Target: ATXN1; (-) strand; PAM type: YTN; PAM sequence: TTT
ctattcgtgagcttctccca

SEQ ID NO: 202058 - DNA, 20 bp, Artificial Sequence
  Description of Artificial Sequence: Synthetic oligonucleotide
  Target: ATXN1; (-) strand; PAM type: YTN; PAM sequence: CTT
tctattcgtgagcttctccc

SEQ ID NO: 202059 - DNA, 20 bp, Artificial Sequence
  Description of Artificial Sequence: Synthetic oligonucleotide
  Target: ATXN1; (-) strand; PAM type: YTN; PAM sequence: CTC
tttctattcgtgagcttctc

SEQ ID NO: 202060 - DNA, 20 bp, Artificial Sequence
  Description of Artificial Sequence: Synthetic oligonucleotide
  Target: ATXN1; (-) strand; PAM type: YTN; PAM sequence: TTC
tctttctattcgtgagcttc

SEQ ID NO: 202061 - DNA, 20 bp, Artificial Sequence
  Description of Artificial Sequence: Synthetic oligonucleotide
  Target: ATXN1; (-) strand; PAM type: YTN; PAM sequence: TTA
gagaattctctttctattcg

SEQ ID NO: 202062 - DNA, 20 bp, Artificial Sequence
  Description of Artificial Sequence: Synthetic oligonucleotide
  Target: ATXN1; (-) strand; PAM type: YTN; PAM sequence: CTT
agagaattctctttctattc

SEQ ID NO: 202063 - DNA, 20 bp, Artificial Sequence
  Description of Artificial Sequence: Synthetic oligonucleotide
  Target: ATXN1; (-) strand; PAM type: YTN; PAM sequence: TTG
aaatcttagagaattctctt

SEQ ID NO: 202064 - DNA, 20 bp, Artificial Sequence
  Description of Artificial Sequence: Synthetic oligonucleotide
  Target: ATXN1; (-) strand; PAM type: YTN; PAM sequence: CTG
ttgaaatcttagagaattct

SEQ ID NO: 202065 - DNA, 20 bp, Artificial Sequence
  Description of Artificial Sequence: Synthetic oligonucleotide
  Target: ATXN1; (-) strand; PAM type: YTN; PAM sequence: CTC
atgatatgatcccagatcat

SEQ ID NO: 202066 - DNA, 20 bp, Artificial Sequence
  Description of Artificial Sequence: Synthetic oligonucleotide
  Target: ATXN1; (-) strand; PAM type: YTN; PAM sequence: CTC
cctcatgatatgatcccaga

SEQ ID NO: 202067 - DNA, 20 bp, Artificial Sequence
  Description of Artificial Sequence: Synthetic oligonucleotide
  Target: ATXN1; (-) strand; PAM type: YTN; PAM sequence: TTG
actccctcatgatatgatcc

SEQ ID NO: 202068 - DNA, 20 bp, Artificial Sequence
  Description of Artificial Sequence: Synthetic oligonucleotide
  Target: ATXN1; (-) strand; PAM type: YTN; PAM sequence: CTG
ttgactccctcatgatatga

SEQ ID NO: 202069 - DNA, 20 bp, Artificial Sequence
  Description of Artificial Sequence: Synthetic oligonucleotide
  Target: ATXN1; (-) strand; PAM type: YTN; PAM sequence: CTG
tctgttgactccctcatgat

SEQ ID NO: 202070 - DNA, 20 bp, Artificial Sequence
  Description of Artificial Sequence: Synthetic oligonucleotide
  Target: ATXN1; (-) strand; PAM type: YTN; PAM sequence: CTC
agcaaggtccatgctgtctg

SEQ ID NO: 202071 - DNA, 20 bp, Artificial Sequence
  Description of Artificial Sequence: Synthetic oligonucleotide
  Target: ATXN1; (-) strand; PAM type: YTN; PAM sequence: TTA
ctcagcaaggtccatgctgt

SEQ ID NO: 202072 - DNA, 20 bp, Artificial Sequence
  Description of Artificial Sequence: Synthetic oligonucleotide
  Target: ATXN1; (-) strand; PAM type: YTN; PAM sequence: TTT
actcagcaaggtccatgctg

SEQ ID NO: 202073 - DNA, 20 bp, Artificial Sequence
  Description of Artificial Sequence: Synthetic oligonucleotide
  Target: ATXN1; (-) strand; PAM type: YTN; PAM sequence: CTG
tttactcagcaaggtccatg

SEQ ID NO: 202074 - DNA, 20 bp, Artificial Sequence
  Description of Artificial Sequence: Synthetic oligonucleotide
  Target: ATXN1; (-) strand; PAM type: YTN; PAM sequence: TTG
gacccacatcctgtttactc

SEQ ID NO: 202075 - DNA, 20 bp, Artificial Sequence
  Description of Artificial Sequence: Synthetic oligonucleotide
  Target: ATXN1; (-) strand; PAM type: YTN; PAM sequence: TTT
ggacccacatcctgtttact

SEQ ID NO: 202076 - DNA, 20 bp, Artificial Sequence
  Description of Artificial Sequence: Synthetic oligonucleotide
  Target: ATXN1; (-) strand; PAM type: YTN; PAM sequence: CTG
ggatttggacccacatcctg

SEQ ID NO: 202077 - DNA, 20 bp, Artificial Sequence
  Description of Artificial Sequence: Synthetic oligonucleotide
  Target: ATXN1; (-) strand; PAM type: YTN; PAM sequence: CTG
aaaaggtagaagagctggga

SEQ ID NO: 202078 - DNA, 20 bp, Artificial Sequence
  Description of Artificial Sequence: Synthetic oligonucleotide
  Target: ATXN1; (-) strand; PAM type: YTN; PAM sequence: TTC
agctgaaaaggtagaagagc

SEQ ID NO: 202079 - DNA, 20 bp, Artificial Sequence
  Description of Artificial Sequence: Synthetic oligonucleotide
  Target: ATXN1; (-) strand; PAM type: YTN; PAM sequence: CTG
gaggtcattcagctgaaaag

SEQ ID NO: 202080 - DNA, 20 bp, Artificial Sequence
  Description of Artificial Sequence: Synthetic oligonucleotide
  Target: ATXN1; (-) strand; PAM type: YTN; PAM sequence: CTA
agcctggaggtcattcagct

SEQ ID NO: 202081 - DNA, 20 bp, Artificial Sequence
  Description of Artificial Sequence: Synthetic oligonucleotide
  Target: ATXN1; (-) strand; PAM type: YTN; PAM sequence: CTG
ctaagcctggaggtcattca

SEQ ID NO: 202082 - DNA, 20 bp, Artificial Sequence
  Description of Artificial Sequence: Synthetic oligonucleotide
  Target: ATXN1; (-) strand; PAM type: YTN; PAM sequence: TTA
gagaggctgctaagcctgga

SEQ ID NO: 202083 - DNA, 20 bp, Artificial Sequence
  Description of Artificial Sequence: Synthetic oligonucleotide
  Target: ATXN1; (-) strand; PAM type: YTN; PAM sequence: TTT
agagaggctgctaagcctgg

SEQ ID NO: 202084 - DNA, 20 bp, Artificial Sequence
  Description of Artificial Sequence: Synthetic oligonucleotide
  Target: ATXN1; (-) strand; PAM type: YTN; PAM sequence: CTG
aggtttagagaggctgctaa

SEQ ID NO: 202085 - DNA, 20 bp, Artificial Sequence
  Description of Artificial Sequence: Synthetic oligonucleotide
  Target: ATXN1; (-) strand; PAM type: YTN; PAM sequence: TTA
tagacgggggctgaggttta

SEQ ID NO: 202086 - DNA, 20 bp, Artificial Sequence
  Description of Artificial Sequence: Synthetic oligonucleotide
  Target: ATXN1; (-) strand; PAM type: YTN; PAM sequence: TTT
atagacgggggctgaggttt

SEQ ID NO: 202087 - DNA, 20 bp, Artificial Sequence
  Description of Artificial Sequence: Synthetic oligonucleotide
  Target: ATXN1; (-) strand; PAM type: YTN; PAM sequence: CTT
tatagacgggggctgaggtt

SEQ ID NO: 202088 - DNA, 20 bp, Artificial Sequence
  Description of Artificial Sequence: Synthetic oligonucleotide
  Target: ATXN1; (-) strand; PAM type: YTN; PAM sequence: CTC
actttatagacgggggctga

SEQ ID NO: 202089 - DNA, 20 bp, Artificial Sequence
  Description of Artificial Sequence: Synthetic oligonucleotide
  Target: ATXN1; (-) strand; PAM type: YTN; PAM sequence: TTC
tcactttatagacgggggct

SEQ ID NO: 202090 - DNA, 20 bp, Artificial Sequence
  Description of Artificial Sequence: Synthetic oligonucleotide
  Target: ATXN1; (-) strand; PAM type: YTN; PAM sequence: TTT
ctcactttatagacgggggc

SEQ ID NO: 202091 - DNA, 20 bp, Artificial Sequence
  Description of Artificial Sequence: Synthetic oligonucleotide
  Target: ATXN1; (-) strand; PAM type: YTN; PAM sequence: TTA
caatgtttctcactttatag

SEQ ID NO: 202092 - DNA, 20 bp, Artificial Sequence
  Description of Artificial Sequence: Synthetic oligonucleotide
  Target: ATXN1; (-) strand; PAM type: YTN; PAM sequence: CTA
agcatcatgtatgtgttaca

SEQ ID NO: 202093 - DNA, 20 bp, Artificial Sequence
  Description of Artificial Sequence: Synthetic oligonucleotide
  Target: ATXN1; (-) strand; PAM type: YTN; PAM sequence: CTG
ctaagcatcatgtatgtgtt

SEQ ID NO: 202094 - DNA, 20 bp, Artificial Sequence
  Description of Artificial Sequence: Synthetic oligonucleotide
  Target: ATXN1; (-) strand; PAM type: YTN; PAM sequence: CTC
tgctaagcatcatgtatgtg

SEQ ID NO: 202095 - DNA, 20 bp, Artificial Sequence
  Description of Artificial Sequence: Synthetic oligonucleotide
  Target: ATXN1; (-) strand; PAM type: YTN; PAM sequence: CTA
agtatgaatgcccaggcgct

SEQ ID NO: 202096 - DNA, 20 bp, Artificial Sequence
  Description of Artificial Sequence: Synthetic oligonucleotide
  Target: ATXN1; (-) strand; PAM type: YTN; PAM sequence: TTG
ctaagtatgaatgcccaggc

SEQ ID NO: 202097 - DNA, 20 bp, Artificial Sequence
  Description of Artificial Sequence: Synthetic oligonucleotide
  Target: ATXN1; (-) strand; PAM type: YTN; PAM sequence: TTT
gctaagtatgaatgcccagg

SEQ ID NO: 202098 - DNA, 20 bp, Artificial Sequence
  Description of Artificial Sequence: Synthetic oligonucleotide
  Target: ATXN1; (-) strand; PAM type: YTN; PAM sequence: TTT
tgctaagtatgaatgcccag

SEQ ID NO: 202099 - DNA, 20 bp, Artificial Sequence
  Description of Artificial Sequence: Synthetic oligonucleotide
  Target: ATXN1; (-) strand; PAM type: YTN; PAM sequence: CTT
ttgctaagtatgaatgccca

SEQ ID NO: 202100 - DNA, 20 bp, Artificial Sequence
  Description of Artificial Sequence: Synthetic oligonucleotide
  Target: ATXN1; (-) strand; PAM type: YTN; PAM sequence: TTG
tagaagggtaagaatatcaa

SEQ ID NO: 202101 - DNA, 20 bp, Artificial Sequence
  Description of Artificial Sequence: Synthetic oligonucleotide
  Target: ATXN1; (-) strand; PAM type: YTN; PAM sequence: TTG
agaacatagttgtagaaggg

SEQ ID NO: 202102 - DNA, 20 bp, Artificial Sequence
  Description of Artificial Sequence: Synthetic oligonucleotide
  Target: ATXN1; (-) strand; PAM type: YTN; PAM sequence: CTT
gagaacatagttgtagaagg

SEQ ID NO: 202103 - DNA, 20 bp, Artificial Sequence
  Description of Artificial Sequence: Synthetic oligonucleotide
  Target: ATXN1; (-) strand; PAM type: YTN; PAM sequence: TTC
ttgagaacatagttgtagaa

SEQ ID NO: 202104 - DNA, 20 bp, Artificial Sequence
  Description of Artificial Sequence: Synthetic oligonucleotide
  Target: ATXN1; (-) strand; PAM type: YTN; PAM sequence: TTT
cttgagaacatagttgtaga

SEQ ID NO: 202105 - DNA, 20 bp, Artificial Sequence
  Description of Artificial Sequence: Synthetic oligonucleotide
  Target: ATXN1; (-) strand; PAM type: YTN; PAM sequence: TTT
tcttgagaacatagttgtag

SEQ ID NO: 202106 - DNA, 20 bp, Artificial Sequence
  Description of Artificial Sequence: Synthetic oligonucleotide
  Target: ATXN1; (-) strand; PAM type: YTN; PAM sequence: TTT
ttcttgagaacatagttgta

SEQ ID NO: 202107 - DNA, 20 bp, Artificial Sequence
  Description of Artificial Sequence: Synthetic oligonucleotide
  Target: ATXN1; (-) strand; PAM type: YTN; PAM sequence: CTC
ccaaaaatgatttttcttga

SEQ ID NO: 202108 - DNA, 20 bp, Artificial Sequence
  Description of Artificial Sequence: Synthetic oligonucleotide
  Target: ATXN1; (-) strand; PAM type: YTN; PAM sequence: CTC
tcccaaaaatgatttttctt

SEQ ID NO: 202109 - DNA, 20 bp, Artificial Sequence
  Description of Artificial Sequence: Synthetic oligonucleotide
  Target: ATXN1; (-) strand; PAM type: YTN; PAM sequence: CTC
actctcccaaaaatgatttt

SEQ ID NO: 202110 - DNA, 20 bp, Artificial Sequence
  Description of Artificial Sequence: Synthetic oligonucleotide
  Target: ATXN1; (-) strand; PAM type: YTN; PAM sequence: CTA
tctcactctcccaaaaatga

SEQ ID NO: 202111 - DNA, 20 bp, Artificial Sequence
  Description of Artificial Sequence: Synthetic oligonucleotide
  Target: ATXN1; (-) strand; PAM type: YTN; PAM sequence: TTA
cctatctcactctcccaaaa

SEQ ID NO: 202112 - DNA, 20 bp, Artificial Sequence
  Description of Artificial Sequence: Synthetic oligonucleotide
  Target: ATXN1; (-) strand; PAM type: YTN; PAM sequence: CTT
acctatctcactctcccaaa

SEQ ID NO: 202113 - DNA, 20 bp, Artificial Sequence
  Description of Artificial Sequence: Synthetic oligonucleotide
  Target: ATXN1; (-) strand; PAM type: YTN; PAM sequence: TTC
ttacctatctcactctccca

SEQ ID NO: 202114 - DNA, 20 bp, Artificial Sequence
  Description of Artificial Sequence: Synthetic oligonucleotide
  Target: ATXN1; (-) strand; PAM type: YTN; PAM sequence: CTT
cttacctatctcactctccc

SEQ ID NO: 202115 - DNA, 20 bp, Artificial Sequence
  Description of Artificial Sequence: Synthetic oligonucleotide
  Target: ATXN1; (-) strand; PAM type: YTN; PAM sequence: CTC
ttcttacctatctcactctc

SEQ ID NO: 202116 - DNA, 20 bp, Artificial Sequence
  Description of Artificial Sequence: Synthetic oligonucleotide
  Target: ATXN1; (-) strand; PAM type: YTN; PAM sequence: CTC
tcttcttacctatctcactc

SEQ ID NO: 202117 - DNA, 20 bp, Artificial Sequence
  Description of Artificial Sequence: Synthetic oligonucleotide
  Target: ATXN1; (-) strand; PAM type: YTN; PAM sequence: CTC
tctcttcttacctatctcac

SEQ ID NO: 202118 - DNA, 20 bp, Artificial Sequence
  Description of Artificial Sequence: Synthetic oligonucleotide
  Target: ATXN1; (-) strand; PAM type: YTN; PAM sequence: CTC
ctctctcttcttacctatct

SEQ ID NO: 202119 - DNA, 20 bp, Artificial Sequence
  Description of Artificial Sequence: Synthetic oligonucleotide
  Target: ATXN1; (-) strand; PAM type: YTN; PAM sequence: TTC
acgatggcctcctctctctt

SEQ ID NO: 202120 - DNA, 20 bp, Artificial Sequence
  Description of Artificial Sequence: Synthetic oligonucleotide
  Target: ATXN1; (-) strand; PAM type: YTN; PAM sequence: CTT
cacgatggcctcctctctct

SEQ ID NO: 202121 - DNA, 20 bp, Artificial Sequence
  Description of Artificial Sequence: Synthetic oligonucleotide
  Target: ATXN1; (-) strand; PAM type: YTN; PAM sequence: TTC
gcttcacgatggcctcctct

SEQ ID NO: 202122 - DNA, 20 bp, Artificial Sequence
  Description of Artificial Sequence: Synthetic oligonucleotide
  Target: ATXN1; (-) strand; PAM type: YTN; PAM sequence: TTG
ttcgcttcacgatggcctcc

SEQ ID NO: 202123 - DNA, 20 bp, Artificial Sequence
  Description of Artificial Sequence: Synthetic oligonucleotide
  Target: ATXN1; (-) strand; PAM type: YTN; PAM sequence: TTT
gttcgcttcacgatggcctc

SEQ ID NO: 202124 - DNA, 20 bp, Artificial Sequence
  Description of Artificial Sequence: Synthetic oligonucleotide
  Target: ATXN1; (-) strand; PAM type: YTN; PAM sequence: TTA
cacatttgttcgcttcacga

SEQ ID NO: 202125 - DNA, 20 bp, Artificial Sequence
  Description of Artificial Sequence: Synthetic oligonucleotide
  Target: ATXN1; (-) strand; PAM type: YTN; PAM sequence: TTT
acacatttgttcgcttcacg

SEQ ID NO: 202126 - DNA, 20 bp, Artificial Sequence
  Description of Artificial Sequence: Synthetic oligonucleotide
  Target: ATXN1; (-) strand; PAM type: YTN; PAM sequence: TTT
tacacatttgttcgcttcac

SEQ ID NO: 202127 - DNA, 20 bp, Artificial Sequence
  Description of Artificial Sequence: Synthetic oligonucleotide
  Target: ATXN1; (-) strand; PAM type: YTN; PAM sequence: TTC
attttacacatttgttcgct

SEQ ID NO: 202128 - DNA, 20 bp, Artificial Sequence
  Description of Artificial Sequence: Synthetic oligonucleotide
  Target: ATXN1; (-) strand; PAM type: YTN; PAM sequence: TTT
cattttacacatttgttcgc

SEQ ID NO: 202129 - DNA, 20 bp, Artificial Sequence
  Description of Artificial Sequence: Synthetic oligonucleotide
  Target: ATXN1; (-) strand; PAM type: YTN; PAM sequence: TTT
tcattttacacatttgttcg

SEQ ID NO: 202130 - DNA, 20 bp, Artificial Sequence
  Description of Artificial Sequence: Synthetic oligonucleotide
  Target: ATXN1; (-) strand; PAM type: YTN; PAM sequence: TTT
ttcattttacacatttgttc

SEQ ID NO: 202131 - DNA, 20 bp, Artificial Sequence
  Description of Artificial Sequence: Synthetic oligonucleotide
  Target: ATXN1; (-) strand; PAM type: YTN; PAM sequence: TTT
tttcattttacacatttgtt

SEQ ID NO: 202132 - DNA, 20 bp, Artificial Sequence
  Description of Artificial Sequence: Synthetic oligonucleotide
  Target: ATXN1; (-) strand; PAM type: YTN; PAM sequence: TTT
ttttcattttacacatttgt

SEQ ID NO: 202133 - DNA, 20 bp, Artificial Sequence
  Description of Artificial Sequence: Synthetic oligonucleotide
  Target: ATXN1; (-) strand; PAM type: YTN; PAM sequence: TTT
tttttcattttacacatttg

SEQ ID NO: 202134 - DNA, 20 bp, Artificial Sequence
  Description of Artificial Sequence: Synthetic oligonucleotide
  Target: ATXN1; (-) strand; PAM type: YTN; PAM sequence: TTT
ttttttcattttacacattt

SEQ ID NO: 202135 - DNA, 20 bp, Artificial Sequence
  Description of Artificial Sequence: Synthetic oligonucleotide
  Target: ATXN1; (-) strand; PAM type: YTN; PAM sequence: TTG
taagtgatttttttttcatt

SEQ ID NO: 202136 - DNA, 20 bp, Artificial Sequence
  Description of Artificial Sequence: Synthetic oligonucleotide
  Target: ATXN1; (-) strand; PAM type: YTN; PAM sequence: TTA
agattgtaagtgattttttt

SEQ ID NO: 202137 - DNA, 20 bp, Artificial Sequence
  Description of Artificial Sequence: Synthetic oligonucleotide
  Target: ATXN1; (-) strand; PAM type: YTN; PAM sequence: TTA
caaattaagattgtaagtga

SEQ ID NO: 202138 - DNA, 20 bp, Artificial Sequence
  Description of Artificial Sequence: Synthetic oligonucleotide
  Target: ATXN1; (-) strand; PAM type: YTN; PAM sequence: TTA
ggtagttacaaattaagatt

SEQ ID NO: 202139 - DNA, 20 bp, Artificial Sequence
  Description of Artificial Sequence: Synthetic oligonucleotide
  Target: ATXN1; (-) strand; PAM type: YTN; PAM sequence: TTT
aggtagttacaaattaagat

SEQ ID NO: 202140 - DNA, 20 bp, Artificial Sequence
  Description of Artificial Sequence: Synthetic oligonucleotide
  Target: ATXN1; (-) strand; PAM type: YTN; PAM sequence: TTT
taggtagttacaaattaaga

SEQ ID NO: 202141 - DNA, 20 bp, Artificial Sequence
  Description of Artificial Sequence: Synthetic oligonucleotide
  Target: ATXN1; (-) strand; PAM type: YTN; PAM sequence: CTT
ttaggtagttacaaattaag

SEQ ID NO: 202142 - DNA, 20 bp, Artificial Sequence
  Description of Artificial Sequence: Synthetic oligonucleotide
  Target: ATXN1; (-) strand; PAM type: YTN; PAM sequence: CTA
cttttaggtagttacaaatt

SEQ ID NO: 202143 - DNA, 20 bp, Artificial Sequence
  Description of Artificial Sequence: Synthetic oligonucleotide
  Target: ATXN1; (-) strand; PAM type: YTN; PAM sequence: CTG
tgcagcctacttttaggtag

SEQ ID NO: 202144 - DNA, 20 bp, Artificial Sequence
  Description of Artificial Sequence: Synthetic oligonucleotide
  Target: ATXN1; (-) strand; PAM type: YTN; PAM sequence: CTC
tgtgcagcctacttttaggt

SEQ ID NO: 202145 - DNA, 20 bp, Artificial Sequence
  Description of Artificial Sequence: Synthetic oligonucleotide
  Target: ATXN1; (-) strand; PAM type: YTN; PAM sequence: TTC
tctgtgcagcctacttttag

SEQ ID NO: 202146 - DNA, 20 bp, Artificial Sequence
  Description of Artificial Sequence: Synthetic oligonucleotide
  Target: ATXN1; (-) strand; PAM type: YTN; PAM sequence: TTT
ctctgtgcagcctactttta

SEQ ID NO: 202147 - DNA, 20 bp, Artificial Sequence
  Description of Artificial Sequence: Synthetic oligonucleotide
  Target: ATXN1; (-) strand; PAM type: YTN; PAM sequence: TTC
atttctctgtgcagcctact

SEQ ID NO: 202148 - DNA, 20 bp, Artificial Sequence
  Description of Artificial Sequence: Synthetic oligonucleotide
  Target: ATXN1; (-) strand; PAM type: YTN; PAM sequence: TTT
catttctctgtgcagcctac

SEQ ID NO: 202149 - DNA, 20 bp, Artificial Sequence
  Description of Artificial Sequence: Synthetic oligonucleotide
  Target: ATXN1; (-) strand; PAM type: YTN; PAM sequence: TTG
tgtagacatagtttcatttc

SEQ ID NO: 202150 - DNA, 20 bp, Artificial Sequence
  Description of Artificial Sequence: Synthetic oligonucleotide
  Target: ATXN1; (-) strand; PAM type: YTN; PAM sequence: TTT
gtgtagacatagtttcattt

SEQ ID NO: 202151 - DNA, 20 bp, Artificial Sequence
  Description of Artificial Sequence: Synthetic oligonucleotide
  Target: ATXN1; (-) strand; PAM type: YTN; PAM sequence: TTT
tgtgtagacatagtttcatt

SEQ ID NO: 202152 - DNA, 20 bp, Artificial Sequence
  Description of Artificial Sequence: Synthetic oligonucleotide
  Target: ATXN1; (-) strand; PAM type: YTN; PAM sequence: TTT
ttgtgtagacatagtttcat

SEQ ID NO: 202153 - DNA, 20 bp, Artificial Sequence
  Description of Artificial Sequence: Synthetic oligonucleotide
  Target: ATXN1; (-) strand; PAM type: YTN; PAM sequence: TTC
caagtttttgtgtagacata

SEQ ID NO: 202154 - DNA, 20 bp, Artificial Sequence
  Description of Artificial Sequence: Synthetic oligonucleotide
  Target: ATXN1; (-) strand; PAM type: YTN; PAM sequence: TTT
ccaagtttttgtgtagacat

SEQ ID NO: 202155 - DNA, 20 bp, Artificial Sequence
  Description of Artificial Sequence: Synthetic oligonucleotide
  Target: ATXN1; (-) strand; PAM type: YTN; PAM sequence: CTT
tccaagtttttgtgtagaca

SEQ ID NO: 202156 - DNA, 20 bp, Artificial Sequence
  Description of Artificial Sequence: Synthetic oligonucleotide
  Target: ATXN1; (-) strand; PAM type: YTN; PAM sequence: TTC
ctttccaagtttttgtgtag

SEQ ID NO: 202157 - DNA, 20 bp, Artificial Sequence
  Description of Artificial Sequence: Synthetic oligonucleotide
  Target: ATXN1; (-) strand; PAM type: YTN; PAM sequence: CTA
tgaacattcctttccaagtt

SEQ ID NO: 202158 - DNA, 20 bp, Artificial Sequence
  Description of Artificial Sequence: Synthetic oligonucleotide
  Target: ATXN1; (-) strand; PAM type: YTN; PAM sequence: CTG
ctatgaacattcctttccaa

SEQ ID NO: 202159 - DNA, 20 bp, Artificial Sequence
  Description of Artificial Sequence: Synthetic oligonucleotide
  Target: ATXN1; (-) strand; PAM type: YTN; PAM sequence: TTA
tgaacagtgctgctatgaac

SEQ ID NO: 202160 - DNA, 20 bp, Artificial Sequence
  Description of Artificial Sequence: Synthetic oligonucleotide
  Target: ATXN1; (-) strand; PAM type: YTN; PAM sequence: CTA
ttatgaacagtgctgctatg

SEQ ID NO: 202161 - DNA, 20 bp, Artificial Sequence
  Description of Artificial Sequence: Synthetic oligonucleotide
  Target: ATXN1; (-) strand; PAM type: YTN; PAM sequence: TTC
actattatgaacagtgctgc

SEQ ID NO: 202162 - DNA, 20 bp, Artificial Sequence
  Description of Artificial Sequence: Synthetic oligonucleotide
  Target: ATXN1; (-) strand; PAM type: YTN; PAM sequence: TTT
cactattatgaacagtgctg

SEQ ID NO: 202163 - DNA, 20 bp, Artificial Sequence
  Description of Artificial Sequence: Synthetic oligonucleotide
  Target: ATXN1; (-) strand; PAM type: YTN; PAM sequence: CTT
tcactattatgaacagtgct

SEQ ID NO: 202164 - DNA, 20 bp, Artificial Sequence
  Description of Artificial Sequence: Synthetic oligonucleotide
  Target: ATXN1; (-) strand; PAM type: YTN; PAM sequence: CTC
tttcactattatgaacagtg

SEQ ID NO: 202165 - DNA, 20 bp, Artificial Sequence
  Description of Artificial Sequence: Synthetic oligonucleotide
  Target: ATXN1; (-) strand; PAM type: YTN; PAM sequence: CTC
cactctttcactattatgaa

SEQ ID NO: 202166 - DNA, 20 bp, Artificial Sequence
  Description of Artificial Sequence: Synthetic oligonucleotide
  Target: ATXN1; (-) strand; PAM type: YTN; PAM sequence: TTG
tctccactctttcactatta

SEQ ID NO: 202167 - DNA, 20 bp, Artificial Sequence
  Description of Artificial Sequence: Synthetic oligonucleotide
  Target: ATXN1; (-) strand; PAM type: YTN; PAM sequence: TTG
ggttgtctccactctttcac

SEQ ID NO: 202168 - DNA, 20 bp, Artificial Sequence
  Description of Artificial Sequence: Synthetic oligonucleotide
  Target: ATXN1; (-) strand; PAM type: YTN; PAM sequence: TTT
gggttgtctccactctttca

SEQ ID NO: 202169 - DNA, 20 bp, Artificial Sequence
  Description of Artificial Sequence: Synthetic oligonucleotide
  Target: ATXN1; (-) strand; PAM type: YTN; PAM sequence: TTG
atggacatttgggttgtctc

SEQ ID NO: 202170 - DNA, 20 bp, Artificial Sequence
  Description of Artificial Sequence: Synthetic oligonucleotide
  Target: ATXN1; (-) strand; PAM type: YTN; PAM sequence: TTA
tcagttgatggacatttggg

SEQ ID NO: 202171 - DNA, 20 bp, Artificial Sequence
  Description of Artificial Sequence: Synthetic oligonucleotide
  Target: ATXN1; (-) strand; PAM type: YTN; PAM sequence: TTT
atcagttgatggacatttgg

SEQ ID NO: 202172 - DNA, 20 bp, Artificial Sequence
  Description of Artificial Sequence: Synthetic oligonucleotide
  Target: ATXN1; (-) strand; PAM type: YTN; PAM sequence: TTC
atttatcagttgatggacat

SEQ ID NO: 202173 - DNA, 20 bp, Artificial Sequence
  Description of Artificial Sequence: Synthetic oligonucleotide
  Target: ATXN1; (-) strand; PAM type: YTN; PAM sequence: TTA
ttcatttatcagttgatgga

SEQ ID NO: 202174 - DNA, 20 bp, Artificial Sequence
  Description of Artificial Sequence: Synthetic oligonucleotide
  Target: ATXN1; (-) strand; PAM type: YTN; PAM sequence: TTT
attcatttatcagttgatgg

SEQ ID NO: 202175 - DNA, 20 bp, Artificial Sequence
  Description of Artificial Sequence: Synthetic oligonucleotide
  Target: ATXN1; (-) strand; PAM type: YTN; PAM sequence: TTG
tttattcatttatcagttga

SEQ ID NO: 202176 - DNA, 20 bp, Artificial Sequence
  Description of Artificial Sequence: Synthetic oligonucleotide
  Target: ATXN1; (-) strand; PAM type: YTN; PAM sequence: TTT
gtttattcatttatcagttg

SEQ ID NO: 202177 - DNA, 20 bp, Artificial Sequence
  Description of Artificial Sequence: Synthetic oligonucleotide
  Target: ATXN1; (-) strand; PAM type: YTN; PAM sequence: TTT
tgtttattcatttatcagtt

SEQ ID NO: 202178 - DNA, 20 bp, Artificial Sequence
  Description of Artificial Sequence: Synthetic oligonucleotide
  Target: ATXN1; (-) strand; PAM type: YTN; PAM sequence: TTA
ttttgtttattcatttatca

SEQ ID NO: 202179 - DNA, 20 bp, Artificial Sequence
  Description of Artificial Sequence: Synthetic oligonucleotide
  Target: ATXN1; (-) strand; PAM type: YTN; PAM sequence: CTT
attttgtttattcatttatc

SEQ ID NO: 202180 - DNA, 20 bp, Artificial Sequence
  Description of Artificial Sequence: Synthetic oligonucleotide
  Target: ATXN1; (-) strand; PAM type: YTN; PAM sequence: CTA
taccttattttgtttattca

SEQ ID NO: 202181 - DNA, 20 bp, Artificial Sequence
  Description of Artificial Sequence: Synthetic oligonucleotide
  Target: ATXN1; (-) strand; PAM type: YTN; PAM sequence: TTG
tatggctataccttattttg

SEQ ID NO: 202182 - DNA, 20 bp, Artificial Sequence
  Description of Artificial Sequence: Synthetic oligonucleotide
  Target: ATXN1; (-) strand; PAM type: YTN; PAM sequence: TTA
tgatggaataatgtaacatt

SEQ ID NO: 202183 - DNA, 20 bp, Artificial Sequence
  Description of Artificial Sequence: Synthetic oligonucleotide
  Target: ATXN1; (-) strand; PAM type: YTN; PAM sequence: TTG
ttatgatggaataatgtaac

SEQ ID NO: 202184 - DNA, 20 bp, Artificial Sequence
  Description of Artificial Sequence: Synthetic oligonucleotide
  Target: ATXN1; (-) strand; PAM type: YTN; PAM sequence: CTT
gttatgatggaataatgtaa

SEQ ID NO: 202185 - DNA, 20 bp, Artificial Sequence
  Description of Artificial Sequence: Synthetic oligonucleotide
  Target: ATXN1; (-) strand; PAM type: YTN; PAM sequence: TTC
ttgttatgatggaataatgt

SEQ ID NO: 202186 - DNA, 20 bp, Artificial Sequence
  Description of Artificial Sequence: Synthetic oligonucleotide
  Target: ATXN1; (-) strand; PAM type: YTN; PAM sequence: TTT
cttgttatgatggaataatg

SEQ ID NO: 202187 - DNA, 20 bp, Artificial Sequence
  Description of Artificial Sequence: Synthetic oligonucleotide
  Target: ATXN1; (-) strand; PAM type: YTN; PAM sequence: TTC
atttcttgttatgatggaat

SEQ ID NO: 202188 - DNA, 20 bp, Artificial Sequence
  Description of Artificial Sequence: Synthetic oligonucleotide
  Target: ATXN1; (-) strand; PAM type: YTN; PAM sequence: TTC
agcatacatcagtcattcat

SEQ ID NO: 202189 - DNA, 20 bp, Artificial Sequence
  Description of Artificial Sequence: Synthetic oligonucleotide
  Target: ATXN1; (-) strand; PAM type: YTN; PAM sequence: TTT
cagcatacatcagtcattca

SEQ ID NO: 202190 - DNA, 20 bp, Artificial Sequence
  Description of Artificial Sequence: Synthetic oligonucleotide
  Target: ATXN1; (-) strand; PAM type: YTN; PAM sequence: TTC
aaggatcatccacatttcag

SEQ ID NO: 202191 - DNA, 20 bp, Artificial Sequence
  Description of Artificial Sequence: Synthetic oligonucleotide
  Target: ATXN1; (-) strand; PAM type: YTN; PAM sequence: TTT
caaggatcatccacatttca

SEQ ID NO: 202192 - DNA, 20 bp, Artificial Sequence
  Description of Artificial Sequence: Synthetic oligonucleotide
  Target: ATXN1; (-) strand; PAM type: YTN; PAM sequence: CTT
tcaaggatcatccacatttc

SEQ ID NO: 202193 - DNA, 20 bp, Artificial Sequence
  Description of Artificial Sequence: Synthetic oligonucleotide
  Target: ATXN1; (-) strand; PAM type: YTN; PAM sequence: TTA
gcataatgctttcaaggatc

SEQ ID NO: 202194 - DNA, 20 bp, Artificial Sequence
  Description of Artificial Sequence: Synthetic oligonucleotide
  Target: ATXN1; (-) strand; PAM type: YTN; PAM sequence: CTT
agcataatgctttcaaggat

SEQ ID NO: 202195 - DNA, 20 bp, Artificial Sequence
  Description of Artificial Sequence: Synthetic oligonucleotide
  Target: ATXN1; (-) strand; PAM type: YTN; PAM sequence: TTC
acttagcataatgctttcaa

SEQ ID NO: 202196 - DNA, 20 bp, Artificial Sequence
  Description of Artificial Sequence: Synthetic oligonucleotide
  Target: ATXN1; (-) strand; PAM type: YTN; PAM sequence: TTT
cacttagcataatgctttca

SEQ ID NO: 202197 - DNA, 20 bp, Artificial Sequence
  Description of Artificial Sequence: Synthetic oligonucleotide
  Target: ATXN1; (-) strand; PAM type: YTN; PAM sequence: CTT
tcacttagcataatgctttc

SEQ ID NO: 202198 - DNA, 20 bp, Artificial Sequence
  Description of Artificial Sequence: Synthetic oligonucleotide
  Target: ATXN1; (-) strand; PAM type: YTN; PAM sequence: TTC
tttcacttagcataatgctt

SEQ ID NO: 202199 - DNA, 20 bp, Artificial Sequence
  Description of Artificial Sequence: Synthetic oligonucleotide
  Target: ATXN1; (-) strand; PAM type: YTN; PAM sequence: CTT
ctttcacttagcataatgct

SEQ ID NO: 202200 - DNA, 20 bp, Artificial Sequence
  Description of Artificial Sequence: Synthetic oligonucleotide
  Target: ATXN1; (-) strand; PAM type: YTN; PAM sequence: CTG
acttctttcacttagcataa

SEQ ID NO: 202201 - DNA, 20 bp, Artificial Sequence
  Description of Artificial Sequence: Synthetic oligonucleotide
  Target: ATXN1; (-) strand; PAM type: YTN; PAM sequence: CTG
tgactgacttctttcactta

SEQ ID NO: 202202 - DNA, 20 bp, Artificial Sequence
  Description of Artificial Sequence: Synthetic oligonucleotide
  Target: ATXN1; (-) strand; PAM type: YTN; PAM sequence: TTC
tgtgactgacttctttcact

SEQ ID NO: 202203 - DNA, 20 bp, Artificial Sequence
  Description of Artificial Sequence: Synthetic oligonucleotide
  Target: ATXN1; (-) strand; PAM type: YTN; PAM sequence: CTT
ctgtgactgacttctttcac

SEQ ID NO: 202204 - DNA, 20 bp, Artificial Sequence
  Description of Artificial Sequence: Synthetic oligonucleotide
  Target: ATXN1; (-) strand; PAM type: YTN; PAM sequence: TTC
catataaatagaatcatgca

SEQ ID NO: 202205 - DNA, 20 bp, Artificial Sequence
  Description of Artificial Sequence: Synthetic oligonucleotide
  Target: ATXN1; (-) strand; PAM type: YTN; PAM sequence: CTA
gacattccatataaatagaa

SEQ ID NO: 202206 - DNA, 20 bp, Artificial Sequence
  Description of Artificial Sequence: Synthetic oligonucleotide
  Target: ATXN1; (-) strand; PAM type: YTN; PAM sequence: TTC
tagacattccatataaatag

SEQ ID NO: 202207 - DNA, 20 bp, Artificial Sequence
  Description of Artificial Sequence: Synthetic oligonucleotide
  Target: ATXN1; (-) strand; PAM type: YTN; PAM sequence: TTG
ttctagacattccatataaa

SEQ ID NO: 202208 - DNA, 20 bp, Artificial Sequence
  Description of Artificial Sequence: Synthetic oligonucleotide
  Target: ATXN1; (-) strand; PAM type: YTN; PAM sequence: CTT
gttctagacattccatataa

SEQ ID NO: 202209 - DNA, 20 bp, Artificial Sequence
  Description of Artificial Sequence: Synthetic oligonucleotide
  Target: ATXN1; (-) strand; PAM type: YTN; PAM sequence: TTG
cttgttctagacattccata

SEQ ID NO: 202210 - DNA, 20 bp, Artificial Sequence
  Description of Artificial Sequence: Synthetic oligonucleotide
  Target: ATXN1; (-) strand; PAM type: YTN; PAM sequence: TTT
gcttgttctagacattccat

SEQ ID NO: 202211 - DNA, 20 bp, Artificial Sequence
  Description of Artificial Sequence: Synthetic oligonucleotide
  Target: ATXN1; (-) strand; PAM type: YTN; PAM sequence: CTA
tatatagatttgcttgttct

SEQ ID NO: 202212 - DNA, 20 bp, Artificial Sequence
  Description of Artificial Sequence: Synthetic oligonucleotide
  Target: ATXN1; (-) strand; PAM type: YTN; PAM sequence: CTC
tatatatagatttgcttgtt

SEQ ID NO: 202213 - DNA, 20 bp, Artificial Sequence
  Description of Artificial Sequence: Synthetic oligonucleotide
  Target: ATXN1; (-) strand; PAM type: YTN; PAM sequence: TTC
tctatatatagatttgcttg

SEQ ID NO: 202214 - DNA, 20 bp, Artificial Sequence
  Description of Artificial Sequence: Synthetic oligonucleotide
  Target: ATXN1; (-) strand; PAM type: YTN; PAM sequence: TTT
ctctatatatagatttgctt

SEQ ID NO: 202215 - DNA, 20 bp, Artificial Sequence
  Description of Artificial Sequence: Synthetic oligonucleotide
  Target: ATXN1; (-) strand; PAM type: YTN; PAM sequence: CTG
tttctctatatatagatttg

SEQ ID NO: 202216 - DNA, 20 bp, Artificial Sequence
  Description of Artificial Sequence: Synthetic oligonucleotide
  Target: ATXN1; (-) strand; PAM type: YTN; PAM sequence: CTG
gcaaccacgaagctgtttct

SEQ ID NO: 202217 - DNA, 20 bp, Artificial Sequence
  Description of Artificial Sequence: Synthetic oligonucleotide
  Target: ATXN1; (-) strand; PAM type: YTN; PAM sequence: CTC
ctggcaaccacgaagctgtt

SEQ ID NO: 202218 - DNA, 20 bp, Artificial Sequence
  Description of Artificial Sequence: Synthetic oligonucleotide
  Target: ATXN1; (-) strand; PAM type: YTN; PAM sequence: CTC
agctcctggcaaccacgaag

SEQ ID NO: 202219 - DNA, 20 bp, Artificial Sequence
  Description of Artificial Sequence: Synthetic oligonucleotide
  Target: ATXN1; (-) strand; PAM type: YTN; PAM sequence: CTA
ccctcagctcctggcaacca

SEQ ID NO: 202220 - DNA, 20 bp, Artificial Sequence
  Description of Artificial Sequence: Synthetic oligonucleotide
  Target: ATXN1; (-) strand; PAM type: YTN; PAM sequence: CTC
taccctcagctcctggcaac

SEQ ID NO: 202221 - DNA, 20 bp, Artificial Sequence
  Description of Artificial Sequence: Synthetic oligonucleotide
  Target: ATXN1; (-) strand; PAM type: YTN; PAM sequence: TTC
ccccaatcctctaccctcag

SEQ ID NO: 202222 - DNA, 20 bp, Artificial Sequence
  Description of Artificial Sequence: Synthetic oligonucleotide
  Target: ATXN1; (-) strand; PAM type: YTN; PAM sequence: TTT
cccccaatcctctaccctca

SEQ ID NO: 202223 - DNA, 20 bp, Artificial Sequence
  Description of Artificial Sequence: Synthetic oligonucleotide
  Target: ATXN1; (-) strand; PAM type: YTN; PAM sequence: TTT
tcccccaatcctctaccctc

SEQ ID NO: 202224 - DNA, 20 bp, Artificial Sequence
  Description of Artificial Sequence: Synthetic oligonucleotide
  Target: ATXN1; (-) strand; PAM type: YTN; PAM sequence: TTC
ccattttcccccaatcctct

SEQ ID NO: 202225 - DNA, 20 bp, Artificial Sequence
  Description of Artificial Sequence: Synthetic oligonucleotide
  Target: ATXN1; (-) strand; PAM type: YTN; PAM sequence: CTT
cccattttcccccaatcctc

SEQ ID NO: 202226 - DNA, 20 bp, Artificial Sequence
  Description of Artificial Sequence: Synthetic oligonucleotide
  Target: ATXN1; (-) strand; PAM type: YTN; PAM sequence: CTA
aaggaaatcccatacccatc

SEQ ID NO: 202227 - DNA, 20 bp, Artificial Sequence
  Description of Artificial Sequence: Synthetic oligonucleotide
  Target: ATXN1; (-) strand; PAM type: YTN; PAM sequence: TTC
atcacccctaaaggaaatcc

SEQ ID NO: 202228 - DNA, 20 bp, Artificial Sequence
  Description of Artificial Sequence: Synthetic oligonucleotide
  Target: ATXN1; (-) strand; PAM type: YTN; PAM sequence: TTT
catcacccctaaaggaaatc

SEQ ID NO: 202229 - DNA, 20 bp, Artificial Sequence
  Description of Artificial Sequence: Synthetic oligonucleotide
  Target: ATXN1; (-) strand; PAM type: YTN; PAM sequence: TTT
tcatcacccctaaaggaaat

SEQ ID NO: 202230 - DNA, 20 bp, Artificial Sequence
  Description of Artificial Sequence: Synthetic oligonucleotide
  Target: ATXN1; (-) strand; PAM type: YTN; PAM sequence: TTA
gaacattttcatcaccccta

SEQ ID NO: 202231 - DNA, 20 bp, Artificial Sequence
  Description of Artificial Sequence: Synthetic oligonucleotide
  Target: ATXN1; (-) strand; PAM type: YTN; PAM sequence: TTT
agaacattttcatcacccct

SEQ ID NO: 202232 - DNA, 20 bp, Artificial Sequence
  Description of Artificial Sequence: Synthetic oligonucleotide
  Target: ATXN1; (-) strand; PAM type: YTN; PAM sequence: TTT
tagaacattttcatcacccc

SEQ ID NO: 202233 - DNA, 20 bp, Artificial Sequence
  Description of Artificial Sequence: Synthetic oligonucleotide
  Target: ATXN1; (-) strand; PAM type: YTN; PAM sequence: CTA
tcaccacaataaattttaga

SEQ ID NO: 202234 - DNA, 20 bp, Artificial Sequence
  Description of Artificial Sequence: Synthetic oligonucleotide
  Target: ATXN1; (-) strand; PAM type: YTN; PAM sequence: CTG
tgcagctatcaccacaataa

SEQ ID NO: 202235 - DNA, 20 bp, Artificial Sequence
  Description of Artificial Sequence: Synthetic oligonucleotide
  Target: ATXN1; (-) strand; PAM type: YTN; PAM sequence: TTA
cagagctgtgcagctatcac

SEQ ID NO: 202236 - DNA, 20 bp, Artificial Sequence
  Description of Artificial Sequence: Synthetic oligonucleotide
  Target: ATXN1; (-) strand; PAM type: YTN; PAM sequence: TTT
acagagctgtgcagctatca

SEQ ID NO: 202237 - DNA, 20 bp, Artificial Sequence
  Description of Artificial Sequence: Synthetic oligonucleotide
  Target: ATXN1; (-) strand; PAM type: YTN; PAM sequence: TTA
gtgtatttacagagctgtgc

SEQ ID NO: 202238 - DNA, 20 bp, Artificial Sequence
  Description of Artificial Sequence: Synthetic oligonucleotide
  Target: ATXN1; (-) strand; PAM type: YTN; PAM sequence: TTT
agtgtatttacagagctgtg

SEQ ID NO: 202239 - DNA, 20 bp, Artificial Sequence
  Description of Artificial Sequence: Synthetic oligonucleotide
  Target: ATXN1; (-) strand; PAM type: YTN; PAM sequence: TTT
tagtgtatttacagagctgt

SEQ ID NO: 202240 - DNA, 20 bp, Artificial Sequence
  Description of Artificial Sequence: Synthetic oligonucleotide
  Target: ATXN1; (-) strand; PAM type: YTN; PAM sequence: TTT
ttagtgtatttacagagctg

SEQ ID NO: 202241 - DNA, 20 bp, Artificial Sequence
  Description of Artificial Sequence: Synthetic oligonucleotide
  Target: ATXN1; (-) strand; PAM type: YTN; PAM sequence: CTT
tttagtgtatttacagagct

SEQ ID NO: 202242 - DNA, 20 bp, Artificial Sequence
  Description of Artificial Sequence: Synthetic oligonucleotide
  Target: ATXN1; (-) strand; PAM type: YTN; PAM sequence: TTG
ctttttagtgtatttacaga

SEQ ID NO: 202243 - DNA, 20 bp, Artificial Sequence
  Description of Artificial Sequence: Synthetic oligonucleotide
  Target: ATXN1; (-) strand; PAM type: YTN; PAM sequence: TTA
aaaaaaaaagtgcaatgaat

SEQ ID NO: 202244 - DNA, 20 bp, Artificial Sequence
  Description of Artificial Sequence: Synthetic oligonucleotide
  Target: ATXN1; (-) strand; PAM type: YTN; PAM sequence: TTA
aattaaaaaaaaaagtgcaa

SEQ ID NO: 202245 - DNA, 20 bp, Artificial Sequence
  Description of Artificial Sequence: Synthetic oligonucleotide
  Target: ATXN1; (-) strand; PAM type: YTN; PAM sequence: TTT
aaattaaaaaaaaaagtgca

SEQ ID NO: 202246 - DNA, 20 bp, Artificial Sequence
  Description of Artificial Sequence: Synthetic oligonucleotide
  Target: ATXN1; (-) strand; PAM type: YTN; PAM sequence: TTA
tttaaattaaaaaaaaaagt

SEQ ID NO: 202247 - DNA, 20 bp, Artificial Sequence
  Description of Artificial Sequence: Synthetic oligonucleotide
  Target: ATXN1; (-) strand; PAM type: YTN; PAM sequence: CTT
atttaaattaaaaaaaaaag

SEQ ID NO: 202248 - DNA, 20 bp, Artificial Sequence
  Description of Artificial Sequence: Synthetic oligonucleotide
  Target: ATXN1; (-) strand; PAM type: YTN; PAM sequence: CTG
catagcttatttaaattaaa

SEQ ID NO: 202249 - DNA, 20 bp, Artificial Sequence
  Description of Artificial Sequence: Synthetic oligonucleotide
  Target: ATXN1; (-) strand; PAM type: YTN; PAM sequence: TTG
aggactgcatagcttattta

SEQ ID NO: 202250 - DNA, 20 bp, Artificial Sequence
  Description of Artificial Sequence: Synthetic oligonucleotide
  Target: ATXN1; (-) strand; PAM type: YTN; PAM sequence: TTC
aggagatggggagcaggagg

SEQ ID NO: 202251 - DNA, 20 bp, Artificial Sequence
  Description of Artificial Sequence: Synthetic oligonucleotide
  Target: ATXN1; (-) strand; PAM type: YTN; PAM sequence: TTA
ttcaggagatggggagcagg

SEQ ID NO: 202252 - DNA, 20 bp, Artificial Sequence
  Description of Artificial Sequence: Synthetic oligonucleotide
  Target: ATXN1; (-) strand; PAM type: YTN; PAM sequence: TTT
attcaggagatggggagcag

SEQ ID NO: 202253 - DNA, 20 bp, Artificial Sequence
  Description of Artificial Sequence: Synthetic oligonucleotide
  Target: ATXN1; (-) strand; PAM type: YTN; PAM sequence: TTG
tttattcaggagatggggag

SEQ ID NO: 202254 - DNA, 20 bp, Artificial Sequence
  Description of Artificial Sequence: Synthetic oligonucleotide
  Target: ATXN1; (-) strand; PAM type: YTN; PAM sequence: CTT
gtttattcaggagatgggga

SEQ ID NO: 202255 - DNA, 20 bp, Artificial Sequence
  Description of Artificial Sequence: Synthetic oligonucleotide
  Target: ATXN1; (-) strand; PAM type: YTN; PAM sequence: CTC
acccagggaagaaagtcttg

SEQ ID NO: 202256 - DNA, 20 bp, Artificial Sequence
  Description of Artificial Sequence: Synthetic oligonucleotide
  Target: ATXN1; (-) strand; PAM type: YTN; PAM sequence: CTA
tcaagaccctcacccaggga

SEQ ID NO: 202257 - DNA, 20 bp, Artificial Sequence
  Description of Artificial Sequence: Synthetic oligonucleotide
  Target: ATXN1; (-) strand; PAM type: YTN; PAM sequence: CTA
cctatcaagaccctcaccca

SEQ ID NO: 202258 - DNA, 20 bp, Artificial Sequence
  Description of Artificial Sequence: Synthetic oligonucleotide
  Target: ATXN1; (-) strand; PAM type: YTN; PAM sequence: TTC
tacctatcaagaccctcacc

SEQ ID NO: 202259 - DNA, 20 bp, Artificial Sequence
  Description of Artificial Sequence: Synthetic oligonucleotide
  Target: ATXN1; (-) strand; PAM type: YTN; PAM sequence: TTC
cgtgtacagtattctaccta

SEQ ID NO: 202260 - DNA, 20 bp, Artificial Sequence
  Description of Artificial Sequence: Synthetic oligonucleotide
  Target: ATXN1; (-) strand; PAM type: YTN; PAM sequence: CTG
tattccgtgtacagtattct

SEQ ID NO: 202261 - DNA, 20 bp, Artificial Sequence
  Description of Artificial Sequence: Synthetic oligonucleotide
  Target: ATXN1; (-) strand; PAM type: YTN; PAM sequence: TTC
tgtattccgtgtacagtatt

SEQ ID NO: 202262 - DNA, 20 bp, Artificial Sequence
  Description of Artificial Sequence: Synthetic oligonucleotide
  Target: ATXN1; (-) strand; PAM type: YTN; PAM sequence: TTG
aattctgtattccgtgtaca

SEQ ID NO: 202263 - DNA, 20 bp, Artificial Sequence
  Description of Artificial Sequence: Synthetic oligonucleotide
  Target: ATXN1; (-) strand; PAM type: YTN; PAM sequence: CTT
gaattctgtattccgtgtac

SEQ ID NO: 202264 - DNA, 20 bp, Artificial Sequence
  Description of Artificial Sequence: Synthetic oligonucleotide
  Target: ATXN1; (-) strand; PAM type: YTN; PAM sequence: CTG
cttgaattctgtattccgtg

SEQ ID NO: 202265 - DNA, 20 bp, Artificial Sequence
  Description of Artificial Sequence: Synthetic oligonucleotide
  Target: ATXN1; (-) strand; PAM type: YTN; PAM sequence: TTC
ataagtcaaggaactgcttg

SEQ ID NO: 202266 - DNA, 20 bp, Artificial Sequence
  Description of Artificial Sequence: Synthetic oligonucleotide
  Target: ATXN1; (-) strand; PAM type: YTN; PAM sequence: CTG
atattcataagtcaaggaac

SEQ ID NO: 202267 - DNA, 20 bp, Artificial Sequence
  Description of Artificial Sequence: Synthetic oligonucleotide
  Target: ATXN1; (-) strand; PAM type: YTN; PAM sequence: TTC
tgatattcataagtcaagga

SEQ ID NO: 202268 - DNA, 20 bp, Artificial Sequence
  Description of Artificial Sequence: Synthetic oligonucleotide
  Target: ATXN1; (-) strand; PAM type: YTN; PAM sequence: CTT
ctgatattcataagtcaagg

SEQ ID NO: 202269 - DNA, 20 bp, Artificial Sequence
  Description of Artificial Sequence: Synthetic oligonucleotide
  Target: ATXN1; (-) strand; PAM type: YTN; PAM sequence: CTG
agaaagaggatggacatctt

SEQ ID NO: 202270 - DNA, 20 bp, Artificial Sequence
  Description of Artificial Sequence: Synthetic oligonucleotide
  Target: ATXN1; (-) strand; PAM type: YTN; PAM sequence: CTC
ctgagaaagaggatggacat

SEQ ID NO: 202271 - DNA, 20 bp, Artificial Sequence
  Description of Artificial Sequence: Synthetic oligonucleotide
  Target: ATXN1; (-) strand; PAM type: YTN; PAM sequence: CTG
gaaatgtctcctgagaaaga

SEQ ID NO: 202272 - DNA, 20 bp, Artificial Sequence
  Description of Artificial Sequence: Synthetic oligonucleotide
  Target: ATXN1; (-) strand; PAM type: YTN; PAM sequence: CTG
gcatccacctggaaatgtct

SEQ ID NO: 202273 - DNA, 20 bp, Artificial Sequence
  Description of Artificial Sequence: Synthetic oligonucleotide
  Target: ATXN1; (-) strand; PAM type: YTN; PAM sequence: CTC
tggcatccacctggaaatgt

SEQ ID NO: 202274 - DNA, 20 bp, Artificial Sequence
  Description of Artificial Sequence: Synthetic oligonucleotide
  Target: ATXN1; (-) strand; PAM type: YTN; PAM sequence: CTC
ctctggcatccacctggaaa

SEQ ID NO: 202275 - DNA, 20 bp, Artificial Sequence
  Description of Artificial Sequence: Synthetic oligonucleotide
  Target: ATXN1; (-) strand; PAM type: YTN; PAM sequence: TTA
aagaagcagatgggaagaag

SEQ ID NO: 202276 - DNA, 20 bp, Artificial Sequence
  Description of Artificial Sequence: Synthetic oligonucleotide
  Target: ATXN1; (-) strand; PAM type: YTN; PAM sequence: TTT
aaagaagcagatgggaagaa

SEQ ID NO: 202277 - DNA, 20 bp, Artificial Sequence
  Description of Artificial Sequence: Synthetic oligonucleotide
  Target: ATXN1; (-) strand; PAM type: YTN; PAM sequence: CTA
agatttaaagaagcagatgg

SEQ ID NO: 202278 - DNA, 20 bp, Artificial Sequence
  Description of Artificial Sequence: Synthetic oligonucleotide
  Target: ATXN1; (-) strand; PAM type: YTN; PAM sequence: CTC
atatggggaaacagaatgca

SEQ ID NO: 202279 - DNA, 20 bp, Artificial Sequence
  Description of Artificial Sequence: Synthetic oligonucleotide
  Target: ATXN1; (-) strand; PAM type: YTN; PAM sequence: CTA
tgctcatatggggaaacaga

SEQ ID NO: 202280 - DNA, 20 bp, Artificial Sequence
  Description of Artificial Sequence: Synthetic oligonucleotide
  Target: ATXN1; (-) strand; PAM type: YTN; PAM sequence: TTA
accactatgctcatatgggg

SEQ ID NO: 202281 - DNA, 20 bp, Artificial Sequence
  Description of Artificial Sequence: Synthetic oligonucleotide
  Target: ATXN1; (-) strand; PAM type: YTN; PAM sequence: TTT
aaccactatgctcatatggg

SEQ ID NO: 202282 - DNA, 20 bp, Artificial Sequence
  Description of Artificial Sequence: Synthetic oligonucleotide
  Target: ATXN1; (-) strand; PAM type: YTN; PAM sequence: TTT
taaccactatgctcatatgg

SEQ ID NO: 202283 - DNA, 20 bp, Artificial Sequence
  Description of Artificial Sequence: Synthetic oligonucleotide
  Target: ATXN1; (-) strand; PAM type: YTN; PAM sequence: TTT
ttaaccactatgctcatatg

SEQ ID NO: 202284 - DNA, 20 bp, Artificial Sequence
  Description of Artificial Sequence: Synthetic oligonucleotide
  Target: ATXN1; (-) strand; PAM type: YTN; PAM sequence: TTG
atttttaaccactatgctca

SEQ ID NO: 202285 - DNA, 20 bp, Artificial Sequence
  Description of Artificial Sequence: Synthetic oligonucleotide
  Target: ATXN1; (-) strand; PAM type: YTN; PAM sequence: CTG
tgaagataaagcagagattg

SEQ ID NO: 202286 - DNA, 20 bp, Artificial Sequence
  Description of Artificial Sequence: Synthetic oligonucleotide
  Target: ATXN1; (-) strand; PAM type: YTN; PAM sequence: TTC
gcctgtgaagataaagcaga

SEQ ID NO: 202287 - DNA, 20 bp, Artificial Sequence
  Description of Artificial Sequence: Synthetic oligonucleotide
  Target: ATXN1; (-) strand; PAM type: YTN; PAM sequence: TTT
cgcctgtgaagataaagcag

SEQ ID NO: 202288 - DNA, 20 bp, Artificial Sequence
  Description of Artificial Sequence: Synthetic oligonucleotide
  Target: ATXN1; (-) strand; PAM type: YTN; PAM sequence: CTT
tcgcctgtgaagataaagca

SEQ ID NO: 202289 - DNA, 20 bp, Artificial Sequence
  Description of Artificial Sequence: Synthetic oligonucleotide
  Target: ATXN1; (-) strand; PAM type: YTN; PAM sequence: TTA
aagctttcgcctgtgaagat

SEQ ID NO: 202290 - DNA, 20 bp, Artificial Sequence
  Description of Artificial Sequence: Synthetic oligonucleotide
  Target: ATXN1; (-) strand; PAM type: YTN; PAM sequence: TTT
aaagctttcgcctgtgaaga

SEQ ID NO: 202291 - DNA, 20 bp, Artificial Sequence
  Description of Artificial Sequence: Synthetic oligonucleotide
  Target: ATXN1; (-) strand; PAM type: YTN; PAM sequence: CTT
taaagctttcgcctgtgaag

SEQ ID NO: 202292 - DNA, 20 bp, Artificial Sequence
  Description of Artificial Sequence: Synthetic oligonucleotide
  Target: ATXN1; (-) strand; PAM type: YTN; PAM sequence: CTG
tccactttaaagctttcgcc

SEQ ID NO: 202293 - DNA, 20 bp, Artificial Sequence
  Description of Artificial Sequence: Synthetic oligonucleotide
  Target: ATXN1; (-) strand; PAM type: YTN; PAM sequence: CTA
ggtatgaaagacctgtccac

SEQ ID NO: 202294 - DNA, 20 bp, Artificial Sequence
  Description of Artificial Sequence: Synthetic oligonucleotide
  Target: ATXN1; (-) strand; PAM type: YTN; PAM sequence: TTC
aaactaggtatgaaagacct

SEQ ID NO: 202295 - DNA, 20 bp, Artificial Sequence
  Description of Artificial Sequence: Synthetic oligonucleotide
  Target: ATXN1; (-) strand; PAM type: YTN; PAM sequence: CTT
caaactaggtatgaaagacc

SEQ ID NO: 202296 - DNA, 20 bp, Artificial Sequence
  Description of Artificial Sequence: Synthetic oligonucleotide
  Target: ATXN1; (-) strand; PAM type: YTN; PAM sequence: TTC
ataaacttcaaactaggtat

SEQ ID NO: 202297 - DNA, 20 bp, Artificial Sequence
  Description of Artificial Sequence: Synthetic oligonucleotide
  Target: ATXN1; (-) strand; PAM type: YTN; PAM sequence: TTT
cataaacttcaaactaggta

SEQ ID NO: 202298 - DNA, 20 bp, Artificial Sequence
  Description of Artificial Sequence: Synthetic oligonucleotide
  Target: ATXN1; (-) strand; PAM type: YTN; PAM sequence: TTT
tcataaacttcaaactaggt

SEQ ID NO: 202299 - DNA, 20 bp, Artificial Sequence
  Description of Artificial Sequence: Synthetic oligonucleotide
  Target: ATXN1; (-) strand; PAM type: YTN; PAM sequence: TTT
ttcataaacttcaaactagg

SEQ ID NO: 202300 - DNA, 20 bp, Artificial Sequence
  Description of Artificial Sequence: Synthetic oligonucleotide
  Target: ATXN1; (-) strand; PAM type: YTN; PAM sequence: CTT
tttcataaacttcaaactag

SEQ ID NO: 202301 - DNA, 20 bp, Artificial Sequence
  Description of Artificial Sequence: Synthetic oligonucleotide
  Target: ATXN1; (-) strand; PAM type: YTN; PAM sequence: TTC
tttttcataaacttcaaact

SEQ ID NO: 202302 - DNA, 20 bp, Artificial Sequence
  Description of Artificial Sequence: Synthetic oligonucleotide
  Target: ATXN1; (-) strand; PAM type: YTN; PAM sequence: TTA
ttctttttcataaacttcaa

SEQ ID NO: 202303 - DNA, 20 bp, Artificial Sequence
  Description of Artificial Sequence: Synthetic oligonucleotide
  Target: ATXN1; (-) strand; PAM type: YTN; PAM sequence: CTT
attctttttcataaacttca

SEQ ID NO: 202304 - DNA, 20 bp, Artificial Sequence
  Description of Artificial Sequence: Synthetic oligonucleotide
  Target: ATXN1; (-) strand; PAM type: YTN; PAM sequence: CTC
cagagtagcccccttattct

SEQ ID NO: 202305 - DNA, 20 bp, Artificial Sequence
  Description of Artificial Sequence: Synthetic oligonucleotide
  Target: ATXN1; (-) strand; PAM type: YTN; PAM sequence: CTC
acagtactccagagtagccc

SEQ ID NO: 202306 - DNA, 20 bp, Artificial Sequence
  Description of Artificial Sequence: Synthetic oligonucleotide
  Target: ATXN1; (-) strand; PAM type: YTN; PAM sequence: TTA
tggtgtggagaagcagaaaa

SEQ ID NO: 202307 - DNA, 20 bp, Artificial Sequence
  Description of Artificial Sequence: Synthetic oligonucleotide
  Target: ATXN1; (-) strand; PAM type: YTN; PAM sequence: CTT
atggtgtggagaagcagaaa

SEQ ID NO: 202308 - DNA, 20 bp, Artificial Sequence
  Description of Artificial Sequence: Synthetic oligonucleotide
  Target: ATXN1; (-) strand; PAM type: YTN; PAM sequence: CTG
tccttatggtgtggagaagc

SEQ ID NO: 202309 - DNA, 20 bp, Artificial Sequence
  Description of Artificial Sequence: Synthetic oligonucleotide
  Target: ATXN1; (-) strand; PAM type: YTN; PAM sequence: TTA
cagggaccctgtccttatgg

SEQ ID NO: 202310 - DNA, 20 bp, Artificial Sequence
  Description of Artificial Sequence: Synthetic oligonucleotide
  Target: ATXN1; (-) strand; PAM type: YTN; PAM sequence: CTT
acagggaccctgtccttatg

SEQ ID NO: 202311 - DNA, 20 bp, Artificial Sequence
  Description of Artificial Sequence: Synthetic oligonucleotide
  Target: ATXN1; (-) strand; PAM type: YTN; PAM sequence: TTG
cttacagggaccctgtcctt

SEQ ID NO: 202312 - DNA, 20 bp, Artificial Sequence
  Description of Artificial Sequence: Synthetic oligonucleotide
  Target: ATXN1; (-) strand; PAM type: YTN; PAM sequence: TTG
gaggacaattgcttacaggg

SEQ ID NO: 202313 - DNA, 20 bp, Artificial Sequence
  Description of Artificial Sequence: Synthetic oligonucleotide
  Target: ATXN1; (-) strand; PAM type: YTN; PAM sequence: TTT
ggaggacaattgcttacagg

SEQ ID NO: 202314 - DNA, 20 bp, Artificial Sequence
  Description of Artificial Sequence: Synthetic oligonucleotide
  Target: ATXN1; (-) strand; PAM type: YTN; PAM sequence: TTG
gtttggaggacaattgctta

SEQ ID NO: 202315 - DNA, 20 bp, Artificial Sequence
  Description of Artificial Sequence: Synthetic oligonucleotide
  Target: ATXN1; (-) strand; PAM type: YTN; PAM sequence: TTA
ggtggattggtttggaggac

SEQ ID NO: 202316 - DNA, 20 bp, Artificial Sequence
  Description of Artificial Sequence: Synthetic oligonucleotide
  Target: ATXN1; (-) strand; PAM type: YTN; PAM sequence: CTA
ttaggtggattggtttggag

SEQ ID NO: 202317 - DNA, 20 bp, Artificial Sequence
  Description of Artificial Sequence: Synthetic oligonucleotide
  Target: ATXN1; (-) strand; PAM type: YTN; PAM sequence: CTA
aacaaaatgatgtggcctat

SEQ ID NO: 202318 - DNA, 20 bp, Artificial Sequence
  Description of Artificial Sequence: Synthetic oligonucleotide
  Target: ATXN1; (-) strand; PAM type: YTN; PAM sequence: TTC
cctaaacaaaatgatgtggc

SEQ ID NO: 202319 - DNA, 20 bp, Artificial Sequence
  Description of Artificial Sequence: Synthetic oligonucleotide
  Target: ATXN1; (-) strand; PAM type: YTN; PAM sequence: CTT
ccctaaacaaaatgatgtgg

SEQ ID NO: 202320 - DNA, 20 bp, Artificial Sequence
  Description of Artificial Sequence: Synthetic oligonucleotide
  Target: ATXN1; (-) strand; PAM type: YTN; PAM sequence: TTC
ttccctaaacaaaatgatgt

SEQ ID NO: 202321 - DNA, 20 bp, Artificial Sequence
  Description of Artificial Sequence: Synthetic oligonucleotide
  Target: ATXN1; (-) strand; PAM type: YTN; PAM sequence: TTT
cttccctaaacaaaatgatg

SEQ ID NO: 202322 - DNA, 20 bp, Artificial Sequence
  Description of Artificial Sequence: Synthetic oligonucleotide
  Target: ATXN1; (-) strand; PAM type: YTN; PAM sequence: TTG
cagtttcttccctaaacaaa

SEQ ID NO: 202323 - DNA, 20 bp, Artificial Sequence
  Description of Artificial Sequence: Synthetic oligonucleotide
  Target: ATXN1; (-) strand; PAM type: YTN; PAM sequence: TTT
gcagtttcttccctaaacaa

SEQ ID NO: 202324 - DNA, 20 bp, Artificial Sequence
  Description of Artificial Sequence: Synthetic oligonucleotide
  Target: ATXN1; (-) strand; PAM type: YTN; PAM sequence: TTT
tgcagtttcttccctaaaca

SEQ ID NO: 202325 - DNA, 20 bp, Artificial Sequence
  Description of Artificial Sequence: Synthetic oligonucleotide
  Target: ATXN1; (-) strand; PAM type: YTN; PAM sequence: TTT
ttgcagtttcttccctaaac

SEQ ID NO: 202326 - DNA, 20 bp, Artificial Sequence
  Description of Artificial Sequence: Synthetic oligonucleotide
  Target: ATXN1; (-) strand; PAM type: YTN; PAM sequence: CTT
tttgcagtttcttccctaaa

SEQ ID NO: 202327 - DNA, 20 bp, Artificial Sequence
  Description of Artificial Sequence: Synthetic oligonucleotide
  Target: ATXN1; (-) strand; PAM type: YTN; PAM sequence: CTC
tttttgcagtttcttcccta

SEQ ID NO: 202328 - DNA, 20 bp, Artificial Sequence
  Description of Artificial Sequence: Synthetic oligonucleotide
  Target: ATXN1; (-) strand; PAM type: YTN; PAM sequence: TTC
agtaatctctttttgcagtt

SEQ ID NO: 202329 - DNA, 20 bp, Artificial Sequence
  Description of Artificial Sequence: Synthetic oligonucleotide
  Target: ATXN1; (-) strand; PAM type: YTN; PAM sequence: TTT
cagtaatctctttttgcagt

SEQ ID NO: 202330 - DNA, 20 bp, Artificial Sequence
  Description of Artificial Sequence: Synthetic oligonucleotide
  Target: ATXN1; (-) strand; PAM type: YTN; PAM sequence: TTT
tcagtaatctctttttgcag

SEQ ID NO: 202331 - DNA, 20 bp, Artificial Sequence
  Description of Artificial Sequence: Synthetic oligonucleotide
  Target: ATXN1; (-) strand; PAM type: YTN; PAM sequence: TTT
ttcagtaatctctttttgca

SEQ ID NO: 202332 - DNA, 20 bp, Artificial Sequence
  Description of Artificial Sequence: Synthetic oligonucleotide
  Target: ATXN1; (-) strand; PAM type: YTN; PAM sequence: TTA
tggggaatgatttttcagta

SEQ ID NO: 202333 - DNA, 20 bp, Artificial Sequence
  Description of Artificial Sequence: Synthetic oligonucleotide
  Target: ATXN1; (-) strand; PAM type: YTN; PAM sequence: TTA
tcagataaatcaaacatcaa

SEQ ID NO: 202334 - DNA, 20 bp, Artificial Sequence
  Description of Artificial Sequence: Synthetic oligonucleotide
  Target: ATXN1; (-) strand; PAM type: YTN; PAM sequence: TTT
atcagataaatcaaacatca

SEQ ID NO: 202335 - DNA, 20 bp, Artificial Sequence
  Description of Artificial Sequence: Synthetic oligonucleotide
  Target: ATXN1; (-) strand; PAM type: YTN; PAM sequence: TTG
gcatgtttatcagataaatc

SEQ ID NO: 202336 - DNA, 20 bp, Artificial Sequence
  Description of Artificial Sequence: Synthetic oligonucleotide
  Target: ATXN1; (-) strand; PAM type: YTN; PAM sequence: TTT
ggcatgtttatcagataaat

SEQ ID NO: 202337 - DNA, 20 bp, Artificial Sequence
  Description of Artificial Sequence: Synthetic oligonucleotide
  Target: ATXN1; (-) strand; PAM type: YTN; PAM sequence: TTT
tggcatgtttatcagataaa

SEQ ID NO: 202338 - DNA, 20 bp, Artificial Sequence
  Description of Artificial Sequence: Synthetic oligonucleotide
  Target: ATXN1; (-) strand; PAM type: YTN; PAM sequence: TTA
ggcaatattttggcatgttt

SEQ ID NO: 202339 - DNA, 20 bp, Artificial Sequence
  Description of Artificial Sequence: Synthetic oligonucleotide
  Target: ATXN1; (-) strand; PAM type: YTN; PAM sequence: TTT
aggcaatattttggcatgtt

SEQ ID NO: 202340 - DNA, 20 bp, Artificial Sequence
  Description of Artificial Sequence: Synthetic oligonucleotide
  Target: ATXN1; (-) strand; PAM type: YTN; PAM sequence: TTT
taggcaatattttggcatgt

SEQ ID NO: 202341 - DNA, 20 bp, Artificial Sequence
  Description of Artificial Sequence: Synthetic oligonucleotide
  Target: ATXN1; (-) strand; PAM type: YTN; PAM sequence: TTT
ttaggcaatattttggcatg

SEQ ID NO: 202342 - DNA, 20 bp, Artificial Sequence
  Description of Artificial Sequence: Synthetic oligonucleotide
  Target: ATXN1; (-) strand; PAM type: YTN; PAM sequence: CTT
tttaggcaatattttggcat

SEQ ID NO: 202343 - DNA, 20 bp, Artificial Sequence
  Description of Artificial Sequence: Synthetic oligonucleotide
  Target: ATXN1; (-) strand; PAM type: YTN; PAM sequence: TTA
ctttttaggcaatattttgg

SEQ ID NO: 202344 - DNA, 20 bp, Artificial Sequence
  Description of Artificial Sequence: Synthetic oligonucleotide
  Target: ATXN1; (-) strand; PAM type: YTN; PAM sequence: TTA
gagattactttttaggcaat

SEQ ID NO: 202345 - DNA, 20 bp, Artificial Sequence
  Description of Artificial Sequence: Synthetic oligonucleotide
  Target: ATXN1; (-) strand; PAM type: YTN; PAM sequence: CTG
gaagtaataatatgatgtta

SEQ ID NO: 202346 - DNA, 20 bp, Artificial Sequence
  Description of Artificial Sequence: Synthetic oligonucleotide
  Target: ATXN1; (-) strand; PAM type: YTN; PAM sequence: TTC
ctggaagtaataatatgatg

SEQ ID NO: 202347 - DNA, 20 bp, Artificial Sequence
  Description of Artificial Sequence: Synthetic oligonucleotide
  Target: ATXN1; (-) strand; PAM type: YTN; PAM sequence: TTT
cctggaagtaataatatgat

SEQ ID NO: 202348 - DNA, 20 bp, Artificial Sequence
  Description of Artificial Sequence: Synthetic oligonucleotide
  Target: ATXN1; (-) strand; PAM type: YTN; PAM sequence: TTG
atttcctggaagtaataata

SEQ ID NO: 202349 - DNA, 20 bp, Artificial Sequence
  Description of Artificial Sequence: Synthetic oligonucleotide
  Target: ATXN1; (-) strand; PAM type: YTN; PAM sequence: TTA
tggagaaggttgatttcctg

SEQ ID NO: 202350 - DNA, 20 bp, Artificial Sequence
  Description of Artificial Sequence: Synthetic oligonucleotide
  Target: ATXN1; (-) strand; PAM type: YTN; PAM sequence: TTT
atggagaaggttgatttcct

SEQ ID NO: 202351 - DNA, 20 bp, Artificial Sequence
  Description of Artificial Sequence: Synthetic oligonucleotide
  Target: ATXN1; (-) strand; PAM type: YTN; PAM sequence: TTT
tatggagaaggttgatttcc

SEQ ID NO: 202352 - DNA, 20 bp, Artificial Sequence
  Description of Artificial Sequence: Synthetic oligonucleotide
  Target: ATXN1; (-) strand; PAM type: YTN; PAM sequence: TTT
ttatggagaaggttgatttc

SEQ ID NO: 202353 - DNA, 20 bp, Artificial Sequence
  Description of Artificial Sequence: Synthetic oligonucleotide
  Target: ATXN1; (-) strand; PAM type: YTN; PAM sequence: TTG
atttttatggagaaggttga

SEQ ID NO: 202354 - DNA, 20 bp, Artificial Sequence
  Description of Artificial Sequence: Synthetic oligonucleotide
  Target: ATXN1; (-) strand; PAM type: YTN; PAM sequence: CTG
ttgatttttatggagaaggt

SEQ ID NO: 202355 - DNA, 20 bp, Artificial Sequence
  Description of Artificial Sequence: Synthetic oligonucleotide
  Target: ATXN1; (-) strand; PAM type: YTN; PAM sequence: TTA
aaaacactgttgatttttat

SEQ ID NO: 202356 - DNA, 20 bp, Artificial Sequence
  Description of Artificial Sequence: Synthetic oligonucleotide
  Target: ATXN1; (-) strand; PAM type: YTN; PAM sequence: TTT
aaaaacactgttgattttta

SEQ ID NO: 202357 - DNA, 20 bp, Artificial Sequence
  Description of Artificial Sequence: Synthetic oligonucleotide
  Target: ATXN1; (-) strand; PAM type: YTN; PAM sequence: CTT
taaaaacactgttgattttt

SEQ ID NO: 202358 - DNA, 20 bp, Artificial Sequence
  Description of Artificial Sequence: Synthetic oligonucleotide
  Target: ATXN1; (-) strand; PAM type: YTN; PAM sequence: TTC
ctttaaaaacactgttgatt

SEQ ID NO: 202359 - DNA, 20 bp, Artificial Sequence
  Description of Artificial Sequence: Synthetic oligonucleotide
  Target: ATXN1; (-) strand; PAM type: YTN; PAM sequence: CTC
aacgttcctttaaaaacact

SEQ ID NO: 202360 - DNA, 20 bp, Artificial Sequence
  Description of Artificial Sequence: Synthetic oligonucleotide
  Target: ATXN1; (-) strand; PAM type: YTN; PAM sequence: TTA
acctcaacgttcctttaaaa

SEQ ID NO: 202361 - DNA, 20 bp, Artificial Sequence
  Description of Artificial Sequence: Synthetic oligonucleotide
  Target: ATXN1; (-) strand; PAM type: YTN; PAM sequence: TTT
aacctcaacgttcctttaaa

SEQ ID NO: 202362 - DNA, 20 bp, Artificial Sequence
  Description of Artificial Sequence: Synthetic oligonucleotide
  Target: ATXN1; (-) strand; PAM type: YTN; PAM sequence: TTT
taacctcaacgttcctttaa

SEQ ID NO: 202363 - DNA, 20 bp, Artificial Sequence
  Description of Artificial Sequence: Synthetic oligonucleotide
  Target: ATXN1; (-) strand; PAM type: YTN; PAM sequence: TTT
ttaacctcaacgttccttta

SEQ ID NO: 202364 - DNA, 20 bp, Artificial Sequence
  Description of Artificial Sequence: Synthetic oligonucleotide
  Target: ATXN1; (-) strand; PAM type: YTN; PAM sequence: TTT
tttaacctcaacgttccttt

SEQ ID NO: 202365 - DNA, 20 bp, Artificial Sequence
  Description of Artificial Sequence: Synthetic oligonucleotide
  Target: ATXN1; (-) strand; PAM type: YTN; PAM sequence: TTT
ttttaacctcaacgttcctt

SEQ ID NO: 202366 - DNA, 20 bp, Artificial Sequence
  Description of Artificial Sequence: Synthetic oligonucleotide
  Target: ATXN1; (-) strand; PAM type: YTN; PAM sequence: CTG
atttttttaacctcaacgtt

SEQ ID NO: 202367 - DNA, 20 bp, Artificial Sequence
  Description of Artificial Sequence: Synthetic oligonucleotide
  Target: ATXN1; (-) strand; PAM type: YTN; PAM sequence: TTC
tgatttttttaacctcaacg

SEQ ID NO: 202368 - DNA, 20 bp, Artificial Sequence
  Description of Artificial Sequence: Synthetic oligonucleotide
  Target: ATXN1; (-) strand; PAM type: YTN; PAM sequence: TTG
tcattctgatttttttaacc

SEQ ID NO: 202369 - DNA, 20 bp, Artificial Sequence
  Description of Artificial Sequence: Synthetic oligonucleotide
  Target: ATXN1; (-) strand; PAM type: YTN; PAM sequence: TTG
caaatgaataaattgtcatt

SEQ ID NO: 202370 - DNA, 20 bp, Artificial Sequence
  Description of Artificial Sequence: Synthetic oligonucleotide
  Target: ATXN1; (-) strand; PAM type: YTN; PAM sequence: TTT
gcaaatgaataaattgtcat

SEQ ID NO: 202371 - DNA, 20 bp, Artificial Sequence
  Description of Artificial Sequence: Synthetic oligonucleotide
  Target: ATXN1; (-) strand; PAM type: YTN; PAM sequence: TTT
tgcaaatgaataaattgtca

SEQ ID NO: 202372 - DNA, 20 bp, Artificial Sequence
  Description of Artificial Sequence: Synthetic oligonucleotide
  Target: ATXN1; (-) strand; PAM type: YTN; PAM sequence: TTT
ttgcaaatgaataaattgtc

SEQ ID NO: 202373 - DNA, 20 bp, Artificial Sequence
  Description of Artificial Sequence: Synthetic oligonucleotide
  Target: ATXN1; (-) strand; PAM type: YTN; PAM sequence: TTA
tttttgcaaatgaataaatt

SEQ ID NO: 202374 - DNA, 20 bp, Artificial Sequence
  Description of Artificial Sequence: Synthetic oligonucleotide
  Target: ATXN1; (-) strand; PAM type: YTN; PAM sequence: TTG
ttatttttgcaaatgaataa

SEQ ID NO: 202375 - DNA, 20 bp, Artificial Sequence
  Description of Artificial Sequence: Synthetic oligonucleotide
  Target: ATXN1; (-) strand; PAM type: YTN; PAM sequence: TTA
ttgttatttttgcaaatgaa

SEQ ID NO: 202376 - DNA, 20 bp, Artificial Sequence
  Description of Artificial Sequence: Synthetic oligonucleotide
  Target: ATXN1; (-) strand; PAM type: YTN; PAM sequence: CTA
tgattattgttatttttgca

SEQ ID NO: 202377 - DNA, 20 bp, Artificial Sequence
  Description of Artificial Sequence: Synthetic oligonucleotide
  Target: ATXN1; (-) strand; PAM type: YTN; PAM sequence: TTA
ctatgattattgttattttt

SEQ ID NO: 202378 - DNA, 20 bp, Artificial Sequence
  Description of Artificial Sequence: Synthetic oligonucleotide
  Target: ATXN1; (-) strand; PAM type: YTN; PAM sequence: TTA
ttactatgattattgttatt

SEQ ID NO: 202379 - DNA, 20 bp, Artificial Sequence
  Description of Artificial Sequence: Synthetic oligonucleotide
  Target: ATXN1; (-) strand; PAM type: YTN; PAM sequence: TTA
ttattactatgattattgtt

SEQ ID NO: 202380 - DNA, 20 bp, Artificial Sequence
  Description of Artificial Sequence: Synthetic oligonucleotide
  Target: ATXN1; (-) strand; PAM type: YTN; PAM sequence: TTA
ttattattactatgattatt

SEQ ID NO: 202381 - DNA, 20 bp, Artificial Sequence
  Description of Artificial Sequence: Synthetic oligonucleotide
  Target: ATXN1; (-) strand; PAM type: YTN; PAM sequence: TTC
atgtggaaattattattatt

SEQ ID NO: 202382 - DNA, 20 bp, Artificial Sequence
  Description of Artificial Sequence: Synthetic oligonucleotide
  Target: ATXN1; (-) strand; PAM type: YTN; PAM sequence: CTG
gttcatgtggaaattattat

SEQ ID NO: 202383 - DNA, 20 bp, Artificial Sequence
  Description of Artificial Sequence: Synthetic oligonucleotide
  Target: ATXN1; (-) strand; PAM type: YTN; PAM sequence: TTC
tggttcatgtggaaattatt

SEQ ID NO: 202384 - DNA, 20 bp, Artificial Sequence
  Description of Artificial Sequence: Synthetic oligonucleotide
  Target: ATXN1; (-) strand; PAM type: YTN; PAM sequence: CTT
ctggttcatgtggaaattat

SEQ ID NO: 202385 - DNA, 20 bp, Artificial Sequence
  Description of Artificial Sequence: Synthetic oligonucleotide
  Target: ATXN1; (-) strand; PAM type: YTN; PAM sequence: TTA
cccagagaccttctggttca

SEQ ID NO: 202386 - DNA, 20 bp, Artificial Sequence
  Description of Artificial Sequence: Synthetic oligonucleotide
  Target: ATXN1; (-) strand; PAM type: YTN; PAM sequence: TTA
aaagccagcattacccagag

SEQ ID NO: 202387 - DNA, 20 bp, Artificial Sequence
  Description of Artificial Sequence: Synthetic oligonucleotide
  Target: ATXN1; (-) strand; PAM type: YTN; PAM sequence: TTG
tggttaaaagccagcattac

SEQ ID NO: 202388 - DNA, 20 bp, Artificial Sequence
  Description of Artificial Sequence: Synthetic oligonucleotide
  Target: ATXN1; (-) strand; PAM type: YTN; PAM sequence: TTT
gtggttaaaagccagcatta

SEQ ID NO: 202389 - DNA, 20 bp, Artificial Sequence
  Description of Artificial Sequence: Synthetic oligonucleotide
  Target: ATXN1; (-) strand; PAM type: YTN; PAM sequence: TTG
gtgtgcatgtgtgtgtttgt

SEQ ID NO: 202390 - DNA, 20 bp, Artificial Sequence
  Description of Artificial Sequence: Synthetic oligonucleotide
  Target: ATXN1; (-) strand; PAM type: YTN; PAM sequence: CTG
ttggtgtgcatgtgtgtgtt

SEQ ID NO: 202391 - DNA, 20 bp, Artificial Sequence
  Description of Artificial Sequence: Synthetic oligonucleotide
  Target: ATXN1; (-) strand; PAM type: YTN; PAM sequence: TTC
tgttggtgtgcatgtgtgtg

SEQ ID NO: 202392 - DNA, 20 bp, Artificial Sequence
  Description of Artificial Sequence: Synthetic oligonucleotide
  Target: ATXN1; (-) strand; PAM type: YTN; PAM sequence: TTT
ctgttggtgtgcatgtgtgt

SEQ ID NO: 202393 - DNA, 20 bp, Artificial Sequence
  Description of Artificial Sequence: Synthetic oligonucleotide
  Target: ATXN1; (-) strand; PAM type: YTN; PAM sequence: TTC
aaatagcaaaggcagtttct

SEQ ID NO: 202394 - DNA, 20 bp, Artificial Sequence
  Description of Artificial Sequence: Synthetic oligonucleotide
  Target: ATXN1; (-) strand; PAM type: YTN; PAM sequence: CTG
gaatgttcaaatagcaaagg

SEQ ID NO: 202395 - DNA, 20 bp, Artificial Sequence
  Description of Artificial Sequence: Synthetic oligonucleotide
  Target: ATXN1; (-) strand; PAM type: YTN; PAM sequence: TTC
ctggaatgttcaaatagcaa

SEQ ID NO: 202396 - DNA, 20 bp, Artificial Sequence
  Description of Artificial Sequence: Synthetic oligonucleotide
  Target: ATXN1; (-) strand; PAM type: YTN; PAM sequence: TTG
attcctggaatgttcaaata

SEQ ID NO: 202397 - DNA, 20 bp, Artificial Sequence
  Description of Artificial Sequence: Synthetic oligonucleotide
  Target: ATXN1; (-) strand; PAM type: YTN; PAM sequence: TTT
gattcctggaatgttcaaat

SEQ ID NO: 202398 - DNA, 20 bp, Artificial Sequence
  Description of Artificial Sequence: Synthetic oligonucleotide
  Target: ATXN1; (-) strand; PAM type: YTN; PAM sequence: TTC
atttgattcctggaatgttc

SEQ ID NO: 202399 - DNA, 20 bp, Artificial Sequence
  Description of Artificial Sequence: Synthetic oligonucleotide
  Target: ATXN1; (-) strand; PAM type: YTN; PAM sequence: TTT
catttgattcctggaatgtt

SEQ ID NO: 202400 - DNA, 20 bp, Artificial Sequence
  Description of Artificial Sequence: Synthetic oligonucleotide
  Target: ATXN1; (-) strand; PAM type: YTN; PAM sequence: TTT
tcatttgattcctggaatgt

SEQ ID NO: 202401 - DNA, 20 bp, Artificial Sequence
  Description of Artificial Sequence: Synthetic oligonucleotide
  Target: ATXN1; (-) strand; PAM type: YTN; PAM sequence: TTG
agcaatgttttcatttgatt

SEQ ID NO: 202402 - DNA, 20 bp, Artificial Sequence
  Description of Artificial Sequence: Synthetic oligonucleotide
  Target: ATXN1; (-) strand; PAM type: YTN; PAM sequence: TTT
gagcaatgttttcatttgat

SEQ ID NO: 202403 - DNA, 20 bp, Artificial Sequence
  Description of Artificial Sequence: Synthetic oligonucleotide
  Target: ATXN1; (-) strand; PAM type: YTN; PAM sequence: TTT
tgagcaatgttttcatttga

SEQ ID NO: 202404 - DNA, 20 bp, Artificial Sequence
  Description of Artificial Sequence: Synthetic oligonucleotide
  Target: ATXN1; (-) strand; PAM type: YTN; PAM sequence: TTT
ttgagcaatgttttcatttg

SEQ ID NO: 202405 - DNA, 20 bp, Artificial Sequence
  Description of Artificial Sequence: Synthetic oligonucleotide
  Target: ATXN1; (-) strand; PAM type: YTN; PAM sequence: TTT
tttgagcaatgttttcattt

SEQ ID NO: 202406 - DNA, 20 bp, Artificial Sequence
  Description of Artificial Sequence: Synthetic oligonucleotide
  Target: ATXN1; (-) strand; PAM type: YTN; PAM sequence: CTG
gaaattttttgagcaatgtt

SEQ ID NO: 202407 - DNA, 20 bp, Artificial Sequence
  Description of Artificial Sequence: Synthetic oligonucleotide
  Target: ATXN1; (-) strand; PAM type: YTN; PAM sequence: TTA
cctggaaattttttgagcaa

SEQ ID NO: 202408 - DNA, 20 bp, Artificial Sequence
  Description of Artificial Sequence: Synthetic oligonucleotide
  Target: ATXN1; (-) strand; PAM type: YTN; PAM sequence: TTT
acctggaaattttttgagca

SEQ ID NO: 202409 - DNA, 20 bp, Artificial Sequence
  Description of Artificial Sequence: Synthetic oligonucleotide
  Target: ATXN1; (-) strand; PAM type: YTN; PAM sequence: TTA
acatggtttacctggaaatt

SEQ ID NO: 202410 - DNA, 20 bp, Artificial Sequence
  Description of Artificial Sequence: Synthetic oligonucleotide
  Target: ATXN1; (-) strand; PAM type: YTN; PAM sequence: CTA
gatattaacatggtttacct

SEQ ID NO: 202411 - DNA, 20 bp, Artificial Sequence
  Description of Artificial Sequence: Synthetic oligonucleotide
  Target: ATXN1; (-) strand; PAM type: YTN; PAM sequence: TTA
accctagatattaacatggt

SEQ ID NO: 202412 - DNA, 20 bp, Artificial Sequence
  Description of Artificial Sequence: Synthetic oligonucleotide
  Target: ATXN1; (-) strand; PAM type: YTN; PAM sequence: TTA
ttaaccctagatattaacat

SEQ ID NO: 202413 - DNA, 20 bp, Artificial Sequence
  Description of Artificial Sequence: Synthetic oligonucleotide
  Target: ATXN1; (-) strand; PAM type: YTN; PAM sequence: TTT
attaaccctagatattaaca

SEQ ID NO: 202414 - DNA, 20 bp, Artificial Sequence
  Description of Artificial Sequence: Synthetic oligonucleotide
  Target: ATXN1; (-) strand; PAM type: YTN; PAM sequence: CTT
tattaaccctagatattaac

SEQ ID NO: 202415 - DNA, 20 bp, Artificial Sequence
  Description of Artificial Sequence: Synthetic oligonucleotide
  Target: ATXN1; (-) strand; PAM type: YTN; PAM sequence: TTA
aagagactttattaacccta

SEQ ID NO: 202416 - DNA, 20 bp, Artificial Sequence
  Description of Artificial Sequence: Synthetic oligonucleotide
  Target: ATXN1; (-) strand; PAM type: YTN; PAM sequence: TTT
aaagagactttattaaccct

SEQ ID NO: 202417 - DNA, 20 bp, Artificial Sequence
  Description of Artificial Sequence: Synthetic oligonucleotide
  Target: ATXN1; (-) strand; PAM type: YTN; PAM sequence: TTA
acatttaaagagactttatt

SEQ ID NO: 202418 - DNA, 20 bp, Artificial Sequence
  Description of Artificial Sequence: Synthetic oligonucleotide
  Target: ATXN1; (-) strand; PAM type: YTN; PAM sequence: TTA
ttaacatttaaagagacttt

SEQ ID NO: 202419 - DNA, 20 bp, Artificial Sequence
  Description of Artificial Sequence: Synthetic oligonucleotide
  Target: ATXN1; (-) strand; PAM type: YTN; PAM sequence: TTT
attaacatttaaagagactt

SEQ ID NO: 202420 - DNA, 20 bp, Artificial Sequence
  Description of Artificial Sequence: Synthetic oligonucleotide
  Target: ATXN1; (-) strand; PAM type: YTN; PAM sequence: CTT
tattaacatttaaagagact

SEQ ID NO: 202421 - DNA, 20 bp, Artificial Sequence
  Description of Artificial Sequence: Synthetic oligonucleotide
  Target: ATXN1; (-) strand; PAM type: YTN; PAM sequence: TTA
tggagagactttattaacat

SEQ ID NO: 202422 - DNA, 20 bp, Artificial Sequence
  Description of Artificial Sequence: Synthetic oligonucleotide
  Target: ATXN1; (-) strand; PAM type: YTN; PAM sequence: TTT
atggagagactttattaaca

SEQ ID NO: 202423 - DNA, 20 bp, Artificial Sequence
  Description of Artificial Sequence: Synthetic oligonucleotide
  Target: ATXN1; (-) strand; PAM type: YTN; PAM sequence: TTT
tatggagagactttattaac

SEQ ID NO: 202424 - DNA, 20 bp, Artificial Sequence
  Description of Artificial Sequence: Synthetic oligonucleotide
  Target: ATXN1; (-) strand; PAM type: YTN; PAM sequence: CTG
aacattttatggagagactt

SEQ ID NO: 202425 - DNA, 20 bp, Artificial Sequence
  Description of Artificial Sequence: Synthetic oligonucleotide
  Target: ATXN1; (-) strand; PAM type: YTN; PAM sequence: TTC
agggctgaacattttatgga

SEQ ID NO: 202426 - DNA, 20 bp, Artificial Sequence
  Description of Artificial Sequence: Synthetic oligonucleotide
  Target: ATXN1; (-) strand; PAM type: YTN; PAM sequence: CTT
cagggctgaacattttatgg

SEQ ID NO: 202427 - DNA, 20 bp, Artificial Sequence
  Description of Artificial Sequence: Synthetic oligonucleotide
  Target: ATXN1; (-) strand; PAM type: YTN; PAM sequence: CTG
tgtcttcagggctgaacatt

SEQ ID NO: 202428 - DNA, 20 bp, Artificial Sequence
  Description of Artificial Sequence: Synthetic oligonucleotide
  Target: ATXN1; (-) strand; PAM type: YTN; PAM sequence: TTC
tgtgtcttcagggctgaaca

SEQ ID NO: 202429 - DNA, 20 bp, Artificial Sequence
  Description of Artificial Sequence: Synthetic oligonucleotide
  Target: ATXN1; (-) strand; PAM type: YTN; PAM sequence: TTG
ttctgtgtcttcagggctga

SEQ ID NO: 202430 - DNA, 20 bp, Artificial Sequence
  Description of Artificial Sequence: Synthetic oligonucleotide
  Target: ATXN1; (-) strand; PAM type: YTN; PAM sequence: TTT
gttctgtgtcttcagggctg

SEQ ID NO: 202431 - DNA, 20 bp, Artificial Sequence
  Description of Artificial Sequence: Synthetic oligonucleotide
  Target: ATXN1; (-) strand; PAM type: YTN; PAM sequence: TTA
tcatttgttctgtgtcttca

SEQ ID NO: 202432 - DNA, 20 bp, Artificial Sequence
  Description of Artificial Sequence: Synthetic oligonucleotide
  Target: ATXN1; (-) strand; PAM type: YTN; PAM sequence: TTT
atcatttgttctgtgtcttc

SEQ ID NO: 202433 - DNA, 20 bp, Artificial Sequence
  Description of Artificial Sequence: Synthetic oligonucleotide
  Target: ATXN1; (-) strand; PAM type: YTN; PAM sequence: TTT
tatcatttgttctgtgtctt

SEQ ID NO: 202434 - DNA, 20 bp, Artificial Sequence
  Description of Artificial Sequence: Synthetic oligonucleotide
  Target: ATXN1; (-) strand; PAM type: YTN; PAM sequence: TTA
taaaacatgatgttttatca

SEQ ID NO: 202435 - DNA, 20 bp, Artificial Sequence
  Description of Artificial Sequence: Synthetic oligonucleotide
  Target: ATXN1; (-) strand; PAM type: YTN; PAM sequence: CTG
ttataaaacatgatgtttta

SEQ ID NO: 202436 - DNA, 20 bp, Artificial Sequence
  Description of Artificial Sequence: Synthetic oligonucleotide
  Target: ATXN1; (-) strand; PAM type: YTN; PAM sequence: TTG
accatagtaacctgttataa

SEQ ID NO: 202437 - DNA, 20 bp, Artificial Sequence
  Description of Artificial Sequence: Synthetic oligonucleotide
  Target: ATXN1; (-) strand; PAM type: YTN; PAM sequence: CTC
cattgaccatagtaacctgt

SEQ ID NO: 202438 - DNA, 20 bp, Artificial Sequence
  Description of Artificial Sequence: Synthetic oligonucleotide
  Target: ATXN1; (-) strand; PAM type: YTN; PAM sequence: CTG
atactccattgaccatagta

SEQ ID NO: 202439 - DNA, 20 bp, Artificial Sequence
  Description of Artificial Sequence: Synthetic oligonucleotide
  Target: ATXN1; (-) strand; PAM type: YTN; PAM sequence: TTA
tagctgatactccattgacc

SEQ ID NO: 202440 - DNA, 20 bp, Artificial Sequence
  Description of Artificial Sequence: Synthetic oligonucleotide
  Target: ATXN1; (-) strand; PAM type: YTN; PAM sequence: TTT
atagctgatactccattgac

SEQ ID NO: 202441 - DNA, 20 bp, Artificial Sequence
  Description of Artificial Sequence: Synthetic oligonucleotide
  Target: ATXN1; (-) strand; PAM type: YTN; PAM sequence: TTT
tatagctgatactccattga

SEQ ID NO: 202442 - DNA, 20 bp, Artificial Sequence
  Description of Artificial Sequence: Synthetic oligonucleotide
  Target: ATXN1; (-) strand; PAM type: YTN; PAM sequence: TTA
tattttatagctgatactcc

SEQ ID NO: 202443 - DNA, 20 bp, Artificial Sequence
  Description of Artificial Sequence: Synthetic oligonucleotide
  Target: ATXN1; (-) strand; PAM type: YTN; PAM sequence: TTT
atattttatagctgatactc

SEQ ID NO: 202444 - DNA, 20 bp, Artificial Sequence
  Description of Artificial Sequence: Synthetic oligonucleotide
  Target: ATXN1; (-) strand; PAM type: YTN; PAM sequence: CTC
agtagaagtttatattttat

SEQ ID NO: 202445 - DNA, 20 bp, Artificial Sequence
  Description of Artificial Sequence: Synthetic oligonucleotide
  Target: ATXN1; (-) strand; PAM type: YTN; PAM sequence: TTC
ctcagtagaagtttatattt

SEQ ID NO: 202446 - DNA, 20 bp, Artificial Sequence
  Description of Artificial Sequence: Synthetic oligonucleotide
  Target: ATXN1; (-) strand; PAM type: YTN; PAM sequence: TTT
cctcagtagaagtttatatt

SEQ ID NO: 202447 - DNA, 20 bp, Artificial Sequence
  Description of Artificial Sequence: Synthetic oligonucleotide
  Target: ATXN1; (-) strand; PAM type: YTN; PAM sequence: CTT
tcctcagtagaagtttatat

SEQ ID NO: 202448 - DNA, 20 bp, Artificial Sequence
  Description of Artificial Sequence: Synthetic oligonucleotide
  Target: ATXN1; (-) strand; PAM type: YTN; PAM sequence: TTG
ccggatgtgctttcctcagt

SEQ ID NO: 202449 - DNA, 20 bp, Artificial Sequence
  Description of Artificial Sequence: Synthetic oligonucleotide
  Target: ATXN1; (-) strand; PAM type: YTN; PAM sequence: CTT
gccggatgtgctttcctcag

SEQ ID NO: 202450 - DNA, 20 bp, Artificial Sequence
  Description of Artificial Sequence: Synthetic oligonucleotide
  Target: ATXN1; (-) strand; PAM type: YTN; PAM sequence: TTA
cacttgccggatgtgctttc

SEQ ID NO: 202451 - DNA, 20 bp, Artificial Sequence
  Description of Artificial Sequence: Synthetic oligonucleotide
  Target: ATXN1; (-) strand; PAM type: YTN; PAM sequence: TTT
acacttgccggatgtgcttt

SEQ ID NO: 202452 - DNA, 20 bp, Artificial Sequence
  Description of Artificial Sequence: Synthetic oligonucleotide
  Target: ATXN1; (-) strand; PAM type: YTN; PAM sequence: TTT
tacacttgccggatgtgctt

SEQ ID NO: 202453 - DNA, 20 bp, Artificial Sequence
  Description of Artificial Sequence: Synthetic oligonucleotide
  Target: ATXN1; (-) strand; PAM type: YTN; PAM sequence: CTA
ttttacacttgccggatgtg

SEQ ID NO: 202454 - DNA, 20 bp, Artificial Sequence
  Description of Artificial Sequence: Synthetic oligonucleotide
  Target: ATXN1; (-) strand; PAM type: YTN; PAM sequence: TTG
gacccagtgggctattttac

SEQ ID NO: 202455 - DNA, 20 bp, Artificial Sequence
  Description of Artificial Sequence: Synthetic oligonucleotide
  Target: ATXN1; (-) strand; PAM type: YTN; PAM sequence: TTC
atggaaattggacccagtgg

SEQ ID NO: 202456 - DNA, 20 bp, Artificial Sequence
  Description of Artificial Sequence: Synthetic oligonucleotide
  Target: ATXN1; (-) strand; PAM type: YTN; PAM sequence: CTT
catggaaattggacccagtg

SEQ ID NO: 202457 - DNA, 20 bp, Artificial Sequence
  Description of Artificial Sequence: Synthetic oligonucleotide
  Target: ATXN1; (-) strand; PAM type: YTN; PAM sequence: CTC
ttcatggaaattggacccag

SEQ ID NO: 202458 - DNA, 20 bp, Artificial Sequence
  Description of Artificial Sequence: Synthetic oligonucleotide
  Target: ATXN1; (-) strand; PAM type: YTN; PAM sequence: CTG
gcacctcttcatggaaattg

SEQ ID NO: 202459 - DNA, 20 bp, Artificial Sequence
  Description of Artificial Sequence: Synthetic oligonucleotide
  Target: ATXN1; (-) strand; PAM type: YTN; PAM sequence: TTG
tacataccaaatggagctgg

SEQ ID NO: 202460 - DNA, 20 bp, Artificial Sequence
  Description of Artificial Sequence: Synthetic oligonucleotide
  Target: ATXN1; (-) strand; PAM type: YTN; PAM sequence: TTG
tagattgtacataccaaatg

SEQ ID NO: 202461 - DNA, 20 bp, Artificial Sequence
  Description of Artificial Sequence: Synthetic oligonucleotide
  Target: ATXN1; (-) strand; PAM type: YTN; PAM sequence: TTT
gtagattgtacataccaaat

SEQ ID NO: 202462 - DNA, 20 bp, Artificial Sequence
  Description of Artificial Sequence: Synthetic oligonucleotide
  Target: ATXN1; (-) strand; PAM type: YTN; PAM sequence: TTC
atttgtagattgtacatacc

SEQ ID NO: 202463 - DNA, 20 bp, Artificial Sequence
  Description of Artificial Sequence: Synthetic oligonucleotide
  Target: ATXN1; (-) strand; PAM type: YTN; PAM sequence: TTG
gattcatttgtagattgtac

SEQ ID NO: 202464 - DNA, 20 bp, Artificial Sequence
  Description of Artificial Sequence: Synthetic oligonucleotide
  Target: ATXN1; (-) strand; PAM type: YTN; PAM sequence: CTT
ggattcatttgtagattgta

SEQ ID NO: 202465 - DNA, 20 bp, Artificial Sequence
  Description of Artificial Sequence: Synthetic oligonucleotide
  Target: ATXN1; (-) strand; PAM type: YTN; PAM sequence: CTG
atagtgcttggattcatttg

SEQ ID NO: 202466 - DNA, 20 bp, Artificial Sequence
  Description of Artificial Sequence: Synthetic oligonucleotide
  Target: ATXN1; (-) strand; PAM type: YTN; PAM sequence: TTC
tgatagtgcttggattcatt

SEQ ID NO: 202467 - DNA, 20 bp, Artificial Sequence
  Description of Artificial Sequence: Synthetic oligonucleotide
  Target: ATXN1; (-) strand; PAM type: YTN; PAM sequence: TTA
acagttctgatagtgcttgg

SEQ ID NO: 202468 - DNA, 20 bp, Artificial Sequence
  Description of Artificial Sequence: Synthetic oligonucleotide
  Target: ATXN1; (-) strand; PAM type: YTN; PAM sequence: CTA
ccatccagagtcatgcagtt

SEQ ID NO: 202469 - DNA, 20 bp, Artificial Sequence
  Description of Artificial Sequence: Synthetic oligonucleotide
  Target: ATXN1; (-) strand; PAM type: YTN; PAM sequence: CTC
cccctaccatccagagtcat

SEQ ID NO: 202470 - DNA, 20 bp, Artificial Sequence
  Description of Artificial Sequence: Synthetic oligonucleotide
  Target: ATXN1; (-) strand; PAM type: YTN; PAM sequence: TTC
cctccccctaccatccagag

SEQ ID NO: 202471 - DNA, 20 bp, Artificial Sequence
  Description of Artificial Sequence: Synthetic oligonucleotide
  Target: ATXN1; (-) strand; PAM type: YTN; PAM sequence: CTT
ccctccccctaccatccaga

SEQ ID NO: 202472 - DNA, 20 bp, Artificial Sequence
  Description of Artificial Sequence: Synthetic oligonucleotide
  Target: ATXN1; (-) strand; PAM type: YTN; PAM sequence: TTG
agacccttccctccccctac

SEQ ID NO: 202473 - DNA, 20 bp, Artificial Sequence
  Description of Artificial Sequence: Synthetic oligonucleotide
  Target: ATXN1; (-) strand; PAM type: YTN; PAM sequence: TTT
gagacccttccctcccccta

SEQ ID NO: 202474 - DNA, 20 bp, Artificial Sequence
  Description of Artificial Sequence: Synthetic oligonucleotide
  Target: ATXN1; (-) strand; PAM type: YTN; PAM sequence: TTT
tgagacccttccctccccct

SEQ ID NO: 202475 - DNA, 20 bp, Artificial Sequence
  Description of Artificial Sequence: Synthetic oligonucleotide
  Target: ATXN1; (-) strand; PAM type: YTN; PAM sequence: TTT
ttgagacccttccctccccc

SEQ ID NO: 202476 - DNA, 20 bp, Artificial Sequence
  Description of Artificial Sequence: Synthetic oligonucleotide
  Target: ATXN1; (-) strand; PAM type: YTN; PAM sequence: TTT
tttgagacccttccctcccc

SEQ ID NO: 202477 - DNA, 20 bp, Artificial Sequence
  Description of Artificial Sequence: Synthetic oligonucleotide
  Target: ATXN1; (-) strand; PAM type: YTN; PAM sequence: CTT
ttttgagacccttccctccc

SEQ ID NO: 202478 - DNA, 20 bp, Artificial Sequence
  Description of Artificial Sequence: Synthetic oligonucleotide
  Target: ATXN1; (-) strand; PAM type: YTN; PAM sequence: CTC
ttttttgagacccttccctc

SEQ ID NO: 202479 - DNA, 20 bp, Artificial Sequence
  Description of Artificial Sequence: Synthetic oligonucleotide
  Target: ATXN1; (-) strand; PAM type: YTN; PAM sequence: CTC
tcttttttgagacccttccc

SEQ ID NO: 202480 - DNA, 20 bp, Artificial Sequence
  Description of Artificial Sequence: Synthetic oligonucleotide
  Target: ATXN1; (-) strand; PAM type: YTN; PAM sequence: TTC
tctcttttttgagacccttc

SEQ ID NO: 202481 - DNA, 20 bp, Artificial Sequence
  Description of Artificial Sequence: Synthetic oligonucleotide
  Target: ATXN1; (-) strand; PAM type: YTN; PAM sequence: TTT
ctctcttttttgagaccctt

SEQ ID NO: 202482 - DNA, 20 bp, Artificial Sequence
  Description of Artificial Sequence: Synthetic oligonucleotide
  Target: ATXN1; (-) strand; PAM type: YTN; PAM sequence: TTT
tctctcttttttgagaccct

SEQ ID NO: 202483 - DNA, 20 bp, Artificial Sequence
  Description of Artificial Sequence: Synthetic oligonucleotide
  Target: ATXN1; (-) strand; PAM type: YTN; PAM sequence: TTT
ttctctcttttttgagaccc

SEQ ID NO: 202484 - DNA, 20 bp, Artificial Sequence
  Description of Artificial Sequence: Synthetic oligonucleotide
  Target: ATXN1; (-) strand; PAM type: YTN; PAM sequence: CTT
tttctctcttttttgagacc

SEQ ID NO: 202485 - DNA, 20 bp, Artificial Sequence
  Description of Artificial Sequence: Synthetic oligonucleotide
  Target: ATXN1; (-) strand; PAM type: YTN; PAM sequence: CTG
aaaaatcctttttctctctt

SEQ ID NO: 202486 - DNA, 20 bp, Artificial Sequence
  Description of Artificial Sequence: Synthetic oligonucleotide
  Target: ATXN1; (-) strand; PAM type: YTN; PAM sequence: TTC
cagtatcctgaaaaatcctt

SEQ ID NO: 202487 - DNA, 20 bp, Artificial Sequence
  Description of Artificial Sequence: Synthetic oligonucleotide
  Target: ATXN1; (-) strand; PAM type: YTN; PAM sequence: TTT
ccagtatcctgaaaaatcct

SEQ ID NO: 202488 - DNA, 20 bp, Artificial Sequence
  Description of Artificial Sequence: Synthetic oligonucleotide
  Target: ATXN1; (-) strand; PAM type: YTN; PAM sequence: CTC
aatttccagtatcctgaaaa

SEQ ID NO: 202489 - DNA, 20 bp, Artificial Sequence
  Description of Artificial Sequence: Synthetic oligonucleotide
  Target: ATXN1; (-) strand; PAM type: YTN; PAM sequence: CTC
tcaatttccagtatcctgaa

SEQ ID NO: 202490 - DNA, 20 bp, Artificial Sequence
  Description of Artificial Sequence: Synthetic oligonucleotide
  Target: ATXN1; (-) strand; PAM type: YTN; PAM sequence: CTG
ctctcaatttccagtatcct

SEQ ID NO: 202491 - DNA, 20 bp, Artificial Sequence
  Description of Artificial Sequence: Synthetic oligonucleotide
  Target: ATXN1; (-) strand; PAM type: YTN; PAM sequence: TTA
taatctgctctcaatttcca

SEQ ID NO: 202492 - DNA, 20 bp, Artificial Sequence
  Description of Artificial Sequence: Synthetic oligonucleotide
  Target: ATXN1; (-) strand; PAM type: YTN; PAM sequence: TTT
ataatctgctctcaatttcc

SEQ ID NO: 202493 - DNA, 20 bp, Artificial Sequence
  Description of Artificial Sequence: Synthetic oligonucleotide
  Target: ATXN1; (-) strand; PAM type: YTN; PAM sequence: TTT
tataatctgctctcaatttc

SEQ ID NO: 202494 - DNA, 20 bp, Artificial Sequence
  Description of Artificial Sequence: Synthetic oligonucleotide
  Target: ATXN1; (-) strand; PAM type: YTN; PAM sequence: CTT
ttataatctgctctcaattt

SEQ ID NO: 202495 - DNA, 20 bp, Artificial Sequence
  Description of Artificial Sequence: Synthetic oligonucleotide
  Target: ATXN1; (-) strand; PAM type: YTN; PAM sequence: TTC
aacgtaaatcttttataatc

SEQ ID NO: 202496 - DNA, 20 bp, Artificial Sequence
  Description of Artificial Sequence: Synthetic oligonucleotide
  Target: ATXN1; (-) strand; PAM type: YTN; PAM sequence: TTA
ttcaacgtaaatcttttata

SEQ ID NO: 202497 - DNA, 20 bp, Artificial Sequence
  Description of Artificial Sequence: Synthetic oligonucleotide
  Target: ATXN1; (-) strand; PAM type: YTN; PAM sequence: TTG
ttattcaacgtaaatctttt

SEQ ID NO: 202498 - DNA, 20 bp, Artificial Sequence
  Description of Artificial Sequence: Synthetic oligonucleotide
  Target: ATXN1; (-) strand; PAM type: YTN; PAM sequence: CTT
gttattcaacgtaaatcttt

SEQ ID NO: 202499 - DNA, 20 bp, Artificial Sequence
  Description of Artificial Sequence: Synthetic oligonucleotide
  Target: ATXN1; (-) strand; PAM type: YTN; PAM sequence: TTC
ttgttattcaacgtaaatct

SEQ ID NO: 202500 - DNA, 20 bp, Artificial Sequence
  Description of Artificial Sequence: Synthetic oligonucleotide
  Target: ATXN1; (-) strand; PAM type: YTN; PAM sequence: TTA
ttcttgttattcaacgtaaa

SEQ ID NO: 202501 - DNA, 20 bp, Artificial Sequence
  Description of Artificial Sequence: Synthetic oligonucleotide
  Target: ATXN1; (-) strand; PAM type: YTN; PAM sequence: TTT
attcttgttattcaacgtaa

SEQ ID NO: 202502 - DNA, 20 bp, Artificial Sequence
  Description of Artificial Sequence: Synthetic oligonucleotide
  Target: ATXN1; (-) strand; PAM type: YTN; PAM sequence: CTT
tattcttgttattcaacgta

SEQ ID NO: 202503 - DNA, 20 bp, Artificial Sequence
  Description of Artificial Sequence: Synthetic oligonucleotide
  Target: ATXN1; (-) strand; PAM type: YTN; PAM sequence: TTC
acatagagatacatgaaagc

SEQ ID NO: 202504 - DNA, 20 bp, Artificial Sequence
  Description of Artificial Sequence: Synthetic oligonucleotide
  Target: ATXN1; (-) strand; PAM type: YTN; PAM sequence: TTT
cacatagagatacatgaaag

SEQ ID NO: 202505 - DNA, 20 bp, Artificial Sequence
  Description of Artificial Sequence: Synthetic oligonucleotide
  Target: ATXN1; (-) strand; PAM type: YTN; PAM sequence: TTT
tcacatagagatacatgaaa

SEQ ID NO: 202506 - DNA, 20 bp, Artificial Sequence
  Description of Artificial Sequence: Synthetic oligonucleotide
  Target: ATXN1; (-) strand; PAM type: YTN; PAM sequence: TTT
ttcacatagagatacatgaa

SEQ ID NO: 202507 - DNA, 20 bp, Artificial Sequence
  Description of Artificial Sequence: Synthetic oligonucleotide
  Target: ATXN1; (-) strand; PAM type: YTN; PAM sequence: TTT
tttcacatagagatacatga

SEQ ID NO: 202508 - DNA, 20 bp, Artificial Sequence
  Description of Artificial Sequence: Synthetic oligonucleotide
  Target: ATXN1; (-) strand; PAM type: YTN; PAM sequence: TTT
ttttcacatagagatacatg

SEQ ID NO: 202509 - DNA, 20 bp, Artificial Sequence
  Description of Artificial Sequence: Synthetic oligonucleotide
  Target: ATXN1; (-) strand; PAM type: YTN; PAM sequence: CTA
tttttttcacatagagatac

SEQ ID NO: 202510 - DNA, 20 bp, Artificial Sequence
  Description of Artificial Sequence: Synthetic oligonucleotide
  Target: ATXN1; (-) strand; PAM type: YTN; PAM sequence: CTA
ggctatttttttcacataga

SEQ ID NO: 202511 - DNA, 20 bp, Artificial Sequence
  Description of Artificial Sequence: Synthetic oligonucleotide
  Target: ATXN1; (-) strand; PAM type: YTN; PAM sequence: TTC
taggctatttttttcacata

SEQ ID NO: 202512 - DNA, 20 bp, Artificial Sequence
  Description of Artificial Sequence: Synthetic oligonucleotide
  Target: ATXN1; (-) strand; PAM type: YTN; PAM sequence: TTT
ctaggctatttttttcacat

SEQ ID NO: 202513 - DNA, 20 bp, Artificial Sequence
  Description of Artificial Sequence: Synthetic oligonucleotide
  Target: ATXN1; (-) strand; PAM type: YTN; PAM sequence: TTA
cagatttctaggctattttt

SEQ ID NO: 202514 - DNA, 20 bp, Artificial Sequence
  Description of Artificial Sequence: Synthetic oligonucleotide
  Target: ATXN1; (-) strand; PAM type: YTN; PAM sequence: TTT
acagatttctaggctatttt

SEQ ID NO: 202515 - DNA, 20 bp, Artificial Sequence
  Description of Artificial Sequence: Synthetic oligonucleotide
  Target: ATXN1; (-) strand; PAM type: YTN; PAM sequence: TTG
gagtttacagatttctaggc

SEQ ID NO: 202516 - DNA, 20 bp, Artificial Sequence
  Description of Artificial Sequence: Synthetic oligonucleotide
  Target: ATXN1; (-) strand; PAM type: YTN; PAM sequence: TTA
tgacaagttggagtttacag

SEQ ID NO: 202517 - DNA, 20 bp, Artificial Sequence
  Description of Artificial Sequence: Synthetic oligonucleotide
  Target: ATXN1; (-) strand; PAM type: YTN; PAM sequence: TTT
atgacaagttggagtttaca

SEQ ID NO: 202518 - DNA, 20 bp, Artificial Sequence
  Description of Artificial Sequence: Synthetic oligonucleotide
  Target: ATXN1; (-) strand; PAM type: YTN; PAM sequence: TTT
tatgacaagttggagtttac

SEQ ID NO: 202519 - DNA, 20 bp, Artificial Sequence
  Description of Artificial Sequence: Synthetic oligonucleotide
  Target: ATXN1; (-) strand; PAM type: YTN; PAM sequence: TTA
tgttttatgacaagttggag

SEQ ID NO: 202520 - DNA, 20 bp, Artificial Sequence
  Description of Artificial Sequence: Synthetic oligonucleotide
  Target: ATXN1; (-) strand; PAM type: YTN; PAM sequence: TTT
atgttttatgacaagttgga

SEQ ID NO: 202521 - DNA, 20 bp, Artificial Sequence
  Description of Artificial Sequence: Synthetic oligonucleotide
  Target: ATXN1; (-) strand; PAM type: YTN; PAM sequence: TTA
agtgtcacggatttatgttt

SEQ ID NO: 202522 - DNA, 20 bp, Artificial Sequence
  Description of Artificial Sequence: Synthetic oligonucleotide
  Target: ATXN1; (-) strand; PAM type: YTN; PAM sequence: TTA
taagtcattaagtgtcacgg

SEQ ID NO: 202523 - DNA, 20 bp, Artificial Sequence
  Description of Artificial Sequence: Synthetic oligonucleotide
  Target: ATXN1; (-) strand; PAM type: YTN; PAM sequence: TTG
tagattataagtcattaagt

SEQ ID NO: 202524 - DNA, 20 bp, Artificial Sequence
  Description of Artificial Sequence: Synthetic oligonucleotide
  Target: ATXN1; (-) strand; PAM type: YTN; PAM sequence: TTA
attgtagattataagtcatt

SEQ ID NO: 202525 - DNA, 20 bp, Artificial Sequence
  Description of Artificial Sequence: Synthetic oligonucleotide
  Target: ATXN1; (-) strand; PAM type: YTN; PAM sequence: CTG
gatgcaaaaacatgaaatgt

SEQ ID NO: 202526 - DNA, 20 bp, Artificial Sequence
  Description of Artificial Sequence: Synthetic oligonucleotide
  Target: ATXN1; (-) strand; PAM type: YTN; PAM sequence: TTA
tatctggatgcaaaaacatg

SEQ ID NO: 202527 - DNA, 20 bp, Artificial Sequence
  Description of Artificial Sequence: Synthetic oligonucleotide
  Target: ATXN1; (-) strand; PAM type: YTN; PAM sequence: CTT
atatctggatgcaaaaacat

SEQ ID NO: 202528 - DNA, 20 bp, Artificial Sequence
  Description of Artificial Sequence: Synthetic oligonucleotide
  Target: ATXN1; (-) strand; PAM type: YTN; PAM sequence: TTC
ttatatctggatgcaaaaac

SEQ ID NO: 202529 - DNA, 20 bp, Artificial Sequence
  Description of Artificial Sequence: Synthetic oligonucleotide
  Target: ATXN1; (-) strand; PAM type: YTN; PAM sequence: TTT
cttatatctggatgcaaaaa

SEQ ID NO: 202530 - DNA, 20 bp, Artificial Sequence
  Description of Artificial Sequence: Synthetic oligonucleotide
  Target: ATXN1; (-) strand; PAM type: YTN; PAM sequence: TTG
tatttcttatatctggatgc

SEQ ID NO: 202531 - DNA, 20 bp, Artificial Sequence
  Description of Artificial Sequence: Synthetic oligonucleotide
  Target: ATXN1; (-) strand; PAM type: YTN; PAM sequence: CTC
acccaagcaaaaacagaata

SEQ ID NO: 202532 - DNA, 20 bp, Artificial Sequence
  Description of Artificial Sequence: Synthetic oligonucleotide
  Target: ATXN1; (-) strand; PAM type: YTN; PAM sequence: TTA
gcctcacccaagcaaaaaca

SEQ ID NO: 202533 - DNA, 20 bp, Artificial Sequence
  Description of Artificial Sequence: Synthetic oligonucleotide
  Target: ATXN1; (-) strand; PAM type: YTN; PAM sequence: TTT
agcctcacccaagcaaaaac

SEQ ID NO: 202534 - DNA, 20 bp, Artificial Sequence
  Description of Artificial Sequence: Synthetic oligonucleotide
  Target: ATXN1; (-) strand; PAM type: YTN; PAM sequence: TTT
tagcctcacccaagcaaaaa

SEQ ID NO: 202535 - DNA, 20 bp, Artificial Sequence
  Description of Artificial Sequence: Synthetic oligonucleotide
  Target: ATXN1; (-) strand; PAM type: YTN; PAM sequence: TTT
ttagcctcacccaagcaaaa

SEQ ID NO: 202536 - DNA, 20 bp, Artificial Sequence
  Description of Artificial Sequence: Synthetic oligonucleotide
  Target: ATXN1; (-) strand; PAM type: YTN; PAM sequence: TTT
tttagcctcacccaagcaaa

SEQ ID NO: 202537 - DNA, 20 bp, Artificial Sequence
  Description of Artificial Sequence: Synthetic oligonucleotide
  Target: ATXN1; (-) strand; PAM type: YTN; PAM sequence: CTG
agttttttagcctcacccaa

SEQ ID NO: 202538 - DNA, 20 bp, Artificial Sequence
  Description of Artificial Sequence: Synthetic oligonucleotide
  Target: ATXN1; (-) strand; PAM type: YTN; PAM sequence: CTA
caaaaaacatggtggtactg

SEQ ID NO: 202539 - DNA, 20 bp, Artificial Sequence
  Description of Artificial Sequence: Synthetic oligonucleotide
  Target: ATXN1; (-) strand; PAM type: YTN; PAM sequence: TTG
accctacaaaaaacatggtg

SEQ ID NO: 202540 - DNA, 20 bp, Artificial Sequence
  Description of Artificial Sequence: Synthetic oligonucleotide
  Target: ATXN1; (-) strand; PAM type: YTN; PAM sequence: TTT
gaccctacaaaaaacatggt

SEQ ID NO: 202541 - DNA, 20 bp, Artificial Sequence
  Description of Artificial Sequence: Synthetic oligonucleotide
  Target: ATXN1; (-) strand; PAM type: YTN; PAM sequence: CTT
tgaccctacaaaaaacatgg

SEQ ID NO: 202542 - DNA, 20 bp, Artificial Sequence
  Description of Artificial Sequence: Synthetic oligonucleotide
  Target: ATXN1; (-) strand; PAM type: YTN; PAM sequence: CTC
tttgaccctacaaaaaacat

SEQ ID NO: 202543 - DNA, 20 bp, Artificial Sequence
  Description of Artificial Sequence: Synthetic oligonucleotide
  Target: ATXN1; (-) strand; PAM type: YTN; PAM sequence: TTA
gccgtctctttgaccctaca

SEQ ID NO: 202544 - DNA, 20 bp, Artificial Sequence
  Description of Artificial Sequence: Synthetic oligonucleotide
  Target: ATXN1; (-) strand; PAM type: YTN; PAM sequence: CTT
agccgtctctttgaccctac

SEQ ID NO: 202545 - DNA, 20 bp, Artificial Sequence
  Description of Artificial Sequence: Synthetic oligonucleotide
  Target: ATXN1; (-) strand; PAM type: YTN; PAM sequence: CTC
ttagccgtctctttgaccct

SEQ ID NO: 202546 - DNA, 20 bp, Artificial Sequence
  Description of Artificial Sequence: Synthetic oligonucleotide
  Target: ATXN1; (-) strand; PAM type: YTN; PAM sequence: TTA
aggggatctcttagccgtct

SEQ ID NO: 202547 - DNA, 20 bp, Artificial Sequence
  Description of Artificial Sequence: Synthetic oligonucleotide
  Target: ATXN1; (-) strand; PAM type: YTN; PAM sequence: TTA
attaaggggatctcttagcc

SEQ ID NO: 202548 - DNA, 20 bp, Artificial Sequence
  Description of Artificial Sequence: Synthetic oligonucleotide
  Target: ATXN1; (-) strand; PAM type: YTN; PAM sequence: TTA
ttaattaaggggatctctta

SEQ ID NO: 202549 - DNA, 20 bp, Artificial Sequence
  Description of Artificial Sequence: Synthetic oligonucleotide
  Target: ATXN1; (-) strand; PAM type: YTN; PAM sequence: TTG
taaaatgccaacaaaaatta

SEQ ID NO: 202550 - DNA, 20 bp, Artificial Sequence
  Description of Artificial Sequence: Synthetic oligonucleotide
  Target: ATXN1; (-) strand; PAM type: YTN; PAM sequence: TTG
ggggaatccagagttgtaaa

SEQ ID NO: 202551 - DNA, 20 bp, Artificial Sequence
  Description of Artificial Sequence: Synthetic oligonucleotide
  Target: ATXN1; (-) strand; PAM type: YTN; PAM sequence: TTT
gggggaatccagagttgtaa

SEQ ID NO: 202552 - DNA, 20 bp, Artificial Sequence
  Description of Artificial Sequence: Synthetic oligonucleotide
  Target: ATXN1; (-) strand; PAM type: YTN; PAM sequence: CTG
caggagtttgggggaatcca

SEQ ID NO: 202553 - DNA, 20 bp, Artificial Sequence
  Description of Artificial Sequence: Synthetic oligonucleotide
  Target: ATXN1; (-) strand; PAM type: YTN; PAM sequence: TTA
caccaatgctgcaggagttt

SEQ ID NO: 202554 - DNA, 20 bp, Artificial Sequence
  Description of Artificial Sequence: Synthetic oligonucleotide
  Target: ATXN1; (-) strand; PAM type: YTN; PAM sequence: CTA
gaagttacaccaatgctgca

SEQ ID NO: 202555 - DNA, 20 bp, Artificial Sequence
  Description of Artificial Sequence: Synthetic oligonucleotide
  Target: ATXN1; (-) strand; PAM type: YTN; PAM sequence: TTA
tgagagtagctagaagttac

SEQ ID NO: 202556 - DNA, 20 bp, Artificial Sequence
  Description of Artificial Sequence: Synthetic oligonucleotide
  Target: ATXN1; (-) strand; PAM type: YTN; PAM sequence: TTA
cagcaatgttatgagagtag

SEQ ID NO: 202557 - DNA, 20 bp, Artificial Sequence
  Description of Artificial Sequence: Synthetic oligonucleotide
  Target: ATXN1; (-) strand; PAM type: YTN; PAM sequence: TTG
agattacagcaatgttatga

SEQ ID NO: 202558 - DNA, 20 bp, Artificial Sequence
  Description of Artificial Sequence: Synthetic oligonucleotide
  Target: ATXN1; (-) strand; PAM type: YTN; PAM sequence: TTT
gagattacagcaatgttatg

SEQ ID NO: 202559 - DNA, 20 bp, Artificial Sequence
  Description of Artificial Sequence: Synthetic oligonucleotide
  Target: ATXN1; (-) strand; PAM type: YTN; PAM sequence: TTG
agcccaggagtttgagatta

SEQ ID NO: 202560 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagtttgagatt

SEQ ID NO: 202561 - DNA, 20 bp, Artificial Sequence
  Description of Artificial Sequence: Synthetic oligonucleotide
  Target: ATXN1; (-) strand; PAM type: YTN; PAM sequence: CTG
aggcgggaggatcgcttgag

SEQ ID NO: 202562 - DNA, 20 bp, Artificial Sequence
  Description of Artificial Sequence: Synthetic oligonucleotide
  Target: ATXN1; (-) strand; PAM type: YTN; PAM sequence: CTG
gaggctgaggcgggaggatc

SEQ ID NO: 202563 - DNA, 20 bp, Artificial Sequence
  Description of Artificial Sequence: Synthetic oligonucleotide
  Target: ATXN1; (-) strand; PAM type: YTN; PAM sequence: CTC
tggaggctgaggcgggagga

SEQ ID NO: 202564 - DNA, 20 bp, Artificial Sequence
  Description of Artificial Sequence: Synthetic oligonucleotide
  Target: ATXN1; (-) strand; PAM type: YTN; PAM sequence: CTA
ctctggaggctgaggcggga

SEQ ID NO: 202565 - DNA, 20 bp, Artificial Sequence
  Description of Artificial Sequence: Synthetic oligonucleotide
  Target: ATXN1; (-) strand; PAM type: YTN; PAM sequence: TTA
tagtccagctactctggagg

SEQ ID NO: 202566 - DNA, 20 bp, Artificial Sequence
  Description of Artificial Sequence: Synthetic oligonucleotide
  Target: ATXN1; (-) strand; PAM type: YTN; PAM sequence: CTT
atagtccagctactctggag

SEQ ID NO: 202567 - DNA, 20 bp, Artificial Sequence
  Description of Artificial Sequence: Synthetic oligonucleotide
  Target: ATXN1; (-) strand; PAM type: YTN; PAM sequence: TTG
gccaggcatggtgagatgtg

SEQ ID NO: 202568 - DNA, 20 bp, Artificial Sequence
  Description of Artificial Sequence: Synthetic oligonucleotide
  Target: ATXN1; (-) strand; PAM type: YTN; PAM sequence: TTA
attggccaggcatggtgaga

SEQ ID NO: 202569 - DNA, 20 bp, Artificial Sequence
  Description of Artificial Sequence: Synthetic oligonucleotide
  Target: ATXN1; (-) strand; PAM type: YTN; PAM sequence: TTT
aattggccaggcatggtgag

SEQ ID NO: 202570 - DNA, 20 bp, Artificial Sequence
  Description of Artificial Sequence: Synthetic oligonucleotide
  Target: ATXN1; (-) strand; PAM type: YTN; PAM sequence: TTT
taattggccaggcatggtga

SEQ ID NO: 202571 - DNA, 20 bp, Artificial Sequence
  Description of Artificial Sequence: Synthetic oligonucleotide
  Target: ATXN1; (-) strand; PAM type: YTN; PAM sequence: TTT
ttaattggccaggcatggtg

SEQ ID NO: 202572 - DNA, 20 bp, Artificial Sequence
  Description of Artificial Sequence: Synthetic oligonucleotide
  Target: ATXN1; (-) strand; PAM type: YTN; PAM sequence: TTT
tttaattggccaggcatggt

SEQ ID NO: 202573 - DNA, 20 bp, Artificial Sequence
  Description of Artificial Sequence: Synthetic oligonucleotide
  Target: ATXN1; (-) strand; PAM type: YTN; PAM sequence: TTG
ttttttaattggccaggcat

SEQ ID NO: 202574 - DNA, 20 bp, Artificial Sequence
  Description of Artificial Sequence: Synthetic oligonucleotide
  Target: ATXN1; (-) strand; PAM type: YTN; PAM sequence: TTT
gttttttaattggccaggca

SEQ ID NO: 202575 - DNA, 20 bp, Artificial Sequence
  Description of Artificial Sequence: Synthetic oligonucleotide
  Target: ATXN1; (-) strand; PAM type: YTN; PAM sequence: TTG
tttgttttttaattggccag

SEQ ID NO: 202576 - DNA, 20 bp, Artificial Sequence
  Description of Artificial Sequence: Synthetic oligonucleotide
  Target: ATXN1; (-) strand; PAM type: YTN; PAM sequence: TTT
gtttgttttttaattggcca

SEQ ID NO: 202577 - DNA, 20 bp, Artificial Sequence
  Description of Artificial Sequence: Synthetic oligonucleotide
  Target: ATXN1; (-) strand; PAM type: YTN; PAM sequence: TTG
tttgtttgttttttaattgg

SEQ ID NO: 202578 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgttttttaattg

SEQ ID NO: 202579 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgttttttaa

SEQ ID NO: 202580 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttttta

SEQ ID NO: 202581 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttgtttgtttt

SEQ ID NO: 202582 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttgtttgttt

SEQ ID NO: 202583 - DNA, 20 bp, Artificial Sequence
  Description of Artificial Sequence: Synthetic oligonucleotide
  Target: ATXN1; (-) strand; PAM type: YTN; PAM sequence: CTG
tttgtttgtttgtttgtttg

SEQ ID NO: 202584 - DNA, 20 bp, Artificial Sequence
  Description of Artificial Sequence: Synthetic oligonucleotide
  Target: ATXN1; (-) strand; PAM type: YTN; PAM sequence: TTA
cagtcgtgagccaccgcgcc

SEQ ID NO: 202585 - DNA, 20 bp, Artificial Sequence
  Description of Artificial Sequence: Synthetic oligonucleotide
  Target: ATXN1; (-) strand; PAM type: YTN; PAM sequence: CTG
ggattacagtcgtgagccac

SEQ ID NO: 202586 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 202587 - DNA, 20 bp, Artificial Sequence
  Description of Artificial Sequence: Synthetic oligonucleotide
  Target: ATXN1; (-) strand; PAM type: YTN; PAM sequence: CTC
gtgatccgcccgccgtggcc

SEQ ID NO: 202588 - DNA, 20 bp, Artificial Sequence
  Description of Artificial Sequence: Synthetic oligonucleotide
  Target: ATXN1; (-) strand; PAM type: YTN; PAM sequence: CTG
acctcgtgatccgcccgccg

SEQ ID NO: 202589 - DNA, 20 bp, Artificial Sequence
  Description of Artificial Sequence: Synthetic oligonucleotide
  Target: ATXN1; (-) strand; PAM type: YTN; PAM sequence: CTC
ctgacctcgtgatccgcccg

SEQ ID NO: 202590 - DNA, 20 bp, Artificial Sequence
  Description of Artificial Sequence: Synthetic oligonucleotide
  Target: ATXN1; (-) strand; PAM type: YTN; PAM sequence: TTG
atctcctgacctcgtgatcc

SEQ ID NO: 202591 - DNA, 20 bp, Artificial Sequence
  Description of Artificial Sequence: Synthetic oligonucleotide
  Target: ATXN1; (-) strand; PAM type: YTN; PAM sequence: CTT
gatctcctgacctcgtgatc

SEQ ID NO: 202592 - DNA, 20 bp, Artificial Sequence
  Description of Artificial Sequence: Synthetic oligonucleotide
  Target: ATXN1; (-) strand; PAM type: YTN; PAM sequence: TTC
gccaggatggtcttgatctc

SEQ ID NO: 202593 - DNA, 20 bp, Artificial Sequence
  Description of Artificial Sequence: Synthetic oligonucleotide
  Target: ATXN1; (-) strand; PAM type: YTN; PAM sequence: TTC
acagtgttcgccaggatggt

SEQ ID NO: 202594 - DNA, 20 bp, Artificial Sequence
  Description of Artificial Sequence: Synthetic oligonucleotide
  Target: ATXN1; (-) strand; PAM type: YTN; PAM sequence: TTT
cacagtgttcgccaggatgg

SEQ ID NO: 202595 - DNA, 20 bp, Artificial Sequence
  Description of Artificial Sequence: Synthetic oligonucleotide
  Target: ATXN1; (-) strand; PAM type: YTN; PAM sequence: TTA
gtagagacggggtttcacag

SEQ ID NO: 202596 - DNA, 20 bp, Artificial Sequence
  Description of Artificial Sequence: Synthetic oligonucleotide
  Target: ATXN1; (-) strand; PAM type: YTN; PAM sequence: TTT
agtagagacggggtttcaca

SEQ ID NO: 202597 - DNA, 20 bp, Artificial Sequence
  Description of Artificial Sequence: Synthetic oligonucleotide
  Target: ATXN1; (-) strand; PAM type: YTN; PAM sequence: TTT
tagtagagacggggtttcac

SEQ ID NO: 202598 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacggggtttca

SEQ ID NO: 202599 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacgggg

SEQ ID NO: 202600 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacggg

SEQ ID NO: 202601 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacgg

SEQ ID NO: 202602 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagacg

SEQ ID NO: 202603 - DNA, 20 bp, Artificial Sequence
  Description of Artificial Sequence: Synthetic oligonucleotide
  Target: ATXN1; (-) strand; PAM type: YTN; PAM sequence: TTT
tttgtatttttagtagagac

SEQ ID NO: 202604 - DNA, 20 bp, Artificial Sequence
  Description of Artificial Sequence: Synthetic oligonucleotide
  Target: ATXN1; (-) strand; PAM type: YTN; PAM sequence: TTT
ttttgtatttttagtagaga

SEQ ID NO: 202605 - DNA, 20 bp, Artificial Sequence
  Description of Artificial Sequence: Synthetic oligonucleotide
  Target: ATXN1; (-) strand; PAM type: YTN; PAM sequence: TTT
tttttgtatttttagtagag

SEQ ID NO: 202606 - DNA, 20 bp, Artificial Sequence
  Description of Artificial Sequence: Synthetic oligonucleotide
  Target: ATXN1; (-) strand; PAM type: YTN; PAM sequence: TTT
ttttttgtatttttagtaga

SEQ ID NO: 202607 - DNA, 20 bp, Artificial Sequence
  Description of Artificial Sequence: Synthetic oligonucleotide
  Target: ATXN1; (-) strand; PAM type: YTN; PAM sequence: CTA
atttttttttgtatttttag

SEQ ID NO: 202608 - DNA, 20 bp, Artificial Sequence
  Description of Artificial Sequence: Synthetic oligonucleotide
  Target: ATXN1; (-) strand; PAM type: YTN; PAM sequence: TTA
caggaacccaccaccatgcc

SEQ ID NO: 202609 - DNA, 20 bp, Artificial Sequence
  Description of Artificial Sequence: Synthetic oligonucleotide
  Target: ATXN1; (-) strand; PAM type: YTN; PAM sequence: CTG
agattacaggaacccaccac

SEQ ID NO: 202610 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgagattacag

SEQ ID NO: 202611 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctgaga

SEQ ID NO: 202612 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 202613 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgagta

SEQ ID NO: 202614 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccgag

SEQ ID NO: 202615 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 202616 - DNA, 20 bp, Artificial Sequence
  Description of Artificial Sequence: Synthetic oligonucleotide
  Target: ATXN1; (-) strand; PAM type: YTN; PAM sequence: CTC
ccagattcaagcgattctcc

SEQ ID NO: 202617 - DNA, 20 bp, Artificial Sequence
  Description of Artificial Sequence: Synthetic oligonucleotide
  Target: ATXN1; (-) strand; PAM type: YTN; PAM sequence: TTG
cctcccagattcaagcgatt

SEQ ID NO: 202618 - DNA, 20 bp, Artificial Sequence
  Description of Artificial Sequence: Synthetic oligonucleotide
  Target: ATXN1; (-) strand; PAM type: YTN; PAM sequence: TTT
gcctcccagattcaagcgat

SEQ ID NO: 202619 - DNA, 20 bp, Artificial Sequence
  Description of Artificial Sequence: Synthetic oligonucleotide
  Target: ATXN1; (-) strand; PAM type: YTN; PAM sequence: CTT
tgcctcccagattcaagcga

SEQ ID NO: 202620 - DNA, 20 bp, Artificial Sequence
  Description of Artificial Sequence: Synthetic oligonucleotide
  Target: ATXN1; (-) strand; PAM type: YTN; PAM sequence: CTG
caacctttgcctcccagatt

SEQ ID NO: 202621 - DNA, 20 bp, Artificial Sequence
  Description of Artificial Sequence: Synthetic oligonucleotide
  Target: ATXN1; (-) strand; PAM type: YTN; PAM sequence: CTC
actgcaacctttgcctccca

SEQ ID NO: 202622 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctttgcc

SEQ ID NO: 202623 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgatctc

SEQ ID NO: 202624 - DNA, 20 bp, Artificial Sequence
  Description of Artificial Sequence: Synthetic oligonucleotide
  Target: ATXN1; (-) strand; PAM type: YTN; PAM sequence: TTG
cccaggctggagtgcagtgg

SEQ ID NO: 202625 - DNA, 20 bp, Artificial Sequence
  Description of Artificial Sequence: Synthetic oligonucleotide
  Target: ATXN1; (-) strand; PAM type: YTN; PAM sequence: CTG
ttgcccaggctggagtgcag

SEQ ID NO: 202626 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaggctggagtgc

SEQ ID NO: 202627 - DNA, 20 bp, Artificial Sequence
  Description of Artificial Sequence: Synthetic oligonucleotide
  Target: ATXN1; (-) strand; PAM type: YTN; PAM sequence: CTC
actctgttgcccaggctgga

SEQ ID NO: 202628 - DNA, 20 bp, Artificial Sequence
  Description of Artificial Sequence: Synthetic oligonucleotide
  Target: ATXN1; (-) strand; PAM type: YTN; PAM sequence: TTG
agacggagtctcactctgtt

SEQ ID NO: 202629 - DNA, 20 bp, Artificial Sequence
  Description of Artificial Sequence: Synthetic oligonucleotide
  Target: ATXN1; (-) strand; PAM type: YTN; PAM sequence: TTT
gagacggagtctcactctgt

SEQ ID NO: 202630 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtctcactctg

SEQ ID NO: 202631 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtctcactct

SEQ ID NO: 202632 - DNA, 20 bp, Artificial Sequence
  Description of Artificial Sequence: Synthetic oligonucleotide
  Target: ATXN1; (-) strand; PAM type: YTN; PAM sequence: TTG
tttttgagacggagtctcac

SEQ ID NO: 202633 - DNA, 20 bp, Artificial Sequence
  Description of Artificial Sequence: Synthetic oligonucleotide
  Target: ATXN1; (-) strand; PAM type: YTN; PAM sequence: TTG
ttgtttttgagacggagtct

SEQ ID NO: 202634 - DNA, 20 bp, Artificial Sequence
  Description of Artificial Sequence: Synthetic oligonucleotide
  Target: ATXN1; (-) strand; PAM type: YTN; PAM sequence: TTG
ttgttgtttttgagacggag

SEQ ID NO: 202635 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgtttttgagacg

SEQ ID NO: 202636 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttgtttttgag

SEQ ID NO: 202637 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttgttgttttt

SEQ ID NO: 202638 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttgttgttgtt

SEQ ID NO: 202639 - DNA, 20 bp, Artificial Sequence
  Description of Artificial Sequence: Synthetic oligonucleotide
  Target: ATXN1; (-) strand; PAM type: YTN; PAM sequence: TTG
ttgttgttgttgttgttgtt

SEQ ID NO: 202640 - DNA, 20 bp, Artificial Sequence
  Description of Artificial Sequence: Synthetic oligonucleotide
  Target: ATXN1; (-) strand; PAM type: YTN; PAM sequence: TTT
gttgttgttgttgttgttgt

SEQ ID NO: 202641 - DNA, 20 bp, Artificial Sequence
  Description of Artificial Sequence: Synthetic oligonucleotide
  Target: ATXN1; (-) strand; PAM type: YTN; PAM sequence: TTT
tgttgttgttgttgttgttg

SEQ ID NO: 202642 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgttgttgttgtt

SEQ ID NO: 202643 - DNA, 20 bp, Artificial Sequence
  Description of Artificial Sequence: Synthetic oligonucleotide
  Target: ATXN1; (-) strand; PAM type: YTN; PAM sequence: CTA
caaaatgtttttgttgttgt

SEQ ID NO: 202644 - DNA, 20 bp, Artificial Sequence
  Description of Artificial Sequence: Synthetic oligonucleotide
  Target: ATXN1; (-) strand; PAM type: YTN; PAM sequence: CTC
tacaaaatgtttttgttgtt

SEQ ID NO: 202645 - DNA, 20 bp, Artificial Sequence
  Description of Artificial Sequence: Synthetic oligonucleotide
  Target: ATXN1; (-) strand; PAM type: YTN; PAM sequence: CTA
ggcaacacagtgaggaccca

SEQ ID NO: 202646 - DNA, 20 bp, Artificial Sequence
  Description of Artificial Sequence: Synthetic oligonucleotide
  Target: ATXN1; (-) strand; PAM type: YTN; PAM sequence: CTA
gcctaggcaacacagtgagg

SEQ ID NO: 202647 - DNA, 20 bp, Artificial Sequence
  Description of Artificial Sequence: Synthetic oligonucleotide
  Target: ATXN1; (-) strand; PAM type: YTN; PAM sequence: TTG
agactagcctaggcaacaca

SEQ ID NO: 202648 - DNA, 20 bp, Artificial Sequence
  Description of Artificial Sequence: Synthetic oligonucleotide
  Target: ATXN1; (-) strand; PAM type: YTN; PAM sequence: TTT
gagactagcctaggcaacac

SEQ ID NO: 202649 - DNA, 20 bp, Artificial Sequence
  Description of Artificial Sequence: Synthetic oligonucleotide
  Target: ATXN1; (-) strand; PAM type: YTN; PAM sequence: TTA
cgatgccaggagtttgagac

SEQ ID NO: 202650 - DNA, 20 bp, Artificial Sequence
  Description of Artificial Sequence: Synthetic oligonucleotide
  Target: ATXN1; (-) strand; PAM type: YTN; PAM sequence: CTT
acgatgccaggagtttgaga

SEQ ID NO: 202651 - DNA, 20 bp, Artificial Sequence
  Description of Artificial Sequence: Synthetic oligonucleotide
  Target: ATXN1; (-) strand; PAM type: YTN; PAM sequence: TTG
aatgccaaagcatatgaaag

SEQ ID NO: 202652 - DNA, 20 bp, Artificial Sequence
  Description of Artificial Sequence: Synthetic oligonucleotide
  Target: ATXN1; (-) strand; PAM type: YTN; PAM sequence: CTG
agcattgaatgccaaagcat

SEQ ID NO: 202653 - DNA, 20 bp, Artificial Sequence
  Description of Artificial Sequence: Synthetic oligonucleotide
  Target: ATXN1; (-) strand; PAM type: YTN; PAM sequence: TTA
ctgagcattgaatgccaaag

SEQ ID NO: 202654 - DNA, 20 bp, Artificial Sequence
  Description of Artificial Sequence: Synthetic oligonucleotide
  Target: ATXN1; (-) strand; PAM type: YTN; PAM sequence: TTG
ttactgagcattgaatgcca

SEQ ID NO: 202655 - DNA, 20 bp, Artificial Sequence
  Description of Artificial Sequence: Synthetic oligonucleotide
  Target: ATXN1; (-) strand; PAM type: YTN; PAM sequence: CTC
aggttgttactgagcattga

SEQ ID NO: 202656 - DNA, 20 bp, Artificial Sequence
  Description of Artificial Sequence: Synthetic oligonucleotide
  Target: ATXN1; (-) strand; PAM type: YTN; PAM sequence: TTA
aatatgctcaggttgttact

SEQ ID NO: 202657 - DNA, 20 bp, Artificial Sequence
  Description of Artificial Sequence: Synthetic oligonucleotide
  Target: ATXN1; (-) strand; PAM type: YTN; PAM sequence: TTA
taattaaatatgctcaggtt

SEQ ID NO: 202658 - DNA, 20 bp, Artificial Sequence
  Description of Artificial Sequence: Synthetic oligonucleotide
  Target: ATXN1; (-) strand; PAM type: YTN; PAM sequence: TTA
aaggtgaggcattataatta

SEQ ID NO: 202659 - DNA, 20 bp, Artificial Sequence
  Description of Artificial Sequence: Synthetic oligonucleotide
  Target: ATXN1; (-) strand; PAM type: YTN; PAM sequence: TTT
aaaggtgaggcattataatt

SEQ ID NO: 202660 - DNA, 20 bp, Artificial Sequence
  Description of Artificial Sequence: Synthetic oligonucleotide
  Target: ATXN1; (-) strand; PAM type: YTN; PAM sequence: CTA
tttaaaggtgaggcattata

SEQ ID NO: 202661 - DNA, 20 bp, Artificial Sequence
  Description of Artificial Sequence: Synthetic oligonucleotide
  Target: ATXN1; (-) strand; PAM type: YTN; PAM sequence: CTG
tagagtactatttaaaggtg

SEQ ID NO: 202662 - DNA, 20 bp, Artificial Sequence
  Description of Artificial Sequence: Synthetic oligonucleotide
  Target: ATXN1; (-) strand; PAM type: YTN; PAM sequence: TTA
tgaactgtagagtactattt

SEQ ID NO: 202663 - DNA, 20 bp, Artificial Sequence
  Description of Artificial Sequence: Synthetic oligonucleotide
  Target: ATXN1; (-) strand; PAM type: YTN; PAM sequence: TTT
atgaactgtagagtactatt

SEQ ID NO: 202664 - DNA, 20 bp, Artificial Sequence
  Description of Artificial Sequence: Synthetic oligonucleotide
  Target: ATXN1; (-) strand; PAM type: YTN; PAM sequence: CTT
tatgaactgtagagtactat

SEQ ID NO: 202665 - DNA, 20 bp, Artificial Sequence
  Description of Artificial Sequence: Synthetic oligonucleotide
  Target: ATXN1; (-) strand; PAM type: YTN; PAM sequence: CTA
catcagtgtgaaagaaagca

SEQ ID NO: 202666 - DNA, 20 bp, Artificial Sequence
  Description of Artificial Sequence: Synthetic oligonucleotide
  Target: ATXN1; (-) strand; PAM type: YTN; PAM sequence: TTA
atacaaggaaggctacatca

SEQ ID NO: 202667 - DNA, 20 bp, Artificial Sequence
  Description of Artificial Sequence: Synthetic oligonucleotide
  Target: ATXN1; (-) strand; PAM type: YTN; PAM sequence: TTT
aatacaaggaaggctacatc

SEQ ID NO: 202668 - DNA, 20 bp, Artificial Sequence
  Description of Artificial Sequence: Synthetic oligonucleotide
  Target: ATXN1; (-) strand; PAM type: YTN; PAM sequence: CTG
tgatttaatacaaggaaggc

SEQ ID NO: 202669 - DNA, 20 bp, Artificial Sequence
  Description of Artificial Sequence: Synthetic oligonucleotide
  Target: ATXN1; (-) strand; PAM type: YTN; PAM sequence: CTG
caaagctgtgatttaataca

SEQ ID NO: 202670 - DNA, 20 bp, Artificial Sequence
  Description of Artificial Sequence: Synthetic oligonucleotide
  Target: ATXN1; (-) strand; PAM type: YTN; PAM sequence: TTG
aactgcaaagctgtgattta

SEQ ID NO: 202671 - DNA, 20 bp, Artificial Sequence
  Description of Artificial Sequence: Synthetic oligonucleotide
  Target: ATXN1; (-) strand; PAM type: YTN; PAM sequence: TTG
caaaaattgaactgcaaagc

SEQ ID NO: 202672 - DNA, 20 bp, Artificial Sequence
  Description of Artificial Sequence: Synthetic oligonucleotide
  Target: ATXN1; (-) strand; PAM type: YTN; PAM sequence: TTT
gcaaaaattgaactgcaaag

SEQ ID NO: 202673 - DNA, 20 bp, Artificial Sequence
  Description of Artificial Sequence: Synthetic oligonucleotide
  Target: ATXN1; (-) strand; PAM type: YTN; PAM sequence: TTT
tgcaaaaattgaactgcaaa

SEQ ID NO: 202674 - DNA, 20 bp, Artificial Sequence
  Description of Artificial Sequence: Synthetic oligonucleotide
  Target: ATXN1; (-) strand; PAM type: YTN; PAM sequence: TTG
aaagggttttgcaaaaattg

SEQ ID NO: 202675 - DNA, 20 bp, Artificial Sequence
  Description of Artificial Sequence: Synthetic oligonucleotide
  Target: ATXN1; (-) strand; PAM type: YTN; PAM sequence: TTT
gaaagggttttgcaaaaatt

SEQ ID NO: 202676 - DNA, 20 bp, Artificial Sequence
  Description of Artificial Sequence: Synthetic oligonucleotide
  Target: ATXN1; (-) strand; PAM type: YTN; PAM sequence: CTT
tgaaagggttttgcaaaaat

SEQ ID NO: 202677 - DNA, 20 bp, Artificial Sequence
  Description of Artificial Sequence: Synthetic oligonucleotide
  Target: ATXN1; (-) strand; PAM type: YTN; PAM sequence: TTG
acaagtacctttgaaagggt

SEQ ID NO: 202678 - DNA, 20 bp, Artificial Sequence
  Description of Artificial Sequence: Synthetic oligonucleotide
  Target: ATXN1; (-) strand; PAM type: YTN; PAM sequence: TTA
attgacaagtacctttgaaa

SEQ ID NO: 202679 - DNA, 20 bp, Artificial Sequence
  Description of Artificial Sequence: Synthetic oligonucleotide
  Target: ATXN1; (-) strand; PAM type: YTN; PAM sequence: TTC
attaattgacaagtaccttt

SEQ ID NO: 202680 - DNA, 20 bp, Artificial Sequence
  Description of Artificial Sequence: Synthetic oligonucleotide
  Target: ATXN1; (-) strand; PAM type: YTN; PAM sequence: CTT
cattaattgacaagtacctt

SEQ ID NO: 202681 - DNA, 20 bp, Artificial Sequence
  Description of Artificial Sequence: Synthetic oligonucleotide
  Target: ATXN1; (-) strand; PAM type: YTN; PAM sequence: TTA
atcttcattaattgacaagt

SEQ ID NO: 202682 - DNA, 20 bp, Artificial Sequence
  Description of Artificial Sequence: Synthetic oligonucleotide
  Target: ATXN1; (-) strand; PAM type: YTN; PAM sequence: TTT
aatcttcattaattgacaag

SEQ ID NO: 202683 - DNA, 20 bp, Artificial Sequence
  Description of Artificial Sequence: Synthetic oligonucleotide
  Target: ATXN1; (-) strand; PAM type: YTN; PAM sequence: TTA
tgtttaatcttcattaattg

SEQ ID NO: 202684 - DNA, 20 bp, Artificial Sequence
  Description of Artificial Sequence: Synthetic oligonucleotide
  Target: ATXN1; (-) strand; PAM type: YTN; PAM sequence: TTT
atgtttaatcttcattaatt

SEQ ID NO: 202685 - DNA, 20 bp, Artificial Sequence
  Description of Artificial Sequence: Synthetic oligonucleotide
  Target: ATXN1; (-) strand; PAM type: YTN; PAM sequence: CTT
tatgtttaatcttcattaat

SEQ ID NO: 202686 - DNA, 20 bp, Artificial Sequence
  Description of Artificial Sequence: Synthetic oligonucleotide
  Target: ATXN1; (-) strand; PAM type: YTN; PAM sequence: TTC
cagatcacctttatgtttaa

SEQ ID NO: 202687 - DNA, 20 bp, Artificial Sequence
  Description of Artificial Sequence: Synthetic oligonucleotide
  Target: ATXN1; (-) strand; PAM type: YTN; PAM sequence: CTC
atagattccagatcaccttt

SEQ ID NO: 202688 - DNA, 20 bp, Artificial Sequence
  Description of Artificial Sequence: Synthetic oligonucleotide
  Target: ATXN1; (-) strand; PAM type: YTN; PAM sequence: TTG
tcctcatagattccagatca

SEQ ID NO: 202689 - DNA, 20 bp, Artificial Sequence
  Description of Artificial Sequence: Synthetic oligonucleotide
  Target: ATXN1; (-) strand; PAM type: YTN; PAM sequence: TTG
gcagtcatatccccccagat

SEQ ID NO: 202690 - DNA, 20 bp, Artificial Sequence
  Description of Artificial Sequence: Synthetic oligonucleotide
  Target: ATXN1; (-) strand; PAM type: YTN; PAM sequence: TTC
agttggcagtcatatccccc

SEQ ID NO: 202691 - DNA, 20 bp, Artificial Sequence
  Description of Artificial Sequence: Synthetic oligonucleotide
  Target: ATXN1; (-) strand; PAM type: YTN; PAM sequence: CTT
cagttggcagtcatatcccc

SEQ ID NO: 202692 - DNA, 20 bp, Artificial Sequence
  Description of Artificial Sequence: Synthetic oligonucleotide
  Target: ATXN1; (-) strand; PAM type: YTN; PAM sequence: CTG
ccatcttcagttggcagtca

SEQ ID NO: 202693 - DNA, 20 bp, Artificial Sequence
  Description of Artificial Sequence: Synthetic oligonucleotide
  Target: ATXN1; (-) strand; PAM type: YTN; PAM sequence: TTC
tgccatcttcagttggcagt

SEQ ID NO: 202694 - DNA, 20 bp, Artificial Sequence
  Description of Artificial Sequence: Synthetic oligonucleotide
  Target: ATXN1; (-) strand; PAM type: YTN; PAM sequence: TTT
ctgccatcttcagttggcag

SEQ ID NO: 202695 - DNA, 20 bp, Artificial Sequence
  Description of Artificial Sequence: Synthetic oligonucleotide
  Target: ATXN1; (-) strand; PAM type: YTN; PAM sequence: TTT
tctgccatcttcagttggca

SEQ ID NO: 202696 - DNA, 20 bp, Artificial Sequence
  Description of Artificial Sequence: Synthetic oligonucleotide
  Target: ATXN1; (-) strand; PAM type: YTN; PAM sequence: TTT
ttctgccatcttcagttggc

SEQ ID NO: 202697 - DNA, 20 bp, Artificial Sequence
  Description of Artificial Sequence: Synthetic oligonucleotide
  Target: ATXN1; (-) strand; PAM type: YTN; PAM sequence: TTT
tttctgccatcttcagttgg

SEQ ID NO: 202698 - DNA, 20 bp, Artificial Sequence
  Description of Artificial Sequence: Synthetic oligonucleotide
  Target: ATXN1; (-) strand; PAM type: YTN; PAM sequence: TTC
aatggcatgttttttctgcc

SEQ ID NO: 202699 - DNA, 20 bp, Artificial Sequence
  Description of Artificial Sequence: Synthetic oligonucleotide
  Target: ATXN1; (-) strand; PAM type: YTN; PAM sequence: TTT
caatggcatgttttttctgc

SEQ ID NO: 202700 - DNA, 20 bp, Artificial Sequence
  Description of Artificial Sequence: Synthetic oligonucleotide
  Target: ATXN1; (-) strand; PAM type: YTN; PAM sequence: CTG
tgagaataatttcaatggca

SEQ ID NO: 202701 - DNA, 20 bp, Artificial Sequence
  Description of Artificial Sequence: Synthetic oligonucleotide
  Target: ATXN1; (-) strand; PAM type: YTN; PAM sequence: CTG
tcaaaactgtgagaataatt

SEQ ID NO: 202702 - DNA, 20 bp, Artificial Sequence
  Description of Artificial Sequence: Synthetic oligonucleotide
  Target: ATXN1; (-) strand; PAM type: YTN; PAM sequence: CTA
ctgtcaaaactgtgagaata

SEQ ID NO: 202703 - DNA, 20 bp, Artificial Sequence
  Description of Artificial Sequence: Synthetic oligonucleotide
  Target: ATXN1; (-) strand; PAM type: YTN; PAM sequence: CTC
tactgtcaaaactgtgagaa

SEQ ID NO: 202704 - DNA, 20 bp, Artificial Sequence
  Description of Artificial Sequence: Synthetic oligonucleotide
  Target: ATXN1; (-) strand; PAM type: YTN; PAM sequence: TTC
tctactgtcaaaactgtgag

SEQ ID NO: 202705 - DNA, 20 bp, Artificial Sequence
  Description of Artificial Sequence: Synthetic oligonucleotide
  Target: ATXN1; (-) strand; PAM type: YTN; PAM sequence: TTT
ctctactgtcaaaactgtga

SEQ ID NO: 202706 - DNA, 20 bp, Artificial Sequence
  Description of Artificial Sequence: Synthetic oligonucleotide
  Target: ATXN1; (-) strand; PAM type: YTN; PAM sequence: TTT
tctctactgtcaaaactgtg

SEQ ID NO: 202707 - DNA, 20 bp, Artificial Sequence
  Description of Artificial Sequence: Synthetic oligonucleotide
  Target: ATXN1; (-) strand; PAM type: YTN; PAM sequence: TTT
ttctctactgtcaaaactgt

SEQ ID NO: 202708 - DNA, 20 bp, Artificial Sequence
  Description of Artificial Sequence: Synthetic oligonucleotide
  Target: ATXN1; (-) strand; PAM type: YTN; PAM sequence: TTG
atggtttttctctactgtca

SEQ ID NO: 202709 - DNA, 20 bp, Artificial Sequence
  Description of Artificial Sequence: Synthetic oligonucleotide
  Target: ATXN1; (-) strand; PAM type: YTN; PAM sequence: TTT
gatggtttttctctactgtc

SEQ ID NO: 202710 - DNA, 20 bp, Artificial Sequence
  Description of Artificial Sequence: Synthetic oligonucleotide
  Target: ATXN1; (-) strand; PAM type: YTN; PAM sequence: TTT
tgatggtttttctctactgt

SEQ ID NO: 202711 - DNA, 20 bp, Artificial Sequence
  Description of Artificial Sequence: Synthetic oligonucleotide
  Target: ATXN1; (-) strand; PAM type: YTN; PAM sequence: CTT
ttgatggtttttctctactg

SEQ ID NO: 202712 - DNA, 20 bp, Artificial Sequence
  Description of Artificial Sequence: Synthetic oligonucleotide
  Target: ATXN1; (-) strand; PAM type: YTN; PAM sequence: TTG
tggtatcttttgatggtttt

SEQ ID NO: 202713 - DNA, 20 bp, Artificial Sequence
  Description of Artificial Sequence: Synthetic oligonucleotide
  Target: ATXN1; (-) strand; PAM type: YTN; PAM sequence: TTT
gtggtatcttttgatggttt

SEQ ID NO: 202714 - DNA, 20 bp, Artificial Sequence
  Description of Artificial Sequence: Synthetic oligonucleotide
  Target: ATXN1; (-) strand; PAM type: YTN; PAM sequence: TTT
tgtggtatcttttgatggtt

SEQ ID NO: 202715 - DNA, 20 bp, Artificial Sequence
  Description of Artificial Sequence: Synthetic oligonucleotide
  Target: ATXN1; (-) strand; PAM type: YTN; PAM sequence: TTA
tgcattttgtggtatctttt

SEQ ID NO: 202716 - DNA, 20 bp, Artificial Sequence
  Description of Artificial Sequence: Synthetic oligonucleotide
  Target: ATXN1; (-) strand; PAM type: YTN; PAM sequence: TTT
atgcattttgtggtatcttt

SEQ ID NO: 202717 - DNA, 20 bp, Artificial Sequence
  Description of Artificial Sequence: Synthetic oligonucleotide
  Target: ATXN1; (-) strand; PAM type: YTN; PAM sequence: TTT
tatgcattttgtggtatctt

SEQ ID NO: 202718 - DNA, 20 bp, Artificial Sequence
  Description of Artificial Sequence: Synthetic oligonucleotide
  Target: ATXN1; (-) strand; PAM type: YTN; PAM sequence: TTA
attttatgcattttgtggta

SEQ ID NO: 202719 - DNA, 20 bp, Artificial Sequence
  Description of Artificial Sequence: Synthetic oligonucleotide
  Target: ATXN1; (-) strand; PAM type: YTN; PAM sequence: TTT
aattttatgcattttgtggt

SEQ ID NO: 202720 - DNA, 20 bp, Artificial Sequence
  Description of Artificial Sequence: Synthetic oligonucleotide
  Target: ATXN1; (-) strand; PAM type: YTN; PAM sequence: CTT
taattttatgcattttgtgg

SEQ ID NO: 202721 - DNA, 20 bp, Artificial Sequence
  Description of Artificial Sequence: Synthetic oligonucleotide
  Target: ATXN1; (-) strand; PAM type: YTN; PAM sequence: TTC
cctttaattttatgcatttt

SEQ ID NO: 202722 - DNA, 20 bp, Artificial Sequence
  Description of Artificial Sequence: Synthetic oligonucleotide
  Target: ATXN1; (-) strand; PAM type: YTN; PAM sequence: TTT
ccctttaattttatgcattt

SEQ ID NO: 202723 - DNA, 20 bp, Artificial Sequence
  Description of Artificial Sequence: Synthetic oligonucleotide
  Target: ATXN1; (-) strand; PAM type: YTN; PAM sequence: CTG
cagcccatgcaagaaacatt

SEQ ID NO: 202724 - DNA, 20 bp, Artificial Sequence
  Description of Artificial Sequence: Synthetic oligonucleotide
  Target: ATXN1; (-) strand; PAM type: YTN; PAM sequence: TTA
aaacagtactgcagcccatg

SEQ ID NO: 202725 - DNA, 20 bp, Artificial Sequence
  Description of Artificial Sequence: Synthetic oligonucleotide
  Target: ATXN1; (-) strand; PAM type: YTN; PAM sequence: TTT
aaaacagtactgcagcccat

SEQ ID NO: 202726 - DNA, 20 bp, Artificial Sequence
  Description of Artificial Sequence: Synthetic oligonucleotide
  Target: ATXN1; (-) strand; PAM type: YTN; PAM sequence: CTG
tttaaaacagtactgcagcc

SEQ ID NO: 202727 - DNA, 20 bp, Artificial Sequence
  Description of Artificial Sequence: Synthetic oligonucleotide
  Target: ATXN1; (-) strand; PAM type: YTN; PAM sequence: TTC
tgtttaaaacagtactgcag

SEQ ID NO: 202728 - DNA, 20 bp, Artificial Sequence
  Description of Artificial Sequence: Synthetic oligonucleotide
  Target: ATXN1; (-) strand; PAM type: YTN; PAM sequence: CTT
ctgtttaaaacagtactgca

SEQ ID NO: 202729 - DNA, 20 bp, Artificial Sequence
  Description of Artificial Sequence: Synthetic oligonucleotide
  Target: ATXN1; (-) strand; PAM type: YTN; PAM sequence: TTC
ccttctgtttaaaacagtac

SEQ ID NO: 202730 - DNA, 20 bp, Artificial Sequence
  Description of Artificial Sequence: Synthetic oligonucleotide
  Target: ATXN1; (-) strand; PAM type: YTN; PAM sequence: TTT
cccttctgtttaaaacagta

SEQ ID NO: 202731 - DNA, 20 bp, Artificial Sequence
  Description of Artificial Sequence: Synthetic oligonucleotide
  Target: ATXN1; (-) strand; PAM type: YTN; PAM sequence: CTT
tcccttctgtttaaaacagt

SEQ ID NO: 202732 - DNA, 20 bp, Artificial Sequence
  Description of Artificial Sequence: Synthetic oligonucleotide
  Target: ATXN1; (-) strand; PAM type: YTN; PAM sequence: TTA
atggtctttcccttctgttt

SEQ ID NO: 202733 - DNA, 20 bp, Artificial Sequence
  Description of Artificial Sequence: Synthetic oligonucleotide
  Target: ATXN1; (-) strand; PAM type: YTN; PAM sequence: TTT
aatggtctttcccttctgtt

SEQ ID NO: 202734 - DNA, 20 bp, Artificial Sequence
  Description of Artificial Sequence: Synthetic oligonucleotide
  Target: ATXN1; (-) strand; PAM type: YTN; PAM sequence: TTA
gtgaataccagtcatgttta

SEQ ID NO: 202735 - DNA, 20 bp, Artificial Sequence
  Description of Artificial Sequence: Synthetic oligonucleotide
  Target: ATXN1; (-) strand; PAM type: YTN; PAM sequence: TTT
agtgaataccagtcatgttt

SEQ ID NO: 202736 - DNA, 20 bp, Artificial Sequence
  Description of Artificial Sequence: Synthetic oligonucleotide
  Target: ATXN1; (-) strand; PAM type: YTN; PAM sequence: TTA
aaatttagtgaataccagtc

SEQ ID NO: 202737 - DNA, 20 bp, Artificial Sequence
  Description of Artificial Sequence: Synthetic oligonucleotide
  Target: ATXN1; (-) strand; PAM type: YTN; PAM sequence: TTG
atgccagtgtagttaaaatt

SEQ ID NO: 202738 - DNA, 20 bp, Artificial Sequence
  Description of Artificial Sequence: Synthetic oligonucleotide
  Target: ATXN1; (-) strand; PAM type: YTN; PAM sequence: TTT
gatgccagtgtagttaaaat

SEQ ID NO: 202739 - DNA, 20 bp, Artificial Sequence
  Description of Artificial Sequence: Synthetic oligonucleotide
  Target: ATXN1; (-) strand; PAM type: YTN; PAM sequence: CTT
tgatgccagtgtagttaaaa

SEQ ID NO: 202740 - DNA, 20 bp, Artificial Sequence
  Description of Artificial Sequence: Synthetic oligonucleotide
  Target: ATXN1; (-) strand; PAM type: YTN; PAM sequence: CTC
agactttgatgccagtgtag

SEQ ID NO: 202741 - DNA, 20 bp, Artificial Sequence
  Description of Artificial Sequence: Synthetic oligonucleotide
  Target: ATXN1; (-) strand; PAM type: YTN; PAM sequence: CTC
acaggctcagactttgatgc

SEQ ID NO: 202742 - DNA, 20 bp, Artificial Sequence
  Description of Artificial Sequence: Synthetic oligonucleotide
  Target: ATXN1; (-) strand; PAM type: YTN; PAM sequence: TTG
cactcacaggctcagacttt

SEQ ID NO: 202743 - DNA, 20 bp, Artificial Sequence
  Description of Artificial Sequence: Synthetic oligonucleotide
  Target: ATXN1; (-) strand; PAM type: YTN; PAM sequence: CTT
gcactcacaggctcagactt

SEQ ID NO: 202744 - DNA, 20 bp, Artificial Sequence
  Description of Artificial Sequence: Synthetic oligonucleotide
  Target: ATXN1; (-) strand; PAM type: YTN; PAM sequence: CTG
acttgcactcacaggctcag

SEQ ID NO: 202745 - DNA, 20 bp, Artificial Sequence
  Description of Artificial Sequence: Synthetic oligonucleotide
  Target: ATXN1; (-) strand; PAM type: YTN; PAM sequence: TTC
tgacttgcactcacaggctc

SEQ ID NO: 202746 - DNA, 20 bp, Artificial Sequence
  Description of Artificial Sequence: Synthetic oligonucleotide
  Target: ATXN1; (-) strand; PAM type: YTN; PAM sequence: TTA
ttctgacttgcactcacagg

SEQ ID NO: 202747 - DNA, 20 bp, Artificial Sequence
  Description of Artificial Sequence: Synthetic oligonucleotide
  Target: ATXN1; (-) strand; PAM type: YTN; PAM sequence: TTC
agaataagcgcaagttattc

SEQ ID NO: 202748 - DNA, 20 bp, Artificial Sequence
  Description of Artificial Sequence: Synthetic oligonucleotide
  Target: ATXN1; (-) strand; PAM type: YTN; PAM sequence: TTT
cagaataagcgcaagttatt

SEQ ID NO: 202749 - DNA, 20 bp, Artificial Sequence
  Description of Artificial Sequence: Synthetic oligonucleotide
  Target: ATXN1; (-) strand; PAM type: YTN; PAM sequence: TTA
tttcagaataagcgcaagtt

SEQ ID NO: 202750 - DNA, 20 bp, Artificial Sequence
  Description of Artificial Sequence: Synthetic oligonucleotide
  Target: ATXN1; (-) strand; PAM type: YTN; PAM sequence: TTT
atttcagaataagcgcaagt

SEQ ID NO: 202751 - DNA, 20 bp, Artificial Sequence
  Description of Artificial Sequence: Synthetic oligonucleotide
  Target: ATXN1; (-) strand; PAM type: YTN; PAM sequence: TTG
cagtggaaagaaacatttat

SEQ ID NO: 202752 - DNA, 20 bp, Artificial Sequence
  Description of Artificial Sequence: Synthetic oligonucleotide
  Target: ATXN1; (-) strand; PAM type: YTN; PAM sequence: CTT
gcagtggaaagaaacattta

SEQ ID NO: 202753 - DNA, 20 bp, Artificial Sequence
  Description of Artificial Sequence: Synthetic oligonucleotide
  Target: ATXN1; (-) strand; PAM type: YTN; PAM sequence: CTC
acacatgcacccttgcagtg

SEQ ID NO: 202754 - DNA, 20 bp, Artificial Sequence
  Description of Artificial Sequence: Synthetic oligonucleotide
  Target: ATXN1; (-) strand; PAM type: YTN; PAM sequence: TTC
ccccctcacacatgcaccct

SEQ ID NO: 202755 - DNA, 20 bp, Artificial Sequence
  Description of Artificial Sequence: Synthetic oligonucleotide
  Target: ATXN1; (-) strand; PAM type: YTN; PAM sequence: TTG
ttcccccctcacacatgcac

SEQ ID NO: 202756 - DNA, 20 bp, Artificial Sequence
  Description of Artificial Sequence: Synthetic oligonucleotide
  Target: ATXN1; (-) strand; PAM type: YTN; PAM sequence: TTT
gttcccccctcacacatgca

SEQ ID NO: 202757 - DNA, 20 bp, Artificial Sequence
  Description of Artificial Sequence: Synthetic oligonucleotide
  Target: ATXN1; (-) strand; PAM type: YTN; PAM sequence: CTT
tgttcccccctcacacatgc

SEQ ID NO: 202758 - DNA, 20 bp, Artificial Sequence
  Description of Artificial Sequence: Synthetic oligonucleotide
  Target: ATXN1; (-) strand; PAM type: YTN; PAM sequence: TTA
aaaagaatactttgttcccc

SEQ ID NO: 202759 - DNA, 20 bp, Artificial Sequence
  Description of Artificial Sequence: Synthetic oligonucleotide
  Target: ATXN1; (-) strand; PAM type: YTN; PAM sequence: TTC
catattaaaaagaatacttt

SEQ ID NO: 202760 - DNA, 20 bp, Artificial Sequence
  Description of Artificial Sequence: Synthetic oligonucleotide
  Target: ATXN1; (-) strand; PAM type: YTN; PAM sequence: CTT
ccatattaaaaagaatactt

SEQ ID NO: 202761 - DNA, 20 bp, Artificial Sequence
  Description of Artificial Sequence: Synthetic oligonucleotide
  Target: ATXN1; (-) strand; PAM type: YTN; PAM sequence: TTG
tcagggtgatgtgcttccat

SEQ ID NO: 202762 - DNA, 20 bp, Artificial Sequence
  Description of Artificial Sequence: Synthetic oligonucleotide
  Target: ATXN1; (-) strand; PAM type: YTN; PAM sequence: TTA
gattgtcagggtgatgtgct

SEQ ID NO: 202763 - DNA, 20 bp, Artificial Sequence
  Description of Artificial Sequence: Synthetic oligonucleotide
  Target: ATXN1; (-) strand; PAM type: YTN; PAM sequence: TTG
tcagagttagattgtcaggg

SEQ ID NO: 202764 - DNA, 20 bp, Artificial Sequence
  Description of Artificial Sequence: Synthetic oligonucleotide
  Target: ATXN1; (-) strand; PAM type: YTN; PAM sequence: CTT
gtcagagttagattgtcagg

SEQ ID NO: 202765 - DNA, 20 bp, Artificial Sequence
  Description of Artificial Sequence: Synthetic oligonucleotide
  Target: ATXN1; (-) strand; PAM type: YTN; PAM sequence: CTA
tgcaagcttgtcagagttag

SEQ ID NO: 202766 - DNA, 20 bp, Artificial Sequence
  Description of Artificial Sequence: Synthetic oligonucleotide
  Target: ATXN1; (-) strand; PAM type: YTN; PAM sequence: CTA
ggactatgcaagcttgtcag

SEQ ID NO: 202767 - DNA, 20 bp, Artificial Sequence
  Description of Artificial Sequence: Synthetic oligonucleotide
  Target: ATXN1; (-) strand; PAM type: YTN; PAM sequence: TTA
ggaggtagaaatagaatgcc

SEQ ID NO: 202768 - DNA, 20 bp, Artificial Sequence
  Description of Artificial Sequence: Synthetic oligonucleotide
  Target: ATXN1; (-) strand; PAM type: YTN; PAM sequence: CTG
ttaggaggtagaaatagaat

SEQ ID NO: 202769 - DNA, 20 bp, Artificial Sequence
  Description of Artificial Sequence: Synthetic oligonucleotide
  Target: ATXN1; (-) strand; PAM type: YTN; PAM sequence: TTC
tgttaggaggtagaaataga

SEQ ID NO: 202770 - DNA, 20 bp, Artificial Sequence
  Description of Artificial Sequence: Synthetic oligonucleotide
  Target: ATXN1; (-) strand; PAM type: YTN; PAM sequence: CTG
ttctgttaggaggtagaaat

SEQ ID NO: 202771 - DNA, 20 bp, Artificial Sequence
  Description of Artificial Sequence: Synthetic oligonucleotide
  Target: ATXN1; (-) strand; PAM type: YTN; PAM sequence: CTG
atgctgttctgttaggaggt

SEQ ID NO: 202772 - DNA, 20 bp, Artificial Sequence
  Description of Artificial Sequence: Synthetic oligonucleotide
  Target: ATXN1; (-) strand; PAM type: YTN; PAM sequence: TTG
ctgatgctgttctgttagga

SEQ ID NO: 202773 - DNA, 20 bp, Artificial Sequence
  Description of Artificial Sequence: Synthetic oligonucleotide
  Target: ATXN1; (-) strand; PAM type: YTN; PAM sequence: CTG
acagaatatgatcacaaatg

SEQ ID NO: 202774 - DNA, 20 bp, Artificial Sequence
  Description of Artificial Sequence: Synthetic oligonucleotide
  Target: ATXN1; (-) strand; PAM type: YTN; PAM sequence: TTA
gcagagcagctgacagaata

SEQ ID NO: 202775 - DNA, 20 bp, Artificial Sequence
  Description of Artificial Sequence: Synthetic oligonucleotide
  Target: ATXN1; (-) strand; PAM type: YTN; PAM sequence: TTG
ttagcagagcagctgacaga

SEQ ID NO: 202776 - DNA, 20 bp, Artificial Sequence
  Description of Artificial Sequence: Synthetic oligonucleotide
  Target: ATXN1; (-) strand; PAM type: YTN; PAM sequence: CTC
attgttagcagagcagctga

SEQ ID NO: 202777 - DNA, 20 bp, Artificial Sequence
  Description of Artificial Sequence: Synthetic oligonucleotide
  Target: ATXN1; (-) strand; PAM type: YTN; PAM sequence: TTC
tcattgttagcagagcagct

SEQ ID NO: 202778 - DNA, 20 bp, Artificial Sequence
  Description of Artificial Sequence: Synthetic oligonucleotide
  Target: ATXN1; (-) strand; PAM type: YTN; PAM sequence: TTT
ctcattgttagcagagcagc

SEQ ID NO: 202779 - DNA, 20 bp, Artificial Sequence
  Description of Artificial Sequence: Synthetic oligonucleotide
  Target: ATXN1; (-) strand; PAM type: YTN; PAM sequence: CTA
tccatatacaagtaaaaatt

SEQ ID NO: 202780 - DNA, 20 bp, Artificial Sequence
  Description of Artificial Sequence: Synthetic oligonucleotide
  Target: ATXN1; (-) strand; PAM type: YTN; PAM sequence: TTA
ctatccatatacaagtaaaa

SEQ ID NO: 202781 - DNA, 20 bp, Artificial Sequence
  Description of Artificial Sequence: Synthetic oligonucleotide
  Target: ATXN1; (-) strand; PAM type: YTN; PAM sequence: CTT
actatccatatacaagtaaa

SEQ ID NO: 202782 - DNA, 20 bp, Artificial Sequence
  Description of Artificial Sequence: Synthetic oligonucleotide
  Target: ATXN1; (-) strand; PAM type: YTN; PAM sequence: CTC
agggaacttactatccatat

SEQ ID NO: 202783 - DNA, 20 bp, Artificial Sequence
  Description of Artificial Sequence: Synthetic oligonucleotide
  Target: ATXN1; (-) strand; PAM type: YTN; PAM sequence: TTC
tcagggaacttactatccat

SEQ ID NO: 202784 - DNA, 20 bp, Artificial Sequence
  Description of Artificial Sequence: Synthetic oligonucleotide
  Target: ATXN1; (-) strand; PAM type: YTN; PAM sequence: CTT
ctcagggaacttactatcca

SEQ ID NO: 202785 - DNA, 20 bp, Artificial Sequence
  Description of Artificial Sequence: Synthetic oligonucleotide
  Target: ATXN1; (-) strand; PAM type: YTN; PAM sequence: CTG
gagatatgccttctcaggga

SEQ ID NO: 202786 - DNA, 20 bp, Artificial Sequence
  Description of Artificial Sequence: Synthetic oligonucleotide
  Target: ATXN1; (-) strand; PAM type: YTN; PAM sequence: CTG
gtcctggagatatgccttct

SEQ ID NO: 202787 - DNA, 20 bp, Artificial Sequence
  Description of Artificial Sequence: Synthetic oligonucleotide
  Target: ATXN1; (-) strand; PAM type: YTN; PAM sequence: TTG
taaagtaaaaaggcggaaca

SEQ ID NO: 202788 - DNA, 20 bp, Artificial Sequence
  Description of Artificial Sequence: Synthetic oligonucleotide
  Target: ATXN1; (-) strand; PAM type: YTN; PAM sequence: TTA
gattgtaaagtaaaaaggcg

SEQ ID NO: 202789 - DNA, 20 bp, Artificial Sequence
  Description of Artificial Sequence: Synthetic oligonucleotide
  Target: ATXN1; (-) strand; PAM type: YTN; PAM sequence: CTG
acattagattgtaaagtaaa

SEQ ID NO: 202790 - DNA, 20 bp, Artificial Sequence
  Description of Artificial Sequence: Synthetic oligonucleotide
  Target: ATXN1; (-) strand; PAM type: YTN; PAM sequence: TTG
ctgacattagattgtaaagt

SEQ ID NO: 202791 - DNA, 20 bp, Artificial Sequence
  Description of Artificial Sequence: Synthetic oligonucleotide
  Target: ATXN1; (-) strand; PAM type: YTN; PAM sequence: CTT
gctgacattagattgtaaag

SEQ ID NO: 202792 - DNA, 20 bp, Artificial Sequence
  Description of Artificial Sequence: Synthetic oligonucleotide
  Target: ATXN1; (-) strand; PAM type: YTN; PAM sequence: CTC
ttgctgacattagattgtaa

SEQ ID NO: 202793 - DNA, 20 bp, Artificial Sequence
  Description of Artificial Sequence: Synthetic oligonucleotide
  Target: ATXN1; (-) strand; PAM type: YTN; PAM sequence: CTG
tgtgcatgggtaatgtgtgc

SEQ ID NO: 202794 - DNA, 20 bp, Artificial Sequence
  Description of Artificial Sequence: Synthetic oligonucleotide
  Target: ATXN1; (-) strand; PAM type: YTN; PAM sequence: CTA
agctgtgtgcatgggtaatg

SEQ ID NO: 202795 - DNA, 20 bp, Artificial Sequence
  Description of Artificial Sequence: Synthetic oligonucleotide
  Target: ATXN1; (-) strand; PAM type: YTN; PAM sequence: TTC
taagctgtgtgcatgggtaa

SEQ ID NO: 202796 - DNA, 20 bp, Artificial Sequence
  Description of Artificial Sequence: Synthetic oligonucleotide
  Target: ATXN1; (-) strand; PAM type: YTN; PAM sequence: TTT
ctaagctgtgtgcatgggta

SEQ ID NO: 202797 - DNA, 20 bp, Artificial Sequence
  Description of Artificial Sequence: Synthetic oligonucleotide
  Target: ATXN1; (-) strand; PAM type: YTN; PAM sequence: TTA
tttctaagctgtgtgcatgg

SEQ ID NO: 202798 - DNA, 20 bp, Artificial Sequence
  Description of Artificial Sequence: Synthetic oligonucleotide
  Target: ATXN1; (-) strand; PAM type: YTN; PAM sequence: TTT
atttctaagctgtgtgcatg

SEQ ID NO: 202799 - DNA, 20 bp, Artificial Sequence
  Description of Artificial Sequence: Synthetic oligonucleotide
  Target: ATXN1; (-) strand; PAM type: YTN; PAM sequence: TTG
tttatttctaagctgtgtgc

SEQ ID NO: 202800 - DNA, 20 bp, Artificial Sequence
  Description of Artificial Sequence: Synthetic oligonucleotide
  Target: ATXN1; (-) strand; PAM type: YTN; PAM sequence: CTT
gtttatttctaagctgtgtg

SEQ ID NO: 202801 - DNA, 20 bp, Artificial Sequence
  Description of Artificial Sequence: Synthetic oligonucleotide
  Target: ATXN1; (-) strand; PAM type: YTN; PAM sequence: TTA
cacaccttgtttatttctaa

SEQ ID NO: 202802 - DNA, 20 bp, Artificial Sequence
  Description of Artificial Sequence: Synthetic oligonucleotide
  Target: ATXN1; (-) strand; PAM type: YTN; PAM sequence: TTT
acacaccttgtttatttcta

SEQ ID NO: 202803 - DNA, 20 bp, Artificial Sequence
  Description of Artificial Sequence: Synthetic oligonucleotide
  Target: ATXN1; (-) strand; PAM type: YTN; PAM sequence: TTG
cagtttacacaccttgttta

SEQ ID NO: 202804 - DNA, 20 bp, Artificial Sequence
  Description of Artificial Sequence: Synthetic oligonucleotide
  Target: ATXN1; (-) strand; PAM type: YTN; PAM sequence: TTT
gcagtttacacaccttgttt

SEQ ID NO: 202805 - DNA, 20 bp, Artificial Sequence
  Description of Artificial Sequence: Synthetic oligonucleotide
  Target: ATXN1; (-) strand; PAM type: YTN; PAM sequence: CTG
tggaaccaatttgcagttta

SEQ ID NO: 202806 - DNA, 20 bp, Artificial Sequence
  Description of Artificial Sequence: Synthetic oligonucleotide
  Target: ATXN1; (-) strand; PAM type: YTN; PAM sequence: CTC
tgtggaaccaatttgcagtt

SEQ ID NO: 202807 - DNA, 20 bp, Artificial Sequence
  Description of Artificial Sequence: Synthetic oligonucleotide
  Target: ATXN1; (-) strand; PAM type: YTN; PAM sequence: TTG
ctctgtggaaccaatttgca

SEQ ID NO: 202808 - DNA, 20 bp, Artificial Sequence
  Description of Artificial Sequence: Synthetic oligonucleotide
  Target: ATXN1; (-) strand; PAM type: YTN; PAM sequence: TTT
gctctgtggaaccaatttgc

SEQ ID NO: 202809 - DNA, 20 bp, Artificial Sequence
  Description of Artificial Sequence: Synthetic oligonucleotide
  Target: ATXN1; (-) strand; PAM type: YTN; PAM sequence: TTA
tttgctctgtggaaccaatt

SEQ ID NO: 202810 - DNA, 20 bp, Artificial Sequence
  Description of Artificial Sequence: Synthetic oligonucleotide
  Target: ATXN1; (-) strand; PAM type: YTN; PAM sequence: CTG
gtgaatcagttatttgctct

SEQ ID NO: 202811 - DNA, 20 bp, Artificial Sequence
  Description of Artificial Sequence: Synthetic oligonucleotide
  Target: ATXN1; (-) strand; PAM type: YTN; PAM sequence: TTA
cagatatctggtgaatcagt

SEQ ID NO: 202812 - DNA, 20 bp, Artificial Sequence
  Description of Artificial Sequence: Synthetic oligonucleotide
  Target: ATXN1; (-) strand; PAM type: YTN; PAM sequence: TTT
acagatatctggtgaatcag

SEQ ID NO: 202813 - DNA, 20 bp, Artificial Sequence
  Description of Artificial Sequence: Synthetic oligonucleotide
  Target: ATXN1; (-) strand; PAM type: YTN; PAM sequence: TTT
tacagatatctggtgaatca

SEQ ID NO: 202814 - DNA, 20 bp, Artificial Sequence
  Description of Artificial Sequence: Synthetic oligonucleotide
  Target: ATXN1; (-) strand; PAM type: YTN; PAM sequence: CTT
ttacagatatctggtgaatc

SEQ ID NO: 202815 - DNA, 20 bp, Artificial Sequence
  Description of Artificial Sequence: Synthetic oligonucleotide
  Target: ATXN1; (-) strand; PAM type: YTN; PAM sequence: TTG
cttttacagatatctggtga

SEQ ID NO: 202816 - DNA, 20 bp, Artificial Sequence
  Description of Artificial Sequence: Synthetic oligonucleotide
  Target: ATXN1; (-) strand; PAM type: YTN; PAM sequence: TTT
gcttttacagatatctggtg

SEQ ID NO: 202817 - DNA, 20 bp, Artificial Sequence
  Description of Artificial Sequence: Synthetic oligonucleotide
  Target: ATXN1; (-) strand; PAM type: YTN; PAM sequence: TTA
tatttgcttttacagatatc

SEQ ID NO: 202818 - DNA, 20 bp, Artificial Sequence
  Description of Artificial Sequence: Synthetic oligonucleotide
  Target: ATXN1; (-) strand; PAM type: YTN; PAM sequence: TTT
atatttgcttttacagatat

SEQ ID NO: 202819 - DNA, 20 bp, Artificial Sequence
  Description of Artificial Sequence: Synthetic oligonucleotide
  Target: ATXN1; (-) strand; PAM type: YTN; PAM sequence: TTT
tatatttgcttttacagata

SEQ ID NO: 202820 - DNA, 20 bp, Artificial Sequence
  Description of Artificial Sequence: Synthetic oligonucleotide
  Target: ATXN1; (-) strand; PAM type: YTN; PAM sequence: TTC
atggattttatatttgcttt

SEQ ID NO: 202821 - DNA, 20 bp, Artificial Sequence
  Description of Artificial Sequence: Synthetic oligonucleotide
  Target: ATXN1; (-) strand; PAM type: YTN; PAM sequence: TTC
aatacagagacataattcat

SEQ ID NO: 202822 - DNA, 20 bp, Artificial Sequence
  Description of Artificial Sequence: Synthetic oligonucleotide
  Target: ATXN1; (-) strand; PAM type: YTN; PAM sequence: TTT
caatacagagacataattca

SEQ ID NO: 202823 - DNA, 20 bp, Artificial Sequence
  Description of Artificial Sequence: Synthetic oligonucleotide
  Target: ATXN1; (-) strand; PAM type: YTN; PAM sequence: TTT
tcaatacagagacataattc

SEQ ID NO: 202824 - DNA, 20 bp, Artificial Sequence
  Description of Artificial Sequence: Synthetic oligonucleotide
  Target: ATXN1; (-) strand; PAM type: YTN; PAM sequence: TTT
ttcaatacagagacataatt

SEQ ID NO: 202825 - DNA, 20 bp, Artificial Sequence
  Description of Artificial Sequence: Synthetic oligonucleotide
  Target: ATXN1; (-) strand; PAM type: YTN; PAM sequence: TTA
tggtttttcaatacagagac

SEQ ID NO: 202826 - DNA, 20 bp, Artificial Sequence
  Description of Artificial Sequence: Synthetic oligonucleotide
  Target: ATXN1; (-) strand; PAM type: YTN; PAM sequence: TTT
atggtttttcaatacagaga

SEQ ID NO: 202827 - DNA, 20 bp, Artificial Sequence
  Description of Artificial Sequence: Synthetic oligonucleotide
  Target: ATXN1; (-) strand; PAM type: YTN; PAM sequence: TTT
tatggtttttcaatacagag

SEQ ID NO: 202828 - DNA, 20 bp, Artificial Sequence
  Description of Artificial Sequence: Synthetic oligonucleotide
  Target: ATXN1; (-) strand; PAM type: YTN; PAM sequence: CTG
agcattttatggtttttcaa

SEQ ID NO: 202829 - DNA, 20 bp, Artificial Sequence
  Description of Artificial Sequence: Synthetic oligonucleotide
  Target: ATXN1; (-) strand; PAM type: YTN; PAM sequence: TTA
acataaaggtcctgagcatt

SEQ ID NO: 202830 - DNA, 20 bp, Artificial Sequence
  Description of Artificial Sequence: Synthetic oligonucleotide
  Target: ATXN1; (-) strand; PAM type: YTN; PAM sequence: TTA
gttaacataaaggtcctgag

SEQ ID NO: 202831 - DNA, 20 bp, Artificial Sequence
  Description of Artificial Sequence: Synthetic oligonucleotide
  Target: ATXN1; (-) strand; PAM type: YTN; PAM sequence: TTT
agttaacataaaggtcctga

SEQ ID NO: 202832 - DNA, 20 bp, Artificial Sequence
  Description of Artificial Sequence: Synthetic oligonucleotide
  Target: ATXN1; (-) strand; PAM type: YTN; PAM sequence: CTT
tagttaacataaaggtcctg

SEQ ID NO: 202833 - DNA, 20 bp, Artificial Sequence
  Description of Artificial Sequence: Synthetic oligonucleotide
  Target: ATXN1; (-) strand; PAM type: YTN; PAM sequence: CTA
acacatggaaggaaaatact

SEQ ID NO: 202834 - DNA, 20 bp, Artificial Sequence
  Description of Artificial Sequence: Synthetic oligonucleotide
  Target: ATXN1; (-) strand; PAM type: YTN; PAM sequence: CTA
cacatataaggggaaaatct

SEQ ID NO: 202835 - DNA, 20 bp, Artificial Sequence
  Description of Artificial Sequence: Synthetic oligonucleotide
  Target: ATXN1; (-) strand; PAM type: YTN; PAM sequence: TTC
tacacatataaggggaaaat

SEQ ID NO: 202836 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgttctacacatat

SEQ ID NO: 202837 - DNA, 20 bp, Artificial Sequence
  Description of Artificial Sequence: Synthetic oligonucleotide
  Target: ATXN1; (-) strand; PAM type: YTN; PAM sequence: TTT
gtgtgtgtgttctacacata

SEQ ID NO: 202838 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtgtgttctacacat

SEQ ID NO: 202839 - DNA, 20 bp, Artificial Sequence
  Description of Artificial Sequence: Synthetic oligonucleotide
  Target: ATXN1; (-) strand; PAM type: YTN; PAM sequence: CTT
ttgtgtgtgtgttctacaca

SEQ ID NO: 202840 - DNA, 20 bp, Artificial Sequence
  Description of Artificial Sequence: Synthetic oligonucleotide
  Target: ATXN1; (-) strand; PAM type: YTN; PAM sequence: CTC
ttttgtgtgtgtgttctaca

SEQ ID NO: 202841 - DNA, 20 bp, Artificial Sequence
  Description of Artificial Sequence: Synthetic oligonucleotide
  Target: ATXN1; (-) strand; PAM type: YTN; PAM sequence: TTC
tcttttgtgtgtgtgttcta

SEQ ID NO: 202842 - DNA, 20 bp, Artificial Sequence
  Description of Artificial Sequence: Synthetic oligonucleotide
  Target: ATXN1; (-) strand; PAM type: YTN; PAM sequence: TTA
taattctcttttgtgtgtgt

SEQ ID NO: 202843 - DNA, 20 bp, Artificial Sequence
  Description of Artificial Sequence: Synthetic oligonucleotide
  Target: ATXN1; (-) strand; PAM type: YTN; PAM sequence: TTT
ataattctcttttgtgtgtg

SEQ ID NO: 202844 - DNA, 20 bp, Artificial Sequence
  Description of Artificial Sequence: Synthetic oligonucleotide
  Target: ATXN1; (-) strand; PAM type: YTN; PAM sequence: CTG
acgtttataattctcttttg

SEQ ID NO: 202845 - DNA, 20 bp, Artificial Sequence
  Description of Artificial Sequence: Synthetic oligonucleotide
  Target: ATXN1; (-) strand; PAM type: YTN; PAM sequence: CTC
tgacgtttataattctcttt

SEQ ID NO: 202846 - DNA, 20 bp, Artificial Sequence
  Description of Artificial Sequence: Synthetic oligonucleotide
  Target: ATXN1; (-) strand; PAM type: YTN; PAM sequence: TTA
aaagagctctgacgtttata

SEQ ID NO: 202847 - DNA, 20 bp, Artificial Sequence
  Description of Artificial Sequence: Synthetic oligonucleotide
  Target: ATXN1; (-) strand; PAM type: YTN; PAM sequence: TTA
aaggttaaaagagctctgac

SEQ ID NO: 202848 - DNA, 20 bp, Artificial Sequence
  Description of Artificial Sequence: Synthetic oligonucleotide
  Target: ATXN1; (-) strand; PAM type: YTN; PAM sequence: TTT
aaaggttaaaagagctctga

SEQ ID NO: 202849 - DNA, 20 bp, Artificial Sequence
  Description of Artificial Sequence: Synthetic oligonucleotide
  Target: ATXN1; (-) strand; PAM type: YTN; PAM sequence: TTT
taaaggttaaaagagctctg

SEQ ID NO: 202850 - DNA, 20 bp, Artificial Sequence
  Description of Artificial Sequence: Synthetic oligonucleotide
  Target: ATXN1; (-) strand; PAM type: YTN; PAM sequence: TTT
ttaaaggttaaaagagctct

SEQ ID NO: 202851 - DNA, 20 bp, Artificial Sequence
  Description of Artificial Sequence: Synthetic oligonucleotide
  Target: ATXN1; (-) strand; PAM type: YTN; PAM sequence: TTG
gtttttaaaggttaaaagag

SEQ ID NO: 202852 - DNA, 20 bp, Artificial Sequence
  Description of Artificial Sequence: Synthetic oligonucleotide
  Target: ATXN1; (-) strand; PAM type: YTN; PAM sequence: CTG
tgttggtttttaaaggttaa

SEQ ID NO: 202853 - DNA, 20 bp, Artificial Sequence
  Description of Artificial Sequence: Synthetic oligonucleotide
  Target: ATXN1; (-) strand; PAM type: YTN; PAM sequence: TTA
ctgtgttggtttttaaaggt

SEQ ID NO: 202854 - DNA, 20 bp, Artificial Sequence
  Description of Artificial Sequence: Synthetic oligonucleotide
  Target: ATXN1; (-) strand; PAM type: YTN; PAM sequence: TTG
caatataattactgtgttgg

SEQ ID NO: 202855 - DNA, 20 bp, Artificial Sequence
  Description of Artificial Sequence: Synthetic oligonucleotide
  Target: ATXN1; (-) strand; PAM type: YTN; PAM sequence: TTT
gcaatataattactgtgttg

SEQ ID NO: 202856 - DNA, 20 bp, Artificial Sequence
  Description of Artificial Sequence: Synthetic oligonucleotide
  Target: ATXN1; (-) strand; PAM type: YTN; PAM sequence: CTT
tgcaatataattactgtgtt

SEQ ID NO: 202857 - DNA, 20 bp, Artificial Sequence
  Description of Artificial Sequence: Synthetic oligonucleotide
  Target: ATXN1; (-) strand; PAM type: YTN; PAM sequence: TTG
tcagatatctttgcaatata

SEQ ID NO: 202858 - DNA, 20 bp, Artificial Sequence
  Description of Artificial Sequence: Synthetic oligonucleotide
  Target: ATXN1; (-) strand; PAM type: YTN; PAM sequence: CTG
ggttgtcagatatctttgca

SEQ ID NO: 202859 - DNA, 20 bp, Artificial Sequence
  Description of Artificial Sequence: Synthetic oligonucleotide
  Target: ATXN1; (-) strand; PAM type: YTN; PAM sequence: CTC
tgggttgtcagatatctttg

SEQ ID NO: 202860 - DNA, 20 bp, Artificial Sequence
  Description of Artificial Sequence: Synthetic oligonucleotide
  Target: ATXN1; (-) strand; PAM type: YTN; PAM sequence: TTA
ctctgggttgtcagatatct

SEQ ID NO: 202861 - DNA, 20 bp, Artificial Sequence
  Description of Artificial Sequence: Synthetic oligonucleotide
  Target: ATXN1; (-) strand; PAM type: YTN; PAM sequence: CTA
gtattactctgggttgtcag

SEQ ID NO: 202862 - DNA, 20 bp, Artificial Sequence
  Description of Artificial Sequence: Synthetic oligonucleotide
  Target: ATXN1; (-) strand; PAM type: YTN; PAM sequence: TTC
tagtattactctgggttgtc

SEQ ID NO: 202863 - DNA, 20 bp, Artificial Sequence
  Description of Artificial Sequence: Synthetic oligonucleotide
  Target: ATXN1; (-) strand; PAM type: YTN; PAM sequence: TTT
ctagtattactctgggttgt

SEQ ID NO: 202864 - DNA, 20 bp, Artificial Sequence
  Description of Artificial Sequence: Synthetic oligonucleotide
  Target: ATXN1; (-) strand; PAM type: YTN; PAM sequence: TTT
tctagtattactctgggttg

SEQ ID NO: 202865 - DNA, 20 bp, Artificial Sequence
  Description of Artificial Sequence: Synthetic oligonucleotide
  Target: ATXN1; (-) strand; PAM type: YTN; PAM sequence: CTT
ttctagtattactctgggtt

SEQ ID NO: 202866 - DNA, 20 bp, Artificial Sequence
  Description of Artificial Sequence: Synthetic oligonucleotide
  Target: ATXN1; (-) strand; PAM type: YTN; PAM sequence: TTA
aaagaagggggcgcagaaat

SEQ ID NO: 202867 - DNA, 20 bp, Artificial Sequence
  Description of Artificial Sequence: Synthetic oligonucleotide
  Target: ATXN1; (-) strand; PAM type: YTN; PAM sequence: TTT
aaaagaagggggcgcagaaa

SEQ ID NO: 202868 - DNA, 20 bp, Artificial Sequence
  Description of Artificial Sequence: Synthetic oligonucleotide
  Target: ATXN1; (-) strand; PAM type: YTN; PAM sequence: CTA
tttaaaagaagggggcgcag

SEQ ID NO: 202869 - DNA, 20 bp, Artificial Sequence
  Description of Artificial Sequence: Synthetic oligonucleotide
  Target: ATXN1; (-) strand; PAM type: YTN; PAM sequence: TTG
agaactatttaaaagaaggg

SEQ ID NO: 202870 - DNA, 20 bp, Artificial Sequence
  Description of Artificial Sequence: Synthetic oligonucleotide
  Target: ATXN1; (-) strand; PAM type: YTN; PAM sequence: TTG
tagaaaaattgagaactatt

SEQ ID NO: 202871 - DNA, 20 bp, Artificial Sequence
  Description of Artificial Sequence: Synthetic oligonucleotide
  Target: ATXN1; (-) strand; PAM type: YTN; PAM sequence: CTA
taaattgtagaaaaattgag

SEQ ID NO: 202872 - DNA, 20 bp, Artificial Sequence
  Description of Artificial Sequence: Synthetic oligonucleotide
  Target: ATXN1; (-) strand; PAM type: YTN; PAM sequence: TTG
cacagtccgcctataaattg

SEQ ID NO: 202873 - DNA, 20 bp, Artificial Sequence
  Description of Artificial Sequence: Synthetic oligonucleotide
  Target: ATXN1; (-) strand; PAM type: YTN; PAM sequence: TTT
gcacagtccgcctataaatt

SEQ ID NO: 202874 - DNA, 20 bp, Artificial Sequence
  Description of Artificial Sequence: Synthetic oligonucleotide
  Target: ATXN1; (-) strand; PAM type: YTN; PAM sequence: TTT
tgcacagtccgcctataaat

SEQ ID NO: 202875 - DNA, 20 bp, Artificial Sequence
  Description of Artificial Sequence: Synthetic oligonucleotide
  Target: ATXN1; (-) strand; PAM type: YTN; PAM sequence: CTT
ttgcacagtccgcctataaa

SEQ ID NO: 202876 - DNA, 20 bp, Artificial Sequence
  Description of Artificial Sequence: Synthetic oligonucleotide
  Target: ATXN1; (-) strand; PAM type: YTN; PAM sequence: CTA
tgaaaatcttttgcacagtc

SEQ ID NO: 202877 - DNA, 20 bp, Artificial Sequence
  Description of Artificial Sequence: Synthetic oligonucleotide
  Target: ATXN1; (-) strand; PAM type: YTN; PAM sequence: TTC
atggctatgaaaatcttttg

SEQ ID NO: 202878 - DNA, 20 bp, Artificial Sequence
  Description of Artificial Sequence: Synthetic oligonucleotide
  Target: ATXN1; (-) strand; PAM type: YTN; PAM sequence: TTA
ataggattcatggctatgaa

SEQ ID NO: 202879 - DNA, 20 bp, Artificial Sequence
  Description of Artificial Sequence: Synthetic oligonucleotide
  Target: ATXN1; (-) strand; PAM type: YTN; PAM sequence: TTT
aataggattcatggctatga

SEQ ID NO: 202880 - DNA, 20 bp, Artificial Sequence
  Description of Artificial Sequence: Synthetic oligonucleotide
  Target: ATXN1; (-) strand; PAM type: YTN; PAM sequence: CTT
taataggattcatggctatg

SEQ ID NO: 202881 - DNA, 20 bp, Artificial Sequence
  Description of Artificial Sequence: Synthetic oligonucleotide
  Target: ATXN1; (-) strand; PAM type: YTN; PAM sequence: CTC
ccaatgtatctttaatagga

SEQ ID NO: 202882 - DNA, 20 bp, Artificial Sequence
  Description of Artificial Sequence: Synthetic oligonucleotide
  Target: ATXN1; (-) strand; PAM type: YTN; PAM sequence: TTA
tctcccaatgtatctttaat

SEQ ID NO: 202883 - DNA, 20 bp, Artificial Sequence
  Description of Artificial Sequence: Synthetic oligonucleotide
  Target: ATXN1; (-) strand; PAM type: YTN; PAM sequence: TTT
atctcccaatgtatctttaa

SEQ ID NO: 202884 - DNA, 20 bp, Artificial Sequence
  Description of Artificial Sequence: Synthetic oligonucleotide
  Target: ATXN1; (-) strand; PAM type: YTN; PAM sequence: TTT
tatctcccaatgtatcttta

SEQ ID NO: 202885 - DNA, 20 bp, Artificial Sequence
  Description of Artificial Sequence: Synthetic oligonucleotide
  Target: ATXN1; (-) strand; PAM type: YTN; PAM sequence: TTA
ttttatctcccaatgtatct

SEQ ID NO: 202886 - DNA, 20 bp, Artificial Sequence
  Description of Artificial Sequence: Synthetic oligonucleotide
  Target: ATXN1; (-) strand; PAM type: YTN; PAM sequence: TTT
attttatctcccaatgtatc

SEQ ID NO: 202887 - DNA, 20 bp, Artificial Sequence
  Description of Artificial Sequence: Synthetic oligonucleotide
  Target: ATXN1; (-) strand; PAM type: YTN; PAM sequence: TTT
tattttatctcccaatgtat

SEQ ID NO: 202888 - DNA, 20 bp, Artificial Sequence
  Description of Artificial Sequence: Synthetic oligonucleotide
  Target: ATXN1; (-) strand; PAM type: YTN; PAM sequence: TTG
gaatagtgattttattttat

SEQ ID NO: 202889 - DNA, 20 bp, Artificial Sequence
  Description of Artificial Sequence: Synthetic oligonucleotide
  Target: ATXN1; (-) strand; PAM type: YTN; PAM sequence: TTG
cgaattggaatagtgatttt

SEQ ID NO: 202890 - DNA, 20 bp, Artificial Sequence
  Description of Artificial Sequence: Synthetic oligonucleotide
  Target: ATXN1; (-) strand; PAM type: YTN; PAM sequence: CTT
gcgaattggaatagtgattt

SEQ ID NO: 202891 - DNA, 20 bp, Artificial Sequence
  Description of Artificial Sequence: Synthetic oligonucleotide
  Target: ATXN1; (-) strand; PAM type: YTN; PAM sequence: TTC
ttgcgaattggaatagtgat

SEQ ID NO: 202892 - DNA, 20 bp, Artificial Sequence
  Description of Artificial Sequence: Synthetic oligonucleotide
  Target: ATXN1; (-) strand; PAM type: YTN; PAM sequence: TTC
aaatattcttgcgaattgga

SEQ ID NO: 202893 - DNA, 20 bp, Artificial Sequence
  Description of Artificial Sequence: Synthetic oligonucleotide
  Target: ATXN1; (-) strand; PAM type: YTN; PAM sequence: TTT
caaatattcttgcgaattgg

SEQ ID NO: 202894 - DNA, 20 bp, Artificial Sequence
  Description of Artificial Sequence: Synthetic oligonucleotide
  Target: ATXN1; (-) strand; PAM type: YTN; PAM sequence: TTG
gcagcgtttcaaatattctt

SEQ ID NO: 202895 - DNA, 20 bp, Artificial Sequence
  Description of Artificial Sequence: Synthetic oligonucleotide
  Target: ATXN1; (-) strand; PAM type: YTN; PAM sequence: TTT
ggcagcgtttcaaatattct

SEQ ID NO: 202896 - DNA, 20 bp, Artificial Sequence
  Description of Artificial Sequence: Synthetic oligonucleotide
  Target: ATXN1; (-) strand; PAM type: YTN; PAM sequence: CTT
tggcagcgtttcaaatattc

SEQ ID NO: 202897 - DNA, 20 bp, Artificial Sequence
  Description of Artificial Sequence: Synthetic oligonucleotide
  Target: ATXN1; (-) strand; PAM type: YTN; PAM sequence: TTC
cctttggcagcgtttcaaat

SEQ ID NO: 202898 - DNA, 20 bp, Artificial Sequence
  Description of Artificial Sequence: Synthetic oligonucleotide
  Target: ATXN1; (-) strand; PAM type: YTN; PAM sequence: TTG
gagaaacattccctttggca

SEQ ID NO: 202899 - DNA, 20 bp, Artificial Sequence
  Description of Artificial Sequence: Synthetic oligonucleotide
  Target: ATXN1; (-) strand; PAM type: YTN; PAM sequence: TTT
ggagaaacattccctttggc

SEQ ID NO: 202900 - DNA, 20 bp, Artificial Sequence
  Description of Artificial Sequence: Synthetic oligonucleotide
  Target: ATXN1; (-) strand; PAM type: YTN; PAM sequence: TTA
tgtttggagaaacattccct

SEQ ID NO: 202901 - DNA, 20 bp, Artificial Sequence
  Description of Artificial Sequence: Synthetic oligonucleotide
  Target: ATXN1; (-) strand; PAM type: YTN; PAM sequence: TTT
atgtttggagaaacattccc

SEQ ID NO: 202902 - DNA, 20 bp, Artificial Sequence
  Description of Artificial Sequence: Synthetic oligonucleotide
  Target: ATXN1; (-) strand; PAM type: YTN; PAM sequence: CTT
tatgtttggagaaacattcc

SEQ ID NO: 202903 - DNA, 20 bp, Artificial Sequence
  Description of Artificial Sequence: Synthetic oligonucleotide
  Target: ATXN1; (-) strand; PAM type: YTN; PAM sequence: CTC
tttatgtttggagaaacatt

SEQ ID NO: 202904 - DNA, 20 bp, Artificial Sequence
  Description of Artificial Sequence: Synthetic oligonucleotide
  Target: ATXN1; (-) strand; PAM type: YTN; PAM sequence: CTC
tctttatgtttggagaaaca

SEQ ID NO: 202905 - DNA, 20 bp, Artificial Sequence
  Description of Artificial Sequence: Synthetic oligonucleotide
  Target: ATXN1; (-) strand; PAM type: YTN; PAM sequence: TTA
atactctctttatgtttgga

SEQ ID NO: 202906 - DNA, 20 bp, Artificial Sequence
  Description of Artificial Sequence: Synthetic oligonucleotide
  Target: ATXN1; (-) strand; PAM type: YTN; PAM sequence: TTT
aatactctctttatgtttgg

SEQ ID NO: 202907 - DNA, 20 bp, Artificial Sequence
  Description of Artificial Sequence: Synthetic oligonucleotide
  Target: ATXN1; (-) strand; PAM type: YTN; PAM sequence: TTA
aaatttaatactctctttat

SEQ ID NO: 202908 - DNA, 20 bp, Artificial Sequence
  Description of Artificial Sequence: Synthetic oligonucleotide
  Target: ATXN1; (-) strand; PAM type: YTN; PAM sequence: CTT
aaaatttaatactctcttta

SEQ ID NO: 202909 - DNA, 20 bp, Artificial Sequence
  Description of Artificial Sequence: Synthetic oligonucleotide
  Target: ATXN1; (-) strand; PAM type: YTN; PAM sequence: CTC
ttaaaatttaatactctctt

SEQ ID NO: 202910 - DNA, 20 bp, Artificial Sequence
  Description of Artificial Sequence: Synthetic oligonucleotide
  Target: ATXN1; (-) strand; PAM type: YTN; PAM sequence: CTC
tcttaaaatttaatactctc

SEQ ID NO: 202911 - DNA, 20 bp, Artificial Sequence
  Description of Artificial Sequence: Synthetic oligonucleotide
  Target: ATXN1; (-) strand; PAM type: YTN; PAM sequence: CTC
tctcttaaaatttaatactc

SEQ ID NO: 202912 - DNA, 20 bp, Artificial Sequence
  Description of Artificial Sequence: Synthetic oligonucleotide
  Target: ATXN1; (-) strand; PAM type: YTN; PAM sequence: TTG
atgatagcctctctcttaaa

SEQ ID NO: 202913 - DNA, 20 bp, Artificial Sequence
  Description of Artificial Sequence: Synthetic oligonucleotide
  Target: ATXN1; (-) strand; PAM type: YTN; PAM sequence: TTT
gatgatagcctctctcttaa

SEQ ID NO: 202914 - DNA, 20 bp, Artificial Sequence
  Description of Artificial Sequence: Synthetic oligonucleotide
  Target: ATXN1; (-) strand; PAM type: YTN; PAM sequence: TTT
tgatgatagcctctctctta

SEQ ID NO: 202915 - DNA, 20 bp, Artificial Sequence
  Description of Artificial Sequence: Synthetic oligonucleotide
  Target: ATXN1; (-) strand; PAM type: YTN; PAM sequence: TTC
gttttgatgatagcctctct

SEQ ID NO: 202916 - DNA, 20 bp, Artificial Sequence
  Description of Artificial Sequence: Synthetic oligonucleotide
  Target: ATXN1; (-) strand; PAM type: YTN; PAM sequence: CTT
cgttttgatgatagcctctc

SEQ ID NO: 202917 - DNA, 20 bp, Artificial Sequence
  Description of Artificial Sequence: Synthetic oligonucleotide
  Target: ATXN1; (-) strand; PAM type: YTN; PAM sequence: CTG
ccttcgttttgatgatagcc

SEQ ID NO: 202918 - DNA, 20 bp, Artificial Sequence
  Description of Artificial Sequence: Synthetic oligonucleotide
  Target: ATXN1; (-) strand; PAM type: YTN; PAM sequence: CTC
tgccttcgttttgatgatag

SEQ ID NO: 202919 - DNA, 20 bp, Artificial Sequence
  Description of Artificial Sequence: Synthetic oligonucleotide
  Target: ATXN1; (-) strand; PAM type: YTN; PAM sequence: CTC
tctgccttcgttttgatgat

SEQ ID NO: 202920 - DNA, 20 bp, Artificial Sequence
  Description of Artificial Sequence: Synthetic oligonucleotide
  Target: ATXN1; (-) strand; PAM type: YTN; PAM sequence: TTC
tctctgccttcgttttgatg

SEQ ID NO: 202921 - DNA, 20 bp, Artificial Sequence
  Description of Artificial Sequence: Synthetic oligonucleotide
  Target: ATXN1; (-) strand; PAM type: YTN; PAM sequence: CTT
ctctctgccttcgttttgat

SEQ ID NO: 202922 - DNA, 20 bp, Artificial Sequence
  Description of Artificial Sequence: Synthetic oligonucleotide
  Target: ATXN1; (-) strand; PAM type: YTN; PAM sequence: TTA
tgtgtacttctctctgcctt

SEQ ID NO: 202923 - DNA, 20 bp, Artificial Sequence
  Description of Artificial Sequence: Synthetic oligonucleotide
  Target: ATXN1; (-) strand; PAM type: YTN; PAM sequence: CTT
atgtgtacttctctctgcct

SEQ ID NO: 202924 - DNA, 20 bp, Artificial Sequence
  Description of Artificial Sequence: Synthetic oligonucleotide
  Target: ATXN1; (-) strand; PAM type: YTN; PAM sequence: TTG
acttatgtgtacttctctct

SEQ ID NO: 202925 - DNA, 20 bp, Artificial Sequence
  Description of Artificial Sequence: Synthetic oligonucleotide
  Target: ATXN1; (-) strand; PAM type: YTN; PAM sequence: TTG
tcaggttgacttatgtgtac

SEQ ID NO: 202926 - DNA, 20 bp, Artificial Sequence
  Description of Artificial Sequence: Synthetic oligonucleotide
  Target: ATXN1; (-) strand; PAM type: YTN; PAM sequence: CTT
gtcaggttgacttatgtgta

SEQ ID NO: 202927 - DNA, 20 bp, Artificial Sequence
  Description of Artificial Sequence: Synthetic oligonucleotide
  Target: ATXN1; (-) strand; PAM type: YTN; PAM sequence: TTA
tcaatatgggcttgtcaggt

SEQ ID NO: 202928 - DNA, 20 bp, Artificial Sequence
  Description of Artificial Sequence: Synthetic oligonucleotide
  Target: ATXN1; (-) strand; PAM type: YTN; PAM sequence: TTT
atcaatatgggcttgtcagg

SEQ ID NO: 202929 - DNA, 20 bp, Artificial Sequence
  Description of Artificial Sequence: Synthetic oligonucleotide
  Target: ATXN1; (-) strand; PAM type: YTN; PAM sequence: CTT
tatcaatatgggcttgtcag

SEQ ID NO: 202930 - DNA, 20 bp, Artificial Sequence
  Description of Artificial Sequence: Synthetic oligonucleotide
  Target: ATXN1; (-) strand; PAM type: YTN; PAM sequence: CTG
ctttatcaatatgggcttgt

SEQ ID NO: 202931 - DNA, 20 bp, Artificial Sequence
  Description of Artificial Sequence: Synthetic oligonucleotide
  Target: ATXN1; (-) strand; PAM type: YTN; PAM sequence: CTC
tgctttatcaatatgggctt

SEQ ID NO: 202932 - DNA, 20 bp, Artificial Sequence
  Description of Artificial Sequence: Synthetic oligonucleotide
  Target: ATXN1; (-) strand; PAM type: YTN; PAM sequence: TTA
tctctgctttatcaatatgg

SEQ ID NO: 202933 - DNA, 20 bp, Artificial Sequence
  Description of Artificial Sequence: Synthetic oligonucleotide
  Target: ATXN1; (-) strand; PAM type: YTN; PAM sequence: TTT
atctctgctttatcaatatg

SEQ ID NO: 202934 - DNA, 20 bp, Artificial Sequence
  Description of Artificial Sequence: Synthetic oligonucleotide
  Target: ATXN1; (-) strand; PAM type: YTN; PAM sequence: TTT
tatctctgctttatcaatat

SEQ ID NO: 202935 - DNA, 20 bp, Artificial Sequence
  Description of Artificial Sequence: Synthetic oligonucleotide
  Target: ATXN1; (-) strand; PAM type: YTN; PAM sequence: CTT
ttatctctgctttatcaata

SEQ ID NO: 202936 - DNA, 20 bp, Artificial Sequence
  Description of Artificial Sequence: Synthetic oligonucleotide
  Target: ATXN1; (-) strand; PAM type: YTN; PAM sequence: CTG
gagataacttttatctctgc

SEQ ID NO: 202937 - DNA, 20 bp, Artificial Sequence
  Description of Artificial Sequence: Synthetic oligonucleotide
  Target: ATXN1; (-) strand; PAM type: YTN; PAM sequence: CTG
taccgggcatgtaacctgga

SEQ ID NO: 202938 - DNA, 20 bp, Artificial Sequence
  Description of Artificial Sequence: Synthetic oligonucleotide
  Target: ATXN1; (-) strand; PAM type: YTN; PAM sequence: CTG
cctgtaccgggcatgtaacc

SEQ ID NO: 202939 - DNA, 20 bp, Artificial Sequence
  Description of Artificial Sequence: Synthetic oligonucleotide
  Target: ATXN1; (-) strand; PAM type: YTN; PAM sequence: TTG
agaactgcctgtaccgggca

SEQ ID NO: 202940 - DNA, 20 bp, Artificial Sequence
  Description of Artificial Sequence: Synthetic oligonucleotide
  Target: ATXN1; (-) strand; PAM type: YTN; PAM sequence: TTC
atacattgagaactgcctgt

SEQ ID NO: 202941 - DNA, 20 bp, Artificial Sequence
  Description of Artificial Sequence: Synthetic oligonucleotide
  Target: ATXN1; (-) strand; PAM type: YTN; PAM sequence: CTC
attcatacattgagaactgc

SEQ ID NO: 202942 - DNA, 20 bp, Artificial Sequence
  Description of Artificial Sequence: Synthetic oligonucleotide
  Target: ATXN1; (-) strand; PAM type: YTN; PAM sequence: CTG
tatacaactcattcatacat

SEQ ID NO: 202943 - DNA, 20 bp, Artificial Sequence
  Description of Artificial Sequence: Synthetic oligonucleotide
  Target: ATXN1; (-) strand; PAM type: YTN; PAM sequence: TTC
tgtatacaactcattcatac

SEQ ID NO: 202944 - DNA, 20 bp, Artificial Sequence
  Description of Artificial Sequence: Synthetic oligonucleotide
  Target: ATXN1; (-) strand; PAM type: YTN; PAM sequence: TTT
ctgtatacaactcattcata

SEQ ID NO: 202945 - DNA, 20 bp, Artificial Sequence
  Description of Artificial Sequence: Synthetic oligonucleotide
  Target: ATXN1; (-) strand; PAM type: YTN; PAM sequence: CTT
tctgtatacaactcattcat

SEQ ID NO: 202946 - DNA, 20 bp, Artificial Sequence
  Description of Artificial Sequence: Synthetic oligonucleotide
  Target: ATXN1; (-) strand; PAM type: YTN; PAM sequence: TTA
caaatgaactttctgtatac

SEQ ID NO: 202947 - DNA, 20 bp, Artificial Sequence
  Description of Artificial Sequence: Synthetic oligonucleotide
  Target: ATXN1; (-) strand; PAM type: YTN; PAM sequence: CTT
acaaatgaactttctgtata

SEQ ID NO: 202948 - DNA, 20 bp, Artificial Sequence
  Description of Artificial Sequence: Synthetic oligonucleotide
  Target: ATXN1; (-) strand; PAM type: YTN; PAM sequence: TTC
aaataaatgacttacaaatg

SEQ ID NO: 202949 - DNA, 20 bp, Artificial Sequence
  Description of Artificial Sequence: Synthetic oligonucleotide
  Target: ATXN1; (-) strand; PAM type: YTN; PAM sequence: TTT
caaataaatgacttacaaat

SEQ ID NO: 202950 - DNA, 20 bp, Artificial Sequence
  Description of Artificial Sequence: Synthetic oligonucleotide
  Target: ATXN1; (-) strand; PAM type: YTN; PAM sequence: TTG
gagtttcaaataaatgactt

SEQ ID NO: 202951 - DNA, 20 bp, Artificial Sequence
  Description of Artificial Sequence: Synthetic oligonucleotide
  Target: ATXN1; (-) strand; PAM type: YTN; PAM sequence: TTT
ggagtttcaaataaatgact

SEQ ID NO: 202952 - DNA, 20 bp, Artificial Sequence
  Description of Artificial Sequence: Synthetic oligonucleotide
  Target: ATXN1; (-) strand; PAM type: YTN; PAM sequence: CTG
agaaaatgtgtttggagttt

SEQ ID NO: 202953 - DNA, 20 bp, Artificial Sequence
  Description of Artificial Sequence: Synthetic oligonucleotide
  Target: ATXN1; (-) strand; PAM type: YTN; PAM sequence: CTC
tgagaaaatgtgtttggagt

SEQ ID NO: 202954 - DNA, 20 bp, Artificial Sequence
  Description of Artificial Sequence: Synthetic oligonucleotide
  Target: ATXN1; (-) strand; PAM type: YTN; PAM sequence: TTC
tctgagaaaatgtgtttgga

SEQ ID NO: 202955 - DNA, 20 bp, Artificial Sequence
  Description of Artificial Sequence: Synthetic oligonucleotide
  Target: ATXN1; (-) strand; PAM type: YTN; PAM sequence: TTT
ctctgagaaaatgtgtttgg

SEQ ID NO: 202956 - DNA, 20 bp, Artificial Sequence
  Description of Artificial Sequence: Synthetic oligonucleotide
  Target: ATXN1; (-) strand; PAM type: YTN; PAM sequence: CTG
tttctctgagaaaatgtgtt

SEQ ID NO: 202957 - DNA, 20 bp, Artificial Sequence
  Description of Artificial Sequence: Synthetic oligonucleotide
  Target: ATXN1; (-) strand; PAM type: YTN; PAM sequence: TTA
taacactgtttctctgagaa

SEQ ID NO: 202958 - DNA, 20 bp, Artificial Sequence
  Description of Artificial Sequence: Synthetic oligonucleotide
  Target: ATXN1; (-) strand; PAM type: YTN; PAM sequence: TTT
ataacactgtttctctgaga

SEQ ID NO: 202959 - DNA, 20 bp, Artificial Sequence
  Description of Artificial Sequence: Synthetic oligonucleotide
  Target: ATXN1; (-) strand; PAM type: YTN; PAM sequence: CTA
tttataacactgtttctctg

SEQ ID NO: 202960 - DNA, 20 bp, Artificial Sequence
  Description of Artificial Sequence: Synthetic oligonucleotide
  Target: ATXN1; (-) strand; PAM type: YTN; PAM sequence: CTA
agcactatttataacactgt

SEQ ID NO: 202961 - DNA, 20 bp, Artificial Sequence
  Description of Artificial Sequence: Synthetic oligonucleotide
  Target: ATXN1; (-) strand; PAM type: YTN; PAM sequence: CTG
caaaactaagcactatttat

SEQ ID NO: 202962 - DNA, 20 bp, Artificial Sequence
  Description of Artificial Sequence: Synthetic oligonucleotide
  Target: ATXN1; (-) strand; PAM type: YTN; PAM sequence: TTC
ctgcaaaactaagcactatt

SEQ ID NO: 202963 - DNA, 20 bp, Artificial Sequence
  Description of Artificial Sequence: Synthetic oligonucleotide
  Target: ATXN1; (-) strand; PAM type: YTN; PAM sequence: CTT
cctgcaaaactaagcactat

SEQ ID NO: 202964 - DNA, 20 bp, Artificial Sequence
  Description of Artificial Sequence: Synthetic oligonucleotide
  Target: ATXN1; (-) strand; PAM type: YTN; PAM sequence: TTG
ccttcctgcaaaactaagca

SEQ ID NO: 202965 - DNA, 20 bp, Artificial Sequence
  Description of Artificial Sequence: Synthetic oligonucleotide
  Target: ATXN1; (-) strand; PAM type: YTN; PAM sequence: TTT
gccttcctgcaaaactaagc

SEQ ID NO: 202966 - DNA, 20 bp, Artificial Sequence
  Description of Artificial Sequence: Synthetic oligonucleotide
  Target: ATXN1; (-) strand; PAM type: YTN; PAM sequence: TTT
tgccttcctgcaaaactaag

SEQ ID NO: 202967 - DNA, 20 bp, Artificial Sequence
  Description of Artificial Sequence: Synthetic oligonucleotide
  Target: ATXN1; (-) strand; PAM type: YTN; PAM sequence: TTT
ttgccttcctgcaaaactaa

SEQ ID NO: 202968 - DNA, 20 bp, Artificial Sequence
  Description of Artificial Sequence: Synthetic oligonucleotide
  Target: ATXN1; (-) strand; PAM type: YTN; PAM sequence: CTT
tttgccttcctgcaaaacta

SEQ ID NO: 202969 - DNA, 20 bp, Artificial Sequence
  Description of Artificial Sequence: Synthetic oligonucleotide
  Target: ATXN1; (-) strand; PAM type: YTN; PAM sequence: CTC
tttttgccttcctgcaaaac

SEQ ID NO: 202970 - DNA, 20 bp, Artificial Sequence
  Description of Artificial Sequence: Synthetic oligonucleotide
  Target: ATXN1; (-) strand; PAM type: YTN; PAM sequence: CTA
tagctctttttgccttcctg

SEQ ID NO: 202971 - DNA, 20 bp, Artificial Sequence
  Description of Artificial Sequence: Synthetic oligonucleotide
  Target: ATXN1; (-) strand; PAM type: YTN; PAM sequence: CTC
tatagctctttttgccttcc

SEQ ID NO: 202972 - DNA, 20 bp, Artificial Sequence
  Description of Artificial Sequence: Synthetic oligonucleotide
  Target: ATXN1; (-) strand; PAM type: YTN; PAM sequence: TTA
taagctctatagctcttttt

SEQ ID NO: 202973 - DNA, 20 bp, Artificial Sequence
  Description of Artificial Sequence: Synthetic oligonucleotide
  Target: ATXN1; (-) strand; PAM type: YTN; PAM sequence: CTA
tattataagctctatagctc

SEQ ID NO: 202974 - DNA, 20 bp, Artificial Sequence
  Description of Artificial Sequence: Synthetic oligonucleotide
  Target: ATXN1; (-) strand; PAM type: YTN; PAM sequence: TTG
tctatattataagctctata

SEQ ID NO: 202975 - DNA, 20 bp, Artificial Sequence
  Description of Artificial Sequence: Synthetic oligonucleotide
  Target: ATXN1; (-) strand; PAM type: YTN; PAM sequence: TTT
gtctatattataagctctat

SEQ ID NO: 202976 - DNA, 20 bp, Artificial Sequence
  Description of Artificial Sequence: Synthetic oligonucleotide
  Target: ATXN1; (-) strand; PAM type: YTN; PAM sequence: CTA
gagtttgtctatattataag

SEQ ID NO: 202977 - DNA, 20 bp, Artificial Sequence
  Description of Artificial Sequence: Synthetic oligonucleotide
  Target: ATXN1; (-) strand; PAM type: YTN; PAM sequence: CTC
atggtactagagtttgtcta

SEQ ID NO: 202978 - DNA, 20 bp, Artificial Sequence
  Description of Artificial Sequence: Synthetic oligonucleotide
  Target: ATXN1; (-) strand; PAM type: YTN; PAM sequence: CTG
ctcatggtactagagtttgt

SEQ ID NO: 202979 - DNA, 20 bp, Artificial Sequence
  Description of Artificial Sequence: Synthetic oligonucleotide
  Target: ATXN1; (-) strand; PAM type: YTN; PAM sequence: CTG
tcccctgctcatggtactag

SEQ ID NO: 202980 - DNA, 20 bp, Artificial Sequence
  Description of Artificial Sequence: Synthetic oligonucleotide
  Target: ATXN1; (-) strand; PAM type: YTN; PAM sequence: CTC
ctgtcccctgctcatggtac

SEQ ID NO: 202981 - DNA, 20 bp, Artificial Sequence
  Description of Artificial Sequence: Synthetic oligonucleotide
  Target: ATXN1; (-) strand; PAM type: YTN; PAM sequence: TTC
acctcctgtcccctgctcat

SEQ ID NO: 202982 - DNA, 20 bp, Artificial Sequence
  Description of Artificial Sequence: Synthetic oligonucleotide
  Target: ATXN1; (-) strand; PAM type: YTN; PAM sequence: CTT
cacctcctgtcccctgctca

SEQ ID NO: 202983 - DNA, 20 bp, Artificial Sequence
  Description of Artificial Sequence: Synthetic oligonucleotide
  Target: ATXN1; (-) strand; PAM type: YTN; PAM sequence: TTC
ttcacctcctgtcccctgct

SEQ ID NO: 202984 - DNA, 20 bp, Artificial Sequence
  Description of Artificial Sequence: Synthetic oligonucleotide
  Target: ATXN1; (-) strand; PAM type: YTN; PAM sequence: TTT
cttcacctcctgtcccctgc

SEQ ID NO: 202985 - DNA, 20 bp, Artificial Sequence
  Description of Artificial Sequence: Synthetic oligonucleotide
  Target: ATXN1; (-) strand; PAM type: YTN; PAM sequence: CTC
atgatttcttcacctcctgt

SEQ ID NO: 202986 - DNA, 20 bp, Artificial Sequence
  Description of Artificial Sequence: Synthetic oligonucleotide
  Target: ATXN1; (-) strand; PAM type: YTN; PAM sequence: CTC
ctcatgatttcttcacctcc

SEQ ID NO: 202987 - DNA, 20 bp, Artificial Sequence
  Description of Artificial Sequence: Synthetic oligonucleotide
  Target: ATXN1; (-) strand; PAM type: YTN; PAM sequence: TTG
taagtcacccacctcctcat

SEQ ID NO: 202988 - DNA, 20 bp, Artificial Sequence
  Description of Artificial Sequence: Synthetic oligonucleotide
  Target: ATXN1; (-) strand; PAM type: YTN; PAM sequence: TTT
gtaagtcacccacctcctca

SEQ ID NO: 202989 - DNA, 20 bp, Artificial Sequence
  Description of Artificial Sequence: Synthetic oligonucleotide
  Target: ATXN1; (-) strand; PAM type: YTN; PAM sequence: TTC
atttgtaagtcacccacctc

SEQ ID NO: 202990 - DNA, 20 bp, Artificial Sequence
  Description of Artificial Sequence: Synthetic oligonucleotide
  Target: ATXN1; (-) strand; PAM type: YTN; PAM sequence: TTC
caggtaccgaaaaagaaagt

SEQ ID NO: 202991 - DNA, 20 bp, Artificial Sequence
  Description of Artificial Sequence: Synthetic oligonucleotide
  Target: ATXN1; (-) strand; PAM type: YTN; PAM sequence: TTT
ccaggtaccgaaaaagaaag

SEQ ID NO: 202992 - DNA, 20 bp, Artificial Sequence
  Description of Artificial Sequence: Synthetic oligonucleotide
  Target: ATXN1; (-) strand; PAM type: YTN; PAM sequence: TTG
tttccaggtaccgaaaaaga

SEQ ID NO: 202993 - DNA, 20 bp, Artificial Sequence
  Description of Artificial Sequence: Synthetic oligonucleotide
  Target: ATXN1; (-) strand; PAM type: YTN; PAM sequence: TTG
gttgtttccaggtaccgaaa

SEQ ID NO: 202994 - DNA, 20 bp, Artificial Sequence
  Description of Artificial Sequence: Synthetic oligonucleotide
  Target: ATXN1; (-) strand; PAM type: YTN; PAM sequence: TTT
ggttgtttccaggtaccgaa

SEQ ID NO: 202995 - DNA, 20 bp, Artificial Sequence
  Description of Artificial Sequence: Synthetic oligonucleotide
  Target: ATXN1; (-) strand; PAM type: YTN; PAM sequence: CTT
tggttgtttccaggtaccga

SEQ ID NO: 202996 - DNA, 20 bp, Artificial Sequence
  Description of Artificial Sequence: Synthetic oligonucleotide
  Target: ATXN1; (-) strand; PAM type: YTN; PAM sequence: TTA
gacagtgggagaagtatagg

SEQ ID NO: 202997 - DNA, 20 bp, Artificial Sequence
  Description of Artificial Sequence: Synthetic oligonucleotide
  Target: ATXN1; (-) strand; PAM type: YTN; PAM sequence: TTT
agacagtgggagaagtatag

SEQ ID NO: 202998 - DNA, 20 bp, Artificial Sequence
  Description of Artificial Sequence: Synthetic oligonucleotide
  Target: ATXN1; (-) strand; PAM type: YTN; PAM sequence: CTG
ggatgaagcatttagacagt

SEQ ID NO: 202999 - DNA, 20 bp, Artificial Sequence
  Description of Artificial Sequence: Synthetic oligonucleotide
  Target: ATXN1; (-) strand; PAM type: YTN; PAM sequence: TTA
tatgggctgggatgaagcat

SEQ ID NO: 203000 - DNA, 20 bp, Artificial Sequence
  Description of Artificial Sequence: Synthetic oligonucleotide
  Target: ATXN1; (-) strand; PAM type: YTN; PAM sequence: CTT
atatgggctgggatgaagca

SEQ ID NO: 203001 - DNA, 20 bp, Artificial Sequence
  Description of Artificial Sequence: Synthetic oligonucleotide
  Target: ATXN1; (-) strand; PAM type: YTN; PAM sequence: CTC
ttatatgggctgggatgaag

SEQ ID NO: 203002 - DNA, 20 bp, Artificial Sequence
  Description of Artificial Sequence: Synthetic oligonucleotide
  Target: ATXN1; (-) strand; PAM type: YTN; PAM sequence: CTC
tcttatatgggctgggatga

SEQ ID NO: 203003 - DNA, 20 bp, Artificial Sequence
  Description of Artificial Sequence: Synthetic oligonucleotide
  Target: ATXN1; (-) strand; PAM type: YTN; PAM sequence: TTG
gtgctctcttatatgggctg

SEQ ID NO: 203004 - DNA, 20 bp, Artificial Sequence
  Description of Artificial Sequence: Synthetic oligonucleotide
  Target: ATXN1; (-) strand; PAM type: YTN; PAM sequence: TTT
ggtgctctcttatatgggct

SEQ ID NO: 203005 - DNA, 20 bp, Artificial Sequence
  Description of Artificial Sequence: Synthetic oligonucleotide
  Target: ATXN1; (-) strand; PAM type: YTN; PAM sequence: TTT
tggtgctctcttatatgggc

SEQ ID NO: 203006 - DNA, 20 bp, Artificial Sequence
  Description of Artificial Sequence: Synthetic oligonucleotide
  Target: ATXN1; (-) strand; PAM type: YTN; PAM sequence: TTT
ttggtgctctcttatatggg

SEQ ID NO: 203007 - DNA, 20 bp, Artificial Sequence
  Description of Artificial Sequence: Synthetic oligonucleotide
  Target: ATXN1; (-) strand; PAM type: YTN; PAM sequence: TTT
tttggtgctctcttatatgg

SEQ ID NO: 203008 - DNA, 20 bp, Artificial Sequence
  Description of Artificial Sequence: Synthetic oligonucleotide
  Target: ATXN1; (-) strand; PAM type: YTN; PAM sequence: TTT
ttttggtgctctcttatatg

SEQ ID NO: 203009 - DNA, 20 bp, Artificial Sequence
  Description of Artificial Sequence: Synthetic oligonucleotide
  Target: ATXN1; (-) strand; PAM type: YTN; PAM sequence: TTA
aatttttttggtgctctctt

SEQ ID NO: 203010 - DNA, 20 bp, Artificial Sequence
  Description of Artificial Sequence: Synthetic oligonucleotide
  Target: ATXN1; (-) strand; PAM type: YTN; PAM sequence: CTA
tattaaatttttttggtgct

SEQ ID NO: 203011 - DNA, 20 bp, Artificial Sequence
  Description of Artificial Sequence: Synthetic oligonucleotide
  Target: ATXN1; (-) strand; PAM type: YTN; PAM sequence: TTA
actatattaaatttttttgg

SEQ ID NO: 203012 - DNA, 20 bp, Artificial Sequence
  Description of Artificial Sequence: Synthetic oligonucleotide
  Target: ATXN1; (-) strand; PAM type: YTN; PAM sequence: TTG
ggaaaaagggttaactatat

SEQ ID NO: 203013 - DNA, 20 bp, Artificial Sequence
  Description of Artificial Sequence: Synthetic oligonucleotide
  Target: ATXN1; (-) strand; PAM type: YTN; PAM sequence: TTT
gggaaaaagggttaactata

SEQ ID NO: 203014 - DNA, 20 bp, Artificial Sequence
  Description of Artificial Sequence: Synthetic oligonucleotide
  Target: ATXN1; (-) strand; PAM type: YTN; PAM sequence: TTG
ggaaggggagtttgggaaaa

SEQ ID NO: 203015 - DNA, 20 bp, Artificial Sequence
  Description of Artificial Sequence: Synthetic oligonucleotide
  Target: ATXN1; (-) strand; PAM type: YTN; PAM sequence: CTT
gggaaggggagtttgggaaa

SEQ ID NO: 203016 - DNA, 20 bp, Artificial Sequence
  Description of Artificial Sequence: Synthetic oligonucleotide
  Target: ATXN1; (-) strand; PAM type: YTN; PAM sequence: CTG
gacttgggaaggggagtttg

SEQ ID NO: 203017 - DNA, 20 bp, Artificial Sequence
  Description of Artificial Sequence: Synthetic oligonucleotide
  Target: ATXN1; (-) strand; PAM type: YTN; PAM sequence: TTG
ccagataactggacttggga

SEQ ID NO: 203018 - DNA, 20 bp, Artificial Sequence
  Description of Artificial Sequence: Synthetic oligonucleotide
  Target: ATXN1; (-) strand; PAM type: YTN; PAM sequence: TTG
attgccagataactggactt

SEQ ID NO: 203019 - DNA, 20 bp, Artificial Sequence
  Description of Artificial Sequence: Synthetic oligonucleotide
  Target: ATXN1; (-) strand; PAM type: YTN; PAM sequence: TTT
gattgccagataactggact

SEQ ID NO: 203020 - DNA, 20 bp, Artificial Sequence
  Description of Artificial Sequence: Synthetic oligonucleotide
  Target: ATXN1; (-) strand; PAM type: YTN; PAM sequence: CTT
tgattgccagataactggac

SEQ ID NO: 203021 - DNA, 20 bp, Artificial Sequence
  Description of Artificial Sequence: Synthetic oligonucleotide
  Target: ATXN1; (-) strand; PAM type: YTN; PAM sequence: TTA
gcctttgattgccagataac

SEQ ID NO: 203022 - DNA, 20 bp, Artificial Sequence
  Description of Artificial Sequence: Synthetic oligonucleotide
  Target: ATXN1; (-) strand; PAM type: YTN; PAM sequence: TTA
ttagcctttgattgccagat

SEQ ID NO: 203023 - DNA, 20 bp, Artificial Sequence
  Description of Artificial Sequence: Synthetic oligonucleotide
  Target: ATXN1; (-) strand; PAM type: YTN; PAM sequence: TTT
attagcctttgattgccaga

SEQ ID NO: 203024 - DNA, 20 bp, Artificial Sequence
  Description of Artificial Sequence: Synthetic oligonucleotide
  Target: ATXN1; (-) strand; PAM type: YTN; PAM sequence: CTT
tattagcctttgattgccag

SEQ ID NO: 203025 - DNA, 20 bp, Artificial Sequence
  Description of Artificial Sequence: Synthetic oligonucleotide
  Target: ATXN1; (-) strand; PAM type: YTN; PAM sequence: CTC
tttattagcctttgattgcc

SEQ ID NO: 203026 - DNA, 20 bp, Artificial Sequence
  Description of Artificial Sequence: Synthetic oligonucleotide
  Target: ATXN1; (-) strand; PAM type: YTN; PAM sequence: CTG
aactctttattagcctttga

SEQ ID NO: 203027 - DNA, 20 bp, Artificial Sequence
  Description of Artificial Sequence: Synthetic oligonucleotide
  Target: ATXN1; (-) strand; PAM type: YTN; PAM sequence: CTG
aactgaactctttattagcc

SEQ ID NO: 203028 - DNA, 20 bp, Artificial Sequence
  Description of Artificial Sequence: Synthetic oligonucleotide
  Target: ATXN1; (-) strand; PAM type: YTN; PAM sequence: TTA
ctgaactgaactctttatta

SEQ ID NO: 203029 - DNA, 20 bp, Artificial Sequence
  Description of Artificial Sequence: Synthetic oligonucleotide
  Target: ATXN1; (-) strand; PAM type: YTN; PAM sequence: TTT
actgaactgaactctttatt

SEQ ID NO: 203030 - DNA, 20 bp, Artificial Sequence
  Description of Artificial Sequence: Synthetic oligonucleotide
  Target: ATXN1; (-) strand; PAM type: YTN; PAM sequence: CTT
tactgaactgaactctttat

SEQ ID NO: 203031 - DNA, 20 bp, Artificial Sequence
  Description of Artificial Sequence: Synthetic oligonucleotide
  Target: ATXN1; (-) strand; PAM type: YTN; PAM sequence: CTA
gaaacaagtctttactgaac

SEQ ID NO: 203032 - DNA, 20 bp, Artificial Sequence
  Description of Artificial Sequence: Synthetic oligonucleotide
  Target: ATXN1; (-) strand; PAM type: YTN; PAM sequence: CTG
tcaaaacctagaaacaagtc

SEQ ID NO: 203033 - DNA, 20 bp, Artificial Sequence
  Description of Artificial Sequence: Synthetic oligonucleotide
  Target: ATXN1; (-) strand; PAM type: YTN; PAM sequence: CTG
ctgtcaaaacctagaaacaa

SEQ ID NO: 203034 - DNA, 20 bp, Artificial Sequence
  Description of Artificial Sequence: Synthetic oligonucleotide
  Target: ATXN1; (-) strand; PAM type: YTN; PAM sequence: TTA
gatctgctgtcaaaacctag

SEQ ID NO: 203035 - DNA, 20 bp, Artificial Sequence
  Description of Artificial Sequence: Synthetic oligonucleotide
  Target: ATXN1; (-) strand; PAM type: YTN; PAM sequence: CTC
aagattagatctgctgtcaa

SEQ ID NO: 203036 - DNA, 20 bp, Artificial Sequence
  Description of Artificial Sequence: Synthetic oligonucleotide
  Target: ATXN1; (-) strand; PAM type: YTN; PAM sequence: CTC
tcaagattagatctgctgtc

SEQ ID NO: 203037 - DNA, 20 bp, Artificial Sequence
  Description of Artificial Sequence: Synthetic oligonucleotide
  Target: ATXN1; (-) strand; PAM type: YTN; PAM sequence: CTC
tctcaagattagatctgctg

SEQ ID NO: 203038 - DNA, 20 bp, Artificial Sequence
  Description of Artificial Sequence: Synthetic oligonucleotide
  Target: ATXN1; (-) strand; PAM type: YTN; PAM sequence: CTC
tctctcaagattagatctgc

SEQ ID NO: 203039 - DNA, 20 bp, Artificial Sequence
  Description of Artificial Sequence: Synthetic oligonucleotide
  Target: ATXN1; (-) strand; PAM type: YTN; PAM sequence: TTC
ctctctctcaagattagatc

SEQ ID NO: 203040 - DNA, 20 bp, Artificial Sequence
  Description of Artificial Sequence: Synthetic oligonucleotide
  Target: ATXN1; (-) strand; PAM type: YTN; PAM sequence: TTG
gtcatgtccccattcctctc

SEQ ID NO: 203041 - DNA, 20 bp, Artificial Sequence
  Description of Artificial Sequence: Synthetic oligonucleotide
  Target: ATXN1; (-) strand; PAM type: YTN; PAM sequence: CTT
ggtcatgtccccattcctct

SEQ ID NO: 203042 - DNA, 20 bp, Artificial Sequence
  Description of Artificial Sequence: Synthetic oligonucleotide
  Target: ATXN1; (-) strand; PAM type: YTN; PAM sequence: TTG
tgtgtatacccagagcttgg

SEQ ID NO: 203043 - DNA, 20 bp, Artificial Sequence
  Description of Artificial Sequence: Synthetic oligonucleotide
  Target: ATXN1; (-) strand; PAM type: YTN; PAM sequence: TTT
gtgtgtatacccagagcttg

SEQ ID NO: 203044 - DNA, 20 bp, Artificial Sequence
  Description of Artificial Sequence: Synthetic oligonucleotide
  Target: ATXN1; (-) strand; PAM type: YTN; PAM sequence: CTT
tgtgtgtatacccagagctt

SEQ ID NO: 203045 - DNA, 20 bp, Artificial Sequence
  Description of Artificial Sequence: Synthetic oligonucleotide
  Target: ATXN1; (-) strand; PAM type: YTN; PAM sequence: TTC
tttgtgtgtatacccagagc

SEQ ID NO: 203046 - DNA, 20 bp, Artificial Sequence
  Description of Artificial Sequence: Synthetic oligonucleotide
  Target: ATXN1; (-) strand; PAM type: YTN; PAM sequence: TTC
attctttgtgtgtataccca

SEQ ID NO: 203047 - DNA, 20 bp, Artificial Sequence
  Description of Artificial Sequence: Synthetic oligonucleotide
  Target: ATXN1; (-) strand; PAM type: YTN; PAM sequence: CTC
ccagatggttcattctttgt

SEQ ID NO: 203048 - DNA, 20 bp, Artificial Sequence
  Description of Artificial Sequence: Synthetic oligonucleotide
  Target: ATXN1; (-) strand; PAM type: YTN; PAM sequence: TTA
tccagtcctcccagatggtt

SEQ ID NO: 203049 - DNA, 20 bp, Artificial Sequence
  Description of Artificial Sequence: Synthetic oligonucleotide
  Target: ATXN1; (-) strand; PAM type: YTN; PAM sequence: CTG
aaattatccagtcctcccag

SEQ ID NO: 203050 - DNA, 20 bp, Artificial Sequence
  Description of Artificial Sequence: Synthetic oligonucleotide
  Target: ATXN1; (-) strand; PAM type: YTN; PAM sequence: TTC
ctgaaattatccagtcctcc

SEQ ID NO: 203051 - DNA, 20 bp, Artificial Sequence
  Description of Artificial Sequence: Synthetic oligonucleotide
  Target: ATXN1; (-) strand; PAM type: YTN; PAM sequence: TTA
cggggaaattcctgaaatta

SEQ ID NO: 203052 - DNA, 20 bp, Artificial Sequence
  Description of Artificial Sequence: Synthetic oligonucleotide
  Target: ATXN1; (-) strand; PAM type: YTN; PAM sequence: CTA
aattacggggaaattcctga

SEQ ID NO: 203053 - DNA, 20 bp, Artificial Sequence
  Description of Artificial Sequence: Synthetic oligonucleotide
  Target: ATXN1; (-) strand; PAM type: YTN; PAM sequence: TTA
ctaaattacggggaaattcc

SEQ ID NO: 203054 - DNA, 20 bp, Artificial Sequence
  Description of Artificial Sequence: Synthetic oligonucleotide
  Target: ATXN1; (-) strand; PAM type: YTN; PAM sequence: TTA
ccattactaaattacgggga

SEQ ID NO: 203055 - DNA, 20 bp, Artificial Sequence
  Description of Artificial Sequence: Synthetic oligonucleotide
  Target: ATXN1; (-) strand; PAM type: YTN; PAM sequence: TTT
accattactaaattacgggg

SEQ ID NO: 203056 - DNA, 20 bp, Artificial Sequence
  Description of Artificial Sequence: Synthetic oligonucleotide
  Target: ATXN1; (-) strand; PAM type: YTN; PAM sequence: TTG
tttaccattactaaattacg

SEQ ID NO: 203057 - DNA, 20 bp, Artificial Sequence
  Description of Artificial Sequence: Synthetic oligonucleotide
  Target: ATXN1; (-) strand; PAM type: YTN; PAM sequence: CTT
gtttaccattactaaattac

SEQ ID NO: 203058 - DNA, 20 bp, Artificial Sequence
  Description of Artificial Sequence: Synthetic oligonucleotide
  Target: ATXN1; (-) strand; PAM type: YTN; PAM sequence: TTC
ttgtttaccattactaaatt

SEQ ID NO: 203059 - DNA, 20 bp, Artificial Sequence
  Description of Artificial Sequence: Synthetic oligonucleotide
  Target: ATXN1; (-) strand; PAM type: YTN; PAM sequence: CTG
ttcttgtttaccattactaa

SEQ ID NO: 203060 - DNA, 20 bp, Artificial Sequence
  Description of Artificial Sequence: Synthetic oligonucleotide
  Target: ATXN1; (-) strand; PAM type: YTN; PAM sequence: CTG
ggtcctgttcttgtttacca

SEQ ID NO: 203061 - DNA, 20 bp, Artificial Sequence
  Description of Artificial Sequence: Synthetic oligonucleotide
  Target: ATXN1; (-) strand; PAM type: YTN; PAM sequence: TTA
ggagctgggtcctgttcttg

SEQ ID NO: 203062 - DNA, 20 bp, Artificial Sequence
  Description of Artificial Sequence: Synthetic oligonucleotide
  Target: ATXN1; (-) strand; PAM type: YTN; PAM sequence: CTT
aggagctgggtcctgttctt

SEQ ID NO: 203063 - DNA, 20 bp, Artificial Sequence
  Description of Artificial Sequence: Synthetic oligonucleotide
  Target: ATXN1; (-) strand; PAM type: YTN; PAM sequence: TTC
ttaggagctgggtcctgttc

SEQ ID NO: 203064 - DNA, 20 bp, Artificial Sequence
  Description of Artificial Sequence: Synthetic oligonucleotide
  Target: ATXN1; (-) strand; PAM type: YTN; PAM sequence: CTT
cttaggagctgggtcctgtt

SEQ ID NO: 203065 - DNA, 20 bp, Artificial Sequence
  Description of Artificial Sequence: Synthetic oligonucleotide
  Target: ATXN1; (-) strand; PAM type: YTN; PAM sequence: CTG
cacttcttaggagctgggtc

SEQ ID NO: 203066 - DNA, 20 bp, Artificial Sequence
  Description of Artificial Sequence: Synthetic oligonucleotide
  Target: ATXN1; (-) strand; PAM type: YTN; PAM sequence: TTC
atctgcacttcttaggagct

SEQ ID NO: 203067 - DNA, 20 bp, Artificial Sequence
  Description of Artificial Sequence: Synthetic oligonucleotide
  Target: ATXN1; (-) strand; PAM type: YTN; PAM sequence: TTC
attcatctgcacttcttagg

SEQ ID NO: 203068 - DNA, 20 bp, Artificial Sequence
  Description of Artificial Sequence: Synthetic oligonucleotide
  Target: ATXN1; (-) strand; PAM type: YTN; PAM sequence: CTT
cattcatctgcacttcttag

SEQ ID NO: 203069 - DNA, 20 bp, Artificial Sequence
  Description of Artificial Sequence: Synthetic oligonucleotide
  Target: ATXN1; (-) strand; PAM type: YTN; PAM sequence: TTA
cttcattcatctgcacttct

SEQ ID NO: 203070 - DNA, 20 bp, Artificial Sequence
  Description of Artificial Sequence: Synthetic oligonucleotide
  Target: ATXN1; (-) strand; PAM type: YTN; PAM sequence: TTT
acttcattcatctgcacttc

SEQ ID NO: 203071 - DNA, 20 bp, Artificial Sequence
  Description of Artificial Sequence: Synthetic oligonucleotide
  Target: ATXN1; (-) strand; PAM type: YTN; PAM sequence: CTT
tacttcattcatctgcactt

SEQ ID NO: 203072 - DNA, 20 bp, Artificial Sequence
  Description of Artificial Sequence: Synthetic oligonucleotide
  Target: ATXN1; (-) strand; PAM type: YTN; PAM sequence: CTA
ctttacttcattcatctgca

SEQ ID NO: 203073 - DNA, 20 bp, Artificial Sequence
  Description of Artificial Sequence: Synthetic oligonucleotide
  Target: ATXN1; (-) strand; PAM type: YTN; PAM sequence: TTC
tactttacttcattcatctg

SEQ ID NO: 203074 - DNA, 20 bp, Artificial Sequence
  Description of Artificial Sequence: Synthetic oligonucleotide
  Target: ATXN1; (-) strand; PAM type: YTN; PAM sequence: CTT
ctactttacttcattcatct

SEQ ID NO: 203075 - DNA, 20 bp, Artificial Sequence
  Description of Artificial Sequence: Synthetic oligonucleotide
  Target: ATXN1; (-) strand; PAM type: YTN; PAM sequence: CTG
cttctactttacttcattca

SEQ ID NO: 203076 - DNA, 20 bp, Artificial Sequence
  Description of Artificial Sequence: Synthetic oligonucleotide
  Target: ATXN1; (-) strand; PAM type: YTN; PAM sequence: TTG
gtcaggaacctgcttctact

SEQ ID NO: 203077 - DNA, 20 bp, Artificial Sequence
  Description of Artificial Sequence: Synthetic oligonucleotide
  Target: ATXN1; (-) strand; PAM type: YTN; PAM sequence: CTG
ttggtcaggaacctgcttct

SEQ ID NO: 203078 - DNA, 20 bp, Artificial Sequence
  Description of Artificial Sequence: Synthetic oligonucleotide
  Target: ATXN1; (-) strand; PAM type: YTN; PAM sequence: CTA
tacctgttggtcaggaacct

SEQ ID NO: 203079 - DNA, 20 bp, Artificial Sequence
  Description of Artificial Sequence: Synthetic oligonucleotide
  Target: ATXN1; (-) strand; PAM type: YTN; PAM sequence: TTG
atctatacctgttggtcagg

SEQ ID NO: 203080 - DNA, 20 bp, Artificial Sequence
  Description of Artificial Sequence: Synthetic oligonucleotide
  Target: ATXN1; (-) strand; PAM type: YTN; PAM sequence: TTT
gatctatacctgttggtcag

SEQ ID NO: 203081 - DNA, 20 bp, Artificial Sequence
  Description of Artificial Sequence: Synthetic oligonucleotide
  Target: ATXN1; (-) strand; PAM type: YTN; PAM sequence: CTT
tgatctatacctgttggtca

SEQ ID NO: 203082 - DNA, 20 bp, Artificial Sequence
  Description of Artificial Sequence: Synthetic oligonucleotide
  Target: ATXN1; (-) strand; PAM type: YTN; PAM sequence: CTG
cctttgatctatacctgttg

SEQ ID NO: 203083 - DNA, 20 bp, Artificial Sequence
  Description of Artificial Sequence: Synthetic oligonucleotide
  Target: ATXN1; (-) strand; PAM type: YTN; PAM sequence: CTA
gaaaccaggtgtgggataga

SEQ ID NO: 203084 - DNA, 20 bp, Artificial Sequence
  Description of Artificial Sequence: Synthetic oligonucleotide
  Target: ATXN1; (-) strand; PAM type: YTN; PAM sequence: CTG
ccgctagaaaccaggtgtgg

SEQ ID NO: 203085 - DNA, 20 bp, Artificial Sequence
  Description of Artificial Sequence: Synthetic oligonucleotide
  Target: ATXN1; (-) strand; PAM type: YTN; PAM sequence: CTA
gatactgccgctagaaacca

SEQ ID NO: 203086 - DNA, 20 bp, Artificial Sequence
  Description of Artificial Sequence: Synthetic oligonucleotide
  Target: ATXN1; (-) strand; PAM type: YTN; PAM sequence: TTC
tagatactgccgctagaaac

SEQ ID NO: 203087 - DNA, 20 bp, Artificial Sequence
  Description of Artificial Sequence: Synthetic oligonucleotide
  Target: ATXN1; (-) strand; PAM type: YTN; PAM sequence: CTT
ctagatactgccgctagaaa

SEQ ID NO: 203088 - DNA, 20 bp, Artificial Sequence
  Description of Artificial Sequence: Synthetic oligonucleotide
  Target: ATXN1; (-) strand; PAM type: YTN; PAM sequence: CTC
cccatgaaaaggcaaggaac

SEQ ID NO: 203089 - DNA, 20 bp, Artificial Sequence
  Description of Artificial Sequence: Synthetic oligonucleotide
  Target: ATXN1; (-) strand; PAM type: YTN; PAM sequence: TTC
atgggaagaagagcaggcag

SEQ ID NO: 203090 - DNA, 20 bp, Artificial Sequence
  Description of Artificial Sequence: Synthetic oligonucleotide
  Target: ATXN1; (-) strand; PAM type: YTN; PAM sequence: CTT
catgggaagaagagcaggca

SEQ ID NO: 203091 - DNA, 20 bp, Artificial Sequence
  Description of Artificial Sequence: Synthetic oligonucleotide
  Target: ATXN1; (-) strand; PAM type: YTN; PAM sequence: TTA
tcttcatgggaagaagagca

SEQ ID NO: 203092 - DNA, 20 bp, Artificial Sequence
  Description of Artificial Sequence: Synthetic oligonucleotide
  Target: ATXN1; (-) strand; PAM type: YTN; PAM sequence: TTA
tgttatcttcatgggaagaa

SEQ ID NO: 203093 - DNA, 20 bp, Artificial Sequence
  Description of Artificial Sequence: Synthetic oligonucleotide
  Target: ATXN1; (-) strand; PAM type: YTN; PAM sequence: CTT
atgttatcttcatgggaaga

SEQ ID NO: 203094 - DNA, 20 bp, Artificial Sequence
  Description of Artificial Sequence: Synthetic oligonucleotide
  Target: ATXN1; (-) strand; PAM type: YTN; PAM sequence: CTG
acagtcccttatgttatctt

SEQ ID NO: 203095 - DNA, 20 bp, Artificial Sequence
  Description of Artificial Sequence: Synthetic oligonucleotide
  Target: ATXN1; (-) strand; PAM type: YTN; PAM sequence: CTG
aactgacagtcccttatgtt

SEQ ID NO: 203096 - DNA, 20 bp, Artificial Sequence
  Description of Artificial Sequence: Synthetic oligonucleotide
  Target: ATXN1; (-) strand; PAM type: YTN; PAM sequence: TTA
aaccacccgggtctgaactg

SEQ ID NO: 203097 - DNA, 20 bp, Artificial Sequence
  Description of Artificial Sequence: Synthetic oligonucleotide
  Target: ATXN1; (-) strand; PAM type: YTN; PAM sequence: TTT
aaaccacccgggtctgaact

SEQ ID NO: 203098 - DNA, 20 bp, Artificial Sequence
  Description of Artificial Sequence: Synthetic oligonucleotide
  Target: ATXN1; (-) strand; PAM type: YTN; PAM sequence: TTT
taaaccacccgggtctgaac

SEQ ID NO: 203099 - DNA, 20 bp, Artificial Sequence
  Description of Artificial Sequence: Synthetic oligonucleotide
  Target: ATXN1; (-) strand; PAM type: YTN; PAM sequence: CTT
ttaaaccacccgggtctgaa

SEQ ID NO: 203100 - DNA, 20 bp, Artificial Sequence
  Description of Artificial Sequence: Synthetic oligonucleotide
  Target: ATXN1; (-) strand; PAM type: YTN; PAM sequence: TTC
atcttttaaaccacccgggt

SEQ ID NO: 203101 - DNA, 20 bp, Artificial Sequence
  Description of Artificial Sequence: Synthetic oligonucleotide
  Target: ATXN1; (-) strand; PAM type: YTN; PAM sequence: CTT
catcttttaaaccacccggg

SEQ ID NO: 203102 - DNA, 20 bp, Artificial Sequence
  Description of Artificial Sequence: Synthetic oligonucleotide
  Target: ATXN1; (-) strand; PAM type: YTN; PAM sequence: CTC
ttcatcttttaaaccacccg

SEQ ID NO: 203103 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccaccaccac

SEQ ID NO: 203104 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 203105 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 203106 - DNA, 20 bp, Artificial Sequence
  Description of Artificial Sequence: Synthetic oligonucleotide
  Target: ATXN1; (-) strand; PAM type: YTN; PAM sequence: TTG
gcctcccaaagtgctgggat

SEQ ID NO: 203107 - DNA, 20 bp, Artificial Sequence
  Description of Artificial Sequence: Synthetic oligonucleotide
  Target: ATXN1; (-) strand; PAM type: YTN; PAM sequence: CTT
ggcctcccaaagtgctggga

SEQ ID NO: 203108 - DNA, 20 bp, Artificial Sequence
  Description of Artificial Sequence: Synthetic oligonucleotide
  Target: ATXN1; (-) strand; PAM type: YTN; PAM sequence: CTC
aggtgatccgcccaccttgg

SEQ ID NO: 203109 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatccgcccac

SEQ ID NO: 203110 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatccgcc

SEQ ID NO: 203111 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaggtga

SEQ ID NO: 203112 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 203113 - DNA, 20 bp, Artificial Sequence
  Description of Artificial Sequence: Synthetic oligonucleotide
  Target: ATXN1; (-) strand; PAM type: YTN; PAM sequence: TTG
gtcaggctggtctcgaactc

SEQ ID NO: 203114 - DNA, 20 bp, Artificial Sequence
  Description of Artificial Sequence: Synthetic oligonucleotide
  Target: ATXN1; (-) strand; PAM type: YTN; PAM sequence: TTC
accatgttggtcaggctggt

SEQ ID NO: 203115 - DNA, 20 bp, Artificial Sequence
  Description of Artificial Sequence: Synthetic oligonucleotide
  Target: ATXN1; (-) strand; PAM type: YTN; PAM sequence: TTT
caccatgttggtcaggctgg

SEQ ID NO: 203116 - DNA, 20 bp, Artificial Sequence
  Description of Artificial Sequence: Synthetic oligonucleotide
  Target: ATXN1; (-) strand; PAM type: YTN; PAM sequence: TTA
gcagagacgaggtttcacca

SEQ ID NO: 203117 - DNA, 20 bp, Artificial Sequence
  Description of Artificial Sequence: Synthetic oligonucleotide
  Target: ATXN1; (-) strand; PAM type: YTN; PAM sequence: TTT
agcagagacgaggtttcacc

SEQ ID NO: 203118 - DNA, 20 bp, Artificial Sequence
  Description of Artificial Sequence: Synthetic oligonucleotide
  Target: ATXN1; (-) strand; PAM type: YTN; PAM sequence: TTT
tagcagagacgaggtttcac

SEQ ID NO: 203119 - DNA, 20 bp, Artificial Sequence
  Description of Artificial Sequence: Synthetic oligonucleotide
  Target: ATXN1; (-) strand; PAM type: YTN; PAM sequence: TTT
ttagcagagacgaggtttca

SEQ ID NO: 203120 - DNA, 20 bp, Artificial Sequence
  Description of Artificial Sequence: Synthetic oligonucleotide
  Target: ATXN1; (-) strand; PAM type: YTN; PAM sequence: TTA
tttttagcagagacgaggtt

SEQ ID NO: 203121 - DNA, 20 bp, Artificial Sequence
  Description of Artificial Sequence: Synthetic oligonucleotide
  Target: ATXN1; (-) strand; PAM type: YTN; PAM sequence: TTT
atttttagcagagacgaggt

SEQ ID NO: 203122 - DNA, 20 bp, Artificial Sequence
  Description of Artificial Sequence: Synthetic oligonucleotide
  Target: ATXN1; (-) strand; PAM type: YTN; PAM sequence: TTT
tatttttagcagagacgagg

SEQ ID NO: 203123 - DNA, 20 bp, Artificial Sequence
  Description of Artificial Sequence: Synthetic oligonucleotide
  Target: ATXN1; (-) strand; PAM type: YTN; PAM sequence: TTT
ttatttttagcagagacgag

SEQ ID NO: 203124 - DNA, 20 bp, Artificial Sequence
  Description of Artificial Sequence: Synthetic oligonucleotide
  Target: ATXN1; (-) strand; PAM type: YTN; PAM sequence: TTT
tttatttttagcagagacga

SEQ ID NO: 203125 - DNA, 20 bp, Artificial Sequence
  Description of Artificial Sequence: Synthetic oligonucleotide
  Target: ATXN1; (-) strand; PAM type: YTN; PAM sequence: TTA
ttttttatttttagcagaga

SEQ ID NO: 203126 - DNA, 20 bp, Artificial Sequence
  Description of Artificial Sequence: Synthetic oligonucleotide
  Target: ATXN1; (-) strand; PAM type: YTN; PAM sequence: TTT
attttttatttttagcagag

SEQ ID NO: 203127 - DNA, 20 bp, Artificial Sequence
  Description of Artificial Sequence: Synthetic oligonucleotide
  Target: ATXN1; (-) strand; PAM type: YTN; PAM sequence: TTT
tattttttatttttagcaga

SEQ ID NO: 203128 - DNA, 20 bp, Artificial Sequence
  Description of Artificial Sequence: Synthetic oligonucleotide
  Target: ATXN1; (-) strand; PAM type: YTN; PAM sequence: TTT
ttattttttatttttagcag

SEQ ID NO: 203129 - DNA, 20 bp, Artificial Sequence
  Description of Artificial Sequence: Synthetic oligonucleotide
  Target: ATXN1; (-) strand; PAM type: YTN; PAM sequence: TTT
tttattttttatttttagca

SEQ ID NO: 203130 - DNA, 20 bp, Artificial Sequence
  Description of Artificial Sequence: Synthetic oligonucleotide
  Target: ATXN1; (-) strand; PAM type: YTN; PAM sequence: CTA
aattttttattttttatttt

SEQ ID NO: 203131 - DNA, 20 bp, Artificial Sequence
  Description of Artificial Sequence: Synthetic oligonucleotide
  Target: ATXN1; (-) strand; PAM type: YTN; PAM sequence: CTC
acaccaccatgcccagctaa

SEQ ID NO: 203132 - DNA, 20 bp, Artificial Sequence
  Description of Artificial Sequence: Synthetic oligonucleotide
  Target: ATXN1; (-) strand; PAM type: YTN; PAM sequence: TTA
caaggctcacaccaccatgc

SEQ ID NO: 203133 - DNA, 20 bp, Artificial Sequence
  Description of Artificial Sequence: Synthetic oligonucleotide
  Target: ATXN1; (-) strand; PAM type: YTN; PAM sequence: CTA
ggattacaaggctcacacca

SEQ ID NO: 203134 - DNA, 20 bp, Artificial Sequence
  Description of Artificial Sequence: Synthetic oligonucleotide
  Target: ATXN1; (-) strand; PAM type: YTN; PAM sequence: CTC
cccagtagctaggattacaa

SEQ ID NO: 203135 - DNA, 20 bp, Artificial Sequence
  Description of Artificial Sequence: Synthetic oligonucleotide
  Target: ATXN1; (-) strand; PAM type: YTN; PAM sequence: TTA
gcctccccagtagctaggat

SEQ ID NO: 203136 - DNA, 20 bp, Artificial Sequence
  Description of Artificial Sequence: Synthetic oligonucleotide
  Target: ATXN1; (-) strand; PAM type: YTN; PAM sequence: CTT
agcctccccagtagctagga

SEQ ID NO: 203137 - DNA, 20 bp, Artificial Sequence
  Description of Artificial Sequence: Synthetic oligonucleotide
  Target: ATXN1; (-) strand; PAM type: YTN; PAM sequence: CTG
tcttagcctccccagtagct

SEQ ID NO: 203138 - DNA, 20 bp, Artificial Sequence
  Description of Artificial Sequence: Synthetic oligonucleotide
  Target: ATXN1; (-) strand; PAM type: YTN; PAM sequence: CTC
ctgtcttagcctccccagta

SEQ ID NO: 203139 - DNA, 20 bp, Artificial Sequence
  Description of Artificial Sequence: Synthetic oligonucleotide
  Target: ATXN1; (-) strand; PAM type: YTN; PAM sequence: TTC
tcctgtcttagcctccccag

SEQ ID NO: 203140 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgtcttag

SEQ ID NO: 203141 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgattctcctgt

SEQ ID NO: 203142 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcgattctcc

SEQ ID NO: 203143 - DNA, 20 bp, Artificial Sequence
  Description of Artificial Sequence: Synthetic oligonucleotide
  Target: ATXN1; (-) strand; PAM type: YTN; PAM sequence: CTC
cacctcctgggttcaagcga

SEQ ID NO: 203144 - DNA, 20 bp, Artificial Sequence
  Description of Artificial Sequence: Synthetic oligonucleotide
  Target: ATXN1; (-) strand; PAM type: YTN; PAM sequence: CTA
cagcctccacctcctgggtt

SEQ ID NO: 203145 - DNA, 20 bp, Artificial Sequence
  Description of Artificial Sequence: Synthetic oligonucleotide
  Target: ATXN1; (-) strand; PAM type: YTN; PAM sequence: CTC
actacagcctccacctcctg

SEQ ID NO: 203146 - DNA, 20 bp, Artificial Sequence
  Description of Artificial Sequence: Synthetic oligonucleotide
  Target: ATXN1; (-) strand; PAM type: YTN; PAM sequence: TTG
gctcactacagcctccacct

SEQ ID NO: 203147 - DNA, 20 bp, Artificial Sequence
  Description of Artificial Sequence: Synthetic oligonucleotide
  Target: ATXN1; (-) strand; PAM type: YTN; PAM sequence: CTT
ggctcactacagcctccacc

SEQ ID NO: 203148 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggtgtgagctt

SEQ ID NO: 203149 - DNA, 20 bp, Artificial Sequence
  Description of Artificial Sequence: Synthetic oligonucleotide
  Target: ATXN1; (-) strand; PAM type: YTN; PAM sequence: CTG
tcgcccaggctggagtgcag

SEQ ID NO: 203150 - DNA, 20 bp, Artificial Sequence
  Description of Artificial Sequence: Synthetic oligonucleotide
  Target: ATXN1; (-) strand; PAM type: YTN; PAM sequence: CTC
tgtcgcccaggctggagtgc

SEQ ID NO: 203151 - DNA, 20 bp, Artificial Sequence
  Description of Artificial Sequence: Synthetic oligonucleotide
  Target: ATXN1; (-) strand; PAM type: YTN; PAM sequence: CTC
actctgtcgcccaggctgga

SEQ ID NO: 203152 - DNA, 20 bp, Artificial Sequence
  Description of Artificial Sequence: Synthetic oligonucleotide
  Target: ATXN1; (-) strand; PAM type: YTN; PAM sequence: CTG
agacggagtctcactctgtc

SEQ ID NO: 203153 - DNA, 20 bp, Artificial Sequence
  Description of Artificial Sequence: Synthetic oligonucleotide
  Target: ATXN1; (-) strand; PAM type: YTN; PAM sequence: TTC
tgagacggagtctcactctg

SEQ ID NO: 203154 - DNA, 20 bp, Artificial Sequence
  Description of Artificial Sequence: Synthetic oligonucleotide
  Target: ATXN1; (-) strand; PAM type: YTN; PAM sequence: TTT
ctgagacggagtctcactct

SEQ ID NO: 203155 - DNA, 20 bp, Artificial Sequence
  Description of Artificial Sequence: Synthetic oligonucleotide
  Target: ATXN1; (-) strand; PAM type: YTN; PAM sequence: TTT
tctgagacggagtctcactc

SEQ ID NO: 203156 - DNA, 20 bp, Artificial Sequence
  Description of Artificial Sequence: Synthetic oligonucleotide
  Target: ATXN1; (-) strand; PAM type: YTN; PAM sequence: TTT
ttctgagacggagtctcact

SEQ ID NO: 203157 - DNA, 20 bp, Artificial Sequence
  Description of Artificial Sequence: Synthetic oligonucleotide
  Target: ATXN1; (-) strand; PAM type: YTN; PAM sequence: TTT
tttctgagacggagtctcac

SEQ ID NO: 203158 - DNA, 20 bp, Artificial Sequence
  Description of Artificial Sequence: Synthetic oligonucleotide
  Target: ATXN1; (-) strand; PAM type: YTN; PAM sequence: TTT
ttttctgagacggagtctca

SEQ ID NO: 203159 - DNA, 20 bp, Artificial Sequence
  Description of Artificial Sequence: Synthetic oligonucleotide
  Target: ATXN1; (-) strand; PAM type: YTN; PAM sequence: TTT
tttttctgagacggagtctc

SEQ ID NO: 203160 - DNA, 20 bp, Artificial Sequence
  Description of Artificial Sequence: Synthetic oligonucleotide
  Target: ATXN1; (-) strand; PAM type: YTN; PAM sequence: TTT
ttttttctgagacggagtct

SEQ ID NO: 203161 - DNA, 20 bp, Artificial Sequence
  Description of Artificial Sequence: Synthetic oligonucleotide
  Target: ATXN1; (-) strand; PAM type: YTN; PAM sequence: TTT
tttttttctgagacggagtc

SEQ ID NO: 203162 - DNA, 20 bp, Artificial Sequence
  Description of Artificial Sequence: Synthetic oligonucleotide
  Target: ATXN1; (-) strand; PAM type: YTN; PAM sequence: TTT
ttttttttctgagacggagt

SEQ ID NO: 203163 - DNA, 20 bp, Artificial Sequence
  Description of Artificial Sequence: Synthetic oligonucleotide
  Target: ATXN1; (-) strand; PAM type: YTN; PAM sequence: TTT
tttttttttctgagacggag

SEQ ID NO: 203164 - DNA, 20 bp, Artificial Sequence
  Description of Artificial Sequence: Synthetic oligonucleotide
  Target: ATXN1; (-) strand; PAM type: YTN; PAM sequence: TTT
ttttttttttctgagacgga

SEQ ID NO: 203165 - DNA, 20 bp, Artificial Sequence
  Description of Artificial Sequence: Synthetic oligonucleotide
  Target: ATXN1; (-) strand; PAM type: YTN; PAM sequence: TTT
tttttttttttctgagacgg

SEQ ID NO: 203166 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttctgagacg

SEQ ID NO: 203167 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttctgagac

SEQ ID NO: 203168 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttctgaga

SEQ ID NO: 203169 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttctgag

SEQ ID NO: 203170 - DNA, 20 bp, Artificial Sequence
  Description of Artificial Sequence: Synthetic oligonucleotide
  Target: ATXN1; (-) strand; PAM type: YTN; PAM sequence: CTG
ttttttttttttttttttct

SEQ ID NO: 203171 - DNA, 20 bp, Artificial Sequence
  Description of Artificial Sequence: Synthetic oligonucleotide
  Target: ATXN1; (-) strand; PAM type: YTN; PAM sequence: CTG
agtcaatcggaactgttttt

SEQ ID NO: 203172 - DNA, 20 bp, Artificial Sequence
  Description of Artificial Sequence: Synthetic oligonucleotide
  Target: ATXN1; (-) strand; PAM type: YTN; PAM sequence: CTC
aggaacagcaggagaccact

SEQ ID NO: 203173 - DNA, 20 bp, Artificial Sequence
  Description of Artificial Sequence: Synthetic oligonucleotide
  Target: ATXN1; (-) strand; PAM type: YTN; PAM sequence: CTG
tctcaggaacagcaggagac

SEQ ID NO: 203174 - DNA, 20 bp, Artificial Sequence
  Description of Artificial Sequence: Synthetic oligonucleotide
  Target: ATXN1; (-) strand; PAM type: YTN; PAM sequence: CTC
tgtctcaggaacagcaggag

SEQ ID NO: 203175 - DNA, 20 bp, Artificial Sequence
  Description of Artificial Sequence: Synthetic oligonucleotide
  Target: ATXN1; (-) strand; PAM type: YTN; PAM sequence: TTA
tatctctgtctcaggaacag

SEQ ID NO: 203176 - DNA, 20 bp, Artificial Sequence
  Description of Artificial Sequence: Synthetic oligonucleotide
  Target: ATXN1; (-) strand; PAM type: YTN; PAM sequence: TTG
cagggcattatatctctgtc

SEQ ID NO: 203177 - DNA, 20 bp, Artificial Sequence
  Description of Artificial Sequence: Synthetic oligonucleotide
  Target: ATXN1; (-) strand; PAM type: YTN; PAM sequence: TTT
gcagggcattatatctctgt

SEQ ID NO: 203178 - DNA, 20 bp, Artificial Sequence
  Description of Artificial Sequence: Synthetic oligonucleotide
  Target: ATXN1; (-) strand; PAM type: YTN; PAM sequence: CTG
taatttgcagggcattatat

SEQ ID NO: 203179 - DNA, 20 bp, Artificial Sequence
  Description of Artificial Sequence: Synthetic oligonucleotide
  Target: ATXN1; (-) strand; PAM type: YTN; PAM sequence: TTG
gccatgagtaccctgtaatt

SEQ ID NO: 203180 - DNA, 20 bp, Artificial Sequence
  Description of Artificial Sequence: Synthetic oligonucleotide
  Target: ATXN1; (-) strand; PAM type: YTN; PAM sequence: TTT
ggccatgagtaccctgtaat

SEQ ID NO: 203181 - DNA, 20 bp, Artificial Sequence
  Description of Artificial Sequence: Synthetic oligonucleotide
  Target: ATXN1; (-) strand; PAM type: YTN; PAM sequence: CTC
ccatcccagccccacccgag

SEQ ID NO: 203182 - DNA, 20 bp, Artificial Sequence
  Description of Artificial Sequence: Synthetic oligonucleotide
  Target: ATXN1; (-) strand; PAM type: YTN; PAM sequence: TTA
ctcccatcccagccccaccc

SEQ ID NO: 203183 - DNA, 20 bp, Artificial Sequence
  Description of Artificial Sequence: Synthetic oligonucleotide
  Target: ATXN1; (-) strand; PAM type: YTN; PAM sequence: TTT
actcccatcccagccccacc

SEQ ID NO: 203184 - DNA, 20 bp, Artificial Sequence
  Description of Artificial Sequence: Synthetic oligonucleotide
  Target: ATXN1; (-) strand; PAM type: YTN; PAM sequence: CTT
tactcccatcccagccccac

SEQ ID NO: 203185 - DNA, 20 bp, Artificial Sequence
  Description of Artificial Sequence: Synthetic oligonucleotide
  Target: ATXN1; (-) strand; PAM type: YTN; PAM sequence: CTG
acgtcatctttactcccatc

SEQ ID NO: 203186 - DNA, 20 bp, Artificial Sequence
  Description of Artificial Sequence: Synthetic oligonucleotide
  Target: ATXN1; (-) strand; PAM type: YTN; PAM sequence: TTC
ctgacgtcatctttactccc

SEQ ID NO: 203187 - DNA, 20 bp, Artificial Sequence
  Description of Artificial Sequence: Synthetic oligonucleotide
  Target: ATXN1; (-) strand; PAM type: YTN; PAM sequence: CTT
cctgacgtcatctttactcc

SEQ ID NO: 203188 - DNA, 20 bp, Artificial Sequence
  Description of Artificial Sequence: Synthetic oligonucleotide
  Target: ATXN1; (-) strand; PAM type: YTN; PAM sequence: CTG
gataccttcctgacgtcatc

SEQ ID NO: 203189 - DNA, 20 bp, Artificial Sequence
  Description of Artificial Sequence: Synthetic oligonucleotide
  Target: ATXN1; (-) strand; PAM type: YTN; PAM sequence: CTG
ccacaactggataccttcct

SEQ ID NO: 203190 - DNA, 20 bp, Artificial Sequence
  Description of Artificial Sequence: Synthetic oligonucleotide
  Target: ATXN1; (-) strand; PAM type: YTN; PAM sequence: TTC
tgccacaactggataccttc

SEQ ID NO: 203191 - DNA, 20 bp, Artificial Sequence
  Description of Artificial Sequence: Synthetic oligonucleotide
  Target: ATXN1; (-) strand; PAM type: YTN; PAM sequence: TTT
ctgccacaactggatacctt

SEQ ID NO: 203192 - DNA, 20 bp, Artificial Sequence
  Description of Artificial Sequence: Synthetic oligonucleotide
  Target: ATXN1; (-) strand; PAM type: YTN; PAM sequence: CTA
accagtttctgccacaactg

SEQ ID NO: 203193 - DNA, 20 bp, Artificial Sequence
  Description of Artificial Sequence: Synthetic oligonucleotide
  Target: ATXN1; (-) strand; PAM type: YTN; PAM sequence: TTC
aacaactaaccagtttctgc

SEQ ID NO: 203194 - DNA, 20 bp, Artificial Sequence
  Description of Artificial Sequence: Synthetic oligonucleotide
  Target: ATXN1; (-) strand; PAM type: YTN; PAM sequence: TTT
caacaactaaccagtttctg

SEQ ID NO: 203195 - DNA, 20 bp, Artificial Sequence
  Description of Artificial Sequence: Synthetic oligonucleotide
  Target: ATXN1; (-) strand; PAM type: YTN; PAM sequence: TTT
tcaacaactaaccagtttct

SEQ ID NO: 203196 - DNA, 20 bp, Artificial Sequence
  Description of Artificial Sequence: Synthetic oligonucleotide
  Target: ATXN1; (-) strand; PAM type: YTN; PAM sequence: TTT
ttcaacaactaaccagtttc

SEQ ID NO: 203197 - DNA, 20 bp, Artificial Sequence
  Description of Artificial Sequence: Synthetic oligonucleotide
  Target: ATXN1; (-) strand; PAM type: YTN; PAM sequence: TTT
tttcaacaactaaccagttt

SEQ ID NO: 203198 - DNA, 20 bp, Artificial Sequence
  Description of Artificial Sequence: Synthetic oligonucleotide
  Target: ATXN1; (-) strand; PAM type: YTN; PAM sequence: CTG
ttttttcaacaactaaccag

SEQ ID NO: 203199 - DNA, 20 bp, Artificial Sequence
  Description of Artificial Sequence: Synthetic oligonucleotide
  Target: ATXN1; (-) strand; PAM type: YTN; PAM sequence: CTG
tatgtcaaggagtacaggga

SEQ ID NO: 203200 - DNA, 20 bp, Artificial Sequence
  Description of Artificial Sequence: Synthetic oligonucleotide
  Target: ATXN1; (-) strand; PAM type: YTN; PAM sequence: TTG
tcagcctgtatgtcaaggag

SEQ ID NO: 203201 - DNA, 20 bp, Artificial Sequence
  Description of Artificial Sequence: Synthetic oligonucleotide
  Target: ATXN1; (-) strand; PAM type: YTN; PAM sequence: CTG
caggtaaagtggagaattgt

SEQ ID NO: 203202 - DNA, 20 bp, Artificial Sequence
  Description of Artificial Sequence: Synthetic oligonucleotide
  Target: ATXN1; (-) strand; PAM type: YTN; PAM sequence: TTA
gtcatgtggacatagtcaac

SEQ ID NO: 203203 - DNA, 20 bp, Artificial Sequence
  Description of Artificial Sequence: Synthetic oligonucleotide
  Target: ATXN1; (-) strand; PAM type: YTN; PAM sequence: TTT
agtcatgtggacatagtcaa

SEQ ID NO: 203204 - DNA, 20 bp, Artificial Sequence
  Description of Artificial Sequence: Synthetic oligonucleotide
  Target: ATXN1; (-) strand; PAM type: YTN; PAM sequence: TTG
accagaatttagtcatgtgg

SEQ ID NO: 203205 - DNA, 20 bp, Artificial Sequence
  Description of Artificial Sequence: Synthetic oligonucleotide
  Target: ATXN1; (-) strand; PAM type: YTN; PAM sequence: CTT
gaccagaatttagtcatgtg

SEQ ID NO: 203206 - DNA, 20 bp, Artificial Sequence
  Description of Artificial Sequence: Synthetic oligonucleotide
  Target: ATXN1; (-) strand; PAM type: YTN; PAM sequence: TTC
ccttgaccagaatttagtca

SEQ ID NO: 203207 - DNA, 20 bp, Artificial Sequence
  Description of Artificial Sequence: Synthetic oligonucleotide
  Target: ATXN1; (-) strand; PAM type: YTN; PAM sequence: TTC
catgttcccttgaccagaat

SEQ ID NO: 203208 - DNA, 20 bp, Artificial Sequence
  Description of Artificial Sequence: Synthetic oligonucleotide
  Target: ATXN1; (-) strand; PAM type: YTN; PAM sequence: CTT
ccatgttcccttgaccagaa

SEQ ID NO: 203209 - DNA, 20 bp, Artificial Sequence
  Description of Artificial Sequence: Synthetic oligonucleotide
  Target: ATXN1; (-) strand; PAM type: YTN; PAM sequence: TTC
cttccatgttcccttgacca

SEQ ID NO: 203210 - DNA, 20 bp, Artificial Sequence
  Description of Artificial Sequence: Synthetic oligonucleotide
  Target: ATXN1; (-) strand; PAM type: YTN; PAM sequence: CTT
ccttccatgttcccttgacc

SEQ ID NO: 203211 - DNA, 20 bp, Artificial Sequence
  Description of Artificial Sequence: Synthetic oligonucleotide
  Target: ATXN1; (-) strand; PAM type: YTN; PAM sequence: TTG
gcatataccacttccttcca

SEQ ID NO: 203212 - DNA, 20 bp, Artificial Sequence
  Description of Artificial Sequence: Synthetic oligonucleotide
  Target: ATXN1; (-) strand; PAM type: YTN; PAM sequence: TTG
gtgaaattggcatataccac

SEQ ID NO: 203213 - DNA, 20 bp, Artificial Sequence
  Description of Artificial Sequence: Synthetic oligonucleotide
  Target: ATXN1; (-) strand; PAM type: YTN; PAM sequence: TTG
ttggtgaaattggcatatac

SEQ ID NO: 203214 - DNA, 20 bp, Artificial Sequence
  Description of Artificial Sequence: Synthetic oligonucleotide
  Target: ATXN1; (-) strand; PAM type: YTN; PAM sequence: TTT
gttggtgaaattggcatata

SEQ ID NO: 203215 - DNA, 20 bp, Artificial Sequence
  Description of Artificial Sequence: Synthetic oligonucleotide
  Target: ATXN1; (-) strand; PAM type: YTN; PAM sequence: CTG
ggaggtttgttggtgaaatt

SEQ ID NO: 203216 - DNA, 20 bp, Artificial Sequence
  Description of Artificial Sequence: Synthetic oligonucleotide
  Target: ATXN1; (-) strand; PAM type: YTN; PAM sequence: CTC
ctgggaggtttgttggtgaa

SEQ ID NO: 203217 - DNA, 20 bp, Artificial Sequence
  Description of Artificial Sequence: Synthetic oligonucleotide
  Target: ATXN1; (-) strand; PAM type: YTN; PAM sequence: CTG
gcagaagagagaagtgggga

SEQ ID NO: 203218 - DNA, 20 bp, Artificial Sequence
  Description of Artificial Sequence: Synthetic oligonucleotide
  Target: ATXN1; (-) strand; PAM type: YTN; PAM sequence: CTG
cacctggcagaagagagaag

SEQ ID NO: 203219 - DNA, 20 bp, Artificial Sequence
  Description of Artificial Sequence: Synthetic oligonucleotide
  Target: ATXN1; (-) strand; PAM type: YTN; PAM sequence: TTC
tgcacctggcagaagagaga

SEQ ID NO: 203220 - DNA, 20 bp, Artificial Sequence
  Description of Artificial Sequence: Synthetic oligonucleotide
  Target: ATXN1; (-) strand; PAM type: YTN; PAM sequence: CTT
ctgcacctggcagaagagag

SEQ ID NO: 203221 - DNA, 20 bp, Artificial Sequence
  Description of Artificial Sequence: Synthetic oligonucleotide
  Target: ATXN1; (-) strand; PAM type: YTN; PAM sequence: CTA
aggatcttctgcacctggca

SEQ ID NO: 203222 - DNA, 20 bp, Artificial Sequence
  Description of Artificial Sequence: Synthetic oligonucleotide
  Target: ATXN1; (-) strand; PAM type: YTN; PAM sequence: TTG
ggagaccctaaggatcttct

SEQ ID NO: 203223 - DNA, 20 bp, Artificial Sequence
  Description of Artificial Sequence: Synthetic oligonucleotide
  Target: ATXN1; (-) strand; PAM type: YTN; PAM sequence: CTC
agtgttgggagaccctaagg

SEQ ID NO: 203224 - DNA, 20 bp, Artificial Sequence
  Description of Artificial Sequence: Synthetic oligonucleotide
  Target: ATXN1; (-) strand; PAM type: YTN; PAM sequence: TTC
cctcagtgttgggagaccct

SEQ ID NO: 203225 - DNA, 20 bp, Artificial Sequence
  Description of Artificial Sequence: Synthetic oligonucleotide
  Target: ATXN1; (-) strand; PAM type: YTN; PAM sequence: CTC
agacattccctcagtgttgg

SEQ ID NO: 203226 - DNA, 20 bp, Artificial Sequence
  Description of Artificial Sequence: Synthetic oligonucleotide
  Target: ATXN1; (-) strand; PAM type: YTN; PAM sequence: TTG
tatcgcaaggctcagacatt

SEQ ID NO: 203227 - DNA, 20 bp, Artificial Sequence
  Description of Artificial Sequence: Synthetic oligonucleotide
  Target: ATXN1; (-) strand; PAM type: YTN; PAM sequence: CTT
gtatcgcaaggctcagacat

SEQ ID NO: 203228 - DNA, 20 bp, Artificial Sequence
  Description of Artificial Sequence: Synthetic oligonucleotide
  Target: ATXN1; (-) strand; PAM type: YTN; PAM sequence: CTG
acccagggtccttgtatcgc

SEQ ID NO: 203229 - DNA, 20 bp, Artificial Sequence
  Description of Artificial Sequence: Synthetic oligonucleotide
  Target: ATXN1; (-) strand; PAM type: YTN; PAM sequence: TTC
cctgacccagggtccttgta

SEQ ID NO: 203230 - DNA, 20 bp, Artificial Sequence
  Description of Artificial Sequence: Synthetic oligonucleotide
  Target: ATXN1; (-) strand; PAM type: YTN; PAM sequence: CTG
tatggtggtgattccctgac

SEQ ID NO: 203231 - DNA, 20 bp, Artificial Sequence
  Description of Artificial Sequence: Synthetic oligonucleotide
  Target: ATXN1; (-) strand; PAM type: YTN; PAM sequence: TTG
gagagggcgtctgtatggtg

SEQ ID NO: 203232 - DNA, 20 bp, Artificial Sequence
  Description of Artificial Sequence: Synthetic oligonucleotide
  Target: ATXN1; (-) strand; PAM type: YTN; PAM sequence: CTG
cagttggagagggcgtctgt

SEQ ID NO: 203233 - DNA, 20 bp, Artificial Sequence
  Description of Artificial Sequence: Synthetic oligonucleotide
  Target: ATXN1; (-) strand; PAM type: YTN; PAM sequence: TTC
tgcagttggagagggcgtct

SEQ ID NO: 203234 - DNA, 20 bp, Artificial Sequence
  Description of Artificial Sequence: Synthetic oligonucleotide
  Target: ATXN1; (-) strand; PAM type: YTN; PAM sequence: TTG
gggtgttctgcagttggaga

SEQ ID NO: 203235 - DNA, 20 bp, Artificial Sequence
  Description of Artificial Sequence: Synthetic oligonucleotide
  Target: ATXN1; (-) strand; PAM type: YTN; PAM sequence: CTT
ggggtgttctgcagttggag

SEQ ID NO: 203236 - DNA, 20 bp, Artificial Sequence
  Description of Artificial Sequence: Synthetic oligonucleotide
  Target: ATXN1; (-) strand; PAM type: YTN; PAM sequence: TTA
cggataacttggggtgttct

SEQ ID NO: 203237 - DNA, 20 bp, Artificial Sequence
  Description of Artificial Sequence: Synthetic oligonucleotide
  Target: ATXN1; (-) strand; PAM type: YTN; PAM sequence: TTG
atggtgttacggataacttg

SEQ ID NO: 203238 - DNA, 20 bp, Artificial Sequence
  Description of Artificial Sequence: Synthetic oligonucleotide
  Target: ATXN1; (-) strand; PAM type: YTN; PAM sequence: TTT
gatggtgttacggataactt

SEQ ID NO: 203239 - DNA, 20 bp, Artificial Sequence
  Description of Artificial Sequence: Synthetic oligonucleotide
  Target: ATXN1; (-) strand; PAM type: YTN; PAM sequence: TTT
tgatggtgttacggataact

SEQ ID NO: 203240 - DNA, 20 bp, Artificial Sequence
  Description of Artificial Sequence: Synthetic oligonucleotide
  Target: ATXN1; (-) strand; PAM type: YTN; PAM sequence: TTT
ttgatggtgttacggataac

SEQ ID NO: 203241 - DNA, 20 bp, Artificial Sequence
  Description of Artificial Sequence: Synthetic oligonucleotide
  Target: ATXN1; (-) strand; PAM type: YTN; PAM sequence: CTT
tttgatggtgttacggataa

SEQ ID NO: 203242 - DNA, 20 bp, Artificial Sequence
  Description of Artificial Sequence: Synthetic oligonucleotide
  Target: ATXN1; (-) strand; PAM type: YTN; PAM sequence: TTC
ctttttgatggtgttacgga

SEQ ID NO: 203243 - DNA, 20 bp, Artificial Sequence
  Description of Artificial Sequence: Synthetic oligonucleotide
  Target: ATXN1; (-) strand; PAM type: YTN; PAM sequence: TTC
agggtggaacacagtagaag

SEQ ID NO: 203244 - DNA, 20 bp, Artificial Sequence
  Description of Artificial Sequence: Synthetic oligonucleotide
  Target: ATXN1; (-) strand; PAM type: YTN; PAM sequence: CTT
cagggtggaacacagtagaa

SEQ ID NO: 203245 - DNA, 20 bp, Artificial Sequence
  Description of Artificial Sequence: Synthetic oligonucleotide
  Target: ATXN1; (-) strand; PAM type: YTN; PAM sequence: CTC
ttcagggtggaacacagtag

SEQ ID NO: 203246 - DNA, 20 bp, Artificial Sequence
  Description of Artificial Sequence: Synthetic oligonucleotide
  Target: ATXN1; (-) strand; PAM type: YTN; PAM sequence: TTG
caataacaagcaaccccaac

SEQ ID NO: 203247 - DNA, 20 bp, Artificial Sequence
  Description of Artificial Sequence: Synthetic oligonucleotide
  Target: ATXN1; (-) strand; PAM type: YTN; PAM sequence: CTG
agatgcaacaaagagatgat

SEQ ID NO: 203248 - DNA, 20 bp, Artificial Sequence
  Description of Artificial Sequence: Synthetic oligonucleotide
  Target: ATXN1; (-) strand; PAM type: YTN; PAM sequence: TTC
ctgagatgcaacaaagagat

SEQ ID NO: 203249 - DNA, 20 bp, Artificial Sequence
  Description of Artificial Sequence: Synthetic oligonucleotide
  Target: ATXN1; (-) strand; PAM type: YTN; PAM sequence: TTT
cctgagatgcaacaaagaga

SEQ ID NO: 203250 - DNA, 20 bp, Artificial Sequence
  Description of Artificial Sequence: Synthetic oligonucleotide
  Target: ATXN1; (-) strand; PAM type: YTN; PAM sequence: TTG
tccagggcaggtgaatgtaa

SEQ ID NO: 203251 - DNA, 20 bp, Artificial Sequence
  Description of Artificial Sequence: Synthetic oligonucleotide
  Target: ATXN1; (-) strand; PAM type: YTN; PAM sequence: CTA
gtggattgtccagggcaggt

SEQ ID NO: 203252 - DNA, 20 bp, Artificial Sequence
  Description of Artificial Sequence: Synthetic oligonucleotide
  Target: ATXN1; (-) strand; PAM type: YTN; PAM sequence: TTG
aggacaaacaaacctagtgg

SEQ ID NO: 203253 - DNA, 20 bp, Artificial Sequence
  Description of Artificial Sequence: Synthetic oligonucleotide
  Target: ATXN1; (-) strand; PAM type: YTN; PAM sequence: TTT
gaggacaaacaaacctagtg

SEQ ID NO: 203254 - DNA, 20 bp, Artificial Sequence
  Description of Artificial Sequence: Synthetic oligonucleotide
  Target: ATXN1; (-) strand; PAM type: YTN; PAM sequence: TTC
gtttgaggacaaacaaacct

SEQ ID NO: 203255 - DNA, 20 bp, Artificial Sequence
  Description of Artificial Sequence: Synthetic oligonucleotide
  Target: ATXN1; (-) strand; PAM type: YTN; PAM sequence: TTT
cgtttgaggacaaacaaacc

SEQ ID NO: 203256 - DNA, 20 bp, Artificial Sequence
  Description of Artificial Sequence: Synthetic oligonucleotide
  Target: ATXN1; (-) strand; PAM type: YTN; PAM sequence: CTC
agcggtgtgaggccatttcg

SEQ ID NO: 203257 - DNA, 20 bp, Artificial Sequence
  Description of Artificial Sequence: Synthetic oligonucleotide
  Target: ATXN1; (-) strand; PAM type: YTN; PAM sequence: TTA
taaaatctcagcggtgtgag

SEQ ID NO: 203258 - DNA, 20 bp, Artificial Sequence
  Description of Artificial Sequence: Synthetic oligonucleotide
  Target: ATXN1; (-) strand; PAM type: YTN; PAM sequence: TTG
aagtattataaaatctcagc

SEQ ID NO: 203259 - DNA, 20 bp, Artificial Sequence
  Description of Artificial Sequence: Synthetic oligonucleotide
  Target: ATXN1; (-) strand; PAM type: YTN; PAM sequence: CTT
gaagtattataaaatctcag

SEQ ID NO: 203260 - DNA, 20 bp, Artificial Sequence
  Description of Artificial Sequence: Synthetic oligonucleotide
  Target: ATXN1; (-) strand; PAM type: YTN; PAM sequence: CTA
taaaaacttgaagtattata

SEQ ID NO: 203261 - DNA, 20 bp, Artificial Sequence
  Description of Artificial Sequence: Synthetic oligonucleotide
  Target: ATXN1; (-) strand; PAM type: YTN; PAM sequence: CTA
accacagtgaaggaaggaga

SEQ ID NO: 203262 - DNA, 20 bp, Artificial Sequence
  Description of Artificial Sequence: Synthetic oligonucleotide
  Target: ATXN1; (-) strand; PAM type: YTN; PAM sequence: TTA
ctaaccacagtgaaggaagg

SEQ ID NO: 203263 - DNA, 20 bp, Artificial Sequence
  Description of Artificial Sequence: Synthetic oligonucleotide
  Target: ATXN1; (-) strand; PAM type: YTN; PAM sequence: CTT
actaaccacagtgaaggaag

SEQ ID NO: 203264 - DNA, 20 bp, Artificial Sequence
  Description of Artificial Sequence: Synthetic oligonucleotide
  Target: ATXN1; (-) strand; PAM type: YTN; PAM sequence: TTA
aacttactaaccacagtgaa

SEQ ID NO: 203265 - DNA, 20 bp, Artificial Sequence
  Description of Artificial Sequence: Synthetic oligonucleotide
  Target: ATXN1; (-) strand; PAM type: YTN; PAM sequence: TTG
ggttaaacttactaaccaca

SEQ ID NO: 203266 - DNA, 20 bp, Artificial Sequence
  Description of Artificial Sequence: Synthetic oligonucleotide
  Target: ATXN1; (-) strand; PAM type: YTN; PAM sequence: CTT
gggttaaacttactaaccac

SEQ ID NO: 203267 - DNA, 20 bp, Artificial Sequence
  Description of Artificial Sequence: Synthetic oligonucleotide
  Target: ATXN1; (-) strand; PAM type: YTN; PAM sequence: TTC
ttgggttaaacttactaacc

SEQ ID NO: 203268 - DNA, 20 bp, Artificial Sequence
  Description of Artificial Sequence: Synthetic oligonucleotide
  Target: ATXN1; (-) strand; PAM type: YTN; PAM sequence: TTT
cttgggttaaacttactaac

SEQ ID NO: 203269 - DNA, 20 bp, Artificial Sequence
  Description of Artificial Sequence: Synthetic oligonucleotide
  Target: ATXN1; (-) strand; PAM type: YTN; PAM sequence: CTT
tcttgggttaaacttactaa

SEQ ID NO: 203270 - DNA, 20 bp, Artificial Sequence
  Description of Artificial Sequence: Synthetic oligonucleotide
  Target: ATXN1; (-) strand; PAM type: YTN; PAM sequence: TTA
gaaggaataagagggctttc

SEQ ID NO: 203271 - DNA, 20 bp, Artificial Sequence
  Description of Artificial Sequence: Synthetic oligonucleotide
  Target: ATXN1; (-) strand; PAM type: YTN; PAM sequence: TTC
ccaaatagattagaaggaat

SEQ ID NO: 203272 - DNA, 20 bp, Artificial Sequence
  Description of Artificial Sequence: Synthetic oligonucleotide
  Target: ATXN1; (-) strand; PAM type: YTN; PAM sequence: TTT
cccaaatagattagaaggaa

SEQ ID NO: 203273 - DNA, 20 bp, Artificial Sequence
  Description of Artificial Sequence: Synthetic oligonucleotide
  Target: ATXN1; (-) strand; PAM type: YTN; PAM sequence: TTC
agtttcccaaatagattaga

SEQ ID NO: 203274 - DNA, 20 bp, Artificial Sequence
  Description of Artificial Sequence: Synthetic oligonucleotide
  Target: ATXN1; (-) strand; PAM type: YTN; PAM sequence: CTT
cagtttcccaaatagattag

SEQ ID NO: 203275 - DNA, 20 bp, Artificial Sequence
  Description of Artificial Sequence: Synthetic oligonucleotide
  Target: ATXN1; (-) strand; PAM type: YTN; PAM sequence: TTC
ttcagtttcccaaatagatt

SEQ ID NO: 203276 - DNA, 20 bp, Artificial Sequence
  Description of Artificial Sequence: Synthetic oligonucleotide
  Target: ATXN1; (-) strand; PAM type: YTN; PAM sequence: CTT
cttcagtttcccaaatagat

SEQ ID NO: 203277 - DNA, 20 bp, Artificial Sequence
  Description of Artificial Sequence: Synthetic oligonucleotide
  Target: ATXN1; (-) strand; PAM type: YTN; PAM sequence: TTC
acttcttcagtttcccaaat

SEQ ID NO: 203278 - DNA, 20 bp, Artificial Sequence
  Description of Artificial Sequence: Synthetic oligonucleotide
  Target: ATXN1; (-) strand; PAM type: YTN; PAM sequence: TTC
aacacattcacttcttcagt

SEQ ID NO: 203279 - DNA, 20 bp, Artificial Sequence
  Description of Artificial Sequence: Synthetic oligonucleotide
  Target: ATXN1; (-) strand; PAM type: YTN; PAM sequence: TTA
gtgattcaacacattcactt

SEQ ID NO: 203280 - DNA, 20 bp, Artificial Sequence
  Description of Artificial Sequence: Synthetic oligonucleotide
  Target: ATXN1; (-) strand; PAM type: YTN; PAM sequence: CTC
aaagtaagattagtgattca

SEQ ID NO: 203281 - DNA, 20 bp, Artificial Sequence
  Description of Artificial Sequence: Synthetic oligonucleotide
  Target: ATXN1; (-) strand; PAM type: YTN; PAM sequence: CTC
acaaggacactcaaagtaag

SEQ ID NO: 203282 - DNA, 20 bp, Artificial Sequence
  Description of Artificial Sequence: Synthetic oligonucleotide
  Target: ATXN1; (-) strand; PAM type: YTN; PAM sequence: TTG
actcacaaggacactcaaag

SEQ ID NO: 203283 - DNA, 20 bp, Artificial Sequence
  Description of Artificial Sequence: Synthetic oligonucleotide
  Target: ATXN1; (-) strand; PAM type: YTN; PAM sequence: CTG
ttgactcacaaggacactca

SEQ ID NO: 203284 - DNA, 20 bp, Artificial Sequence
  Description of Artificial Sequence: Synthetic oligonucleotide
  Target: ATXN1; (-) strand; PAM type: YTN; PAM sequence: CTG
gtgaacccagagccctgttg

SEQ ID NO: 203285 - DNA, 20 bp, Artificial Sequence
  Description of Artificial Sequence: Synthetic oligonucleotide
  Target: ATXN1; (-) strand; PAM type: YTN; PAM sequence: TTA
tagatgaagccctggtgaac

SEQ ID NO: 203286 - DNA, 20 bp, Artificial Sequence
  Description of Artificial Sequence: Synthetic oligonucleotide
  Target: ATXN1; (-) strand; PAM type: YTN; PAM sequence: CTT
atagatgaagccctggtgaa

SEQ ID NO: 203287 - DNA, 20 bp, Artificial Sequence
  Description of Artificial Sequence: Synthetic oligonucleotide
  Target: ATXN1; (-) strand; PAM type: YTN; PAM sequence: TTA
tacttatagatgaagccctg

SEQ ID NO: 203288 - DNA, 20 bp, Artificial Sequence
  Description of Artificial Sequence: Synthetic oligonucleotide
  Target: ATXN1; (-) strand; PAM type: YTN; PAM sequence: CTG
aattatacttatagatgaag

SEQ ID NO: 203289 - DNA, 20 bp, Artificial Sequence
  Description of Artificial Sequence: Synthetic oligonucleotide
  Target: ATXN1; (-) strand; PAM type: YTN; PAM sequence: TTC
tgaattatacttatagatga

SEQ ID NO: 203290 - DNA, 20 bp, Artificial Sequence
  Description of Artificial Sequence: Synthetic oligonucleotide
  Target: ATXN1; (-) strand; PAM type: YTN; PAM sequence: TTG
ggaaggagaaaaatgaccaa

SEQ ID NO: 203291 - DNA, 20 bp, Artificial Sequence
  Description of Artificial Sequence: Synthetic oligonucleotide
  Target: ATXN1; (-) strand; PAM type: YTN; PAM sequence: CTT
gggaaggagaaaaatgacca

SEQ ID NO: 203292 - DNA, 20 bp, Artificial Sequence
  Description of Artificial Sequence: Synthetic oligonucleotide
  Target: ATXN1; (-) strand; PAM type: YTN; PAM sequence: TTC
ttgggaaggagaaaaatgac

SEQ ID NO: 203293 - DNA, 20 bp, Artificial Sequence
  Description of Artificial Sequence: Synthetic oligonucleotide
  Target: ATXN1; (-) strand; PAM type: YTN; PAM sequence: CTT
cttgggaaggagaaaaatga

SEQ ID NO: 203294 - DNA, 20 bp, Artificial Sequence
  Description of Artificial Sequence: Synthetic oligonucleotide
  Target: ATXN1; (-) strand; PAM type: YTN; PAM sequence: CTG
gaaatgataggaaaaacctt

SEQ ID NO: 203295 - DNA, 20 bp, Artificial Sequence
  Description of Artificial Sequence: Synthetic oligonucleotide
  Target: ATXN1; (-) strand; PAM type: YTN; PAM sequence: TTG
aaacctggaaatgataggaa

SEQ ID NO: 203296 - DNA, 20 bp, Artificial Sequence
  Description of Artificial Sequence: Synthetic oligonucleotide
  Target: ATXN1; (-) strand; PAM type: YTN; PAM sequence: CTT
gaaacctggaaatgatagga

SEQ ID NO: 203297 - DNA, 20 bp, Artificial Sequence
  Description of Artificial Sequence: Synthetic oligonucleotide
  Target: ATXN1; (-) strand; PAM type: YTN; PAM sequence: CTA
cttgaaacctggaaatgata

SEQ ID NO: 203298 - DNA, 20 bp, Artificial Sequence
  Description of Artificial Sequence: Synthetic oligonucleotide
  Target: ATXN1; (-) strand; PAM type: YTN; PAM sequence: CTA
cgtgggtcctacttgaaacc

SEQ ID NO: 203299 - DNA, 20 bp, Artificial Sequence
  Description of Artificial Sequence: Synthetic oligonucleotide
  Target: ATXN1; (-) strand; PAM type: YTN; PAM sequence: CTA
atctacgtgggtcctacttg

SEQ ID NO: 203300 - DNA, 20 bp, Artificial Sequence
  Description of Artificial Sequence: Synthetic oligonucleotide
  Target: ATXN1; (-) strand; PAM type: YTN; PAM sequence: CTG
tgaccctaatctacgtgggt

SEQ ID NO: 203301 - DNA, 20 bp, Artificial Sequence
  Description of Artificial Sequence: Synthetic oligonucleotide
  Target: ATXN1; (-) strand; PAM type: YTN; PAM sequence: TTC
tgtgaccctaatctacgtgg

SEQ ID NO: 203302 - DNA, 20 bp, Artificial Sequence
  Description of Artificial Sequence: Synthetic oligonucleotide
  Target: ATXN1; (-) strand; PAM type: YTN; PAM sequence: TTT
ctgtgaccctaatctacgtg

SEQ ID NO: 203303 - DNA, 20 bp, Artificial Sequence
  Description of Artificial Sequence: Synthetic oligonucleotide
  Target: ATXN1; (-) strand; PAM type: YTN; PAM sequence: TTA
ggcagaatacatatttctgt

SEQ ID NO: 203304 - DNA, 20 bp, Artificial Sequence
  Description of Artificial Sequence: Synthetic oligonucleotide
  Target: ATXN1; (-) strand; PAM type: YTN; PAM sequence: CTT
aggcagaatacatatttctg

SEQ ID NO: 203305 - DNA, 20 bp, Artificial Sequence
  Description of Artificial Sequence: Synthetic oligonucleotide
  Target: ATXN1; (-) strand; PAM type: YTN; PAM sequence: TTA
tcttaggcagaatacatatt

SEQ ID NO: 203306 - DNA, 20 bp, Artificial Sequence
  Description of Artificial Sequence: Synthetic oligonucleotide
  Target: ATXN1; (-) strand; PAM type: YTN; PAM sequence: CTA
gttatcttaggcagaataca

SEQ ID NO: 203307 - DNA, 20 bp, Artificial Sequence
  Description of Artificial Sequence: Synthetic oligonucleotide
  Target: ATXN1; (-) strand; PAM type: YTN; PAM sequence: TTA
taaaagtgatatgatcctag

SEQ ID NO: 203308 - DNA, 20 bp, Artificial Sequence
  Description of Artificial Sequence: Synthetic oligonucleotide
  Target: ATXN1; (-) strand; PAM type: YTN; PAM sequence: TTA
gttataaaagtgatatgatc

SEQ ID NO: 203309 - DNA, 20 bp, Artificial Sequence
  Description of Artificial Sequence: Synthetic oligonucleotide
  Target: ATXN1; (-) strand; PAM type: YTN; PAM sequence: TTT
agttataaaagtgatatgat

SEQ ID NO: 203310 - DNA, 20 bp, Artificial Sequence
  Description of Artificial Sequence: Synthetic oligonucleotide
  Target: ATXN1; (-) strand; PAM type: YTN; PAM sequence: TTC
catggatttagttataaaag

SEQ ID NO: 203311 - DNA, 20 bp, Artificial Sequence
  Description of Artificial Sequence: Synthetic oligonucleotide
  Target: ATXN1; (-) strand; PAM type: YTN; PAM sequence: CTT
ccatggatttagttataaaa

SEQ ID NO: 203312 - DNA, 20 bp, Artificial Sequence
  Description of Artificial Sequence: Synthetic oligonucleotide
  Target: ATXN1; (-) strand; PAM type: YTN; PAM sequence: TTG
gtgccacttccatggattta

SEQ ID NO: 203313 - DNA, 20 bp, Artificial Sequence
  Description of Artificial Sequence: Synthetic oligonucleotide
  Target: ATXN1; (-) strand; PAM type: YTN; PAM sequence: CTT
ggtgccacttccatggattt

SEQ ID NO: 203314 - DNA, 20 bp, Artificial Sequence
  Description of Artificial Sequence: Synthetic oligonucleotide
  Target: ATXN1; (-) strand; PAM type: YTN; PAM sequence: TTC
acttggtgccacttccatgg

SEQ ID NO: 203315 - DNA, 20 bp, Artificial Sequence
  Description of Artificial Sequence: Synthetic oligonucleotide
  Target: ATXN1; (-) strand; PAM type: YTN; PAM sequence: TTC
aacaaagttcacttggtgcc

SEQ ID NO: 203316 - DNA, 20 bp, Artificial Sequence
  Description of Artificial Sequence: Synthetic oligonucleotide
  Target: ATXN1; (-) strand; PAM type: YTN; PAM sequence: TTT
caacaaagttcacttggtgc

SEQ ID NO: 203317 - DNA, 20 bp, Artificial Sequence
  Description of Artificial Sequence: Synthetic oligonucleotide
  Target: ATXN1; (-) strand; PAM type: YTN; PAM sequence: TTT
tcaacaaagttcacttggtg

SEQ ID NO: 203318 - DNA, 20 bp, Artificial Sequence
  Description of Artificial Sequence: Synthetic oligonucleotide
  Target: ATXN1; (-) strand; PAM type: YTN; PAM sequence: CTG
ttttcaacaaagttcacttg

SEQ ID NO: 203319 - DNA, 20 bp, Artificial Sequence
  Description of Artificial Sequence: Synthetic oligonucleotide
  Target: ATXN1; (-) strand; PAM type: YTN; PAM sequence: CTG
aataaatgaatagtgaatga

SEQ ID NO: 203320 - DNA, 20 bp, Artificial Sequence
  Description of Artificial Sequence: Synthetic oligonucleotide
  Target: ATXN1; (-) strand; PAM type: YTN; PAM sequence: TTA
aaggtaaactgaataaatga

SEQ ID NO: 203321 - DNA, 20 bp, Artificial Sequence
  Description of Artificial Sequence: Synthetic oligonucleotide
  Target: ATXN1; (-) strand; PAM type: YTN; PAM sequence: TTC
cattaaaggtaaactgaata

SEQ ID NO: 203322 - DNA, 20 bp, Artificial Sequence
  Description of Artificial Sequence: Synthetic oligonucleotide
  Target: ATXN1; (-) strand; PAM type: YTN; PAM sequence: CTT
ccattaaaggtaaactgaat

SEQ ID NO: 203323 - DNA, 20 bp, Artificial Sequence
  Description of Artificial Sequence: Synthetic oligonucleotide
  Target: ATXN1; (-) strand; PAM type: YTN; PAM sequence: CTC
ttccattaaaggtaaactga

SEQ ID NO: 203324 - DNA, 20 bp, Artificial Sequence
  Description of Artificial Sequence: Synthetic oligonucleotide
  Target: ATXN1; (-) strand; PAM type: YTN; PAM sequence: CTC
ccctcttccattaaaggtaa

SEQ ID NO: 203325 - DNA, 20 bp, Artificial Sequence
  Description of Artificial Sequence: Synthetic oligonucleotide
  Target: ATXN1; (-) strand; PAM type: YTN; PAM sequence: TTC
tcccctcttccattaaaggt

SEQ ID NO: 203326 - DNA, 20 bp, Artificial Sequence
  Description of Artificial Sequence: Synthetic oligonucleotide
  Target: ATXN1; (-) strand; PAM type: YTN; PAM sequence: CTT
ctcccctcttccattaaagg

SEQ ID NO: 203327 - DNA, 20 bp, Artificial Sequence
  Description of Artificial Sequence: Synthetic oligonucleotide
  Target: ATXN1; (-) strand; PAM type: YTN; PAM sequence: CTC
ttctcccctcttccattaaa

SEQ ID NO: 203328 - DNA, 20 bp, Artificial Sequence
  Description of Artificial Sequence: Synthetic oligonucleotide
  Target: ATXN1; (-) strand; PAM type: YTN; PAM sequence: TTC
agtctcttctcccctcttcc

SEQ ID NO: 203329 - DNA, 20 bp, Artificial Sequence
  Description of Artificial Sequence: Synthetic oligonucleotide
  Target: ATXN1; (-) strand; PAM type: YTN; PAM sequence: CTT
cagtctcttctcccctcttc

SEQ ID NO: 203330 - DNA, 20 bp, Artificial Sequence
  Description of Artificial Sequence: Synthetic oligonucleotide
  Target: ATXN1; (-) strand; PAM type: YTN; PAM sequence: TTC
ttcagtctcttctcccctct

SEQ ID NO: 203331 - DNA, 20 bp, Artificial Sequence
  Description of Artificial Sequence: Synthetic oligonucleotide
  Target: ATXN1; (-) strand; PAM type: YTN; PAM sequence: TTT
cttcagtctcttctcccctc

SEQ ID NO: 203332 - DNA, 20 bp, Artificial Sequence
  Description of Artificial Sequence: Synthetic oligonucleotide
  Target: ATXN1; (-) strand; PAM type: YTN; PAM sequence: CTT
tcttcagtctcttctcccct

SEQ ID NO: 203333 - DNA, 20 bp, Artificial Sequence
  Description of Artificial Sequence: Synthetic oligonucleotide
  Target: ATXN1; (-) strand; PAM type: YTN; PAM sequence: CTG
tctttcttcagtctcttctc

SEQ ID NO: 203334 - DNA, 20 bp, Artificial Sequence
  Description of Artificial Sequence: Synthetic oligonucleotide
  Target: ATXN1; (-) strand; PAM type: YTN; PAM sequence: TTC
atctgtctttcttcagtctc

SEQ ID NO: 203335 - DNA, 20 bp, Artificial Sequence
  Description of Artificial Sequence: Synthetic oligonucleotide
  Target: ATXN1; (-) strand; PAM type: YTN; PAM sequence: TTT
catctgtctttcttcagtct

SEQ ID NO: 203336 - DNA, 20 bp, Artificial Sequence
  Description of Artificial Sequence: Synthetic oligonucleotide
  Target: ATXN1; (-) strand; PAM type: YTN; PAM sequence: CTT
tcatctgtctttcttcagtc

SEQ ID NO: 203337 - DNA, 20 bp, Artificial Sequence
  Description of Artificial Sequence: Synthetic oligonucleotide
  Target: ATXN1; (-) strand; PAM type: YTN; PAM sequence: TTC
actttcatctgtctttcttc

SEQ ID NO: 203338 - DNA, 20 bp, Artificial Sequence
  Description of Artificial Sequence: Synthetic oligonucleotide
  Target: ATXN1; (-) strand; PAM type: YTN; PAM sequence: CTT
cactttcatctgtctttctt

SEQ ID NO: 203339 - DNA, 20 bp, Artificial Sequence
  Description of Artificial Sequence: Synthetic oligonucleotide
  Target: ATXN1; (-) strand; PAM type: YTN; PAM sequence: TTC
ttcactttcatctgtctttc

SEQ ID NO: 203340 - DNA, 20 bp, Artificial Sequence
  Description of Artificial Sequence: Synthetic oligonucleotide
  Target: ATXN1; (-) strand; PAM type: YTN; PAM sequence: CTT
cttcactttcatctgtcttt

SEQ ID NO: 203341 - DNA, 20 bp, Artificial Sequence
  Description of Artificial Sequence: Synthetic oligonucleotide
  Target: ATXN1; (-) strand; PAM type: YTN; PAM sequence: CTC
ttcttcactttcatctgtct

SEQ ID NO: 203342 - DNA, 20 bp, Artificial Sequence
  Description of Artificial Sequence: Synthetic oligonucleotide
  Target: ATXN1; (-) strand; PAM type: YTN; PAM sequence: TTC
tcttcttcactttcatctgt

SEQ ID NO: 203343 - DNA, 20 bp, Artificial Sequence
  Description of Artificial Sequence: Synthetic oligonucleotide
  Target: ATXN1; (-) strand; PAM type: YTN; PAM sequence: TTT
ctcttcttcactttcatctg

SEQ ID NO: 203344 - DNA, 20 bp, Artificial Sequence
  Description of Artificial Sequence: Synthetic oligonucleotide
  Target: ATXN1; (-) strand; PAM type: YTN; PAM sequence: TTA
tttctcttcttcactttcat

SEQ ID NO: 203345 - DNA, 20 bp, Artificial Sequence
  Description of Artificial Sequence: Synthetic oligonucleotide
  Target: ATXN1; (-) strand; PAM type: YTN; PAM sequence: CTT
atttctcttcttcactttca

SEQ ID NO: 203346 - DNA, 20 bp, Artificial Sequence
  Description of Artificial Sequence: Synthetic oligonucleotide
  Target: ATXN1; (-) strand; PAM type: YTN; PAM sequence: TTA
caacttatttctcttcttca

SEQ ID NO: 203347 - DNA, 20 bp, Artificial Sequence
  Description of Artificial Sequence: Synthetic oligonucleotide
  Target: ATXN1; (-) strand; PAM type: YTN; PAM sequence: TTA
ggcgtggggaatggttacaa

SEQ ID NO: 203348 - DNA, 20 bp, Artificial Sequence
  Description of Artificial Sequence: Synthetic oligonucleotide
  Target: ATXN1; (-) strand; PAM type: YTN; PAM sequence: TTA
tgaataaaataaggggaata

SEQ ID NO: 203349 - DNA, 20 bp, Artificial Sequence
  Description of Artificial Sequence: Synthetic oligonucleotide
  Target: ATXN1; (-) strand; PAM type: YTN; PAM sequence: CTT
atgaataaaataaggggaat

SEQ ID NO: 203350 - DNA, 20 bp, Artificial Sequence
  Description of Artificial Sequence: Synthetic oligonucleotide
  Target: ATXN1; (-) strand; PAM type: YTN; PAM sequence: CTA
acaacttatgaataaaataa

SEQ ID NO: 203351 - DNA, 20 bp, Artificial Sequence
  Description of Artificial Sequence: Synthetic oligonucleotide
  Target: ATXN1; (-) strand; PAM type: YTN; PAM sequence: CTC
taacaacttatgaataaaat

SEQ ID NO: 203352 - DNA, 20 bp, Artificial Sequence
  Description of Artificial Sequence: Synthetic oligonucleotide
  Target: ATXN1; (-) strand; PAM type: YTN; PAM sequence: TTG
taccctctaacaacttatga

SEQ ID NO: 203353 - DNA, 20 bp, Artificial Sequence
  Description of Artificial Sequence: Synthetic oligonucleotide
  Target: ATXN1; (-) strand; PAM type: YTN; PAM sequence: TTA
ttgtaccctctaacaactta

SEQ ID NO: 203354 - DNA, 20 bp, Artificial Sequence
  Description of Artificial Sequence: Synthetic oligonucleotide
  Target: ATXN1; (-) strand; PAM type: YTN; PAM sequence: TTT
attgtaccctctaacaactt

SEQ ID NO: 203355 - DNA, 20 bp, Artificial Sequence
  Description of Artificial Sequence: Synthetic oligonucleotide
  Target: ATXN1; (-) strand; PAM type: YTN; PAM sequence: TTT
tattgtaccctctaacaact

SEQ ID NO: 203356 - DNA, 20 bp, Artificial Sequence
  Description of Artificial Sequence: Synthetic oligonucleotide
  Target: ATXN1; (-) strand; PAM type: YTN; PAM sequence: TTT
ttattgtaccctctaacaac

SEQ ID NO: 203357 - DNA, 20 bp, Artificial Sequence
  Description of Artificial Sequence: Synthetic oligonucleotide
  Target: ATXN1; (-) strand; PAM type: YTN; PAM sequence: TTA
gtttttattgtaccctctaa

SEQ ID NO: 203358 - DNA, 20 bp, Artificial Sequence
  Description of Artificial Sequence: Synthetic oligonucleotide
  Target: ATXN1; (-) strand; PAM type: YTN; PAM sequence: CTT
agtttttattgtaccctcta

SEQ ID NO: 203359 - DNA, 20 bp, Artificial Sequence
  Description of Artificial Sequence: Synthetic oligonucleotide
  Target: ATXN1; (-) strand; PAM type: YTN; PAM sequence: TTA
acttagtttttattgtaccc

SEQ ID NO: 203360 - DNA, 20 bp, Artificial Sequence
  Description of Artificial Sequence: Synthetic oligonucleotide
  Target: ATXN1; (-) strand; PAM type: YTN; PAM sequence: CTT
aacttagtttttattgtacc

SEQ ID NO: 203361 - DNA, 20 bp, Artificial Sequence
  Description of Artificial Sequence: Synthetic oligonucleotide
  Target: ATXN1; (-) strand; PAM type: YTN; PAM sequence: TTA
catcttaacttagtttttat

SEQ ID NO: 203362 - DNA, 20 bp, Artificial Sequence
  Description of Artificial Sequence: Synthetic oligonucleotide
  Target: ATXN1; (-) strand; PAM type: YTN; PAM sequence: TTC
aaattacatcttaacttagt

SEQ ID NO: 203363 - DNA, 20 bp, Artificial Sequence
  Description of Artificial Sequence: Synthetic oligonucleotide
  Target: ATXN1; (-) strand; PAM type: YTN; PAM sequence: TTT
caaattacatcttaacttag

SEQ ID NO: 203364 - DNA, 20 bp, Artificial Sequence
  Description of Artificial Sequence: Synthetic oligonucleotide
  Target: ATXN1; (-) strand; PAM type: YTN; PAM sequence: CTC
catttcaaattacatcttaa

SEQ ID NO: 203365 - DNA, 20 bp, Artificial Sequence
  Description of Artificial Sequence: Synthetic oligonucleotide
  Target: ATXN1; (-) strand; PAM type: YTN; PAM sequence: TTA
gacagactccatttcaaatt

SEQ ID NO: 203366 - DNA, 20 bp, Artificial Sequence
  Description of Artificial Sequence: Synthetic oligonucleotide
  Target: ATXN1; (-) strand; PAM type: YTN; PAM sequence: TTG
gattagacagactccatttc

SEQ ID NO: 203367 - DNA, 20 bp, Artificial Sequence
  Description of Artificial Sequence: Synthetic oligonucleotide
  Target: ATXN1; (-) strand; PAM type: YTN; PAM sequence: TTT
ggattagacagactccattt

SEQ ID NO: 203368 - DNA, 20 bp, Artificial Sequence
  Description of Artificial Sequence: Synthetic oligonucleotide
  Target: ATXN1; (-) strand; PAM type: YTN; PAM sequence: TTT
tggattagacagactccatt

SEQ ID NO: 203369 - DNA, 20 bp, Artificial Sequence
  Description of Artificial Sequence: Synthetic oligonucleotide
  Target: ATXN1; (-) strand; PAM type: YTN; PAM sequence: CTA
gggttttggattagacagac

SEQ ID NO: 203370 - DNA, 20 bp, Artificial Sequence
  Description of Artificial Sequence: Synthetic oligonucleotide
  Target: ATXN1; (-) strand; PAM type: YTN; PAM sequence: CTG
tgcaaggagcaagggtagaa

SEQ ID NO: 203371 - DNA, 20 bp, Artificial Sequence
  Description of Artificial Sequence: Synthetic oligonucleotide
  Target: ATXN1; (-) strand; PAM type: YTN; PAM sequence: CTC
cagaaaatcgctgtgcaagg

SEQ ID NO: 203372 - DNA, 20 bp, Artificial Sequence
  Description of Artificial Sequence: Synthetic oligonucleotide
  Target: ATXN1; (-) strand; PAM type: YTN; PAM sequence: CTA
gagatgcaacaaagtgatga

SEQ ID NO: 203373 - DNA, 20 bp, Artificial Sequence
  Description of Artificial Sequence: Synthetic oligonucleotide
  Target: ATXN1; (-) strand; PAM type: YTN; PAM sequence: TTC
tagagatgcaacaaagtgat

SEQ ID NO: 203374 - DNA, 20 bp, Artificial Sequence
  Description of Artificial Sequence: Synthetic oligonucleotide
  Target: ATXN1; (-) strand; PAM type: YTN; PAM sequence: TTT
ctagagatgcaacaaagtga

SEQ ID NO: 203375 - DNA, 20 bp, Artificial Sequence
  Description of Artificial Sequence: Synthetic oligonucleotide
  Target: ATXN1; (-) strand; PAM type: YTN; PAM sequence: CTT
tctagagatgcaacaaagtg

SEQ ID NO: 203376 - DNA, 20 bp, Artificial Sequence
  Description of Artificial Sequence: Synthetic oligonucleotide
  Target: ATXN1; (-) strand; PAM type: YTN; PAM sequence: CTG
gatctttctagagatgcaac

SEQ ID NO: 203377 - DNA, 20 bp, Artificial Sequence
  Description of Artificial Sequence: Synthetic oligonucleotide
  Target: ATXN1; (-) strand; PAM type: YTN; PAM sequence: TTA
atccctggatctttctagag

SEQ ID NO: 203378 - DNA, 20 bp, Artificial Sequence
  Description of Artificial Sequence: Synthetic oligonucleotide
  Target: ATXN1; (-) strand; PAM type: YTN; PAM sequence: TTT
aatccctggatctttctaga

SEQ ID NO: 203379 - DNA, 20 bp, Artificial Sequence
  Description of Artificial Sequence: Synthetic oligonucleotide
  Target: ATXN1; (-) strand; PAM type: YTN; PAM sequence: TTA
tttaatccctggatctttct

SEQ ID NO: 203380 - DNA, 20 bp, Artificial Sequence
  Description of Artificial Sequence: Synthetic oligonucleotide
  Target: ATXN1; (-) strand; PAM type: YTN; PAM sequence: TTA
ggccaccacacaggaagcac

SEQ ID NO: 203381 - DNA, 20 bp, Artificial Sequence
  Description of Artificial Sequence: Synthetic oligonucleotide
  Target: ATXN1; (-) strand; PAM type: YTN; PAM sequence: CTT
aggccaccacacaggaagca

SEQ ID NO: 203382 - DNA, 20 bp, Artificial Sequence
  Description of Artificial Sequence: Synthetic oligonucleotide
  Target: ATXN1; (-) strand; PAM type: YTN; PAM sequence: TTC
ttaggccaccacacaggaag

SEQ ID NO: 203383 - DNA, 20 bp, Artificial Sequence
  Description of Artificial Sequence: Synthetic oligonucleotide
  Target: ATXN1; (-) strand; PAM type: YTN; PAM sequence: TTA
attcttaggccaccacacag

SEQ ID NO: 203384 - DNA, 20 bp, Artificial Sequence
  Description of Artificial Sequence: Synthetic oligonucleotide
  Target: ATXN1; (-) strand; PAM type: YTN; PAM sequence: CTT
aattcttaggccaccacaca

SEQ ID NO: 203385 - DNA, 20 bp, Artificial Sequence
  Description of Artificial Sequence: Synthetic oligonucleotide
  Target: ATXN1; (-) strand; PAM type: YTN; PAM sequence: CTC
ttaattcttaggccaccaca

SEQ ID NO: 203386 - DNA, 20 bp, Artificial Sequence
  Description of Artificial Sequence: Synthetic oligonucleotide
  Target: ATXN1; (-) strand; PAM type: YTN; PAM sequence: TTC
tcttaattcttaggccacca

SEQ ID NO: 203387 - DNA, 20 bp, Artificial Sequence
  Description of Artificial Sequence: Synthetic oligonucleotide
  Target: ATXN1; (-) strand; PAM type: YTN; PAM sequence: CTT
ctcttaattcttaggccacc

SEQ ID NO: 203388 - DNA, 20 bp, Artificial Sequence
  Description of Artificial Sequence: Synthetic oligonucleotide
  Target: ATXN1; (-) strand; PAM type: YTN; PAM sequence: TTG
tcaaagagagggtgcacaca

SEQ ID NO: 203389 - DNA, 20 bp, Artificial Sequence
  Description of Artificial Sequence: Synthetic oligonucleotide
  Target: ATXN1; (-) strand; PAM type: YTN; PAM sequence: TTT
gtcaaagagagggtgcacac

SEQ ID NO: 203390 - DNA, 20 bp, Artificial Sequence
  Description of Artificial Sequence: Synthetic oligonucleotide
  Target: ATXN1; (-) strand; PAM type: YTN; PAM sequence: CTT
tgtcaaagagagggtgcaca

SEQ ID NO: 203391 - DNA, 20 bp, Artificial Sequence
  Description of Artificial Sequence: Synthetic oligonucleotide
  Target: ATXN1; (-) strand; PAM type: YTN; PAM sequence: TTG
ggaaatcaggccatgctttg

SEQ ID NO: 203392 - DNA, 20 bp, Artificial Sequence
  Description of Artificial Sequence: Synthetic oligonucleotide
  Target: ATXN1; (-) strand; PAM type: YTN; PAM sequence: CTC
cataaggattgggaaatcag

SEQ ID NO: 203393 - DNA, 20 bp, Artificial Sequence
  Description of Artificial Sequence: Synthetic oligonucleotide
  Target: ATXN1; (-) strand; PAM type: YTN; PAM sequence: CTC
aacagagctccataaggatt

SEQ ID NO: 203394 - DNA, 20 bp, Artificial Sequence
  Description of Artificial Sequence: Synthetic oligonucleotide
  Target: ATXN1; (-) strand; PAM type: YTN; PAM sequence: CTG
tgtaaccctcaacagagctc

SEQ ID NO: 203395 - DNA, 20 bp, Artificial Sequence
  Description of Artificial Sequence: Synthetic oligonucleotide
  Target: ATXN1; (-) strand; PAM type: YTN; PAM sequence: TTG
ctgtgtaaccctcaacagag

SEQ ID NO: 203396 - DNA, 20 bp, Artificial Sequence
  Description of Artificial Sequence: Synthetic oligonucleotide
  Target: ATXN1; (-) strand; PAM type: YTN; PAM sequence: CTT
gctgtgtaaccctcaacaga

SEQ ID NO: 203397 - DNA, 20 bp, Artificial Sequence
  Description of Artificial Sequence: Synthetic oligonucleotide
  Target: ATXN1; (-) strand; PAM type: YTN; PAM sequence: TTG
caaggtaaaggcaggcagaa

SEQ ID NO: 203398 - DNA, 20 bp, Artificial Sequence
  Description of Artificial Sequence: Synthetic oligonucleotide
  Target: ATXN1; (-) strand; PAM type: YTN; PAM sequence: CTC
atagcaattgcaaggtaaag

SEQ ID NO: 203399 - DNA, 20 bp, Artificial Sequence
  Description of Artificial Sequence: Synthetic oligonucleotide
  Target: ATXN1; (-) strand; PAM type: YTN; PAM sequence: TTC
tcatagcaattgcaaggtaa

SEQ ID NO: 203400 - DNA, 20 bp, Artificial Sequence
  Description of Artificial Sequence: Synthetic oligonucleotide
  Target: ATXN1; (-) strand; PAM type: YTN; PAM sequence: TTA
ttctcatagcaattgcaagg

SEQ ID NO: 203401 - DNA, 20 bp, Artificial Sequence
  Description of Artificial Sequence: Synthetic oligonucleotide
  Target: ATXN1; (-) strand; PAM type: YTN; PAM sequence: TTT
attctcatagcaattgcaag

SEQ ID NO: 203402 - DNA, 20 bp, Artificial Sequence
  Description of Artificial Sequence: Synthetic oligonucleotide
  Target: ATXN1; (-) strand; PAM type: YTN; PAM sequence: TTG
aatttattctcatagcaatt

SEQ ID NO: 203403 - DNA, 20 bp, Artificial Sequence
  Description of Artificial Sequence: Synthetic oligonucleotide
  Target: ATXN1; (-) strand; PAM type: YTN; PAM sequence: TTT
gaatttattctcatagcaat

SEQ ID NO: 203404 - DNA, 20 bp, Artificial Sequence
  Description of Artificial Sequence: Synthetic oligonucleotide
  Target: ATXN1; (-) strand; PAM type: YTN; PAM sequence: TTT
tgaatttattctcatagcaa

SEQ ID NO: 203405 - DNA, 20 bp, Artificial Sequence
  Description of Artificial Sequence: Synthetic oligonucleotide
  Target: ATXN1; (-) strand; PAM type: YTN; PAM sequence: CTC
gggaaccattttgaatttat

SEQ ID NO: 203406 - DNA, 20 bp, Artificial Sequence
  Description of Artificial Sequence: Synthetic oligonucleotide
  Target: ATXN1; (-) strand; PAM type: YTN; PAM sequence: CTG
aactcgggaaccattttgaa

SEQ ID NO: 203407 - DNA, 20 bp, Artificial Sequence
  Description of Artificial Sequence: Synthetic oligonucleotide
  Target: ATXN1; (-) strand; PAM type: YTN; PAM sequence: TTA
gcagcagaagtgggagtcac

SEQ ID NO: 203408 - DNA, 20 bp, Artificial Sequence
  Description of Artificial Sequence: Synthetic oligonucleotide
  Target: ATXN1; (-) strand; PAM type: YTN; PAM sequence: TTT
agcagcagaagtgggagtca

SEQ ID NO: 203409 - DNA, 20 bp, Artificial Sequence
  Description of Artificial Sequence: Synthetic oligonucleotide
  Target: ATXN1; (-) strand; PAM type: YTN; PAM sequence: TTT
tagcagcagaagtgggagtc

SEQ ID NO: 203410 - DNA, 20 bp, Artificial Sequence
  Description of Artificial Sequence: Synthetic oligonucleotide
  Target: ATXN1; (-) strand; PAM type: YTN; PAM sequence: TTT
ttagcagcagaagtgggagt

SEQ ID NO: 203411 - DNA, 20 bp, Artificial Sequence
  Description of Artificial Sequence: Synthetic oligonucleotide
  Target: ATXN1; (-) strand; PAM type: YTN; PAM sequence: TTT
tttagcagcagaagtgggag

SEQ ID NO: 203412 - DNA, 20 bp, Artificial Sequence
  Description of Artificial Sequence: Synthetic oligonucleotide
  Target: ATXN1; (-) strand; PAM type: YTN; PAM sequence: TTT
ttttagcagcagaagtggga

SEQ ID NO: 203413 - DNA, 20 bp, Artificial Sequence
  Description of Artificial Sequence: Synthetic oligonucleotide
  Target: ATXN1; (-) strand; PAM type: YTN; PAM sequence: TTG
tttttttagcagcagaagtg

SEQ ID NO: 203414 - DNA, 20 bp, Artificial Sequence
  Description of Artificial Sequence: Synthetic oligonucleotide
  Target: ATXN1; (-) strand; PAM type: YTN; PAM sequence: CTT
gtttttttagcagcagaagt

SEQ ID NO: 203415 - DNA, 20 bp, Artificial Sequence
  Description of Artificial Sequence: Synthetic oligonucleotide
  Target: ATXN1; (-) strand; PAM type: YTN; PAM sequence: CTG
tcttgtttttttagcagcag

SEQ ID NO: 203416 - DNA, 20 bp, Artificial Sequence
  Description of Artificial Sequence: Synthetic oligonucleotide
  Target: ATXN1; (-) strand; PAM type: YTN; PAM sequence: TTC
aatacaatagctgtcttgtt

SEQ ID NO: 203417 - DNA, 20 bp, Artificial Sequence
  Description of Artificial Sequence: Synthetic oligonucleotide
  Target: ATXN1; (-) strand; PAM type: YTN; PAM sequence: CTG
atgagtagagtgcattcaat

SEQ ID NO: 203418 - DNA, 20 bp, Artificial Sequence
  Description of Artificial Sequence: Synthetic oligonucleotide
  Target: ATXN1; (-) strand; PAM type: YTN; PAM sequence: CTC
agagtgcctgatgagtagag

SEQ ID NO: 203419 - DNA, 20 bp, Artificial Sequence
  Description of Artificial Sequence: Synthetic oligonucleotide
  Target: ATXN1; (-) strand; PAM type: YTN; PAM sequence: TTC
tcagagtgcctgatgagtag

SEQ ID NO: 203420 - DNA, 20 bp, Artificial Sequence
  Description of Artificial Sequence: Synthetic oligonucleotide
  Target: ATXN1; (-) strand; PAM type: YTN; PAM sequence: TTC
attctcagagtgcctgatga

SEQ ID NO: 203421 - DNA, 20 bp, Artificial Sequence
  Description of Artificial Sequence: Synthetic oligonucleotide
  Target: ATXN1; (-) strand; PAM type: YTN; PAM sequence: CTT
cattctcagagtgcctgatg

SEQ ID NO: 203422 - DNA, 20 bp, Artificial Sequence
  Description of Artificial Sequence: Synthetic oligonucleotide
  Target: ATXN1; (-) strand; PAM type: YTN; PAM sequence: TTC
cacagacccatatataccag

SEQ ID NO: 203423 - DNA, 20 bp, Artificial Sequence
  Description of Artificial Sequence: Synthetic oligonucleotide
  Target: ATXN1; (-) strand; PAM type: YTN; PAM sequence: TTT
ccacagacccatatatacca

SEQ ID NO: 203424 - DNA, 20 bp, Artificial Sequence
  Description of Artificial Sequence: Synthetic oligonucleotide
  Target: ATXN1; (-) strand; PAM type: YTN; PAM sequence: CTT
tccacagacccatatatacc

SEQ ID NO: 203425 - DNA, 20 bp, Artificial Sequence
  Description of Artificial Sequence: Synthetic oligonucleotide
  Target: ATXN1; (-) strand; PAM type: YTN; PAM sequence: TTG
tctttccacagacccatata

SEQ ID NO: 203426 - DNA, 20 bp, Artificial Sequence
  Description of Artificial Sequence: Synthetic oligonucleotide
  Target: ATXN1; (-) strand; PAM type: YTN; PAM sequence: TTT
gtctttccacagacccatat

SEQ ID NO: 203427 - DNA, 20 bp, Artificial Sequence
  Description of Artificial Sequence: Synthetic oligonucleotide
  Target: ATXN1; (-) strand; PAM type: YTN; PAM sequence: CTT
tgtctttccacagacccata

SEQ ID NO: 203428 - DNA, 20 bp, Artificial Sequence
  Description of Artificial Sequence: Synthetic oligonucleotide
  Target: ATXN1; (-) strand; PAM type: YTN; PAM sequence: CTA
tgtaaaaatactttgtcttt

SEQ ID NO: 203429 - DNA, 20 bp, Artificial Sequence
  Description of Artificial Sequence: Synthetic oligonucleotide
  Target: ATXN1; (-) strand; PAM type: YTN; PAM sequence: TTC
tatgtaaaaatactttgtct

SEQ ID NO: 203430 - DNA, 20 bp, Artificial Sequence
  Description of Artificial Sequence: Synthetic oligonucleotide
  Target: ATXN1; (-) strand; PAM type: YTN; PAM sequence: TTG
taatggtagtcaatggttct

SEQ ID NO: 203431 - DNA, 20 bp, Artificial Sequence
  Description of Artificial Sequence: Synthetic oligonucleotide
  Target: ATXN1; (-) strand; PAM type: YTN; PAM sequence: TTC
aaaattgtaatggtagtcaa

SEQ ID NO: 203432 - DNA, 20 bp, Artificial Sequence
  Description of Artificial Sequence: Synthetic oligonucleotide
  Target: ATXN1; (-) strand; PAM type: YTN; PAM sequence: TTT
caaaattgtaatggtagtca

SEQ ID NO: 203433 - DNA, 20 bp, Artificial Sequence
  Description of Artificial Sequence: Synthetic oligonucleotide
  Target: ATXN1; (-) strand; PAM type: YTN; PAM sequence: TTA
tagggaacatatttcaaaat

SEQ ID NO: 203434 - DNA, 20 bp, Artificial Sequence
  Description of Artificial Sequence: Synthetic oligonucleotide
  Target: ATXN1; (-) strand; PAM type: YTN; PAM sequence: TTT
atagggaacatatttcaaaa

SEQ ID NO: 203435 - DNA, 20 bp, Artificial Sequence
  Description of Artificial Sequence: Synthetic oligonucleotide
  Target: ATXN1; (-) strand; PAM type: YTN; PAM sequence: TTT
tatagggaacatatttcaaa

SEQ ID NO: 203436 - DNA, 20 bp, Artificial Sequence
  Description of Artificial Sequence: Synthetic oligonucleotide
  Target: ATXN1; (-) strand; PAM type: YTN; PAM sequence: TTT
ttatagggaacatatttcaa

SEQ ID NO: 203437 - DNA, 20 bp, Artificial Sequence
  Description of Artificial Sequence: Synthetic oligonucleotide
  Target: ATXN1; (-) strand; PAM type: YTN; PAM sequence: TTT
tttatagggaacatatttca

SEQ ID NO: 203438 - DNA, 20 bp, Artificial Sequence
  Description of Artificial Sequence: Synthetic oligonucleotide
  Target: ATXN1; (-) strand; PAM type: YTN; PAM sequence: TTT
ttttatagggaacatatttc

SEQ ID NO: 203439 - DNA, 20 bp, Artificial Sequence
  Description of Artificial Sequence: Synthetic oligonucleotide
  Target: ATXN1; (-) strand; PAM type: YTN; PAM sequence: TTT
tttttatagggaacatattt

SEQ ID NO: 203440 - DNA, 20 bp, Artificial Sequence
  Description of Artificial Sequence: Synthetic oligonucleotide
  Target: ATXN1; (-) strand; PAM type: YTN; PAM sequence: TTC
agtattttttttatagggaa

SEQ ID NO: 203441 - DNA, 20 bp, Artificial Sequence
  Description of Artificial Sequence: Synthetic oligonucleotide
  Target: ATXN1; (-) strand; PAM type: YTN; PAM sequence: CTT
cagtattttttttataggga

SEQ ID NO: 203442 - DNA, 20 bp, Artificial Sequence
  Description of Artificial Sequence: Synthetic oligonucleotide
  Target: ATXN1; (-) strand; PAM type: YTN; PAM sequence: TTG
acttcagtattttttttata

SEQ ID NO: 203443 - DNA, 20 bp, Artificial Sequence
  Description of Artificial Sequence: Synthetic oligonucleotide
  Target: ATXN1; (-) strand; PAM type: YTN; PAM sequence: CTA
atgtattgacttcagtattt

SEQ ID NO: 203444 - DNA, 20 bp, Artificial Sequence
  Description of Artificial Sequence: Synthetic oligonucleotide
  Target: ATXN1; (-) strand; PAM type: YTN; PAM sequence: TTA
aactaatgtattgacttcag

SEQ ID NO: 203445 - DNA, 20 bp, Artificial Sequence
  Description of Artificial Sequence: Synthetic oligonucleotide
  Target: ATXN1; (-) strand; PAM type: YTN; PAM sequence: TTT
aaactaatgtattgacttca

SEQ ID NO: 203446 - DNA, 20 bp, Artificial Sequence
  Description of Artificial Sequence: Synthetic oligonucleotide
  Target: ATXN1; (-) strand; PAM type: YTN; PAM sequence: TTT
taaactaatgtattgacttc

SEQ ID NO: 203447 - DNA, 20 bp, Artificial Sequence
  Description of Artificial Sequence: Synthetic oligonucleotide
  Target: ATXN1; (-) strand; PAM type: YTN; PAM sequence: CTT
ttaaactaatgtattgactt

SEQ ID NO: 203448 - DNA, 20 bp, Artificial Sequence
  Description of Artificial Sequence: Synthetic oligonucleotide
  Target: ATXN1; (-) strand; PAM type: YTN; PAM sequence: TTA
tgtccttttaaactaatgta

SEQ ID NO: 203449 - DNA, 20 bp, Artificial Sequence
  Description of Artificial Sequence: Synthetic oligonucleotide
  Target: ATXN1; (-) strand; PAM type: YTN; PAM sequence: TTT
atgtccttttaaactaatgt

SEQ ID NO: 203450 - DNA, 20 bp, Artificial Sequence
  Description of Artificial Sequence: Synthetic oligonucleotide
  Target: ATXN1; (-) strand; PAM type: YTN; PAM sequence: TTT
tatgtccttttaaactaatg

SEQ ID NO: 203451 - DNA, 20 bp, Artificial Sequence
  Description of Artificial Sequence: Synthetic oligonucleotide
  Target: ATXN1; (-) strand; PAM type: YTN; PAM sequence: TTT
ttatgtccttttaaactaat

SEQ ID NO: 203452 - DNA, 20 bp, Artificial Sequence
  Description of Artificial Sequence: Synthetic oligonucleotide
  Target: ATXN1; (-) strand; PAM type: YTN; PAM sequence: CTT
tttatgtccttttaaactaa

SEQ ID NO: 203453 - DNA, 20 bp, Artificial Sequence
  Description of Artificial Sequence: Synthetic oligonucleotide
  Target: ATXN1; (-) strand; PAM type: YTN; PAM sequence: CTC
tttttatgtccttttaaact

SEQ ID NO: 203454 - DNA, 20 bp, Artificial Sequence
  Description of Artificial Sequence: Synthetic oligonucleotide
  Target: ATXN1; (-) strand; PAM type: YTN; PAM sequence: TTG
gcagaataaagactcttttt

SEQ ID NO: 203455 - DNA, 20 bp, Artificial Sequence
  Description of Artificial Sequence: Synthetic oligonucleotide
  Target: ATXN1; (-) strand; PAM type: YTN; PAM sequence: TTC
acattggcagaataaagact

SEQ ID NO: 203456 - DNA, 20 bp, Artificial Sequence
  Description of Artificial Sequence: Synthetic oligonucleotide
  Target: ATXN1; (-) strand; PAM type: YTN; PAM sequence: CTG
tggaagcacatatgttcaca

SEQ ID NO: 203457 - DNA, 20 bp, Artificial Sequence
  Description of Artificial Sequence: Synthetic oligonucleotide
  Target: ATXN1; (-) strand; PAM type: YTN; PAM sequence: TTG
ctgtggaagcacatatgttc

SEQ ID NO: 203458 - DNA, 20 bp, Artificial Sequence
  Description of Artificial Sequence: Synthetic oligonucleotide
  Target: ATXN1; (-) strand; PAM type: YTN; PAM sequence: CTT
gctgtggaagcacatatgtt

SEQ ID NO: 203459 - DNA, 20 bp, Artificial Sequence
  Description of Artificial Sequence: Synthetic oligonucleotide
  Target: ATXN1; (-) strand; PAM type: YTN; PAM sequence: TTA
tgggcttgctgtggaagcac

SEQ ID NO: 203460 - DNA, 20 bp, Artificial Sequence
  Description of Artificial Sequence: Synthetic oligonucleotide
  Target: ATXN1; (-) strand; PAM type: YTN; PAM sequence: TTT
atgggcttgctgtggaagca

SEQ ID NO: 203461 - DNA, 20 bp, Artificial Sequence
  Description of Artificial Sequence: Synthetic oligonucleotide
  Target: ATXN1; (-) strand; PAM type: YTN; PAM sequence: CTT
tatgggcttgctgtggaagc

SEQ ID NO: 203462 - DNA, 20 bp, Artificial Sequence
  Description of Artificial Sequence: Synthetic oligonucleotide
  Target: ATXN1; (-) strand; PAM type: YTN; PAM sequence: TTC
cctttatgggcttgctgtgg

SEQ ID NO: 203463 - DNA, 20 bp, Artificial Sequence
  Description of Artificial Sequence: Synthetic oligonucleotide
  Target: ATXN1; (-) strand; PAM type: YTN; PAM sequence: CTA
gattccctttatgggcttgc

SEQ ID NO: 203464 - DNA, 20 bp, Artificial Sequence
  Description of Artificial Sequence: Synthetic oligonucleotide
  Target: ATXN1; (-) strand; PAM type: YTN; PAM sequence: CTC
tagattccctttatgggctt

SEQ ID NO: 203465 - DNA, 20 bp, Artificial Sequence
  Description of Artificial Sequence: Synthetic oligonucleotide
  Target: ATXN1; (-) strand; PAM type: YTN; PAM sequence: CTC
catgaagtagcctctagatt

SEQ ID NO: 203466 - DNA, 20 bp, Artificial Sequence
  Description of Artificial Sequence: Synthetic oligonucleotide
  Target: ATXN1; (-) strand; PAM type: YTN; PAM sequence: TTG
gaaatggcagaatactccat

SEQ ID NO: 203467 - DNA, 20 bp, Artificial Sequence
  Description of Artificial Sequence: Synthetic oligonucleotide
  Target: ATXN1; (-) strand; PAM type: YTN; PAM sequence: TTG
tagagcggacattggaaatg

SEQ ID NO: 203468 - DNA, 20 bp, Artificial Sequence
  Description of Artificial Sequence: Synthetic oligonucleotide
  Target: ATXN1; (-) strand; PAM type: YTN; PAM sequence: TTT
gtagagcggacattggaaat

SEQ ID NO: 203469 - DNA, 20 bp, Artificial Sequence
  Description of Artificial Sequence: Synthetic oligonucleotide
  Target: ATXN1; (-) strand; PAM type: YTN; PAM sequence: TTT
tgtagagcggacattggaaa

SEQ ID NO: 203470 - DNA, 20 bp, Artificial Sequence
  Description of Artificial Sequence: Synthetic oligonucleotide
  Target: ATXN1; (-) strand; PAM type: YTN; PAM sequence: CTT
ttgtagagcggacattggaa

SEQ ID NO: 203471 - DNA, 20 bp, Artificial Sequence
  Description of Artificial Sequence: Synthetic oligonucleotide
  Target: ATXN1; (-) strand; PAM type: YTN; PAM sequence: CTA
gaaaaataaaataaaagaaa

SEQ ID NO: 203472 - DNA, 20 bp, Artificial Sequence
  Description of Artificial Sequence: Synthetic oligonucleotide
  Target: ATXN1; (-) strand; PAM type: YTN; PAM sequence: CTC
tagaaaaataaaataaaaga

SEQ ID NO: 203473 - DNA, 20 bp, Artificial Sequence
  Description of Artificial Sequence: Synthetic oligonucleotide
  Target: ATXN1; (-) strand; PAM type: YTN; PAM sequence: CTG
tctctagaaaaataaaataa

SEQ ID NO: 203474 - DNA, 20 bp, Artificial Sequence
  Description of Artificial Sequence: Synthetic oligonucleotide
  Target: ATXN1; (-) strand; PAM type: YTN; PAM sequence: CTG
ggtggcaaagtgagaccctg

SEQ ID NO: 203475 - DNA, 20 bp, Artificial Sequence
  Description of Artificial Sequence: Synthetic oligonucleotide
  Target: ATXN1; (-) strand; PAM type: YTN; PAM sequence: CTG
cacaccagtctgggtggcaa

SEQ ID NO: 203476 - DNA, 20 bp, Artificial Sequence
  Description of Artificial Sequence: Synthetic oligonucleotide
  Target: ATXN1; (-) strand; PAM type: YTN; PAM sequence: TTG
caccactgcacaccagtctg

SEQ ID NO: 203477 - DNA, 20 bp, Artificial Sequence
  Description of Artificial Sequence: Synthetic oligonucleotide
  Target: ATXN1; (-) strand; PAM type: YTN; PAM sequence: CTA
tgattgcaccactgcacacc

SEQ ID NO: 203478 - DNA, 20 bp, Artificial Sequence
  Description of Artificial Sequence: Synthetic oligonucleotide
  Target: ATXN1; (-) strand; PAM type: YTN; PAM sequence: TTA
cagtgagctatgattgcacc

SEQ ID NO: 203479 - DNA, 20 bp, Artificial Sequence
  Description of Artificial Sequence: Synthetic oligonucleotide
  Target: ATXN1; (-) strand; PAM type: YTN; PAM sequence: TTC
aaggttacagtgagctatga

SEQ ID NO: 203480 - DNA, 20 bp, Artificial Sequence
  Description of Artificial Sequence: Synthetic oligonucleotide
  Target: ATXN1; (-) strand; PAM type: YTN; PAM sequence: TTG
agcccaggagttcaaggtta

SEQ ID NO: 203481 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagttcaaggtt

SEQ ID NO: 203482 - DNA, 20 bp, Artificial Sequence
  Description of Artificial Sequence: Synthetic oligonucleotide
  Target: ATXN1; (-) strand; PAM type: YTN; PAM sequence: TTG
cttgagcccaggagttcaag

SEQ ID NO: 203483 - DNA, 20 bp, Artificial Sequence
  Description of Artificial Sequence: Synthetic oligonucleotide
  Target: ATXN1; (-) strand; PAM type: YTN; PAM sequence: CTG
aggtgggaggattgcttgag

SEQ ID NO: 203484 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggtgggagga

SEQ ID NO: 203485 - DNA, 20 bp, Artificial Sequence
  Description of Artificial Sequence: Synthetic oligonucleotide
  Target: ATXN1; (-) strand; PAM type: YTN; PAM sequence: CTG
ctcaggaggctgaggtggga

SEQ ID NO: 203486 - DNA, 20 bp, Artificial Sequence
  Description of Artificial Sequence: Synthetic oligonucleotide
  Target: ATXN1; (-) strand; PAM type: YTN; PAM sequence: CTA
gctgctcaggaggctgaggt

SEQ ID NO: 203487 - DNA, 20 bp, Artificial Sequence
  Description of Artificial Sequence: Synthetic oligonucleotide
  Target: ATXN1; (-) strand; PAM type: YTN; PAM sequence: CTG
tagtcctagctgctcaggag

SEQ ID NO: 203488 - DNA, 20 bp, Artificial Sequence
  Description of Artificial Sequence: Synthetic oligonucleotide
  Target: ATXN1; (-) strand; PAM type: YTN; PAM sequence: TTG
tgagtctgtagtcctagctg

SEQ ID NO: 203489 - DNA, 20 bp, Artificial Sequence
  Description of Artificial Sequence: Synthetic oligonucleotide
  Target: ATXN1; (-) strand; PAM type: YTN; PAM sequence: CTG
agtgtaatgttgtgagtctg

SEQ ID NO: 203490 - DNA, 20 bp, Artificial Sequence
  Description of Artificial Sequence: Synthetic oligonucleotide
  Target: ATXN1; (-) strand; PAM type: YTN; PAM sequence: TTA
gctgagtgtaatgttgtgag

SEQ ID NO: 203491 - DNA, 20 bp, Artificial Sequence
  Description of Artificial Sequence: Synthetic oligonucleotide
  Target: ATXN1; (-) strand; PAM type: YTN; PAM sequence: TTA
attagctgagtgtaatgttg

SEQ ID NO: 203492 - DNA, 20 bp, Artificial Sequence
  Description of Artificial Sequence: Synthetic oligonucleotide
  Target: ATXN1; (-) strand; PAM type: YTN; PAM sequence: TTT
aattagctgagtgtaatgtt

SEQ ID NO: 203493 - DNA, 20 bp, Artificial Sequence
  Description of Artificial Sequence: Synthetic oligonucleotide
  Target: ATXN1; (-) strand; PAM type: YTN; PAM sequence: TTT
taattagctgagtgtaatgt

SEQ ID NO: 203494 - DNA, 20 bp, Artificial Sequence
  Description of Artificial Sequence: Synthetic oligonucleotide
  Target: ATXN1; (-) strand; PAM type: YTN; PAM sequence: TTT
ttaattagctgagtgtaatg

SEQ ID NO: 203495 - DNA, 20 bp, Artificial Sequence
  Description of Artificial Sequence: Synthetic oligonucleotide
  Target: ATXN1; (-) strand; PAM type: YTN; PAM sequence: TTT
tttaattagctgagtgtaat

SEQ ID NO: 203496 - DNA, 20 bp, Artificial Sequence
  Description of Artificial Sequence: Synthetic oligonucleotide
  Target: ATXN1; (-) strand; PAM type: YTN; PAM sequence: TTT
ttttaattagctgagtgtaa

SEQ ID NO: 203497 - DNA, 20 bp, Artificial Sequence
  Description of Artificial Sequence: Synthetic oligonucleotide
  Target: ATXN1; (-) strand; PAM type: YTN; PAM sequence: TTT
tttttaattagctgagtgta

SEQ ID NO: 203498 - DNA, 20 bp, Artificial Sequence
  Description of Artificial Sequence: Synthetic oligonucleotide
  Target: ATXN1; (-) strand; PAM type: YTN; PAM sequence: TTT
ttttttaattagctgagtgt

SEQ ID NO: 203499 - DNA, 20 bp, Artificial Sequence
  Description of Artificial Sequence: Synthetic oligonucleotide
  Target: ATXN1; (-) strand; PAM type: YTN; PAM sequence: TTT
tttttttaattagctgagtg

SEQ ID NO: 203500 - DNA, 20 bp, Artificial Sequence
  Description of Artificial Sequence: Synthetic oligonucleotide
  Target: ATXN1; (-) strand; PAM type: YTN; PAM sequence: TTT
ttttttttaattagctgagt

SEQ ID NO: 203501 - DNA, 20 bp, Artificial Sequence
  Description of Artificial Sequence: Synthetic oligonucleotide
  Target: ATXN1; (-) strand; PAM type: YTN; PAM sequence: TTT
tttttttttaattagctgag

SEQ ID NO: 203502 - DNA, 20 bp, Artificial Sequence
  Description of Artificial Sequence: Synthetic oligonucleotide
  Target: ATXN1; (-) strand; PAM type: YTN; PAM sequence: TTA
agttttttttttttaattag

SEQ ID NO: 203503 - DNA, 20 bp, Artificial Sequence
  Description of Artificial Sequence: Synthetic oligonucleotide
  Target: ATXN1; (-) strand; PAM type: YTN; PAM sequence: TTT
aagttttttttttttaatta

SEQ ID NO: 203504 - DNA, 20 bp, Artificial Sequence
  Description of Artificial Sequence: Synthetic oligonucleotide
  Target: ATXN1; (-) strand; PAM type: YTN; PAM sequence: CTT
taagttttttttttttaatt

SEQ ID NO: 203505 - DNA, 20 bp, Artificial Sequence
  Description of Artificial Sequence: Synthetic oligonucleotide
  Target: ATXN1; (-) strand; PAM type: YTN; PAM sequence: CTC
tttaagttttttttttttaa

SEQ ID NO: 203506 - DNA, 20 bp, Artificial Sequence
  Description of Artificial Sequence: Synthetic oligonucleotide
  Target: ATXN1; (-) strand; PAM type: YTN; PAM sequence: TTG
tctctttaagtttttttttt

SEQ ID NO: 203507 - DNA, 20 bp, Artificial Sequence
  Description of Artificial Sequence: Synthetic oligonucleotide
  Target: ATXN1; (-) strand; PAM type: YTN; PAM sequence: TTT
gtctctttaagttttttttt

SEQ ID NO: 203508 - DNA, 20 bp, Artificial Sequence
  Description of Artificial Sequence: Synthetic oligonucleotide
  Target: ATXN1; (-) strand; PAM type: YTN; PAM sequence: CTT
tgtctctttaagtttttttt

SEQ ID NO: 203509 - DNA, 20 bp, Artificial Sequence
  Description of Artificial Sequence: Synthetic oligonucleotide
  Target: ATXN1; (-) strand; PAM type: YTN; PAM sequence: CTG
ggtgacagaacaagtctttg

SEQ ID NO: 203510 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagaacaa

SEQ ID NO: 203511 - DNA, 20 bp, Artificial Sequence
  Description of Artificial Sequence: Synthetic oligonucleotide
  Target: ATXN1; (-) strand; PAM type: YTN; PAM sequence: CTA
cactccagcctgggtgacag

SEQ ID NO: 203512 - DNA, 20 bp, Artificial Sequence
  Description of Artificial Sequence: Synthetic oligonucleotide
  Target: ATXN1; (-) strand; PAM type: YTN; PAM sequence: CTG
tgatcgcaccactacactcc

SEQ ID NO: 203513 - DNA, 20 bp, Artificial Sequence
  Description of Artificial Sequence: Synthetic oligonucleotide
  Target: ATXN1; (-) strand; PAM type: YTN; PAM sequence: CTG
cagtgagctgtgatcgcacc

SEQ ID NO: 203514 - DNA, 20 bp, Artificial Sequence
  Description of Artificial Sequence: Synthetic oligonucleotide
  Target: ATXN1; (-) strand; PAM type: YTN; PAM sequence: TTG
aggctgcagtgagctgtgat

SEQ ID NO: 203515 - DNA, 20 bp, Artificial Sequence
  Description of Artificial Sequence: Synthetic oligonucleotide
  Target: ATXN1; (-) strand; PAM type: YTN; PAM sequence: TTT
gaggctgcagtgagctgtga

SEQ ID NO: 203516 - DNA, 20 bp, Artificial Sequence
  Description of Artificial Sequence: Synthetic oligonucleotide
  Target: ATXN1; (-) strand; PAM type: YTN; PAM sequence: CTA
ggagtttgaggctgcagtga

SEQ ID NO: 203517 - DNA, 20 bp, Artificial Sequence
  Description of Artificial Sequence: Synthetic oligonucleotide
  Target: ATXN1; (-) strand; PAM type: YTN; PAM sequence: TTG
agtctaggagtttgaggctg

SEQ ID NO: 203518 - DNA, 20 bp, Artificial Sequence
  Description of Artificial Sequence: Synthetic oligonucleotide
  Target: ATXN1; (-) strand; PAM type: YTN; PAM sequence: CTT
gagtctaggagtttgaggct

SEQ ID NO: 203519 - DNA, 20 bp, Artificial Sequence
  Description of Artificial Sequence: Synthetic oligonucleotide
  Target: ATXN1; (-) strand; PAM type: YTN; PAM sequence: TTA
tgtaggaggatcacttgagt

SEQ ID NO: 203520 - DNA, 20 bp, Artificial Sequence
  Description of Artificial Sequence: Synthetic oligonucleotide
  Target: ATXN1; (-) strand; PAM type: YTN; PAM sequence: CTT
atgtaggaggatcacttgag

SEQ ID NO: 203521 - DNA, 20 bp, Artificial Sequence
  Description of Artificial Sequence: Synthetic oligonucleotide
  Target: ATXN1; (-) strand; PAM type: YTN; PAM sequence: TTG
ggaggcttatgtaggaggat

SEQ ID NO: 203522 - DNA, 20 bp, Artificial Sequence
  Description of Artificial Sequence: Synthetic oligonucleotide
  Target: ATXN1; (-) strand; PAM type: YTN; PAM sequence: CTT
gggaggcttatgtaggagga

SEQ ID NO: 203523 - DNA, 20 bp, Artificial Sequence
  Description of Artificial Sequence: Synthetic oligonucleotide
  Target: ATXN1; (-) strand; PAM type: YTN; PAM sequence: CTA
cttgggaggcttatgtagga

SEQ ID NO: 203524 - DNA, 20 bp, Artificial Sequence
  Description of Artificial Sequence: Synthetic oligonucleotide
  Target: ATXN1; (-) strand; PAM type: YTN; PAM sequence: CTA
gctacttgggaggcttatgt

SEQ ID NO: 203525 - DNA, 20 bp, Artificial Sequence
  Description of Artificial Sequence: Synthetic oligonucleotide
  Target: ATXN1; (-) strand; PAM type: YTN; PAM sequence: CTG
tagtcctagctacttgggag

SEQ ID NO: 203526 - DNA, 20 bp, Artificial Sequence
  Description of Artificial Sequence: Synthetic oligonucleotide
  Target: ATXN1; (-) strand; PAM type: YTN; PAM sequence: CTG
agcatggtggcatgagcctg

SEQ ID NO: 203527 - DNA, 20 bp, Artificial Sequence
  Description of Artificial Sequence: Synthetic oligonucleotide
  Target: ATXN1; (-) strand; PAM type: YTN; PAM sequence: TTA
gctgagcatggtggcatgag

SEQ ID NO: 203528 - DNA, 20 bp, Artificial Sequence
  Description of Artificial Sequence: Synthetic oligonucleotide
  Target: ATXN1; (-) strand; PAM type: YTN; PAM sequence: CTT
agctgagcatggtggcatga

SEQ ID NO: 203529 - DNA, 20 bp, Artificial Sequence
  Description of Artificial Sequence: Synthetic oligonucleotide
  Target: ATXN1; (-) strand; PAM type: YTN; PAM sequence: TTA
aaacttagctgagcatggtg

SEQ ID NO: 203530 - DNA, 20 bp, Artificial Sequence
  Description of Artificial Sequence: Synthetic oligonucleotide
  Target: ATXN1; (-) strand; PAM type: YTN; PAM sequence: TTT
aaaacttagctgagcatggt

SEQ ID NO: 203531 - DNA, 20 bp, Artificial Sequence
  Description of Artificial Sequence: Synthetic oligonucleotide
  Target: ATXN1; (-) strand; PAM type: YTN; PAM sequence: CTA
caaaaaaaatttaaaactta

SEQ ID NO: 203532 - DNA, 20 bp, Artificial Sequence
  Description of Artificial Sequence: Synthetic oligonucleotide
  Target: ATXN1; (-) strand; PAM type: YTN; PAM sequence: CTC
tacaaaaaaaatttaaaact

SEQ ID NO: 203533 - DNA, 20 bp, Artificial Sequence
  Description of Artificial Sequence: Synthetic oligonucleotide
  Target: ATXN1; (-) strand; PAM type: YTN; PAM sequence: CTA
tctctacaaaaaaaatttaa

SEQ ID NO: 203534 - DNA, 20 bp, Artificial Sequence
  Description of Artificial Sequence: Synthetic oligonucleotide
  Target: ATXN1; (-) strand; PAM type: YTN; PAM sequence: CTG
gacagcgtagtgagacccta

SEQ ID NO: 203535 - DNA, 20 bp, Artificial Sequence
  Description of Artificial Sequence: Synthetic oligonucleotide
  Target: ATXN1; (-) strand; PAM type: YTN; PAM sequence: TTG
agaccagcctggacagcgta

SEQ ID NO: 203536 - DNA, 20 bp, Artificial Sequence
  Description of Artificial Sequence: Synthetic oligonucleotide
  Target: ATXN1; (-) strand; PAM type: YTN; PAM sequence: TTT
gagaccagcctggacagcgt

SEQ ID NO: 203537 - DNA, 20 bp, Artificial Sequence
  Description of Artificial Sequence: Synthetic oligonucleotide
  Target: ATXN1; (-) strand; PAM type: YTN; PAM sequence: TTG
aagccacgagtttgagacca

SEQ ID NO: 203538 - DNA, 20 bp, Artificial Sequence
  Description of Artificial Sequence: Synthetic oligonucleotide
  Target: ATXN1; (-) strand; PAM type: YTN; PAM sequence: CTT
gaagccacgagtttgagacc

SEQ ID NO: 203539 - DNA, 20 bp, Artificial Sequence
  Description of Artificial Sequence: Synthetic oligonucleotide
  Target: ATXN1; (-) strand; PAM type: YTN; PAM sequence: CTG
aggtggaaggatcacttgaa

SEQ ID NO: 203540 - DNA, 20 bp, Artificial Sequence
  Description of Artificial Sequence: Synthetic oligonucleotide
  Target: ATXN1; (-) strand; PAM type: YTN; PAM sequence: TTG
gggggctgaggtggaaggat

SEQ ID NO: 203541 - DNA, 20 bp, Artificial Sequence
  Description of Artificial Sequence: Synthetic oligonucleotide
  Target: ATXN1; (-) strand; PAM type: YTN; PAM sequence: TTT
ggggggctgaggtggaagga

SEQ ID NO: 203542 - DNA, 20 bp, Artificial Sequence
  Description of Artificial Sequence: Synthetic oligonucleotide
  Target: ATXN1; (-) strand; PAM type: YTN; PAM sequence: CTT
tggggggctgaggtggaagg

SEQ ID NO: 203543 - DNA, 20 bp, Artificial Sequence
  Description of Artificial Sequence: Synthetic oligonucleotide
  Target: ATXN1; (-) strand; PAM type: YTN; PAM sequence: CTG
caatcccagcactttggggg

SEQ ID NO: 203544 - DNA, 20 bp, Artificial Sequence
  Description of Artificial Sequence: Synthetic oligonucleotide
  Target: ATXN1; (-) strand; PAM type: YTN; PAM sequence: CTC
acccctgcaatcccagcact

SEQ ID NO: 203545 - DNA, 20 bp, Artificial Sequence
  Description of Artificial Sequence: Synthetic oligonucleotide
  Target: ATXN1; (-) strand; PAM type: YTN; PAM sequence: CTG
aacgtgatggctcacccctg

SEQ ID NO: 203546 - DNA, 20 bp, Artificial Sequence
  Description of Artificial Sequence: Synthetic oligonucleotide
  Target: ATXN1; (-) strand; PAM type: YTN; PAM sequence: TTA
gaaagaggctgaacgtgatg

SEQ ID NO: 203547 - DNA, 20 bp, Artificial Sequence
  Description of Artificial Sequence: Synthetic oligonucleotide
  Target: ATXN1; (-) strand; PAM type: YTN; PAM sequence: TTT
agaaagaggctgaacgtgat

SEQ ID NO: 203548 - DNA, 20 bp, Artificial Sequence
  Description of Artificial Sequence: Synthetic oligonucleotide
  Target: ATXN1; (-) strand; PAM type: YTN; PAM sequence: TTG
tagaatttagaaagaggctg

SEQ ID NO: 203549 - DNA, 20 bp, Artificial Sequence
  Description of Artificial Sequence: Synthetic oligonucleotide
  Target: ATXN1; (-) strand; PAM type: YTN; PAM sequence: TTT
gtagaatttagaaagaggct

SEQ ID NO: 203550 - DNA, 20 bp, Artificial Sequence
  Description of Artificial Sequence: Synthetic oligonucleotide
  Target: ATXN1; (-) strand; PAM type: YTN; PAM sequence: TTT
tgtagaatttagaaagaggc

SEQ ID NO: 203551 - DNA, 20 bp, Artificial Sequence
  Description of Artificial Sequence: Synthetic oligonucleotide
  Target: ATXN1; (-) strand; PAM type: YTN; PAM sequence: TTT
ttgtagaatttagaaagagg

SEQ ID NO: 203552 - DNA, 20 bp, Artificial Sequence
  Description of Artificial Sequence: Synthetic oligonucleotide
  Target: ATXN1; (-) strand; PAM type: YTN; PAM sequence: TTT
tttgtagaatttagaaagag

SEQ ID NO: 203553 - DNA, 20 bp, Artificial Sequence
  Description of Artificial Sequence: Synthetic oligonucleotide
  Target: ATXN1; (-) strand; PAM type: YTN; PAM sequence: TTT
ttttgtagaatttagaaaga

SEQ ID NO: 203554 - DNA, 20 bp, Artificial Sequence
  Description of Artificial Sequence: Synthetic oligonucleotide
  Target: ATXN1; (-) strand; PAM type: YTN; PAM sequence: TTG
cacgatataatatgaatgca

SEQ ID NO: 203555 - DNA, 20 bp, Artificial Sequence
  Description of Artificial Sequence: Synthetic oligonucleotide
  Target: ATXN1; (-) strand; PAM type: YTN; PAM sequence: TTA
catagcattgcacgatataa

SEQ ID NO: 203556 - DNA, 20 bp, Artificial Sequence
  Description of Artificial Sequence: Synthetic oligonucleotide
  Target: ATXN1; (-) strand; PAM type: YTN; PAM sequence: CTT
acatagcattgcacgatata

SEQ ID NO: 203557 - DNA, 20 bp, Artificial Sequence
  Description of Artificial Sequence: Synthetic oligonucleotide
  Target: ATXN1; (-) strand; PAM type: YTN; PAM sequence: CTA
aaacatgacttacatagcat

SEQ ID NO: 203558 - DNA, 20 bp, Artificial Sequence
  Description of Artificial Sequence: Synthetic oligonucleotide
  Target: ATXN1; (-) strand; PAM type: YTN; PAM sequence: CTC
cccatggaataggaaccggc

SEQ ID NO: 203559 - DNA, 20 bp, Artificial Sequence
  Description of Artificial Sequence: Synthetic oligonucleotide
  Target: ATXN1; (-) strand; PAM type: YTN; PAM sequence: CTG
agaactccccatggaatagg

SEQ ID NO: 203560 - DNA, 20 bp, Artificial Sequence
  Description of Artificial Sequence: Synthetic oligonucleotide
  Target: ATXN1; (-) strand; PAM type: YTN; PAM sequence: TTA
tgatgctgagaactccccat

SEQ ID NO: 203561 - DNA, 20 bp, Artificial Sequence
  Description of Artificial Sequence: Synthetic oligonucleotide
  Target: ATXN1; (-) strand; PAM type: YTN; PAM sequence: TTT
atgatgctgagaactcccca

SEQ ID NO: 203562 - DNA, 20 bp, Artificial Sequence
  Description of Artificial Sequence: Synthetic oligonucleotide
  Target: ATXN1; (-) strand; PAM type: YTN; PAM sequence: CTT
tatgatgctgagaactcccc

SEQ ID NO: 203563 - DNA, 20 bp, Artificial Sequence
  Description of Artificial Sequence: Synthetic oligonucleotide
  Target: ATXN1; (-) strand; PAM type: YTN; PAM sequence: TTC
aaatacctttatgatgctga

SEQ ID NO: 203564 - DNA, 20 bp, Artificial Sequence
  Description of Artificial Sequence: Synthetic oligonucleotide
  Target: ATXN1; (-) strand; PAM type: YTN; PAM sequence: CTT
caaatacctttatgatgctg

SEQ ID NO: 203565 - DNA, 20 bp, Artificial Sequence
  Description of Artificial Sequence: Synthetic oligonucleotide
  Target: ATXN1; (-) strand; PAM type: YTN; PAM sequence: TTA
aacttcaaatacctttatga

SEQ ID NO: 203566 - DNA, 20 bp, Artificial Sequence
  Description of Artificial Sequence: Synthetic oligonucleotide
  Target: ATXN1; (-) strand; PAM type: YTN; PAM sequence: CTT
aaacttcaaatacctttatg

SEQ ID NO: 203567 - DNA, 20 bp, Artificial Sequence
  Description of Artificial Sequence: Synthetic oligonucleotide
  Target: ATXN1; (-) strand; PAM type: YTN; PAM sequence: TTA
caacatgtagacttaaactt

SEQ ID NO: 203568 - DNA, 20 bp, Artificial Sequence
  Description of Artificial Sequence: Synthetic oligonucleotide
  Target: ATXN1; (-) strand; PAM type: YTN; PAM sequence: TTT
acaacatgtagacttaaact

SEQ ID NO: 203569 - DNA, 20 bp, Artificial Sequence
  Description of Artificial Sequence: Synthetic oligonucleotide
  Target: ATXN1; (-) strand; PAM type: YTN; PAM sequence: CTT
tacaacatgtagacttaaac

SEQ ID NO: 203570 - DNA, 20 bp, Artificial Sequence
  Description of Artificial Sequence: Synthetic oligonucleotide
  Target: ATXN1; (-) strand; PAM type: YTN; PAM sequence: TTG
agcatcacctttacaacatg

SEQ ID NO: 203571 - DNA, 20 bp, Artificial Sequence
  Description of Artificial Sequence: Synthetic oligonucleotide
  Target: ATXN1; (-) strand; PAM type: YTN; PAM sequence: TTG
agcattgagcatcaccttta

SEQ ID NO: 203572 - DNA, 20 bp, Artificial Sequence
  Description of Artificial Sequence: Synthetic oligonucleotide
  Target: ATXN1; (-) strand; PAM type: YTN; PAM sequence: CTG
agaattgagcattgagcatc

SEQ ID NO: 203573 - DNA, 20 bp, Artificial Sequence
  Description of Artificial Sequence: Synthetic oligonucleotide
  Target: ATXN1; (-) strand; PAM type: YTN; PAM sequence: CTA
gtctgagaattgagcattga

SEQ ID NO: 203574 - DNA, 20 bp, Artificial Sequence
  Description of Artificial Sequence: Synthetic oligonucleotide
  Target: ATXN1; (-) strand; PAM type: YTN; PAM sequence: TTC
tagtctgagaattgagcatt

SEQ ID NO: 203575 - DNA, 20 bp, Artificial Sequence
  Description of Artificial Sequence: Synthetic oligonucleotide
  Target: ATXN1; (-) strand; PAM type: YTN; PAM sequence: CTG
gttctagtctgagaattgag

SEQ ID NO: 203576 - DNA, 20 bp, Artificial Sequence
  Description of Artificial Sequence: Synthetic oligonucleotide
  Target: ATXN1; (-) strand; PAM type: YTN; PAM sequence: TTC
tggttctagtctgagaattg

SEQ ID NO: 203577 - DNA, 20 bp, Artificial Sequence
  Description of Artificial Sequence: Synthetic oligonucleotide
  Target: ATXN1; (-) strand; PAM type: YTN; PAM sequence: TTG
tggaagttctggttctagtc

SEQ ID NO: 203578 - DNA, 20 bp, Artificial Sequence
  Description of Artificial Sequence: Synthetic oligonucleotide
  Target: ATXN1; (-) strand; PAM type: YTN; PAM sequence: TTA
aaaatatgaaattgtggaag

SEQ ID NO: 203579 - DNA, 20 bp, Artificial Sequence
  Description of Artificial Sequence: Synthetic oligonucleotide
  Target: ATXN1; (-) strand; PAM type: YTN; PAM sequence: CTT
aaaaatatgaaattgtggaa

SEQ ID NO: 203580 - DNA, 20 bp, Artificial Sequence
  Description of Artificial Sequence: Synthetic oligonucleotide
  Target: ATXN1; (-) strand; PAM type: YTN; PAM sequence: TTC
ttaaaaatatgaaattgtgg

SEQ ID NO: 203581 - DNA, 20 bp, Artificial Sequence
  Description of Artificial Sequence: Synthetic oligonucleotide
  Target: ATXN1; (-) strand; PAM type: YTN; PAM sequence: TTG
atattcttaaaaatatgaaa

SEQ ID NO: 203582 - DNA, 20 bp, Artificial Sequence
  Description of Artificial Sequence: Synthetic oligonucleotide
  Target: ATXN1; (-) strand; PAM type: YTN; PAM sequence: CTT
gatattcttaaaaatatgaa

SEQ ID NO: 203583 - DNA, 20 bp, Artificial Sequence
  Description of Artificial Sequence: Synthetic oligonucleotide
  Target: ATXN1; (-) strand; PAM type: YTN; PAM sequence: TTG
cttgatattcttaaaaatat

SEQ ID NO: 203584 - DNA, 20 bp, Artificial Sequence
  Description of Artificial Sequence: Synthetic oligonucleotide
  Target: ATXN1; (-) strand; PAM type: YTN; PAM sequence: TTG
taagtggaagttgcttgata

SEQ ID NO: 203585 - DNA, 20 bp, Artificial Sequence
  Description of Artificial Sequence: Synthetic oligonucleotide
  Target: ATXN1; (-) strand; PAM type: YTN; PAM sequence: TTA
attgtaagtggaagttgctt

SEQ ID NO: 203586 - DNA, 20 bp, Artificial Sequence
  Description of Artificial Sequence: Synthetic oligonucleotide
  Target: ATXN1; (-) strand; PAM type: YTN; PAM sequence: TTA
tagttaattgtaagtggaag

SEQ ID NO: 203587 - DNA, 20 bp, Artificial Sequence
  Description of Artificial Sequence: Synthetic oligonucleotide
  Target: ATXN1; (-) strand; PAM type: YTN; PAM sequence: TTT
atagttaattgtaagtggaa

SEQ ID NO: 203588 - DNA, 20 bp, Artificial Sequence
  Description of Artificial Sequence: Synthetic oligonucleotide
  Target: ATXN1; (-) strand; PAM type: YTN; PAM sequence: TTT
tatagttaattgtaagtgga

SEQ ID NO: 203589 - DNA, 20 bp, Artificial Sequence
  Description of Artificial Sequence: Synthetic oligonucleotide
  Target: ATXN1; (-) strand; PAM type: YTN; PAM sequence: TTT
ttatagttaattgtaagtgg

SEQ ID NO: 203590 - DNA, 20 bp, Artificial Sequence
  Description of Artificial Sequence: Synthetic oligonucleotide
  Target: ATXN1; (-) strand; PAM type: YTN; PAM sequence: CTT
tttatagttaattgtaagtg

SEQ ID NO: 203591 - DNA, 20 bp, Artificial Sequence
  Description of Artificial Sequence: Synthetic oligonucleotide
  Target: ATXN1; (-) strand; PAM type: YTN; PAM sequence: TTA
accctttttatagttaattg

SEQ ID NO: 203592 - DNA, 20 bp, Artificial Sequence
  Description of Artificial Sequence: Synthetic oligonucleotide
  Target: ATXN1; (-) strand; PAM type: YTN; PAM sequence: CTG
aggagaaaattaaccctttt

SEQ ID NO: 203593 - DNA, 20 bp, Artificial Sequence
  Description of Artificial Sequence: Synthetic oligonucleotide
  Target: ATXN1; (-) strand; PAM type: YTN; PAM sequence: TTG
acaataggcaactgaggaga

SEQ ID NO: 203594 - DNA, 20 bp, Artificial Sequence
  Description of Artificial Sequence: Synthetic oligonucleotide
  Target: ATXN1; (-) strand; PAM type: YTN; PAM sequence: TTA
ttgacaataggcaactgagg

SEQ ID NO: 203595 - DNA, 20 bp, Artificial Sequence
  Description of Artificial Sequence: Synthetic oligonucleotide
  Target: ATXN1; (-) strand; PAM type: YTN; PAM sequence: TTT
attgacaataggcaactgag

SEQ ID NO: 203596 - DNA, 20 bp, Artificial Sequence
  Description of Artificial Sequence: Synthetic oligonucleotide
  Target: ATXN1; (-) strand; PAM type: YTN; PAM sequence: TTT
tattgacaataggcaactga

SEQ ID NO: 203597 - DNA, 20 bp, Artificial Sequence
  Description of Artificial Sequence: Synthetic oligonucleotide
  Target: ATXN1; (-) strand; PAM type: YTN; PAM sequence: TTA
ggccaagtaaacattttatt

SEQ ID NO: 203598 - DNA, 20 bp, Artificial Sequence
  Description of Artificial Sequence: Synthetic oligonucleotide
  Target: ATXN1; (-) strand; PAM type: YTN; PAM sequence: TTG
gtatcagtcggtcattaggc

SEQ ID NO: 203599 - DNA, 20 bp, Artificial Sequence
  Description of Artificial Sequence: Synthetic oligonucleotide
  Target: ATXN1; (-) strand; PAM type: YTN; PAM sequence: TTT
ggtatcagtcggtcattagg

SEQ ID NO: 203600 - DNA, 20 bp, Artificial Sequence
  Description of Artificial Sequence: Synthetic oligonucleotide
  Target: ATXN1; (-) strand; PAM type: YTN; PAM sequence: TTT
tggtatcagtcggtcattag

SEQ ID NO: 203601 - DNA, 20 bp, Artificial Sequence
  Description of Artificial Sequence: Synthetic oligonucleotide
  Target: ATXN1; (-) strand; PAM type: YTN; PAM sequence: TTT
ttggtatcagtcggtcatta

SEQ ID NO: 203602 - DNA, 20 bp, Artificial Sequence
  Description of Artificial Sequence: Synthetic oligonucleotide
  Target: ATXN1; (-) strand; PAM type: YTN; PAM sequence: TTT
tttggtatcagtcggtcatt

SEQ ID NO: 203603 - DNA, 20 bp, Artificial Sequence
  Description of Artificial Sequence: Synthetic oligonucleotide
  Target: ATXN1; (-) strand; PAM type: YTN; PAM sequence: CTT
ttttggtatcagtcggtcat

SEQ ID NO: 203604 - DNA, 20 bp, Artificial Sequence
  Description of Artificial Sequence: Synthetic oligonucleotide
  Target: ATXN1; (-) strand; PAM type: YTN; PAM sequence: TTA
taccttttttggtatcagtc

SEQ ID NO: 203605 - DNA, 20 bp, Artificial Sequence
  Description of Artificial Sequence: Synthetic oligonucleotide
  Target: ATXN1; (-) strand; PAM type: YTN; PAM sequence: CTT
ataccttttttggtatcagt

SEQ ID NO: 203606 - DNA, 20 bp, Artificial Sequence
  Description of Artificial Sequence: Synthetic oligonucleotide
  Target: ATXN1; (-) strand; PAM type: YTN; PAM sequence: TTG
agtccttataccttttttgg

SEQ ID NO: 203607 - DNA, 20 bp, Artificial Sequence
  Description of Artificial Sequence: Synthetic oligonucleotide
  Target: ATXN1; (-) strand; PAM type: YTN; PAM sequence: TTA
acagttgagtccttatacct

SEQ ID NO: 203608 - DNA, 20 bp, Artificial Sequence
  Description of Artificial Sequence: Synthetic oligonucleotide
  Target: ATXN1; (-) strand; PAM type: YTN; PAM sequence: CTT
aacagttgagtccttatacc

SEQ ID NO: 203609 - DNA, 20 bp, Artificial Sequence
  Description of Artificial Sequence: Synthetic oligonucleotide
  Target: ATXN1; (-) strand; PAM type: YTN; PAM sequence: TTC
ttaacagttgagtccttata

SEQ ID NO: 203610 - DNA, 20 bp, Artificial Sequence
  Description of Artificial Sequence: Synthetic oligonucleotide
  Target: ATXN1; (-) strand; PAM type: YTN; PAM sequence: TTT
cttaacagttgagtccttat

SEQ ID NO: 203611 - DNA, 20 bp, Artificial Sequence
  Description of Artificial Sequence: Synthetic oligonucleotide
  Target: ATXN1; (-) strand; PAM type: YTN; PAM sequence: TTG
tttcttaacagttgagtcct

SEQ ID NO: 203612 - DNA, 20 bp, Artificial Sequence
  Description of Artificial Sequence: Synthetic oligonucleotide
  Target: ATXN1; (-) strand; PAM type: YTN; PAM sequence: TTA
tacatcattgtttcttaaca

SEQ ID NO: 203613 - DNA, 20 bp, Artificial Sequence
  Description of Artificial Sequence: Synthetic oligonucleotide
  Target: ATXN1; (-) strand; PAM type: YTN; PAM sequence: CTC
agtcaacattatacatcatt

SEQ ID NO: 203614 - DNA, 20 bp, Artificial Sequence
  Description of Artificial Sequence: Synthetic oligonucleotide
  Target: ATXN1; (-) strand; PAM type: YTN; PAM sequence: TTC
tcagtcaacattatacatca

SEQ ID NO: 203615 - DNA, 20 bp, Artificial Sequence
  Description of Artificial Sequence: Synthetic oligonucleotide
  Target: ATXN1; (-) strand; PAM type: YTN; PAM sequence: TTT
ctcagtcaacattatacatc

SEQ ID NO: 203616 - DNA, 20 bp, Artificial Sequence
  Description of Artificial Sequence: Synthetic oligonucleotide
  Target: ATXN1; (-) strand; PAM type: YTN; PAM sequence: CTT
tctcagtcaacattatacat

SEQ ID NO: 203617 - DNA, 20 bp, Artificial Sequence
  Description of Artificial Sequence: Synthetic oligonucleotide
  Target: ATXN1; (-) strand; PAM type: YTN; PAM sequence: CTC
cgtccctttctcagtcaaca

SEQ ID NO: 203618 - DNA, 20 bp, Artificial Sequence
  Description of Artificial Sequence: Synthetic oligonucleotide
  Target: ATXN1; (-) strand; PAM type: YTN; PAM sequence: TTC
gaagatctccgtccctttct

SEQ ID NO: 203619 - DNA, 20 bp, Artificial Sequence
  Description of Artificial Sequence: Synthetic oligonucleotide
  Target: ATXN1; (-) strand; PAM type: YTN; PAM sequence: CTT
cgaagatctccgtccctttc

SEQ ID NO: 203620 - DNA, 20 bp, Artificial Sequence
  Description of Artificial Sequence: Synthetic oligonucleotide
  Target: ATXN1; (-) strand; PAM type: YTN; PAM sequence: TTG
aaggtcttcgaagatctccg

SEQ ID NO: 203621 - DNA, 20 bp, Artificial Sequence
  Description of Artificial Sequence: Synthetic oligonucleotide
  Target: ATXN1; (-) strand; PAM type: YTN; PAM sequence: TTT
gaaggtcttcgaagatctcc

SEQ ID NO: 203622 - DNA, 20 bp, Artificial Sequence
  Description of Artificial Sequence: Synthetic oligonucleotide
  Target: ATXN1; (-) strand; PAM type: YTN; PAM sequence: TTT
tgaaggtcttcgaagatctc

SEQ ID NO: 203623 - DNA, 20 bp, Artificial Sequence
  Description of Artificial Sequence: Synthetic oligonucleotide
  Target: ATXN1; (-) strand; PAM type: YTN; PAM sequence: TTA
tgttttgaaggtcttcgaag

SEQ ID NO: 203624 - DNA, 20 bp, Artificial Sequence
  Description of Artificial Sequence: Synthetic oligonucleotide
  Target: ATXN1; (-) strand; PAM type: YTN; PAM sequence: TTT
atgttttgaaggtcttcgaa

SEQ ID NO: 203625 - DNA, 20 bp, Artificial Sequence
  Description of Artificial Sequence: Synthetic oligonucleotide
  Target: ATXN1; (-) strand; PAM type: YTN; PAM sequence: TTA
tgggtggcagtaatcagatt

SEQ ID NO: 203626 - DNA, 20 bp, Artificial Sequence
  Description of Artificial Sequence: Synthetic oligonucleotide
  Target: ATXN1; (-) strand; PAM type: YTN; PAM sequence: TTG
attatgggtggcagtaatca

SEQ ID NO: 203627 - DNA, 20 bp, Artificial Sequence
  Description of Artificial Sequence: Synthetic oligonucleotide
  Target: ATXN1; (-) strand; PAM type: YTN; PAM sequence: TTT
gattatgggtggcagtaatc

SEQ ID NO: 203628 - DNA, 20 bp, Artificial Sequence
  Description of Artificial Sequence: Synthetic oligonucleotide
  Target: ATXN1; (-) strand; PAM type: YTN; PAM sequence: TTA
gacatacacatttgattatg

SEQ ID NO: 203629 - DNA, 20 bp, Artificial Sequence
  Description of Artificial Sequence: Synthetic oligonucleotide
  Target: ATXN1; (-) strand; PAM type: YTN; PAM sequence: CTT
agacatacacatttgattat

SEQ ID NO: 203630 - DNA, 20 bp, Artificial Sequence
  Description of Artificial Sequence: Synthetic oligonucleotide
  Target: ATXN1; (-) strand; PAM type: YTN; PAM sequence: CTG
tggaagacttagacatacac

SEQ ID NO: 203631 - DNA, 20 bp, Artificial Sequence
  Description of Artificial Sequence: Synthetic oligonucleotide
  Target: ATXN1; (-) strand; PAM type: YTN; PAM sequence: TTC
acctgtggaagacttagaca

SEQ ID NO: 203632 - DNA, 20 bp, Artificial Sequence
  Description of Artificial Sequence: Synthetic oligonucleotide
  Target: ATXN1; (-) strand; PAM type: YTN; PAM sequence: TTC
aggggcagaaccgtaggtgt

SEQ ID NO: 203633 - DNA, 20 bp, Artificial Sequence
  Description of Artificial Sequence: Synthetic oligonucleotide
  Target: ATXN1; (-) strand; PAM type: YTN; PAM sequence: TTG
cggttcaggggcagaaccgt

SEQ ID NO: 203634 - DNA, 20 bp, Artificial Sequence
  Description of Artificial Sequence: Synthetic oligonucleotide
  Target: ATXN1; (-) strand; PAM type: YTN; PAM sequence: CTT
gcggttcaggggcagaaccg

SEQ ID NO: 203635 - DNA, 20 bp, Artificial Sequence
  Description of Artificial Sequence: Synthetic oligonucleotide
  Target: ATXN1; (-) strand; PAM type: YTN; PAM sequence: TTG
gggaggtatggccttgcggt

SEQ ID NO: 203636 - DNA, 20 bp, Artificial Sequence
  Description of Artificial Sequence: Synthetic oligonucleotide
  Target: ATXN1; (-) strand; PAM type: YTN; PAM sequence: CTT
ggggaggtatggccttgcgg

SEQ ID NO: 203637 - DNA, 20 bp, Artificial Sequence
  Description of Artificial Sequence: Synthetic oligonucleotide
  Target: ATXN1; (-) strand; PAM type: YTN; PAM sequence: CTC
acagagtcagtcttggggag

SEQ ID NO: 203638 - DNA, 20 bp, Artificial Sequence
  Description of Artificial Sequence: Synthetic oligonucleotide
  Target: ATXN1; (-) strand; PAM type: YTN; PAM sequence: TTA
gccctcacagagtcagtctt

SEQ ID NO: 203639 - DNA, 20 bp, Artificial Sequence
  Description of Artificial Sequence: Synthetic oligonucleotide
  Target: ATXN1; (-) strand; PAM type: YTN; PAM sequence: CTG
ttagccctcacagagtcagt

SEQ ID NO: 203640 - DNA, 20 bp, Artificial Sequence
  Description of Artificial Sequence: Synthetic oligonucleotide
  Target: ATXN1; (-) strand; PAM type: YTN; PAM sequence: TTA
tagcctgttagccctcacag

SEQ ID NO: 203641 - DNA, 20 bp, Artificial Sequence
  Description of Artificial Sequence: Synthetic oligonucleotide
  Target: ATXN1; (-) strand; PAM type: YTN; PAM sequence: CTG
tcagcaattatagcctgtta

SEQ ID NO: 203642 - DNA, 20 bp, Artificial Sequence
  Description of Artificial Sequence: Synthetic oligonucleotide
  Target: ATXN1; (-) strand; PAM type: YTN; PAM sequence: CTC
cctgtcagcaattatagcct

SEQ ID NO: 203643 - DNA, 20 bp, Artificial Sequence
  Description of Artificial Sequence: Synthetic oligonucleotide
  Target: ATXN1; (-) strand; PAM type: YTN; PAM sequence: CTG
aaaacctccctgtcagcaat

SEQ ID NO: 203644 - DNA, 20 bp, Artificial Sequence
  Description of Artificial Sequence: Synthetic oligonucleotide
  Target: ATXN1; (-) strand; PAM type: YTN; PAM sequence: CTA
tgacaagctgaaaacctccc

SEQ ID NO: 203645 - DNA, 20 bp, Artificial Sequence
  Description of Artificial Sequence: Synthetic oligonucleotide
  Target: ATXN1; (-) strand; PAM type: YTN; PAM sequence: CTC
tatgacaagctgaaaacctc

SEQ ID NO: 203646 - DNA, 20 bp, Artificial Sequence
  Description of Artificial Sequence: Synthetic oligonucleotide
  Target: ATXN1; (-) strand; PAM type: YTN; PAM sequence: TTA
tctctatgacaagctgaaaa

SEQ ID NO: 203647 - DNA, 20 bp, Artificial Sequence
  Description of Artificial Sequence: Synthetic oligonucleotide
  Target: ATXN1; (-) strand; PAM type: YTN; PAM sequence: TTT
atctctatgacaagctgaaa

SEQ ID NO: 203648 - DNA, 20 bp, Artificial Sequence
  Description of Artificial Sequence: Synthetic oligonucleotide
  Target: ATXN1; (-) strand; PAM type: YTN; PAM sequence: TTT
tatctctatgacaagctgaa

SEQ ID NO: 203649 - DNA, 20 bp, Artificial Sequence
  Description of Artificial Sequence: Synthetic oligonucleotide
  Target: ATXN1; (-) strand; PAM type: YTN; PAM sequence: TTT
ttatctctatgacaagctga

SEQ ID NO: 203650 - DNA, 20 bp, Artificial Sequence
  Description of Artificial Sequence: Synthetic oligonucleotide
  Target: ATXN1; (-) strand; PAM type: YTN; PAM sequence: TTT
tttatctctatgacaagctg

SEQ ID NO: 203651 - DNA, 20 bp, Artificial Sequence
  Description of Artificial Sequence: Synthetic oligonucleotide
  Target: ATXN1; (-) strand; PAM type: YTN; PAM sequence: TTT
ttttatctctatgacaagct

SEQ ID NO: 203652 - DNA, 20 bp, Artificial Sequence
  Description of Artificial Sequence: Synthetic oligonucleotide
  Target: ATXN1; (-) strand; PAM type: YTN; PAM sequence: CTC
aagaataaccatattttttt

SEQ ID NO: 203653 - DNA, 20 bp, Artificial Sequence
  Description of Artificial Sequence: Synthetic oligonucleotide
  Target: ATXN1; (-) strand; PAM type: YTN; PAM sequence: TTA
ctcaagaataaccatatttt

SEQ ID NO: 203654 - DNA, 20 bp, Artificial Sequence
  Description of Artificial Sequence: Synthetic oligonucleotide
  Target: ATXN1; (-) strand; PAM type: YTN; PAM sequence: TTA
ttactcaagaataaccatat

SEQ ID NO: 203655 - DNA, 20 bp, Artificial Sequence
  Description of Artificial Sequence: Synthetic oligonucleotide
  Target: ATXN1; (-) strand; PAM type: YTN; PAM sequence: CTT
attactcaagaataaccata

SEQ ID NO: 203656 - DNA, 20 bp, Artificial Sequence
  Description of Artificial Sequence: Synthetic oligonucleotide
  Target: ATXN1; (-) strand; PAM type: YTN; PAM sequence: TTC
cacttattactcaagaataa

SEQ ID NO: 203657 - DNA, 20 bp, Artificial Sequence
  Description of Artificial Sequence: Synthetic oligonucleotide
  Target: ATXN1; (-) strand; PAM type: YTN; PAM sequence: TTT
ccacttattactcaagaata

SEQ ID NO: 203658 - DNA, 20 bp, Artificial Sequence
  Description of Artificial Sequence: Synthetic oligonucleotide
  Target: ATXN1; (-) strand; PAM type: YTN; PAM sequence: TTC
acgaatttccacttattact

SEQ ID NO: 203659 - DNA, 20 bp, Artificial Sequence
  Description of Artificial Sequence: Synthetic oligonucleotide
  Target: ATXN1; (-) strand; PAM type: YTN; PAM sequence: TTT
cacgaatttccacttattac

SEQ ID NO: 203660 - DNA, 20 bp, Artificial Sequence
  Description of Artificial Sequence: Synthetic oligonucleotide
  Target: ATXN1; (-) strand; PAM type: YTN; PAM sequence: TTA
tttcacgaatttccacttat

SEQ ID NO: 203661 - DNA, 20 bp, Artificial Sequence
  Description of Artificial Sequence: Synthetic oligonucleotide
  Target: ATXN1; (-) strand; PAM type: YTN; PAM sequence: CTT
atttcacgaatttccactta

SEQ ID NO: 203662 - DNA, 20 bp, Artificial Sequence
  Description of Artificial Sequence: Synthetic oligonucleotide
  Target: ATXN1; (-) strand; PAM type: YTN; PAM sequence: TTC
atcacttatttcacgaattt

SEQ ID NO: 203663 - DNA, 20 bp, Artificial Sequence
  Description of Artificial Sequence: Synthetic oligonucleotide
  Target: ATXN1; (-) strand; PAM type: YTN; PAM sequence: TTT
catcacttatttcacgaatt

SEQ ID NO: 203664 - DNA, 20 bp, Artificial Sequence
  Description of Artificial Sequence: Synthetic oligonucleotide
  Target: ATXN1; (-) strand; PAM type: YTN; PAM sequence: TTT
tcatcacttatttcacgaat

SEQ ID NO: 203665 - DNA, 20 bp, Artificial Sequence
  Description of Artificial Sequence: Synthetic oligonucleotide
  Target: ATXN1; (-) strand; PAM type: YTN; PAM sequence: TTG
ttttcatcacttatttcacg

SEQ ID NO: 203666 - DNA, 20 bp, Artificial Sequence
  Description of Artificial Sequence: Synthetic oligonucleotide
  Target: ATXN1; (-) strand; PAM type: YTN; PAM sequence: CTT
gttttcatcacttatttcac

SEQ ID NO: 203667 - DNA, 20 bp, Artificial Sequence
  Description of Artificial Sequence: Synthetic oligonucleotide
  Target: ATXN1; (-) strand; PAM type: YTN; PAM sequence: TTA
tacccttgttttcatcactt

SEQ ID NO: 203668 - DNA, 20 bp, Artificial Sequence
  Description of Artificial Sequence: Synthetic oligonucleotide
  Target: ATXN1; (-) strand; PAM type: YTN; PAM sequence: TTT
atacccttgttttcatcact

SEQ ID NO: 203669 - DNA, 20 bp, Artificial Sequence
  Description of Artificial Sequence: Synthetic oligonucleotide
  Target: ATXN1; (-) strand; PAM type: YTN; PAM sequence: CTT
tatacccttgttttcatcac

SEQ ID NO: 203670 - DNA, 20 bp, Artificial Sequence
  Description of Artificial Sequence: Synthetic oligonucleotide
  Target: ATXN1; (-) strand; PAM type: YTN; PAM sequence: CTG
tagcctttatacccttgttt

SEQ ID NO: 203671 - DNA, 20 bp, Artificial Sequence
  Description of Artificial Sequence: Synthetic oligonucleotide
  Target: ATXN1; (-) strand; PAM type: YTN; PAM sequence: TTC
tgtagcctttatacccttgt

SEQ ID NO: 203672 - DNA, 20 bp, Artificial Sequence
  Description of Artificial Sequence: Synthetic oligonucleotide
  Target: ATXN1; (-) strand; PAM type: YTN; PAM sequence: TTT
ctgtagcctttatacccttg

SEQ ID NO: 203673 - DNA, 20 bp, Artificial Sequence
  Description of Artificial Sequence: Synthetic oligonucleotide
  Target: ATXN1; (-) strand; PAM type: YTN; PAM sequence: TTG
ggtaggaaagggtttctgta

SEQ ID NO: 203674 - DNA, 20 bp, Artificial Sequence
  Description of Artificial Sequence: Synthetic oligonucleotide
  Target: ATXN1; (-) strand; PAM type: YTN; PAM sequence: CTG
tgttgggtaggaaagggttt

SEQ ID NO: 203675 - DNA, 20 bp, Artificial Sequence
  Description of Artificial Sequence: Synthetic oligonucleotide
  Target: ATXN1; (-) strand; PAM type: YTN; PAM sequence: CTC
tgtgttgggtaggaaagggt

SEQ ID NO: 203676 - DNA, 20 bp, Artificial Sequence
  Description of Artificial Sequence: Synthetic oligonucleotide
  Target: ATXN1; (-) strand; PAM type: YTN; PAM sequence: CTC
actctgtgttgggtaggaaa

SEQ ID NO: 203677 - DNA, 20 bp, Artificial Sequence
  Description of Artificial Sequence: Synthetic oligonucleotide
  Target: ATXN1; (-) strand; PAM type: YTN; PAM sequence: TTG
tgtctcactctgtgttgggt

SEQ ID NO: 203678 - DNA, 20 bp, Artificial Sequence
  Description of Artificial Sequence: Synthetic oligonucleotide
  Target: ATXN1; (-) strand; PAM type: YTN; PAM sequence: CTT
gtgtctcactctgtgttggg

SEQ ID NO: 203679 - DNA, 20 bp, Artificial Sequence
  Description of Artificial Sequence: Synthetic oligonucleotide
  Target: ATXN1; (-) strand; PAM type: YTN; PAM sequence: TTG
ggcttgtgtctcactctgtg

SEQ ID NO: 203680 - DNA, 20 bp, Artificial Sequence
  Description of Artificial Sequence: Synthetic oligonucleotide
  Target: ATXN1; (-) strand; PAM type: YTN; PAM sequence: CTT
gggcttgtgtctcactctgt

SEQ ID NO: 203681 - DNA, 20 bp, Artificial Sequence
  Description of Artificial Sequence: Synthetic oligonucleotide
  Target: ATXN1; (-) strand; PAM type: YTN; PAM sequence: CTC
ttgggcttgtgtctcactct

SEQ ID NO: 203682 - DNA, 20 bp, Artificial Sequence
  Description of Artificial Sequence: Synthetic oligonucleotide
  Target: ATXN1; (-) strand; PAM type: YTN; PAM sequence: TTC
tcttgggcttgtgtctcact

SEQ ID NO: 203683 - DNA, 20 bp, Artificial Sequence
  Description of Artificial Sequence: Synthetic oligonucleotide
  Target: ATXN1; (-) strand; PAM type: YTN; PAM sequence: TTT
ctcttgggcttgtgtctcac

SEQ ID NO: 203684 - DNA, 20 bp, Artificial Sequence
  Description of Artificial Sequence: Synthetic oligonucleotide
  Target: ATXN1; (-) strand; PAM type: YTN; PAM sequence: TTT
tctcttgggcttgtgtctca

SEQ ID NO: 203685 - DNA, 20 bp, Artificial Sequence
  Description of Artificial Sequence: Synthetic oligonucleotide
  Target: ATXN1; (-) strand; PAM type: YTN; PAM sequence: TTG
ttttctcttgggcttgtgtc

SEQ ID NO: 203686 - DNA, 20 bp, Artificial Sequence
  Description of Artificial Sequence: Synthetic oligonucleotide
  Target: ATXN1; (-) strand; PAM type: YTN; PAM sequence: TTT
gttttctcttgggcttgtgt

SEQ ID NO: 203687 - DNA, 20 bp, Artificial Sequence
  Description of Artificial Sequence: Synthetic oligonucleotide
  Target: ATXN1; (-) strand; PAM type: YTN; PAM sequence: TTT
tgttttctcttgggcttgtg

SEQ ID NO: 203688 - DNA, 20 bp, Artificial Sequence
  Description of Artificial Sequence: Synthetic oligonucleotide
  Target: ATXN1; (-) strand; PAM type: YTN; PAM sequence: TTT
ttgttttctcttgggcttgt

SEQ ID NO: 203689 - DNA, 20 bp, Artificial Sequence
  Description of Artificial Sequence: Synthetic oligonucleotide
  Target: ATXN1; (-) strand; PAM type: YTN; PAM sequence: CTT
tttgttttctcttgggcttg

SEQ ID NO: 203690 - DNA, 20 bp, Artificial Sequence
  Description of Artificial Sequence: Synthetic oligonucleotide
  Target: ATXN1; (-) strand; PAM type: YTN; PAM sequence: TTC
tttttgttttctcttgggct

SEQ ID NO: 203691 - DNA, 20 bp, Artificial Sequence
  Description of Artificial Sequence: Synthetic oligonucleotide
  Target: ATXN1; (-) strand; PAM type: YTN; PAM sequence: CTG
tgttctttttgttttctctt

SEQ ID NO: 203692 - DNA, 20 bp, Artificial Sequence
  Description of Artificial Sequence: Synthetic oligonucleotide
  Target: ATXN1; (-) strand; PAM type: YTN; PAM sequence: TTG
ctgtgttctttttgttttct

SEQ ID NO: 203693 - DNA, 20 bp, Artificial Sequence
  Description of Artificial Sequence: Synthetic oligonucleotide
  Target: ATXN1; (-) strand; PAM type: YTN; PAM sequence: TTT
gctgtgttctttttgttttc

SEQ ID NO: 203694 - DNA, 20 bp, Artificial Sequence
  Description of Artificial Sequence: Synthetic oligonucleotide
  Target: ATXN1; (-) strand; PAM type: YTN; PAM sequence: CTT
tgctgtgttctttttgtttt

SEQ ID NO: 203695 - DNA, 20 bp, Artificial Sequence
  Description of Artificial Sequence: Synthetic oligonucleotide
  Target: ATXN1; (-) strand; PAM type: YTN; PAM sequence: CTG
gctttgctgtgttctttttg

SEQ ID NO: 203696 - DNA, 20 bp, Artificial Sequence
  Description of Artificial Sequence: Synthetic oligonucleotide
  Target: ATXN1; (-) strand; PAM type: YTN; PAM sequence: CTG
gctggctttgctgtgttctt

SEQ ID NO: 203697 - DNA, 20 bp, Artificial Sequence
  Description of Artificial Sequence: Synthetic oligonucleotide
  Target: ATXN1; (-) strand; PAM type: YTN; PAM sequence: CTC
tggctggctttgctgtgttc

SEQ ID NO: 203698 - DNA, 20 bp, Artificial Sequence
  Description of Artificial Sequence: Synthetic oligonucleotide
  Target: ATXN1; (-) strand; PAM type: YTN; PAM sequence: CTG
aagtcatgctctggctggct

SEQ ID NO: 203699 - DNA, 20 bp, Artificial Sequence
  Description of Artificial Sequence: Synthetic oligonucleotide
  Target: ATXN1; (-) strand; PAM type: YTN; PAM sequence: CTA
gtgagcacaccctgaagtca

SEQ ID NO: 203700 - DNA, 20 bp, Artificial Sequence
  Description of Artificial Sequence: Synthetic oligonucleotide
  Target: ATXN1; (-) strand; PAM type: YTN; PAM sequence: TTC
aacgtagataatatcaccta

SEQ ID NO: 203701 - DNA, 20 bp, Artificial Sequence
  Description of Artificial Sequence: Synthetic oligonucleotide
  Target: ATXN1; (-) strand; PAM type: YTN; PAM sequence: TTT
caacgtagataatatcacct

SEQ ID NO: 203702 - DNA, 20 bp, Artificial Sequence
  Description of Artificial Sequence: Synthetic oligonucleotide
  Target: ATXN1; (-) strand; PAM type: YTN; PAM sequence: TTT
tcaacgtagataatatcacc

SEQ ID NO: 203703 - DNA, 20 bp, Artificial Sequence
  Description of Artificial Sequence: Synthetic oligonucleotide
  Target: ATXN1; (-) strand; PAM type: YTN; PAM sequence: CTT
ttcaacgtagataatatcac

SEQ ID NO: 203704 - DNA, 20 bp, Artificial Sequence
  Description of Artificial Sequence: Synthetic oligonucleotide
  Target: ATXN1; (-) strand; PAM type: YTN; PAM sequence: TTC
aggtaccatgtcttttcaac

SEQ ID NO: 203705 - DNA, 20 bp, Artificial Sequence
  Description of Artificial Sequence: Synthetic oligonucleotide
  Target: ATXN1; (-) strand; PAM type: YTN; PAM sequence: CTT
caggtaccatgtcttttcaa

SEQ ID NO: 203706 - DNA, 20 bp, Artificial Sequence
  Description of Artificial Sequence: Synthetic oligonucleotide
  Target: ATXN1; (-) strand; PAM type: YTN; PAM sequence: TTG
atcttcaggtaccatgtctt

SEQ ID NO: 203707 - DNA, 20 bp, Artificial Sequence
  Description of Artificial Sequence: Synthetic oligonucleotide
  Target: ATXN1; (-) strand; PAM type: YTN; PAM sequence: CTT
gatcttcaggtaccatgtct

SEQ ID NO: 203708 - DNA, 20 bp, Artificial Sequence
  Description of Artificial Sequence: Synthetic oligonucleotide
  Target: ATXN1; (-) strand; PAM type: YTN; PAM sequence: CTC
ttgatcttcaggtaccatgt

SEQ ID NO: 203709 - DNA, 20 bp, Artificial Sequence
  Description of Artificial Sequence: Synthetic oligonucleotide
  Target: ATXN1; (-) strand; PAM type: YTN; PAM sequence: CTC
aaactcttgatcttcaggta

SEQ ID NO: 203710 - DNA, 20 bp, Artificial Sequence
  Description of Artificial Sequence: Synthetic oligonucleotide
  Target: ATXN1; (-) strand; PAM type: YTN; PAM sequence: TTA
aacctcaaactcttgatctt

SEQ ID NO: 203711 - DNA, 20 bp, Artificial Sequence
  Description of Artificial Sequence: Synthetic oligonucleotide
  Target: ATXN1; (-) strand; PAM type: YTN; PAM sequence: CTT
aaacctcaaactcttgatct

SEQ ID NO: 203712 - DNA, 20 bp, Artificial Sequence
  Description of Artificial Sequence: Synthetic oligonucleotide
  Target: ATXN1; (-) strand; PAM type: YTN; PAM sequence: TTA
tagaagaaaaaacagaaaaa

SEQ ID NO: 203713 - DNA, 20 bp, Artificial Sequence
  Description of Artificial Sequence: Synthetic oligonucleotide
  Target: ATXN1; (-) strand; PAM type: YTN; PAM sequence: TTT
atagaagaaaaaacagaaaa

SEQ ID NO: 203714 - DNA, 20 bp, Artificial Sequence
  Description of Artificial Sequence: Synthetic oligonucleotide
  Target: ATXN1; (-) strand; PAM type: YTN; PAM sequence: CTT
tatagaagaaaaaacagaaa

SEQ ID NO: 203715 - DNA, 20 bp, Artificial Sequence
  Description of Artificial Sequence: Synthetic oligonucleotide
  Target: ATXN1; (-) strand; PAM type: YTN; PAM sequence: CTG
aactttatagaagaaaaaac

SEQ ID NO: 203716 - DNA, 20 bp, Artificial Sequence
  Description of Artificial Sequence: Synthetic oligonucleotide
  Target: ATXN1; (-) strand; PAM type: YTN; PAM sequence: TTA
aaatgccataaaagtatact

SEQ ID NO: 203717 - DNA, 20 bp, Artificial Sequence
  Description of Artificial Sequence: Synthetic oligonucleotide
  Target: ATXN1; (-) strand; PAM type: YTN; PAM sequence: CTG
aaagttaaaatgccataaaa

SEQ ID NO: 203718 - DNA, 20 bp, Artificial Sequence
  Description of Artificial Sequence: Synthetic oligonucleotide
  Target: ATXN1; (-) strand; PAM type: YTN; PAM sequence: TTC
ccaaggtaccaaaactgaaa

SEQ ID NO: 203719 - DNA, 20 bp, Artificial Sequence
  Description of Artificial Sequence: Synthetic oligonucleotide
  Target: ATXN1; (-) strand; PAM type: YTN; PAM sequence: CTG
tgttcccaaggtaccaaaac

SEQ ID NO: 203720 - DNA, 20 bp, Artificial Sequence
  Description of Artificial Sequence: Synthetic oligonucleotide
  Target: ATXN1; (-) strand; PAM type: YTN; PAM sequence: CTG
ccaagatagaggatgctgtg

SEQ ID NO: 203721 - DNA, 20 bp, Artificial Sequence
  Description of Artificial Sequence: Synthetic oligonucleotide
  Target: ATXN1; (-) strand; PAM type: YTN; PAM sequence: CTC
tgccaagatagaggatgctg

SEQ ID NO: 203722 - DNA, 20 bp, Artificial Sequence
  Description of Artificial Sequence: Synthetic oligonucleotide
  Target: ATXN1; (-) strand; PAM type: YTN; PAM sequence: TTA
actctgccaagatagaggat

SEQ ID NO: 203723 - DNA, 20 bp, Artificial Sequence
  Description of Artificial Sequence: Synthetic oligonucleotide
  Target: ATXN1; (-) strand; PAM type: YTN; PAM sequence: CTT
aactctgccaagatagagga

SEQ ID NO: 203724 - DNA, 20 bp, Artificial Sequence
  Description of Artificial Sequence: Synthetic oligonucleotide
  Target: ATXN1; (-) strand; PAM type: YTN; PAM sequence: TTC
atgccccacttaactctgcc

SEQ ID NO: 203725 - DNA, 20 bp, Artificial Sequence
  Description of Artificial Sequence: Synthetic oligonucleotide
  Target: ATXN1; (-) strand; PAM type: YTN; PAM sequence: TTA
ggaaaaggccattcatgccc

SEQ ID NO: 203726 - DNA, 20 bp, Artificial Sequence
  Description of Artificial Sequence: Synthetic oligonucleotide
  Target: ATXN1; (-) strand; PAM type: YTN; PAM sequence: CTT
aggaaaaggccattcatgcc

SEQ ID NO: 203727 - DNA, 20 bp, Artificial Sequence
  Description of Artificial Sequence: Synthetic oligonucleotide
  Target: ATXN1; (-) strand; PAM type: YTN; PAM sequence: CTA
cttaggaaaaggccattcat

SEQ ID NO: 203728 - DNA, 20 bp, Artificial Sequence
  Description of Artificial Sequence: Synthetic oligonucleotide
  Target: ATXN1; (-) strand; PAM type: YTN; PAM sequence: TTC
tacttaggaaaaggccattc

SEQ ID NO: 203729 - DNA, 20 bp, Artificial Sequence
  Description of Artificial Sequence: Synthetic oligonucleotide
  Target: ATXN1; (-) strand; PAM type: YTN; PAM sequence: TTA
aatcaccattctacttagga

SEQ ID NO: 203730 - DNA, 20 bp, Artificial Sequence
  Description of Artificial Sequence: Synthetic oligonucleotide
  Target: ATXN1; (-) strand; PAM type: YTN; PAM sequence: CTG
ttaaatcaccattctactta

SEQ ID NO: 203731 - DNA, 20 bp, Artificial Sequence
  Description of Artificial Sequence: Synthetic oligonucleotide
  Target: ATXN1; (-) strand; PAM type: YTN; PAM sequence: CTC
tgttaaatcaccattctact

SEQ ID NO: 203732 - DNA, 20 bp, Artificial Sequence
  Description of Artificial Sequence: Synthetic oligonucleotide
  Target: ATXN1; (-) strand; PAM type: YTN; PAM sequence: CTC
ataaaaactctgttaaatca

SEQ ID NO: 203733 - DNA, 20 bp, Artificial Sequence
  Description of Artificial Sequence: Synthetic oligonucleotide
  Target: ATXN1; (-) strand; PAM type: YTN; PAM sequence: TTG
gaccatactcataaaaactc

SEQ ID NO: 203734 - DNA, 20 bp, Artificial Sequence
  Description of Artificial Sequence: Synthetic oligonucleotide
  Target: ATXN1; (-) strand; PAM type: YTN; PAM sequence: CTG
ttggaccatactcataaaaa

SEQ ID NO: 203735 - DNA, 20 bp, Artificial Sequence
  Description of Artificial Sequence: Synthetic oligonucleotide
  Target: ATXN1; (-) strand; PAM type: YTN; PAM sequence: CTA
ctgttggaccatactcataa

SEQ ID NO: 203736 - DNA, 20 bp, Artificial Sequence
  Description of Artificial Sequence: Synthetic oligonucleotide
  Target: ATXN1; (-) strand; PAM type: YTN; PAM sequence: TTG
ataaaaatgtcaggtctact

SEQ ID NO: 203737 - DNA, 20 bp, Artificial Sequence
  Description of Artificial Sequence: Synthetic oligonucleotide
  Target: ATXN1; (-) strand; PAM type: YTN; PAM sequence: CTT
gataaaaatgtcaggtctac

SEQ ID NO: 203738 - DNA, 20 bp, Artificial Sequence
  Description of Artificial Sequence: Synthetic oligonucleotide
  Target: ATXN1; (-) strand; PAM type: YTN; PAM sequence: CTC
ttgataaaaatgtcaggtct

SEQ ID NO: 203739 - DNA, 20 bp, Artificial Sequence
  Description of Artificial Sequence: Synthetic oligonucleotide
  Target: ATXN1; (-) strand; PAM type: YTN; PAM sequence: CTG
tcctcttgataaaaatgtca

SEQ ID NO: 203740 - DNA, 20 bp, Artificial Sequence
  Description of Artificial Sequence: Synthetic oligonucleotide
  Target: ATXN1; (-) strand; PAM type: YTN; PAM sequence: TTC
tgtcctcttgataaaaatgt

SEQ ID NO: 203741 - DNA, 20 bp, Artificial Sequence
  Description of Artificial Sequence: Synthetic oligonucleotide
  Target: ATXN1; (-) strand; PAM type: YTN; PAM sequence: CTT
ctgtcctcttgataaaaatg

SEQ ID NO: 203742 - DNA, 20 bp, Artificial Sequence
  Description of Artificial Sequence: Synthetic oligonucleotide
  Target: ATXN1; (-) strand; PAM type: YTN; PAM sequence: CTG
acacttctgtcctcttgata

SEQ ID NO: 203743 - DNA, 20 bp, Artificial Sequence
  Description of Artificial Sequence: Synthetic oligonucleotide
  Target: ATXN1; (-) strand; PAM type: YTN; PAM sequence: TTC
aaactgacacttctgtcctc

SEQ ID NO: 203744 - DNA, 20 bp, Artificial Sequence
  Description of Artificial Sequence: Synthetic oligonucleotide
  Target: ATXN1; (-) strand; PAM type: YTN; PAM sequence: TTT
caaactgacacttctgtcct

SEQ ID NO: 203745 - DNA, 20 bp, Artificial Sequence
  Description of Artificial Sequence: Synthetic oligonucleotide
  Target: ATXN1; (-) strand; PAM type: YTN; PAM sequence: CTT
tcaaactgacacttctgtcc

SEQ ID NO: 203746 - DNA, 20 bp, Artificial Sequence
  Description of Artificial Sequence: Synthetic oligonucleotide
  Target: ATXN1; (-) strand; PAM type: YTN; PAM sequence: TTA
gaagatctttcaaactgaca

SEQ ID NO: 203747 - DNA, 20 bp, Artificial Sequence
  Description of Artificial Sequence: Synthetic oligonucleotide
  Target: ATXN1; (-) strand; PAM type: YTN; PAM sequence: CTA
gcagtagccatgaacagtgt

SEQ ID NO: 203748 - DNA, 20 bp, Artificial Sequence
  Description of Artificial Sequence: Synthetic oligonucleotide
  Target: ATXN1; (-) strand; PAM type: YTN; PAM sequence: TTC
ctagcagtagccatgaacag

SEQ ID NO: 203749 - DNA, 20 bp, Artificial Sequence
  Description of Artificial Sequence: Synthetic oligonucleotide
  Target: ATXN1; (-) strand; PAM type: YTN; PAM sequence: CTG
ttcctagcagtagccatgaa

SEQ ID NO: 203750 - DNA, 20 bp, Artificial Sequence
  Description of Artificial Sequence: Synthetic oligonucleotide
  Target: ATXN1; (-) strand; PAM type: YTN; PAM sequence: CTC
tgttcctagcagtagccatg

SEQ ID NO: 203751 - DNA, 20 bp, Artificial Sequence
  Description of Artificial Sequence: Synthetic oligonucleotide
  Target: ATXN1; (-) strand; PAM type: YTN; PAM sequence: CTA
ctctgttcctagcagtagcc

SEQ ID NO: 203752 - DNA, 20 bp, Artificial Sequence
  Description of Artificial Sequence: Synthetic oligonucleotide
  Target: ATXN1; (-) strand; PAM type: YTN; PAM sequence: TTG
ccctactctgttcctagcag

SEQ ID NO: 203753 - DNA, 20 bp, Artificial Sequence
  Description of Artificial Sequence: Synthetic oligonucleotide
  Target: ATXN1; (-) strand; PAM type: YTN; PAM sequence: CTC
cacataaaaagaagggaaag

SEQ ID NO: 203754 - DNA, 20 bp, Artificial Sequence
  Description of Artificial Sequence: Synthetic oligonucleotide
  Target: ATXN1; (-) strand; PAM type: YTN; PAM sequence: CTG
ccctccacataaaaagaagg

SEQ ID NO: 203755 - DNA, 20 bp, Artificial Sequence
  Description of Artificial Sequence: Synthetic oligonucleotide
  Target: ATXN1; (-) strand; PAM type: YTN; PAM sequence: TTA
aggagtccctgccctccaca

SEQ ID NO: 203756 - DNA, 20 bp, Artificial Sequence
  Description of Artificial Sequence: Synthetic oligonucleotide
  Target: ATXN1; (-) strand; PAM type: YTN; PAM sequence: CTT
aaggagtccctgccctccac

SEQ ID NO: 203757 - DNA, 20 bp, Artificial Sequence
  Description of Artificial Sequence: Synthetic oligonucleotide
  Target: ATXN1; (-) strand; PAM type: YTN; PAM sequence: CTA
cttaaggagtccctgccctc

SEQ ID NO: 203758 - DNA, 20 bp, Artificial Sequence
  Description of Artificial Sequence: Synthetic oligonucleotide
  Target: ATXN1; (-) strand; PAM type: YTN; PAM sequence: CTG
aatgaatggccaggtcagcc

SEQ ID NO: 203759 - DNA, 20 bp, Artificial Sequence
  Description of Artificial Sequence: Synthetic oligonucleotide
  Target: ATXN1; (-) strand; PAM type: YTN; PAM sequence: CTA
gactgaatgaatggccaggt

SEQ ID NO: 203760 - DNA, 20 bp, Artificial Sequence
  Description of Artificial Sequence: Synthetic oligonucleotide
  Target: ATXN1; (-) strand; PAM type: YTN; PAM sequence: TTA
ggctagactgaatgaatggc

SEQ ID NO: 203761 - DNA, 20 bp, Artificial Sequence
  Description of Artificial Sequence: Synthetic oligonucleotide
  Target: ATXN1; (-) strand; PAM type: YTN; PAM sequence: CTT
aggctagactgaatgaatgg

SEQ ID NO: 203762 - DNA, 20 bp, Artificial Sequence
  Description of Artificial Sequence: Synthetic oligonucleotide
  Target: ATXN1; (-) strand; PAM type: YTN; PAM sequence: CTG
tggcttaggctagactgaat

SEQ ID NO: 203763 - DNA, 20 bp, Artificial Sequence
  Description of Artificial Sequence: Synthetic oligonucleotide
  Target: ATXN1; (-) strand; PAM type: YTN; PAM sequence: CTG
gaatgtgggccagaaagcct

SEQ ID NO: 203764 - DNA, 20 bp, Artificial Sequence
  Description of Artificial Sequence: Synthetic oligonucleotide
  Target: ATXN1; (-) strand; PAM type: YTN; PAM sequence: TTA
cgctggaatgtgggccagaa

SEQ ID NO: 203765 - DNA, 20 bp, Artificial Sequence
  Description of Artificial Sequence: Synthetic oligonucleotide
  Target: ATXN1; (-) strand; PAM type: YTN; PAM sequence: CTT
acgctggaatgtgggccaga

SEQ ID NO: 203766 - DNA, 20 bp, Artificial Sequence
  Description of Artificial Sequence: Synthetic oligonucleotide
  Target: ATXN1; (-) strand; PAM type: YTN; PAM sequence: CTG
cttacgctggaatgtgggcc

SEQ ID NO: 203767 - DNA, 20 bp, Artificial Sequence
  Description of Artificial Sequence: Synthetic oligonucleotide
  Target: ATXN1; (-) strand; PAM type: YTN; PAM sequence: TTA
aaaagaatgtcaacacagca

SEQ ID NO: 203768 - DNA, 20 bp, Artificial Sequence
  Description of Artificial Sequence: Synthetic oligonucleotide
  Target: ATXN1; (-) strand; PAM type: YTN; PAM sequence: CTA
ggtgaggaaggaggattaaa

SEQ ID NO: 203769 - DNA, 20 bp, Artificial Sequence
  Description of Artificial Sequence: Synthetic oligonucleotide
  Target: ATXN1; (-) strand; PAM type: YTN; PAM sequence: TTC
taggtgaggaaggaggatta

SEQ ID NO: 203770 - DNA, 20 bp, Artificial Sequence
  Description of Artificial Sequence: Synthetic oligonucleotide
  Target: ATXN1; (-) strand; PAM type: YTN; PAM sequence: CTA
catcgaggaataatgtattc

SEQ ID NO: 203771 - DNA, 20 bp, Artificial Sequence
  Description of Artificial Sequence: Synthetic oligonucleotide
  Target: ATXN1; (-) strand; PAM type: YTN; PAM sequence: TTG
catgcctacatcgaggaata

SEQ ID NO: 203772 - DNA, 20 bp, Artificial Sequence
  Description of Artificial Sequence: Synthetic oligonucleotide
  Target: ATXN1; (-) strand; PAM type: YTN; PAM sequence: TTT
gcatgcctacatcgaggaat

SEQ ID NO: 203773 - DNA, 20 bp, Artificial Sequence
  Description of Artificial Sequence: Synthetic oligonucleotide
  Target: ATXN1; (-) strand; PAM type: YTN; PAM sequence: TTC
agcagatatttgcatgccta

SEQ ID NO: 203774 - DNA, 20 bp, Artificial Sequence
  Description of Artificial Sequence: Synthetic oligonucleotide
  Target: ATXN1; (-) strand; PAM type: YTN; PAM sequence: CTG
aaataatccattcagcagat

SEQ ID NO: 203775 - DNA, 20 bp, Artificial Sequence
  Description of Artificial Sequence: Synthetic oligonucleotide
  Target: ATXN1; (-) strand; PAM type: YTN; PAM sequence: TTG
gtgtccataactgaaataat

SEQ ID NO: 203776 - DNA, 20 bp, Artificial Sequence
  Description of Artificial Sequence: Synthetic oligonucleotide
  Target: ATXN1; (-) strand; PAM type: YTN; PAM sequence: CTA
ttggtgtccataactgaaat

SEQ ID NO: 203777 - DNA, 20 bp, Artificial Sequence
  Description of Artificial Sequence: Synthetic oligonucleotide
  Target: ATXN1; (-) strand; PAM type: YTN; PAM sequence: CTG
gacaggtactattggtgtcc

SEQ ID NO: 203778 - DNA, 20 bp, Artificial Sequence
  Description of Artificial Sequence: Synthetic oligonucleotide
  Target: ATXN1; (-) strand; PAM type: YTN; PAM sequence: TTA
ctggacaggtactattggtg

SEQ ID NO: 203779 - DNA, 20 bp, Artificial Sequence
  Description of Artificial Sequence: Synthetic oligonucleotide
  Target: ATXN1; (-) strand; PAM type: YTN; PAM sequence: TTT
actggacaggtactattggt

SEQ ID NO: 203780 - DNA, 20 bp, Artificial Sequence
  Description of Artificial Sequence: Synthetic oligonucleotide
  Target: ATXN1; (-) strand; PAM type: YTN; PAM sequence: CTG
ggtcatatttactggacagg

SEQ ID NO: 203781 - DNA, 20 bp, Artificial Sequence
  Description of Artificial Sequence: Synthetic oligonucleotide
  Target: ATXN1; (-) strand; PAM type: YTN; PAM sequence: TTC
tgggtcatatttactggaca

SEQ ID NO: 203782 - DNA, 20 bp, Artificial Sequence
  Description of Artificial Sequence: Synthetic oligonucleotide
  Target: ATXN1; (-) strand; PAM type: YTN; PAM sequence: TTT
ctgggtcatatttactggac

SEQ ID NO: 203783 - DNA, 20 bp, Artificial Sequence
  Description of Artificial Sequence: Synthetic oligonucleotide
  Target: ATXN1; (-) strand; PAM type: YTN; PAM sequence: TTG
gagaatggagaggaaggagt

SEQ ID NO: 203784 - DNA, 20 bp, Artificial Sequence
  Description of Artificial Sequence: Synthetic oligonucleotide
  Target: ATXN1; (-) strand; PAM type: YTN; PAM sequence: TTT
ggagaatggagaggaaggag

SEQ ID NO: 203785 - DNA, 20 bp, Artificial Sequence
  Description of Artificial Sequence: Synthetic oligonucleotide
  Target: ATXN1; (-) strand; PAM type: YTN; PAM sequence: TTG
gatttggagaatggagagga

SEQ ID NO: 203786 - DNA, 20 bp, Artificial Sequence
  Description of Artificial Sequence: Synthetic oligonucleotide
  Target: ATXN1; (-) strand; PAM type: YTN; PAM sequence: TTG
ttggatttggagaatggaga

SEQ ID NO: 203787 - DNA, 20 bp, Artificial Sequence
  Description of Artificial Sequence: Synthetic oligonucleotide
  Target: ATXN1; (-) strand; PAM type: YTN; PAM sequence: TTA
gtaattgttggatttggaga

SEQ ID NO: 203788 - DNA, 20 bp, Artificial Sequence
  Description of Artificial Sequence: Synthetic oligonucleotide
  Target: ATXN1; (-) strand; PAM type: YTN; PAM sequence: CTT
agtaattgttggatttggag

SEQ ID NO: 203789 - DNA, 20 bp, Artificial Sequence
  Description of Artificial Sequence: Synthetic oligonucleotide
  Target: ATXN1; (-) strand; PAM type: YTN; PAM sequence: TTG
aagggataaaataatataac

SEQ ID NO: 203790 - DNA, 20 bp, Artificial Sequence
  Description of Artificial Sequence: Synthetic oligonucleotide
  Target: ATXN1; (-) strand; PAM type: YTN; PAM sequence: TTT
gaagggataaaataatataa

SEQ ID NO: 203791 - DNA, 20 bp, Artificial Sequence
  Description of Artificial Sequence: Synthetic oligonucleotide
  Target: ATXN1; (-) strand; PAM type: YTN; PAM sequence: TTC
aaaggtatttgaagggataa

SEQ ID NO: 203792 - DNA, 20 bp, Artificial Sequence
  Description of Artificial Sequence: Synthetic oligonucleotide
  Target: ATXN1; (-) strand; PAM type: YTN; PAM sequence: TTG
ggaggatggcaggaaaggaa

SEQ ID NO: 203793 - DNA, 20 bp, Artificial Sequence
  Description of Artificial Sequence: Synthetic oligonucleotide
  Target: ATXN1; (-) strand; PAM type: YTN; PAM sequence: TTG
agggtgttgggaggatggca

SEQ ID NO: 203794 - DNA, 20 bp, Artificial Sequence
  Description of Artificial Sequence: Synthetic oligonucleotide
  Target: ATXN1; (-) strand; PAM type: YTN; PAM sequence: TTT
gagggtgttgggaggatggc

SEQ ID NO: 203795 - DNA, 20 bp, Artificial Sequence
  Description of Artificial Sequence: Synthetic oligonucleotide
  Target: ATXN1; (-) strand; PAM type: YTN; PAM sequence: TTC
gtttgagggtgttgggagga

SEQ ID NO: 203796 - DNA, 20 bp, Artificial Sequence
  Description of Artificial Sequence: Synthetic oligonucleotide
  Target: ATXN1; (-) strand; PAM type: YTN; PAM sequence: CTA
ttcgtttgagggtgttggga

SEQ ID NO: 203797 - DNA, 20 bp, Artificial Sequence
  Description of Artificial Sequence: Synthetic oligonucleotide
  Target: ATXN1; (-) strand; PAM type: YTN; PAM sequence: TTA
aagataggtaatgggagcct

SEQ ID NO: 203798 - DNA, 20 bp, Artificial Sequence
  Description of Artificial Sequence: Synthetic oligonucleotide
  Target: ATXN1; (-) strand; PAM type: YTN; PAM sequence: TTG
ggagaaacaggggacaggcg

SEQ ID NO: 203799 - DNA, 20 bp, Artificial Sequence
  Description of Artificial Sequence: Synthetic oligonucleotide
  Target: ATXN1; (-) strand; PAM type: YTN; PAM sequence: CTG
aaaccggtgacaatgtatgt

SEQ ID NO: 203800 - DNA, 20 bp, Artificial Sequence
  Description of Artificial Sequence: Synthetic oligonucleotide
  Target: ATXN1; (-) strand; PAM type: YTN; PAM sequence: TTG
tgtgtatatatctgaaaccg

SEQ ID NO: 203801 - DNA, 20 bp, Artificial Sequence
  Description of Artificial Sequence: Synthetic oligonucleotide
  Target: ATXN1; (-) strand; PAM type: YTN; PAM sequence: TTT
gtgtgtatatatctgaaacc

SEQ ID NO: 203802 - DNA, 20 bp, Artificial Sequence
  Description of Artificial Sequence: Synthetic oligonucleotide
  Target: ATXN1; (-) strand; PAM type: YTN; PAM sequence: CTC
agtgagtttgtgtgtatata

SEQ ID NO: 203803 - DNA, 20 bp, Artificial Sequence
  Description of Artificial Sequence: Synthetic oligonucleotide
  Target: ATXN1; (-) strand; PAM type: YTN; PAM sequence: TTA
tggaaggggctcagtgagtt

SEQ ID NO: 203804 - DNA, 20 bp, Artificial Sequence
  Description of Artificial Sequence: Synthetic oligonucleotide
  Target: ATXN1; (-) strand; PAM type: YTN; PAM sequence: TTT
atggaaggggctcagtgagt

SEQ ID NO: 203805 - DNA, 20 bp, Artificial Sequence
  Description of Artificial Sequence: Synthetic oligonucleotide
  Target: ATXN1; (-) strand; PAM type: YTN; PAM sequence: TTG
tttatggaaggggctcagtg

SEQ ID NO: 203806 - DNA, 20 bp, Artificial Sequence
  Description of Artificial Sequence: Synthetic oligonucleotide
  Target: ATXN1; (-) strand; PAM type: YTN; PAM sequence: CTT
gtttatggaaggggctcagt

SEQ ID NO: 203807 - DNA, 20 bp, Artificial Sequence
  Description of Artificial Sequence: Synthetic oligonucleotide
  Target: ATXN1; (-) strand; PAM type: YTN; PAM sequence: TTC
ttgtttatggaaggggctca

SEQ ID NO: 203808 - DNA, 20 bp, Artificial Sequence
  Description of Artificial Sequence: Synthetic oligonucleotide
  Target: ATXN1; (-) strand; PAM type: YTN; PAM sequence: TTC
ccagttcttgtttatggaag

SEQ ID NO: 203809 - DNA, 20 bp, Artificial Sequence
  Description of Artificial Sequence: Synthetic oligonucleotide
  Target: ATXN1; (-) strand; PAM type: YTN; PAM sequence: TTA
atgcaggaggtgacacagag

SEQ ID NO: 203810 - DNA, 20 bp, Artificial Sequence
  Description of Artificial Sequence: Synthetic oligonucleotide
  Target: ATXN1; (-) strand; PAM type: YTN; PAM sequence: CTG
gcggaggaatgtgaagttaa

SEQ ID NO: 203811 - DNA, 20 bp, Artificial Sequence
  Description of Artificial Sequence: Synthetic oligonucleotide
  Target: ATXN1; (-) strand; PAM type: YTN; PAM sequence: CTA
agacctggcggaggaatgtg

SEQ ID NO: 203812 - DNA, 20 bp, Artificial Sequence
  Description of Artificial Sequence: Synthetic oligonucleotide
  Target: ATXN1; (-) strand; PAM type: YTN; PAM sequence: CTA
aaggatcactaagacctggc

SEQ ID NO: 203813 - DNA, 20 bp, Artificial Sequence
  Description of Artificial Sequence: Synthetic oligonucleotide
  Target: ATXN1; (-) strand; PAM type: YTN; PAM sequence: CTG
tggggataacagagctaaag

SEQ ID NO: 203814 - DNA, 20 bp, Artificial Sequence
  Description of Artificial Sequence: Synthetic oligonucleotide
  Target: ATXN1; (-) strand; PAM type: YTN; PAM sequence: TTG
acagctgtggggataacaga

SEQ ID NO: 203815 - DNA, 20 bp, Artificial Sequence
  Description of Artificial Sequence: Synthetic oligonucleotide
  Target: ATXN1; (-) strand; PAM type: YTN; PAM sequence: TTT
gacagctgtggggataacag

SEQ ID NO: 203816 - DNA, 20 bp, Artificial Sequence
  Description of Artificial Sequence: Synthetic oligonucleotide
  Target: ATXN1; (-) strand; PAM type: YTN; PAM sequence: TTG
gtatgaaagagaatttgaca

SEQ ID NO: 203817 - DNA, 20 bp, Artificial Sequence
  Description of Artificial Sequence: Synthetic oligonucleotide
  Target: ATXN1; (-) strand; PAM type: YTN; PAM sequence: CTG
gagattggtatgaaagagaa

SEQ ID NO: 203818 - DNA, 20 bp, Artificial Sequence
  Description of Artificial Sequence: Synthetic oligonucleotide
  Target: ATXN1; (-) strand; PAM type: YTN; PAM sequence: TTG
ctggagattggtatgaaaga

SEQ ID NO: 203819 - DNA, 20 bp, Artificial Sequence
  Description of Artificial Sequence: Synthetic oligonucleotide
  Target: ATXN1; (-) strand; PAM type: YTN; PAM sequence: TTA
tatgtgcattgctggagatt

SEQ ID NO: 203820 - DNA, 20 bp, Artificial Sequence
  Description of Artificial Sequence: Synthetic oligonucleotide
  Target: ATXN1; (-) strand; PAM type: YTN; PAM sequence: TTG
gaggggccagcggagttata

SEQ ID NO: 203821 - DNA, 20 bp, Artificial Sequence
  Description of Artificial Sequence: Synthetic oligonucleotide
  Target: ATXN1; (-) strand; PAM type: YTN; PAM sequence: CTG
catgggatatgttggagggg

SEQ ID NO: 203822 - DNA, 20 bp, Artificial Sequence
  Description of Artificial Sequence: Synthetic oligonucleotide
  Target: ATXN1; (-) strand; PAM type: YTN; PAM sequence: TTG
taggcacagtggcagcaggg

SEQ ID NO: 203823 - DNA, 20 bp, Artificial Sequence
  Description of Artificial Sequence: Synthetic oligonucleotide
  Target: ATXN1; (-) strand; PAM type: YTN; PAM sequence: CTG
aggggtcattgtaggcacag

SEQ ID NO: 203824 - DNA, 20 bp, Artificial Sequence
  Description of Artificial Sequence: Synthetic oligonucleotide
  Target: ATXN1; (-) strand; PAM type: YTN; PAM sequence: TTA
acaggatgtgtagtgatgat

SEQ ID NO: 203825 - DNA, 20 bp, Artificial Sequence
  Description of Artificial Sequence: Synthetic oligonucleotide
  Target: ATXN1; (-) strand; PAM type: YTN; PAM sequence: CTT
aacaggatgtgtagtgatga

SEQ ID NO: 203826 - DNA, 20 bp, Artificial Sequence
  Description of Artificial Sequence: Synthetic oligonucleotide
  Target: ATXN1; (-) strand; PAM type: YTN; PAM sequence: CTG
acagggaccttaacaggatg

SEQ ID NO: 203827 - DNA, 20 bp, Artificial Sequence
  Description of Artificial Sequence: Synthetic oligonucleotide
  Target: ATXN1; (-) strand; PAM type: YTN; PAM sequence: CTA
tgagaagcaaagcctgacag

SEQ ID NO: 203828 - DNA, 20 bp, Artificial Sequence
  Description of Artificial Sequence: Synthetic oligonucleotide
  Target: ATXN1; (-) strand; PAM type: YTN; PAM sequence: TTC
ctatgagaagcaaagcctga

SEQ ID NO: 203829 - DNA, 20 bp, Artificial Sequence
  Description of Artificial Sequence: Synthetic oligonucleotide
  Target: ATXN1; (-) strand; PAM type: YTN; PAM sequence: CTT
cctatgagaagcaaagcctg

SEQ ID NO: 203830 - DNA, 20 bp, Artificial Sequence
  Description of Artificial Sequence: Synthetic oligonucleotide
  Target: ATXN1; (-) strand; PAM type: YTN; PAM sequence: TTC
aggaagagcttcctatgaga

SEQ ID NO: 203831 - DNA, 20 bp, Artificial Sequence
  Description of Artificial Sequence: Synthetic oligonucleotide
  Target: ATXN1; (-) strand; PAM type: YTN; PAM sequence: CTT
caggaagagcttcctatgag

SEQ ID NO: 203832 - DNA, 20 bp, Artificial Sequence
  Description of Artificial Sequence: Synthetic oligonucleotide
  Target: ATXN1; (-) strand; PAM type: YTN; PAM sequence: TTG
gagtcttcaggaagagcttc

SEQ ID NO: 203833 - DNA, 20 bp, Artificial Sequence
  Description of Artificial Sequence: Synthetic oligonucleotide
  Target: ATXN1; (-) strand; PAM type: YTN; PAM sequence: CTG
gggattggagtcttcaggaa

SEQ ID NO: 203834 - DNA, 20 bp, Artificial Sequence
  Description of Artificial Sequence: Synthetic oligonucleotide
  Target: ATXN1; (-) strand; PAM type: YTN; PAM sequence: TTC
agaagaggaatgagaaatgg

SEQ ID NO: 203835 - DNA, 20 bp, Artificial Sequence
  Description of Artificial Sequence: Synthetic oligonucleotide
  Target: ATXN1; (-) strand; PAM type: YTN; PAM sequence: TTG
taatggggtgccagtgtcag

SEQ ID NO: 203836 - DNA, 20 bp, Artificial Sequence
  Description of Artificial Sequence: Synthetic oligonucleotide
  Target: ATXN1; (-) strand; PAM type: YTN; PAM sequence: TTT
gtaatggggtgccagtgtca

SEQ ID NO: 203837 - DNA, 20 bp, Artificial Sequence
  Description of Artificial Sequence: Synthetic oligonucleotide
  Target: ATXN1; (-) strand; PAM type: YTN; PAM sequence: CTG
agaatttgtaatggggtgcc

SEQ ID NO: 203838 - DNA, 20 bp, Artificial Sequence
  Description of Artificial Sequence: Synthetic oligonucleotide
  Target: ATXN1; (-) strand; PAM type: YTN; PAM sequence: TTA
tagagcaatccatgacaaca

SEQ ID NO: 203839 - DNA, 20 bp, Artificial Sequence
  Description of Artificial Sequence: Synthetic oligonucleotide
  Target: ATXN1; (-) strand; PAM type: YTN; PAM sequence: TTC
agggcacaataccaatccac

SEQ ID NO: 203840 - DNA, 20 bp, Artificial Sequence
  Description of Artificial Sequence: Synthetic oligonucleotide
  Target: ATXN1; (-) strand; PAM type: YTN; PAM sequence: CTA
gttcagggcacaataccaat

SEQ ID NO: 203841 - DNA, 20 bp, Artificial Sequence
  Description of Artificial Sequence: Synthetic oligonucleotide
  Target: ATXN1; (-) strand; PAM type: YTN; PAM sequence: CTC
catcaaaaaacaaaacaaaa

SEQ ID NO: 203842 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagtgagactcca

SEQ ID NO: 203843 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagtga

SEQ ID NO: 203844 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtgacag

SEQ ID NO: 203845 - DNA, 20 bp, Artificial Sequence
  Description of Artificial Sequence: Synthetic oligonucleotide
  Target: ATXN1; (-) strand; PAM type: YTN; PAM sequence: CTG
agatccggccactgcactcc

SEQ ID NO: 203846 - DNA, 20 bp, Artificial Sequence
  Description of Artificial Sequence: Synthetic oligonucleotide
  Target: ATXN1; (-) strand; PAM type: YTN; PAM sequence: TTG
cagtgagctgagatccggcc

SEQ ID NO: 203847 - DNA, 20 bp, Artificial Sequence
  Description of Artificial Sequence: Synthetic oligonucleotide
  Target: ATXN1; (-) strand; PAM type: YTN; PAM sequence: CTG
gaaggcagaggttgcagtga

SEQ ID NO: 203848 - DNA, 20 bp, Artificial Sequence
  Description of Artificial Sequence: Synthetic oligonucleotide
  Target: ATXN1; (-) strand; PAM type: YTN; PAM sequence: TTG
aacctggaaggcagaggttg

SEQ ID NO: 203849 - DNA, 20 bp, Artificial Sequence
  Description of Artificial Sequence: Synthetic oligonucleotide
  Target: ATXN1; (-) strand; PAM type: YTN; PAM sequence: CTT
gaacctggaaggcagaggtt

SEQ ID NO: 203850 - DNA, 20 bp, Artificial Sequence
  Description of Artificial Sequence: Synthetic oligonucleotide
  Target: ATXN1; (-) strand; PAM type: YTN; PAM sequence: TTG
cttgaacctggaaggcagag

SEQ ID NO: 203851 - DNA, 20 bp, Artificial Sequence
  Description of Artificial Sequence: Synthetic oligonucleotide
  Target: ATXN1; (-) strand; PAM type: YTN; PAM sequence: CTG
aggcaagagaattgcttgaa

SEQ ID NO: 203852 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaagagaat

SEQ ID NO: 203853 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaagagaa

SEQ ID NO: 203854 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcaaga

SEQ ID NO: 203855 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 203856 - DNA, 20 bp, Artificial Sequence
  Description of Artificial Sequence: Synthetic oligonucleotide
  Target: ATXN1; (-) strand; PAM type: YTN; PAM sequence: CTA
ggcatggtggtgtgtacctg

SEQ ID NO: 203857 - DNA, 20 bp, Artificial Sequence
  Description of Artificial Sequence: Synthetic oligonucleotide
  Target: ATXN1; (-) strand; PAM type: YTN; PAM sequence: TTA
gctaggcatggtggtgtgta

SEQ ID NO: 203858 - DNA, 20 bp, Artificial Sequence
  Description of Artificial Sequence: Synthetic oligonucleotide
  Target: ATXN1; (-) strand; PAM type: YTN; PAM sequence: CTC
aaataaataaataaataaat

SEQ ID NO: 203859 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaataaataaataa

SEQ ID NO: 203860 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcgagactccg

SEQ ID NO: 203861 - DNA, 20 bp, Artificial Sequence
  Description of Artificial Sequence: Synthetic oligonucleotide
  Target: ATXN1; (-) strand; PAM type: YTN; PAM sequence: CTG
catgccagcctgggcgacag

SEQ ID NO: 203862 - DNA, 20 bp, Artificial Sequence
  Description of Artificial Sequence: Synthetic oligonucleotide
  Target: ATXN1; (-) strand; PAM type: YTN; PAM sequence: TTG
cagtgagccgagatcgcgcc

SEQ ID NO: 203863 - DNA, 20 bp, Artificial Sequence
  Description of Artificial Sequence: Synthetic oligonucleotide
  Target: ATXN1; (-) strand; PAM type: YTN; PAM sequence: TTG
aaccccggaggcagaggttg

SEQ ID NO: 203864 - DNA, 20 bp, Artificial Sequence
  Description of Artificial Sequence: Synthetic oligonucleotide
  Target: ATXN1; (-) strand; PAM type: YTN; PAM sequence: CTT
gaaccccggaggcagaggtt

SEQ ID NO: 203865 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaagcacttgaa

SEQ ID NO: 203866 - DNA, 20 bp, Artificial Sequence
  Description of Artificial Sequence: Synthetic oligonucleotide
  Target: ATXN1; (-) strand; PAM type: YTN; PAM sequence: CTC
aagaggctgaggcaggagaa

SEQ ID NO: 203867 - DNA, 20 bp, Artificial Sequence
  Description of Artificial Sequence: Synthetic oligonucleotide
  Target: ATXN1; (-) strand; PAM type: YTN; PAM sequence: CTA
ctcaagaggctgaggcagga

SEQ ID NO: 203868 - DNA, 20 bp, Artificial Sequence
  Description of Artificial Sequence: Synthetic oligonucleotide
  Target: ATXN1; (-) strand; PAM type: YTN; PAM sequence: CTG
taatcccagctactcaagag

SEQ ID NO: 203869 - DNA, 20 bp, Artificial Sequence
  Description of Artificial Sequence: Synthetic oligonucleotide
  Target: ATXN1; (-) strand; PAM type: YTN; PAM sequence: CTG
ggcatggtggcgcatgcctg

SEQ ID NO: 203870 - DNA, 20 bp, Artificial Sequence
  Description of Artificial Sequence: Synthetic oligonucleotide
  Target: ATXN1; (-) strand; PAM type: YTN; PAM sequence: TTA
gctgggcatggtggcgcatg

SEQ ID NO: 203871 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaataaaattagc

SEQ ID NO: 203872 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaataaaatt

SEQ ID NO: 203873 - DNA, 20 bp, Artificial Sequence
  Description of Artificial Sequence: Synthetic oligonucleotide
  Target: ATXN1; (-) strand; PAM type: YTN; PAM sequence: TTC
tactaaaaatacaaataaaa

SEQ ID NO: 203874 - DNA, 20 bp, Artificial Sequence
  Description of Artificial Sequence: Synthetic oligonucleotide
  Target: ATXN1; (-) strand; PAM type: YTN; PAM sequence: TTT
ctactaaaaatacaaataaa

SEQ ID NO: 203875 - DNA, 20 bp, Artificial Sequence
  Description of Artificial Sequence: Synthetic oligonucleotide
  Target: ATXN1; (-) strand; PAM type: YTN; PAM sequence: CTG
agcaacatggagaaaccccg

SEQ ID NO: 203876 - DNA, 20 bp, Artificial Sequence
  Description of Artificial Sequence: Synthetic oligonucleotide
  Target: ATXN1; (-) strand; PAM type: YTN; PAM sequence: TTC
gagaccaccctgagcaacat

SEQ ID NO: 203877 - DNA, 20 bp, Artificial Sequence
  Description of Artificial Sequence: Synthetic oligonucleotide
  Target: ATXN1; (-) strand; PAM type: YTN; PAM sequence: CTG
aggtcgggagttcgagacca

SEQ ID NO: 203878 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcgggcggat

SEQ ID NO: 203879 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcgggcgga

SEQ ID NO: 203880 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcgggcgg

SEQ ID NO: 203881 - DNA, 20 bp, Artificial Sequence
  Description of Artificial Sequence: Synthetic oligonucleotide
  Target: ATXN1; (-) strand; PAM type: YTN; PAM sequence: CTG
taatcccaacactttgggag

SEQ ID NO: 203882 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatcccaacact

SEQ ID NO: 203883 - DNA, 20 bp, Artificial Sequence
  Description of Artificial Sequence: Synthetic oligonucleotide
  Target: ATXN1; (-) strand; PAM type: YTN; PAM sequence: TTA
ggccgggtgcggtggctcat

SEQ ID NO: 203884 - DNA, 20 bp, Artificial Sequence
  Description of Artificial Sequence: Synthetic oligonucleotide
  Target: ATXN1; (-) strand; PAM type: YTN; PAM sequence: CTG
aaaatacaaaaattaggccg

SEQ ID NO: 203885 - DNA, 20 bp, Artificial Sequence
  Description of Artificial Sequence: Synthetic oligonucleotide
  Target: ATXN1; (-) strand; PAM type: YTN; PAM sequence: CTA
ctgaaaatacaaaaattagg

SEQ ID NO: 203886 - DNA, 20 bp, Artificial Sequence
  Description of Artificial Sequence: Synthetic oligonucleotide
  Target: ATXN1; (-) strand; PAM type: YTN; PAM sequence: CTC
tactgaaaatacaaaaatta

SEQ ID NO: 203887 - DNA, 20 bp, Artificial Sequence
  Description of Artificial Sequence: Synthetic oligonucleotide
  Target: ATXN1; (-) strand; PAM type: YTN; PAM sequence: CTG
gccaacatggtgaaacccca

SEQ ID NO: 203888 - DNA, 20 bp, Artificial Sequence
  Description of Artificial Sequence: Synthetic oligonucleotide
  Target: ATXN1; (-) strand; PAM type: YTN; PAM sequence: TTG
aggtcaggagatcgagacca

SEQ ID NO: 203889 - DNA, 20 bp, Artificial Sequence
  Description of Artificial Sequence: Synthetic oligonucleotide
  Target: ATXN1; (-) strand; PAM type: YTN; PAM sequence: CTT
gaggtcaggagatcgagacc

SEQ ID NO: 203890 - DNA, 20 bp, Artificial Sequence
  Description of Artificial Sequence: Synthetic oligonucleotide
  Target: ATXN1; (-) strand; PAM type: YTN; PAM sequence: TTA
ggtaggccgaggtgggcaga

SEQ ID NO: 203891 - DNA, 20 bp, Artificial Sequence
  Description of Artificial Sequence: Synthetic oligonucleotide
  Target: ATXN1; (-) strand; PAM type: YTN; PAM sequence: CTT
aggtaggccgaggtgggcag

SEQ ID NO: 203892 - DNA, 20 bp, Artificial Sequence
  Description of Artificial Sequence: Synthetic oligonucleotide
  Target: ATXN1; (-) strand; PAM type: YTN; PAM sequence: TTG
acacttaggtaggccgaggt

SEQ ID NO: 203893 - DNA, 20 bp, Artificial Sequence
  Description of Artificial Sequence: Synthetic oligonucleotide
  Target: ATXN1; (-) strand; PAM type: YTN; PAM sequence: CTA
gttgacacttaggtaggccg

SEQ ID NO: 203894 - DNA, 20 bp, Artificial Sequence
  Description of Artificial Sequence: Synthetic oligonucleotide
  Target: ATXN1; (-) strand; PAM type: YTN; PAM sequence: TTC
aaaaaaacctagttgacact

SEQ ID NO: 203895 - DNA, 20 bp, Artificial Sequence
  Description of Artificial Sequence: Synthetic oligonucleotide
  Target: ATXN1; (-) strand; PAM type: YTN; PAM sequence: CTT
caaaaaaacctagttgacac

SEQ ID NO: 203896 - DNA, 20 bp, Artificial Sequence
  Description of Artificial Sequence: Synthetic oligonucleotide
  Target: ATXN1; (-) strand; PAM type: YTN; PAM sequence: TTA
tcttcaaaaaaacctagttg

SEQ ID NO: 203897 - DNA, 20 bp, Artificial Sequence
  Description of Artificial Sequence: Synthetic oligonucleotide
  Target: ATXN1; (-) strand; PAM type: YTN; PAM sequence: CTA
aaattatcttcaaaaaaacc

SEQ ID NO: 203898 - DNA, 20 bp, Artificial Sequence
  Description of Artificial Sequence: Synthetic oligonucleotide
  Target: ATXN1; (-) strand; PAM type: YTN; PAM sequence: CTG
taaatctaaaattatcttca

SEQ ID NO: 203899 - DNA, 20 bp, Artificial Sequence
  Description of Artificial Sequence: Synthetic oligonucleotide
  Target: ATXN1; (-) strand; PAM type: YTN; PAM sequence: TTC
tgtaaatctaaaattatctt

SEQ ID NO: 203900 - DNA, 20 bp, Artificial Sequence
  Description of Artificial Sequence: Synthetic oligonucleotide
  Target: ATXN1; (-) strand; PAM type: YTN; PAM sequence: TTT
ctgtaaatctaaaattatct

SEQ ID NO: 203901 - DNA, 20 bp, Artificial Sequence
  Description of Artificial Sequence: Synthetic oligonucleotide
  Target: ATXN1; (-) strand; PAM type: YTN; PAM sequence: CTT
tctgtaaatctaaaattatc

SEQ ID NO: 203902 - DNA, 20 bp, Artificial Sequence
  Description of Artificial Sequence: Synthetic oligonucleotide
  Target: ATXN1; (-) strand; PAM type: YTN; PAM sequence: TTG
ccgctttctgtaaatctaaa

SEQ ID NO: 203903 - DNA, 20 bp, Artificial Sequence
  Description of Artificial Sequence: Synthetic oligonucleotide
  Target: ATXN1; (-) strand; PAM type: YTN; PAM sequence: TTT
gccgctttctgtaaatctaa

SEQ ID NO: 203904 - DNA, 20 bp, Artificial Sequence
  Description of Artificial Sequence: Synthetic oligonucleotide
  Target: ATXN1; (-) strand; PAM type: YTN; PAM sequence: TTT
tgccgctttctgtaaatcta

SEQ ID NO: 203905 - DNA, 20 bp, Artificial Sequence
  Description of Artificial Sequence: Synthetic oligonucleotide
  Target: ATXN1; (-) strand; PAM type: YTN; PAM sequence: TTT
ttgccgctttctgtaaatct

SEQ ID NO: 203906 - DNA, 20 bp, Artificial Sequence
  Description of Artificial Sequence: Synthetic oligonucleotide
  Target: ATXN1; (-) strand; PAM type: YTN; PAM sequence: CTA
tttttgccgctttctgtaaa

SEQ ID NO: 203907 - DNA, 20 bp, Artificial Sequence
  Description of Artificial Sequence: Synthetic oligonucleotide
  Target: ATXN1; (-) strand; PAM type: YTN; PAM sequence: CTG
tactatttttgccgctttct

SEQ ID NO: 203908 - DNA, 20 bp, Artificial Sequence
  Description of Artificial Sequence: Synthetic oligonucleotide
  Target: ATXN1; (-) strand; PAM type: YTN; PAM sequence: CTC
tgtactatttttgccgcttt

SEQ ID NO: 203909 - DNA, 20 bp, Artificial Sequence
  Description of Artificial Sequence: Synthetic oligonucleotide
  Target: ATXN1; (-) strand; PAM type: YTN; PAM sequence: CTG
ggtggaaggtacaagggagc

SEQ ID NO: 203910 - DNA, 20 bp, Artificial Sequence
  Description of Artificial Sequence: Synthetic oligonucleotide
  Target: ATXN1; (-) strand; PAM type: YTN; PAM sequence: TTA
atatagggggaaactgggtg

SEQ ID NO: 203911 - DNA, 20 bp, Artificial Sequence
  Description of Artificial Sequence: Synthetic oligonucleotide
  Target: ATXN1; (-) strand; PAM type: YTN; PAM sequence: CTG
ttaatatagggggaaactgg

SEQ ID NO: 203912 - DNA, 20 bp, Artificial Sequence
  Description of Artificial Sequence: Synthetic oligonucleotide
  Target: ATXN1; (-) strand; PAM type: YTN; PAM sequence: TTG
taagctgttaatataggggg

SEQ ID NO: 203913 - DNA, 20 bp, Artificial Sequence
  Description of Artificial Sequence: Synthetic oligonucleotide
  Target: ATXN1; (-) strand; PAM type: YTN; PAM sequence: TTT
gtaagctgttaatatagggg

SEQ ID NO: 203914 - DNA, 20 bp, Artificial Sequence
  Description of Artificial Sequence: Synthetic oligonucleotide
  Target: ATXN1; (-) strand; PAM type: YTN; PAM sequence: CTT
tgtaagctgttaatataggg

SEQ ID NO: 203915 - DNA, 20 bp, Artificial Sequence
  Description of Artificial Sequence: Synthetic oligonucleotide
  Target: ATXN1; (-) strand; PAM type: YTN; PAM sequence: CTA
tggctttgtaagctgttaat

SEQ ID NO: 203916 - DNA, 20 bp, Artificial Sequence
  Description of Artificial Sequence: Synthetic oligonucleotide
  Target: ATXN1; (-) strand; PAM type: YTN; PAM sequence: TTC
tatggctttgtaagctgtta

SEQ ID NO: 203917 - DNA, 20 bp, Artificial Sequence
  Description of Artificial Sequence: Synthetic oligonucleotide
  Target: ATXN1; (-) strand; PAM type: YTN; PAM sequence: TTG
atcgtggttctatggctttg

SEQ ID NO: 203918 - DNA, 20 bp, Artificial Sequence
  Description of Artificial Sequence: Synthetic oligonucleotide
  Target: ATXN1; (-) strand; PAM type: YTN; PAM sequence: TTT
gatcgtggttctatggcttt

SEQ ID NO: 203919 - DNA, 20 bp, Artificial Sequence
  Description of Artificial Sequence: Synthetic oligonucleotide
  Target: ATXN1; (-) strand; PAM type: YTN; PAM sequence: TTT
tgatcgtggttctatggctt

SEQ ID NO: 203920 - DNA, 20 bp, Artificial Sequence
  Description of Artificial Sequence: Synthetic oligonucleotide
  Target: ATXN1; (-) strand; PAM type: YTN; PAM sequence: CTA
gttttgatcgtggttctatg

SEQ ID NO: 203921 - DNA, 20 bp, Artificial Sequence
  Description of Artificial Sequence: Synthetic oligonucleotide
  Target: ATXN1; (-) strand; PAM type: YTN; PAM sequence: TTC
tagttttgatcgtggttcta

SEQ ID NO: 203922 - DNA, 20 bp, Artificial Sequence
  Description of Artificial Sequence: Synthetic oligonucleotide
  Target: ATXN1; (-) strand; PAM type: YTN; PAM sequence: TTT
ctagttttgatcgtggttct

SEQ ID NO: 203923 - DNA, 20 bp, Artificial Sequence
  Description of Artificial Sequence: Synthetic oligonucleotide
  Target: ATXN1; (-) strand; PAM type: YTN; PAM sequence: CTT
tctagttttgatcgtggttc

SEQ ID NO: 203924 - DNA, 20 bp, Artificial Sequence
  Description of Artificial Sequence: Synthetic oligonucleotide
  Target: ATXN1; (-) strand; PAM type: YTN; PAM sequence: TTA
actttctagttttgatcgtg

SEQ ID NO: 203925 - DNA, 20 bp, Artificial Sequence
  Description of Artificial Sequence: Synthetic oligonucleotide
  Target: ATXN1; (-) strand; PAM type: YTN; PAM sequence: TTG
agtagtcgtgacccaggtta

SEQ ID NO: 203926 - DNA, 20 bp, Artificial Sequence
  Description of Artificial Sequence: Synthetic oligonucleotide
  Target: ATXN1; (-) strand; PAM type: YTN; PAM sequence: TTG
ttgagtagtcgtgacccagg

SEQ ID NO: 203927 - DNA, 20 bp, Artificial Sequence
  Description of Artificial Sequence: Synthetic oligonucleotide
  Target: ATXN1; (-) strand; PAM type: YTN; PAM sequence: TTT
gttgagtagtcgtgacccag

SEQ ID NO: 203928 - DNA, 20 bp, Artificial Sequence
  Description of Artificial Sequence: Synthetic oligonucleotide
  Target: ATXN1; (-) strand; PAM type: YTN; PAM sequence: CTA
cggtttgttgagtagtcgtg

SEQ ID NO: 203929 - DNA, 20 bp, Artificial Sequence
  Description of Artificial Sequence: Synthetic oligonucleotide
  Target: ATXN1; (-) strand; PAM type: YTN; PAM sequence: CTA
atacaccctacggtttgttg

SEQ ID NO: 203930 - DNA, 20 bp, Artificial Sequence
  Description of Artificial Sequence: Synthetic oligonucleotide
  Target: ATXN1; (-) strand; PAM type: YTN; PAM sequence: CTG
gtgaaatcctaatacaccct

SEQ ID NO: 203931 - DNA, 20 bp, Artificial Sequence
  Description of Artificial Sequence: Synthetic oligonucleotide
  Target: ATXN1; (-) strand; PAM type: YTN; PAM sequence: TTG
gtgcaaaaactggtgaaatc

SEQ ID NO: 203932 - DNA, 20 bp, Artificial Sequence
  Description of Artificial Sequence: Synthetic oligonucleotide
  Target: ATXN1; (-) strand; PAM type: YTN; PAM sequence: TTT
ggtgcaaaaactggtgaaat

SEQ ID NO: 203933 - DNA, 20 bp, Artificial Sequence
  Description of Artificial Sequence: Synthetic oligonucleotide
  Target: ATXN1; (-) strand; PAM type: YTN; PAM sequence: CTG
tttggtgcaaaaactggtga

SEQ ID NO: 203934 - DNA, 20 bp, Artificial Sequence
  Description of Artificial Sequence: Synthetic oligonucleotide
  Target: ATXN1; (-) strand; PAM type: YTN; PAM sequence: CTG
aaacaggaaaaaaaaaaaaa

SEQ ID NO: 203935 - DNA, 20 bp, Artificial Sequence
  Description of Artificial Sequence: Synthetic oligonucleotide
  Target: ATXN1; (-) strand; PAM type: YTN; PAM sequence: CTA
agtatgatcctgaaacagga

SEQ ID NO: 203936 - DNA, 20 bp, Artificial Sequence
  Description of Artificial Sequence: Synthetic oligonucleotide
  Target: ATXN1; (-) strand; PAM type: YTN; PAM sequence: TTC
taagtatgatcctgaaacag

SEQ ID NO: 203937 - DNA, 20 bp, Artificial Sequence
  Description of Artificial Sequence: Synthetic oligonucleotide
  Target: ATXN1; (-) strand; PAM type: YTN; PAM sequence: CTA
agaaatatgaccacataaaa

SEQ ID NO: 203938 - DNA, 20 bp, Artificial Sequence
  Description of Artificial Sequence: Synthetic oligonucleotide
  Target: ATXN1; (-) strand; PAM type: YTN; PAM sequence: TTA
gcagaaactaagaaatatga

SEQ ID NO: 203939 - DNA, 20 bp, Artificial Sequence
  Description of Artificial Sequence: Synthetic oligonucleotide
  Target: ATXN1; (-) strand; PAM type: YTN; PAM sequence: CTG
tcacagattagcagaaacta

SEQ ID NO: 203940 - DNA, 20 bp, Artificial Sequence
  Description of Artificial Sequence: Synthetic oligonucleotide
  Target: ATXN1; (-) strand; PAM type: YTN; PAM sequence: TTC
aggaactgtcacagattagc

SEQ ID NO: 203941 - DNA, 20 bp, Artificial Sequence
  Description of Artificial Sequence: Synthetic oligonucleotide
  Target: ATXN1; (-) strand; PAM type: YTN; PAM sequence: TTA
aggataaggaaggattcagg

SEQ ID NO: 203942 - DNA, 20 bp, Artificial Sequence
  Description of Artificial Sequence: Synthetic oligonucleotide
  Target: ATXN1; (-) strand; PAM type: YTN; PAM sequence: TTT
aaggataaggaaggattcag

SEQ ID NO: 203943 - DNA, 20 bp, Artificial Sequence
  Description of Artificial Sequence: Synthetic oligonucleotide
  Target: ATXN1; (-) strand; PAM type: YTN; PAM sequence: CTT
taaggataaggaaggattca

SEQ ID NO: 203944 - DNA, 20 bp, Artificial Sequence
  Description of Artificial Sequence: Synthetic oligonucleotide
  Target: ATXN1; (-) strand; PAM type: YTN; PAM sequence: TTG
tcaaggtctttaaggataag

SEQ ID NO: 203945 - DNA, 20 bp, Artificial Sequence
  Description of Artificial Sequence: Synthetic oligonucleotide
  Target: ATXN1; (-) strand; PAM type: YTN; PAM sequence: TTA
aaattgtcaaggtctttaag

SEQ ID NO: 203946 - DNA, 20 bp, Artificial Sequence
  Description of Artificial Sequence: Synthetic oligonucleotide
  Target: ATXN1; (-) strand; PAM type: YTN; PAM sequence: CTT
aaaattgtcaaggtctttaa

SEQ ID NO: 203947 - DNA, 20 bp, Artificial Sequence
  Description of Artificial Sequence: Synthetic oligonucleotide
  Target: ATXN1; (-) strand; PAM type: YTN; PAM sequence: CTC
cccttaaaattgtcaaggtc

SEQ ID NO: 203948 - DNA, 20 bp, Artificial Sequence
  Description of Artificial Sequence: Synthetic oligonucleotide
  Target: ATXN1; (-) strand; PAM type: YTN; PAM sequence: CTG
acccctccccttaaaattgt

SEQ ID NO: 203949 - DNA, 20 bp, Artificial Sequence
  Description of Artificial Sequence: Synthetic oligonucleotide
  Target: ATXN1; (-) strand; PAM type: YTN; PAM sequence: TTC
gaaaaaataactgacccctc

SEQ ID NO: 203950 - DNA, 20 bp, Artificial Sequence
  Description of Artificial Sequence: Synthetic oligonucleotide
  Target: ATXN1; (-) strand; PAM type: YTN; PAM sequence: CTC
aaatggaaggacattcgaaa

SEQ ID NO: 203951 - DNA, 20 bp, Artificial Sequence
  Description of Artificial Sequence: Synthetic oligonucleotide
  Target: ATXN1; (-) strand; PAM type: YTN; PAM sequence: CTA
atcaagaaaaaaatagcaaa

SEQ ID NO: 203952 - DNA, 20 bp, Artificial Sequence
  Description of Artificial Sequence: Synthetic oligonucleotide
  Target: ATXN1; (-) strand; PAM type: YTN; PAM sequence: CTC
taatcaagaaaaaaatagca

SEQ ID NO: 203953 - DNA, 20 bp, Artificial Sequence
  Description of Artificial Sequence: Synthetic oligonucleotide
  Target: ATXN1; (-) strand; PAM type: YTN; PAM sequence: CTC
actctaatcaagaaaaaaat

SEQ ID NO: 203954 - DNA, 20 bp, Artificial Sequence
  Description of Artificial Sequence: Synthetic oligonucleotide
  Target: ATXN1; (-) strand; PAM type: YTN; PAM sequence: CTG
aaaaggcataatctcactct

SEQ ID NO: 203955 - DNA, 20 bp, Artificial Sequence
  Description of Artificial Sequence: Synthetic oligonucleotide
  Target: ATXN1; (-) strand; PAM type: YTN; PAM sequence: CTC
cctgaaaaggcataatctca

SEQ ID NO: 203956 - DNA, 20 bp, Artificial Sequence
  Description of Artificial Sequence: Synthetic oligonucleotide
  Target: ATXN1; (-) strand; PAM type: YTN; PAM sequence: CTG
atatcctccctgaaaaggca

SEQ ID NO: 203957 - DNA, 20 bp, Artificial Sequence
  Description of Artificial Sequence: Synthetic oligonucleotide
  Target: ATXN1; (-) strand; PAM type: YTN; PAM sequence: CTC
tgatatcctccctgaaaagg

SEQ ID NO: 203958 - DNA, 20 bp, Artificial Sequence
  Description of Artificial Sequence: Synthetic oligonucleotide
  Target: ATXN1; (-) strand; PAM type: YTN; PAM sequence: CTG
agaagggcgtgtcatctctg

SEQ ID NO: 203959 - DNA, 20 bp, Artificial Sequence
  Description of Artificial Sequence: Synthetic oligonucleotide
  Target: ATXN1; (-) strand; PAM type: YTN; PAM sequence: TTG
acatcgtgtgtcccactgag

SEQ ID NO: 203960 - DNA, 20 bp, Artificial Sequence
  Description of Artificial Sequence: Synthetic oligonucleotide
  Target: ATXN1; (-) strand; PAM type: YTN; PAM sequence: TTA
atgtcaccagtgatacatat

SEQ ID NO: 203961 - DNA, 20 bp, Artificial Sequence
  Description of Artificial Sequence: Synthetic oligonucleotide
  Target: ATXN1; (-) strand; PAM type: YTN; PAM sequence: CTG
agtgatcaaggttaatgtca

SEQ ID NO: 203962 - DNA, 20 bp, Artificial Sequence
  Description of Artificial Sequence: Synthetic oligonucleotide
  Target: ATXN1; (-) strand; PAM type: YTN; PAM sequence: TTA
actgagtgatcaaggttaat

SEQ ID NO: 203963 - DNA, 20 bp, Artificial Sequence
  Description of Artificial Sequence: Synthetic oligonucleotide
  Target: ATXN1; (-) strand; PAM type: YTN; PAM sequence: CTT
aactgagtgatcaaggttaa

SEQ ID NO: 203964 - DNA, 20 bp, Artificial Sequence
  Description of Artificial Sequence: Synthetic oligonucleotide
  Target: ATXN1; (-) strand; PAM type: YTN; PAM sequence: CTG
gcagacatcaccttaactga

SEQ ID NO: 203965 - DNA, 20 bp, Artificial Sequence
  Description of Artificial Sequence: Synthetic oligonucleotide
  Target: ATXN1; (-) strand; PAM type: YTN; PAM sequence: TTA
cggtgaagaatcctggcaga

SEQ ID NO: 203966 - DNA, 20 bp, Artificial Sequence
  Description of Artificial Sequence: Synthetic oligonucleotide
  Target: ATXN1; (-) strand; PAM type: YTN; PAM sequence: TTT
acggtgaagaatcctggcag

SEQ ID NO: 203967 - DNA, 20 bp, Artificial Sequence
  Description of Artificial Sequence: Synthetic oligonucleotide
  Target: ATXN1; (-) strand; PAM type: YTN; PAM sequence: TTA
caaggagaaaaataaaagtt

SEQ ID NO: 203968 - DNA, 20 bp, Artificial Sequence
  Description of Artificial Sequence: Synthetic oligonucleotide
  Target: ATXN1; (-) strand; PAM type: YTN; PAM sequence: TTA
gtaattacaaggagaaaaat

SEQ ID NO: 203969 - DNA, 20 bp, Artificial Sequence
  Description of Artificial Sequence: Synthetic oligonucleotide
  Target: ATXN1; (-) strand; PAM type: YTN; PAM sequence: TTT
agtaattacaaggagaaaaa

SEQ ID NO: 203970 - DNA, 20 bp, Artificial Sequence
  Description of Artificial Sequence: Synthetic oligonucleotide
  Target: ATXN1; (-) strand; PAM type: YTN; PAM sequence: CTA
ccccaaacatttagtaatta

SEQ ID NO: 203971 - DNA, 20 bp, Artificial Sequence
  Description of Artificial Sequence: Synthetic oligonucleotide
  Target: ATXN1; (-) strand; PAM type: YTN; PAM sequence: TTA
aaatatccctaccccaaaca

SEQ ID NO: 203972 - DNA, 20 bp, Artificial Sequence
  Description of Artificial Sequence: Synthetic oligonucleotide
  Target: ATXN1; (-) strand; PAM type: YTN; PAM sequence: TTT
aaaatatccctaccccaaac

SEQ ID NO: 203973 - DNA, 20 bp, Artificial Sequence
  Description of Artificial Sequence: Synthetic oligonucleotide
  Target: ATXN1; (-) strand; PAM type: YTN; PAM sequence: TTT
taaaatatccctaccccaaa

SEQ ID NO: 203974 - DNA, 20 bp, Artificial Sequence
  Description of Artificial Sequence: Synthetic oligonucleotide
  Target: ATXN1; (-) strand; PAM type: YTN; PAM sequence: TTC
gtagaattttaaaatatccc

SEQ ID NO: 203975 - DNA, 20 bp, Artificial Sequence
  Description of Artificial Sequence: Synthetic oligonucleotide
  Target: ATXN1; (-) strand; PAM type: YTN; PAM sequence: TTA
gaatgagcgggcaaaagtat

SEQ ID NO: 203976 - DNA, 20 bp, Artificial Sequence
  Description of Artificial Sequence: Synthetic oligonucleotide
  Target: ATXN1; (-) strand; PAM type: YTN; PAM sequence: TTA
gatggattagaatgagcggg

SEQ ID NO: 203977 - DNA, 20 bp, Artificial Sequence
  Description of Artificial Sequence: Synthetic oligonucleotide
  Target: ATXN1; (-) strand; PAM type: YTN; PAM sequence: TTA
gatgggcagatgtggattag

SEQ ID NO: 203978 - DNA, 20 bp, Artificial Sequence
  Description of Artificial Sequence: Synthetic oligonucleotide
  Target: ATXN1; (-) strand; PAM type: YTN; PAM sequence: TTG
ccacgagaaagtcccaccga

SEQ ID NO: 203979 - DNA, 20 bp, Artificial Sequence
  Description of Artificial Sequence: Synthetic oligonucleotide
  Target: ATXN1; (-) strand; PAM type: YTN; PAM sequence: CTC
atagtaagaattgccacgag

SEQ ID NO: 203980 - DNA, 20 bp, Artificial Sequence
  Description of Artificial Sequence: Synthetic oligonucleotide
  Target: ATXN1; (-) strand; PAM type: YTN; PAM sequence: TTA
gaactcatagtaagaattgc

SEQ ID NO: 203981 - DNA, 20 bp, Artificial Sequence
  Description of Artificial Sequence: Synthetic oligonucleotide
  Target: ATXN1; (-) strand; PAM type: YTN; PAM sequence: TTA
ataaacaaacgaggaaggaa

SEQ ID NO: 203982 - DNA, 20 bp, Artificial Sequence
  Description of Artificial Sequence: Synthetic oligonucleotide
  Target: ATXN1; (-) strand; PAM type: YTN; PAM sequence: TTC
agttaataaacaaacgagga

SEQ ID NO: 203983 - DNA, 20 bp, Artificial Sequence
  Description of Artificial Sequence: Synthetic oligonucleotide
  Target: ATXN1; (-) strand; PAM type: YTN; PAM sequence: TTT
cagttaataaacaaacgagg

SEQ ID NO: 203984 - DNA, 20 bp, Artificial Sequence
  Description of Artificial Sequence: Synthetic oligonucleotide
  Target: ATXN1; (-) strand; PAM type: YTN; PAM sequence: CTG
cagcagaatttcagttaata

SEQ ID NO: 203985 - DNA, 20 bp, Artificial Sequence
  Description of Artificial Sequence: Synthetic oligonucleotide
  Target: ATXN1; (-) strand; PAM type: YTN; PAM sequence: TTC
cctgcagcagaatttcagtt

SEQ ID NO: 203986 - DNA, 20 bp, Artificial Sequence
  Description of Artificial Sequence: Synthetic oligonucleotide
  Target: ATXN1; (-) strand; PAM type: YTN; PAM sequence: CTT
ccctgcagcagaatttcagt

SEQ ID NO: 203987 - DNA, 20 bp, Artificial Sequence
  Description of Artificial Sequence: Synthetic oligonucleotide
  Target: ATXN1; (-) strand; PAM type: YTN; PAM sequence: CTC
ttccctgcagcagaatttca

SEQ ID NO: 203988 - DNA, 20 bp, Artificial Sequence
  Description of Artificial Sequence: Synthetic oligonucleotide
  Target: ATXN1; (-) strand; PAM type: YTN; PAM sequence: TTA
taacccaaagaataaaatat

SEQ ID NO: 203989 - DNA, 20 bp, Artificial Sequence
  Description of Artificial Sequence: Synthetic oligonucleotide
  Target: ATXN1; (-) strand; PAM type: YTN; PAM sequence: CTG
gattataacccaaagaataa

SEQ ID NO: 203990 - DNA, 20 bp, Artificial Sequence
  Description of Artificial Sequence: Synthetic oligonucleotide
  Target: ATXN1; (-) strand; PAM type: YTN; PAM sequence: CTG
ggtaaggaaataaatgctgg

SEQ ID NO: 203991 - DNA, 20 bp, Artificial Sequence
  Description of Artificial Sequence: Synthetic oligonucleotide
  Target: ATXN1; (-) strand; PAM type: YTN; PAM sequence: TTA
gaataactgggtaaggaaat

SEQ ID NO: 203992 - DNA, 20 bp, Artificial Sequence
  Description of Artificial Sequence: Synthetic oligonucleotide
  Target: ATXN1; (-) strand; PAM type: YTN; PAM sequence: CTT
agaataactgggtaaggaaa

SEQ ID NO: 203993 - DNA, 20 bp, Artificial Sequence
  Description of Artificial Sequence: Synthetic oligonucleotide
  Target: ATXN1; (-) strand; PAM type: YTN; PAM sequence: CTA
cagcttagaataactgggta

SEQ ID NO: 203994 - DNA, 20 bp, Artificial Sequence
  Description of Artificial Sequence: Synthetic oligonucleotide
  Target: ATXN1; (-) strand; PAM type: YTN; PAM sequence: CTA
gctacagcttagaataactg

SEQ ID NO: 203995 - DNA, 20 bp, Artificial Sequence
  Description of Artificial Sequence: Synthetic oligonucleotide
  Target: ATXN1; (-) strand; PAM type: YTN; PAM sequence: CTG
aaatggtagaatatctagct

SEQ ID NO: 203996 - DNA, 20 bp, Artificial Sequence
  Description of Artificial Sequence: Synthetic oligonucleotide
  Target: ATXN1; (-) strand; PAM type: YTN; PAM sequence: CTC
tgaaatggtagaatatctag

SEQ ID NO: 203997 - DNA, 20 bp, Artificial Sequence
  Description of Artificial Sequence: Synthetic oligonucleotide
  Target: ATXN1; (-) strand; PAM type: YTN; PAM sequence: CTG
ctctgaaatggtagaatatc

SEQ ID NO: 203998 - DNA, 20 bp, Artificial Sequence
  Description of Artificial Sequence: Synthetic oligonucleotide
  Target: ATXN1; (-) strand; PAM type: YTN; PAM sequence: CTG
tgtctgctctgaaatggtag

SEQ ID NO: 203999 - DNA, 20 bp, Artificial Sequence
  Description of Artificial Sequence: Synthetic oligonucleotide
  Target: ATXN1; (-) strand; PAM type: YTN; PAM sequence: CTG
taacacaggacacaatgtgg

SEQ ID NO: 204000 - DNA, 20 bp, Artificial Sequence
  Description of Artificial Sequence: Synthetic oligonucleotide
  Target: ATXN1; (-) strand; PAM type: YTN; PAM sequence: TTA
agacatgagggacaacctgt

SEQ ID NO: 204001 - DNA, 20 bp, Artificial Sequence
  Description of Artificial Sequence: Synthetic oligonucleotide
  Target: ATXN1; (-) strand; PAM type: YTN; PAM sequence: CTT
aagacatgagggacaacctg

SEQ ID NO: 204002 - DNA, 20 bp, Artificial Sequence
  Description of Artificial Sequence: Synthetic oligonucleotide
  Target: ATXN1; (-) strand; PAM type: YTN; PAM sequence: TTG
tcttaagacatgagggacaa

SEQ ID NO: 204003 - DNA, 20 bp, Artificial Sequence
  Description of Artificial Sequence: Synthetic oligonucleotide
  Target: ATXN1; (-) strand; PAM type: YTN; PAM sequence: CTT
gtcttaagacatgagggaca

SEQ ID NO: 204004 - DNA, 20 bp, Artificial Sequence
  Description of Artificial Sequence: Synthetic oligonucleotide
  Target: ATXN1; (-) strand; PAM type: YTN; PAM sequence: TTC
ttgtcttaagacatgaggga

SEQ ID NO: 204005 - DNA, 20 bp, Artificial Sequence
  Description of Artificial Sequence: Synthetic oligonucleotide
  Target: ATXN1; (-) strand; PAM type: YTN; PAM sequence: CTG
ttcttgtcttaagacatgag

SEQ ID NO: 204006 - DNA, 20 bp, Artificial Sequence
  Description of Artificial Sequence: Synthetic oligonucleotide
  Target: ATXN1; (-) strand; PAM type: YTN; PAM sequence: CTG
tgtgcctgttcttgtcttaa

SEQ ID NO: 204007 - DNA, 20 bp, Artificial Sequence
  Description of Artificial Sequence: Synthetic oligonucleotide
  Target: ATXN1; (-) strand; PAM type: YTN; PAM sequence: CTG
aatacccgctgtgtgcctgt

SEQ ID NO: 204008 - DNA, 20 bp, Artificial Sequence
  Description of Artificial Sequence: Synthetic oligonucleotide
  Target: ATXN1; (-) strand; PAM type: YTN; PAM sequence: CTG
tcaaatgaatgaacagatga

SEQ ID NO: 204009 - DNA, 20 bp, Artificial Sequence
  Description of Artificial Sequence: Synthetic oligonucleotide
  Target: ATXN1; (-) strand; PAM type: YTN; PAM sequence: CTC
aagataacctgtcaaatgaa

SEQ ID NO: 204010 - DNA, 20 bp, Artificial Sequence
  Description of Artificial Sequence: Synthetic oligonucleotide
  Target: ATXN1; (-) strand; PAM type: YTN; PAM sequence: CTA
acacaaggccctcaagataa

SEQ ID NO: 204011 - DNA, 20 bp, Artificial Sequence
  Description of Artificial Sequence: Synthetic oligonucleotide
  Target: ATXN1; (-) strand; PAM type: YTN; PAM sequence: CTA
acacctaacacaaggccctc

SEQ ID NO: 204012 - DNA, 20 bp, Artificial Sequence
  Description of Artificial Sequence: Synthetic oligonucleotide
  Target: ATXN1; (-) strand; PAM type: YTN; PAM sequence: CTC
taacacctaacacaaggccc

SEQ ID NO: 204013 - DNA, 20 bp, Artificial Sequence
  Description of Artificial Sequence: Synthetic oligonucleotide
  Target: ATXN1; (-) strand; PAM type: YTN; PAM sequence: TTG
taactctaacacctaacaca

SEQ ID NO: 204014 - DNA, 20 bp, Artificial Sequence
  Description of Artificial Sequence: Synthetic oligonucleotide
  Target: ATXN1; (-) strand; PAM type: YTN; PAM sequence: CTT
gtaactctaacacctaacac

SEQ ID NO: 204015 - DNA, 20 bp, Artificial Sequence
  Description of Artificial Sequence: Synthetic oligonucleotide
  Target: ATXN1; (-) strand; PAM type: YTN; PAM sequence: TTC
ttgtaactctaacacctaac

SEQ ID NO: 204016 - DNA, 20 bp, Artificial Sequence
  Description of Artificial Sequence: Synthetic oligonucleotide
  Target: ATXN1; (-) strand; PAM type: YTN; PAM sequence: TTT
cttgtaactctaacacctaa

SEQ ID NO: 204017 - DNA, 20 bp, Artificial Sequence
  Description of Artificial Sequence: Synthetic oligonucleotide
  Target: ATXN1; (-) strand; PAM type: YTN; PAM sequence: TTA
tttcttgtaactctaacacc

SEQ ID NO: 204018 - DNA, 20 bp, Artificial Sequence
  Description of Artificial Sequence: Synthetic oligonucleotide
  Target: ATXN1; (-) strand; PAM type: YTN; PAM sequence: TTT
atttcttgtaactctaacac

SEQ ID NO: 204019 - DNA, 20 bp, Artificial Sequence
  Description of Artificial Sequence: Synthetic oligonucleotide
  Target: ATXN1; (-) strand; PAM type: YTN; PAM sequence: TTT
tatttcttgtaactctaaca

SEQ ID NO: 204020 - DNA, 20 bp, Artificial Sequence
  Description of Artificial Sequence: Synthetic oligonucleotide
  Target: ATXN1; (-) strand; PAM type: YTN; PAM sequence: TTG
ttttatttcttgtaactcta

SEQ ID NO: 204021 - DNA, 20 bp, Artificial Sequence
  Description of Artificial Sequence: Synthetic oligonucleotide
  Target: ATXN1; (-) strand; PAM type: YTN; PAM sequence: CTC
ggacagaggaattgttttat

SEQ ID NO: 204022 - DNA, 20 bp, Artificial Sequence
  Description of Artificial Sequence: Synthetic oligonucleotide
  Target: ATXN1; (-) strand; PAM type: YTN; PAM sequence: CTG
taaaccactcggacagagga

SEQ ID NO: 204023 - DNA, 20 bp, Artificial Sequence
  Description of Artificial Sequence: Synthetic oligonucleotide
  Target: ATXN1; (-) strand; PAM type: YTN; PAM sequence: CTA
ggctgtaaaccactcggaca

SEQ ID NO: 204024 - DNA, 20 bp, Artificial Sequence
  Description of Artificial Sequence: Synthetic oligonucleotide
  Target: ATXN1; (-) strand; PAM type: YTN; PAM sequence: CTA
actaggctgtaaaccactcg

SEQ ID NO: 204025 - DNA, 20 bp, Artificial Sequence
  Description of Artificial Sequence: Synthetic oligonucleotide
  Target: ATXN1; (-) strand; PAM type: YTN; PAM sequence: TTC
taactaggctgtaaaccact

SEQ ID NO: 204026 - DNA, 20 bp, Artificial Sequence
  Description of Artificial Sequence: Synthetic oligonucleotide
  Target: ATXN1; (-) strand; PAM type: YTN; PAM sequence: CTT
ctaactaggctgtaaaccac

SEQ ID NO: 204027 - DNA, 20 bp, Artificial Sequence
  Description of Artificial Sequence: Synthetic oligonucleotide
  Target: ATXN1; (-) strand; PAM type: YTN; PAM sequence: CTC
ttctaactaggctgtaaacc

SEQ ID NO: 204028 - DNA, 20 bp, Artificial Sequence
  Description of Artificial Sequence: Synthetic oligonucleotide
  Target: ATXN1; (-) strand; PAM type: YTN; PAM sequence: CTG
taggtctcttctaactaggc

SEQ ID NO: 204029 - DNA, 20 bp, Artificial Sequence
  Description of Artificial Sequence: Synthetic oligonucleotide
  Target: ATXN1; (-) strand; PAM type: YTN; PAM sequence: TTG
caaatgtgcctgtaggtctc

SEQ ID NO: 204030 - DNA, 20 bp, Artificial Sequence
  Description of Artificial Sequence: Synthetic oligonucleotide
  Target: ATXN1; (-) strand; PAM type: YTN; PAM sequence: CTT
gcaaatgtgcctgtaggtct

SEQ ID NO: 204031 - DNA, 20 bp, Artificial Sequence
  Description of Artificial Sequence: Synthetic oligonucleotide
  Target: ATXN1; (-) strand; PAM type: YTN; PAM sequence: TTA
ataaggacttgcaaatgtgc

SEQ ID NO: 204032 - DNA, 20 bp, Artificial Sequence
  Description of Artificial Sequence: Synthetic oligonucleotide
  Target: ATXN1; (-) strand; PAM type: YTN; PAM sequence: TTT
aataaggacttgcaaatgtg

SEQ ID NO: 204033 - DNA, 20 bp, Artificial Sequence
  Description of Artificial Sequence: Synthetic oligonucleotide
  Target: ATXN1; (-) strand; PAM type: YTN; PAM sequence: TTT
taataaggacttgcaaatgt

SEQ ID NO: 204034 - DNA, 20 bp, Artificial Sequence
  Description of Artificial Sequence: Synthetic oligonucleotide
  Target: ATXN1; (-) strand; PAM type: YTN; PAM sequence: CTT
ttaataaggacttgcaaatg

SEQ ID NO: 204035 - DNA, 20 bp, Artificial Sequence
  Description of Artificial Sequence: Synthetic oligonucleotide
  Target: ATXN1; (-) strand; PAM type: YTN; PAM sequence: CTA
atacttttaataaggacttg

SEQ ID NO: 204036 - DNA, 20 bp, Artificial Sequence
  Description of Artificial Sequence: Synthetic oligonucleotide
  Target: ATXN1; (-) strand; PAM type: YTN; PAM sequence: TTG
cctaatacttttaataagga

SEQ ID NO: 204037 - DNA, 20 bp, Artificial Sequence
  Description of Artificial Sequence: Synthetic oligonucleotide
  Target: ATXN1; (-) strand; PAM type: YTN; PAM sequence: CTT
gcctaatacttttaataagg

SEQ ID NO: 204038 - DNA, 20 bp, Artificial Sequence
  Description of Artificial Sequence: Synthetic oligonucleotide
  Target: ATXN1; (-) strand; PAM type: YTN; PAM sequence: CTG
tacttgcctaatacttttaa

SEQ ID NO: 204039 - DNA, 20 bp, Artificial Sequence
  Description of Artificial Sequence: Synthetic oligonucleotide
  Target: ATXN1; (-) strand; PAM type: YTN; PAM sequence: TTG
ctgtacttgcctaatacttt

SEQ ID NO: 204040 - DNA, 20 bp, Artificial Sequence
  Description of Artificial Sequence: Synthetic oligonucleotide
  Target: ATXN1; (-) strand; PAM type: YTN; PAM sequence: CTG
ggccattgctgtacttgcct

SEQ ID NO: 204041 - DNA, 20 bp, Artificial Sequence
  Description of Artificial Sequence: Synthetic oligonucleotide
  Target: ATXN1; (-) strand; PAM type: YTN; PAM sequence: TTC
tgggccattgctgtacttgc

SEQ ID NO: 204042 - DNA, 20 bp, Artificial Sequence
  Description of Artificial Sequence: Synthetic oligonucleotide
  Target: ATXN1; (-) strand; PAM type: YTN; PAM sequence: CTT
ctgggccattgctgtacttg

SEQ ID NO: 204043 - DNA, 20 bp, Artificial Sequence
  Description of Artificial Sequence: Synthetic oligonucleotide
  Target: ATXN1; (-) strand; PAM type: YTN; PAM sequence: TTC
ttctgggccattgctgtact

SEQ ID NO: 204044 - DNA, 20 bp, Artificial Sequence
  Description of Artificial Sequence: Synthetic oligonucleotide
  Target: ATXN1; (-) strand; PAM type: YTN; PAM sequence: TTT
cttctgggccattgctgtac

SEQ ID NO: 204045 - DNA, 20 bp, Artificial Sequence
  Description of Artificial Sequence: Synthetic oligonucleotide
  Target: ATXN1; (-) strand; PAM type: YTN; PAM sequence: TTT
tcttctgggccattgctgta

SEQ ID NO: 204046 - DNA, 20 bp, Artificial Sequence
  Description of Artificial Sequence: Synthetic oligonucleotide
  Target: ATXN1; (-) strand; PAM type: YTN; PAM sequence: CTA
tgttttcttctgggccattg

SEQ ID NO: 204047 - DNA, 20 bp, Artificial Sequence
  Description of Artificial Sequence: Synthetic oligonucleotide
  Target: ATXN1; (-) strand; PAM type: YTN; PAM sequence: TTG
actatgttttcttctgggcc

SEQ ID NO: 204048 - DNA, 20 bp, Artificial Sequence
  Description of Artificial Sequence: Synthetic oligonucleotide
  Target: ATXN1; (-) strand; PAM type: YTN; PAM sequence: CTC
caggtagagttgactatgtt

SEQ ID NO: 204049 - DNA, 20 bp, Artificial Sequence
  Description of Artificial Sequence: Synthetic oligonucleotide
  Target: ATXN1; (-) strand; PAM type: YTN; PAM sequence: TTC
tccaggtagagttgactatg

SEQ ID NO: 204050 - DNA, 20 bp, Artificial Sequence
  Description of Artificial Sequence: Synthetic oligonucleotide
  Target: ATXN1; (-) strand; PAM type: YTN; PAM sequence: TTT
ctccaggtagagttgactat

SEQ ID NO: 204051 - DNA, 20 bp, Artificial Sequence
  Description of Artificial Sequence: Synthetic oligonucleotide
  Target: ATXN1; (-) strand; PAM type: YTN; PAM sequence: TTT
tctccaggtagagttgacta

SEQ ID NO: 204052 - DNA, 20 bp, Artificial Sequence
  Description of Artificial Sequence: Synthetic oligonucleotide
  Target: ATXN1; (-) strand; PAM type: YTN; PAM sequence: TTT
ttctccaggtagagttgact

SEQ ID NO: 204053 - DNA, 20 bp, Artificial Sequence
  Description of Artificial Sequence: Synthetic oligonucleotide
  Target: ATXN1; (-) strand; PAM type: YTN; PAM sequence: CTT
tttctccaggtagagttgac

SEQ ID NO: 204054 - DNA, 20 bp, Artificial Sequence
  Description of Artificial Sequence: Synthetic oligonucleotide
  Target: ATXN1; (-) strand; PAM type: YTN; PAM sequence: TTG
ccacacccctttttctccag

SEQ ID NO: 204055 - DNA, 20 bp, Artificial Sequence
  Description of Artificial Sequence: Synthetic oligonucleotide
  Target: ATXN1; (-) strand; PAM type: YTN; PAM sequence: CTA
ccaattgccacacccctttt

SEQ ID NO: 204056 - DNA, 20 bp, Artificial Sequence
  Description of Artificial Sequence: Synthetic oligonucleotide
  Target: ATXN1; (-) strand; PAM type: YTN; PAM sequence: CTG
cctaccaattgccacacccc

SEQ ID NO: 204057 - DNA, 20 bp, Artificial Sequence
  Description of Artificial Sequence: Synthetic oligonucleotide
  Target: ATXN1; (-) strand; PAM type: YTN; PAM sequence: TTC
ctgcctaccaattgccacac

SEQ ID NO: 204058 - DNA, 20 bp, Artificial Sequence
  Description of Artificial Sequence: Synthetic oligonucleotide
  Target: ATXN1; (-) strand; PAM type: YTN; PAM sequence: TTT
cctgcctaccaattgccaca

SEQ ID NO: 204059 - DNA, 20 bp, Artificial Sequence
  Description of Artificial Sequence: Synthetic oligonucleotide
  Target: ATXN1; (-) strand; PAM type: YTN; PAM sequence: CTT
tcctgcctaccaattgccac

SEQ ID NO: 204060 - DNA, 20 bp, Artificial Sequence
  Description of Artificial Sequence: Synthetic oligonucleotide
  Target: ATXN1; (-) strand; PAM type: YTN; PAM sequence: TTA
aggaagtctttcctgcctac

SEQ ID NO: 204061 - DNA, 20 bp, Artificial Sequence
  Description of Artificial Sequence: Synthetic oligonucleotide
  Target: ATXN1; (-) strand; PAM type: YTN; PAM sequence: CTT
aaggaagtctttcctgccta

SEQ ID NO: 204062 - DNA, 20 bp, Artificial Sequence
  Description of Artificial Sequence: Synthetic oligonucleotide
  Target: ATXN1; (-) strand; PAM type: YTN; PAM sequence: TTG
gtcttaaggaagtctttcct

SEQ ID NO: 204063 - DNA, 20 bp, Artificial Sequence
  Description of Artificial Sequence: Synthetic oligonucleotide
  Target: ATXN1; (-) strand; PAM type: YTN; PAM sequence: CTT
ggtcttaaggaagtctttcc

SEQ ID NO: 204064 - DNA, 20 bp, Artificial Sequence
  Description of Artificial Sequence: Synthetic oligonucleotide
  Target: ATXN1; (-) strand; PAM type: YTN; PAM sequence: CTG
cttggtcttaaggaagtctt

SEQ ID NO: 204065 - DNA, 20 bp, Artificial Sequence
  Description of Artificial Sequence: Synthetic oligonucleotide
  Target: ATXN1; (-) strand; PAM type: YTN; PAM sequence: TTA
tagagcaagcagtacaatag

SEQ ID NO: 204066 - DNA, 20 bp, Artificial Sequence
  Description of Artificial Sequence: Synthetic oligonucleotide
  Target: ATXN1; (-) strand; PAM type: YTN; PAM sequence: TTT
atagagcaagcagtacaata

SEQ ID NO: 204067 - DNA, 20 bp, Artificial Sequence
  Description of Artificial Sequence: Synthetic oligonucleotide
  Target: ATXN1; (-) strand; PAM type: YTN; PAM sequence: TTT
tatagagcaagcagtacaat

SEQ ID NO: 204068 - DNA, 20 bp, Artificial Sequence
  Description of Artificial Sequence: Synthetic oligonucleotide
  Target: ATXN1; (-) strand; PAM type: YTN; PAM sequence: TTT
ttatagagcaagcagtacaa

SEQ ID NO: 204069 - DNA, 20 bp, Artificial Sequence
  Description of Artificial Sequence: Synthetic oligonucleotide
  Target: ATXN1; (-) strand; PAM type: YTN; PAM sequence: TTG
atttttatagagcaagcagt

SEQ ID NO: 204070 - DNA, 20 bp, Artificial Sequence
  Description of Artificial Sequence: Synthetic oligonucleotide
  Target: ATXN1; (-) strand; PAM type: YTN; PAM sequence: TTA
tatgcccattgatttttata

SEQ ID NO: 204071 - DNA, 20 bp, Artificial Sequence
  Description of Artificial Sequence: Synthetic oligonucleotide
  Target: ATXN1; (-) strand; PAM type: YTN; PAM sequence: TTT
atatgcccattgatttttat

SEQ ID NO: 204072 - DNA, 20 bp, Artificial Sequence
  Description of Artificial Sequence: Synthetic oligonucleotide
  Target: ATXN1; (-) strand; PAM type: YTN; PAM sequence: TTT
tatatgcccattgattttta

SEQ ID NO: 204073 - DNA, 20 bp, Artificial Sequence
  Description of Artificial Sequence: Synthetic oligonucleotide
  Target: ATXN1; (-) strand; PAM type: YTN; PAM sequence: CTA
gaaattttatatgcccattg

SEQ ID NO: 204074 - DNA, 20 bp, Artificial Sequence
  Description of Artificial Sequence: Synthetic oligonucleotide
  Target: ATXN1; (-) strand; PAM type: YTN; PAM sequence: CTC
tagaaattttatatgcccat

SEQ ID NO: 204075 - DNA, 20 bp, Artificial Sequence
  Description of Artificial Sequence: Synthetic oligonucleotide
  Target: ATXN1; (-) strand; PAM type: YTN; PAM sequence: CTG
tgtgatggcgtgtgtctcta

SEQ ID NO: 204076 - DNA, 20 bp, Artificial Sequence
  Description of Artificial Sequence: Synthetic oligonucleotide
  Target: ATXN1; (-) strand; PAM type: YTN; PAM sequence: CTA
actgtgtgatggcgtgtgtc

SEQ ID NO: 204077 - DNA, 20 bp, Artificial Sequence
  Description of Artificial Sequence: Synthetic oligonucleotide
  Target: ATXN1; (-) strand; PAM type: YTN; PAM sequence: CTG
ctaactgtgtgatggcgtgt

SEQ ID NO: 204078 - DNA, 20 bp, Artificial Sequence
  Description of Artificial Sequence: Synthetic oligonucleotide
  Target: ATXN1; (-) strand; PAM type: YTN; PAM sequence: TTG
gagtacctgctaactgtgtg

SEQ ID NO: 204079 - DNA, 20 bp, Artificial Sequence
  Description of Artificial Sequence: Synthetic oligonucleotide
  Target: ATXN1; (-) strand; PAM type: YTN; PAM sequence: CTT
ggagtacctgctaactgtgt

SEQ ID NO: 204080 - DNA, 20 bp, Artificial Sequence
  Description of Artificial Sequence: Synthetic oligonucleotide
  Target: ATXN1; (-) strand; PAM type: YTN; PAM sequence: TTC
aggggcttggagtacctgct

SEQ ID NO: 204081 - DNA, 20 bp, Artificial Sequence
  Description of Artificial Sequence: Synthetic oligonucleotide
  Target: ATXN1; (-) strand; PAM type: YTN; PAM sequence: TTA
gaagattcaggggcttggag

SEQ ID NO: 204082 - DNA, 20 bp, Artificial Sequence
  Description of Artificial Sequence: Synthetic oligonucleotide
  Target: ATXN1; (-) strand; PAM type: YTN; PAM sequence: TTT
agaagattcaggggcttgga

SEQ ID NO: 204083 - DNA, 20 bp, Artificial Sequence
  Description of Artificial Sequence: Synthetic oligonucleotide
  Target: ATXN1; (-) strand; PAM type: YTN; PAM sequence: TTA
gtttagaagattcaggggct

SEQ ID NO: 204084 - DNA, 20 bp, Artificial Sequence
  Description of Artificial Sequence: Synthetic oligonucleotide
  Target: ATXN1; (-) strand; PAM type: YTN; PAM sequence: TTG
atgtggggaattagtttaga

SEQ ID NO: 204085 - DNA, 20 bp, Artificial Sequence
  Description of Artificial Sequence: Synthetic oligonucleotide
  Target: ATXN1; (-) strand; PAM type: YTN; PAM sequence: TTT
gatgtggggaattagtttag

SEQ ID NO: 204086 - DNA, 20 bp, Artificial Sequence
  Description of Artificial Sequence: Synthetic oligonucleotide
  Target: ATXN1; (-) strand; PAM type: YTN; PAM sequence: TTG
aggtttgatgtggggaatta

SEQ ID NO: 204087 - DNA, 20 bp, Artificial Sequence
  Description of Artificial Sequence: Synthetic oligonucleotide
  Target: ATXN1; (-) strand; PAM type: YTN; PAM sequence: CTT
gaggtttgatgtggggaatt

SEQ ID NO: 204088 - DNA, 20 bp, Artificial Sequence
  Description of Artificial Sequence: Synthetic oligonucleotide
  Target: ATXN1; (-) strand; PAM type: YTN; PAM sequence: CTA
aatagtgtgcccttgaggtt

SEQ ID NO: 204089 - DNA, 20 bp, Artificial Sequence
  Description of Artificial Sequence: Synthetic oligonucleotide
  Target: ATXN1; (-) strand; PAM type: YTN; PAM sequence: TTC
ctaaatagtgtgcccttgag

SEQ ID NO: 204090 - DNA, 20 bp, Artificial Sequence
  Description of Artificial Sequence: Synthetic oligonucleotide
  Target: ATXN1; (-) strand; PAM type: YTN; PAM sequence: CTT
cctaaatagtgtgcccttga

SEQ ID NO: 204091 - DNA, 20 bp, Artificial Sequence
  Description of Artificial Sequence: Synthetic oligonucleotide
  Target: ATXN1; (-) strand; PAM type: YTN; PAM sequence: TTA
aatcttcctaaatagtgtgc

SEQ ID NO: 204092 - DNA, 20 bp, Artificial Sequence
  Description of Artificial Sequence: Synthetic oligonucleotide
  Target: ATXN1; (-) strand; PAM type: YTN; PAM sequence: TTG
cattaaatcttcctaaatag

SEQ ID NO: 204093 - DNA, 20 bp, Artificial Sequence
  Description of Artificial Sequence: Synthetic oligonucleotide
  Target: ATXN1; (-) strand; PAM type: YTN; PAM sequence: TTA
ttgcattaaatcttcctaaa

SEQ ID NO: 204094 - DNA, 20 bp, Artificial Sequence
  Description of Artificial Sequence: Synthetic oligonucleotide
  Target: ATXN1; (-) strand; PAM type: YTN; PAM sequence: TTT
attgcattaaatcttcctaa

SEQ ID NO: 204095 - DNA, 20 bp, Artificial Sequence
  Description of Artificial Sequence: Synthetic oligonucleotide
  Target: ATXN1; (-) strand; PAM type: YTN; PAM sequence: CTG
agtttattgcattaaatctt

SEQ ID NO: 204096 - DNA, 20 bp, Artificial Sequence
  Description of Artificial Sequence: Synthetic oligonucleotide
  Target: ATXN1; (-) strand; PAM type: YTN; PAM sequence: CTA
tataaagagtctgagtttat

SEQ ID NO: 204097 - DNA, 20 bp, Artificial Sequence
  Description of Artificial Sequence: Synthetic oligonucleotide
  Target: ATXN1; (-) strand; PAM type: YTN; PAM sequence: CTA
gaaaagcacatagtcactat

SEQ ID NO: 204098 - DNA, 20 bp, Artificial Sequence
  Description of Artificial Sequence: Synthetic oligonucleotide
  Target: ATXN1; (-) strand; PAM type: YTN; PAM sequence: TTC
ctagaaaagcacatagtcac

SEQ ID NO: 204099 - DNA, 20 bp, Artificial Sequence
  Description of Artificial Sequence: Synthetic oligonucleotide
  Target: ATXN1; (-) strand; PAM type: YTN; PAM sequence: TTT
cctagaaaagcacatagtca

SEQ ID NO: 204100 - DNA, 20 bp, Artificial Sequence
  Description of Artificial Sequence: Synthetic oligonucleotide
  Target: ATXN1; (-) strand; PAM type: YTN; PAM sequence: TTT
tcctagaaaagcacatagtc

SEQ ID NO: 204101 - DNA, 20 bp, Artificial Sequence
  Description of Artificial Sequence: Synthetic oligonucleotide
  Target: ATXN1; (-) strand; PAM type: YTN; PAM sequence: TTC
caattttcctagaaaagcac

SEQ ID NO: 204102 - DNA, 20 bp, Artificial Sequence
  Description of Artificial Sequence: Synthetic oligonucleotide
  Target: ATXN1; (-) strand; PAM type: YTN; PAM sequence: TTT
ccaattttcctagaaaagca

SEQ ID NO: 204103 - DNA, 20 bp, Artificial Sequence
  Description of Artificial Sequence: Synthetic oligonucleotide
  Target: ATXN1; (-) strand; PAM type: YTN; PAM sequence: CTG
tttccaattttcctagaaaa

SEQ ID NO: 204104 - DNA, 20 bp, Artificial Sequence
  Description of Artificial Sequence: Synthetic oligonucleotide
  Target: ATXN1; (-) strand; PAM type: YTN; PAM sequence: TTA
gctgtttccaattttcctag

SEQ ID NO: 204105 - DNA, 20 bp, Artificial Sequence
  Description of Artificial Sequence: Synthetic oligonucleotide
  Target: ATXN1; (-) strand; PAM type: YTN; PAM sequence: CTT
agctgtttccaattttccta

SEQ ID NO: 204106 - DNA, 20 bp, Artificial Sequence
  Description of Artificial Sequence: Synthetic oligonucleotide
  Target: ATXN1; (-) strand; PAM type: YTN; PAM sequence: TTA
ccttagctgtttccaatttt

SEQ ID NO: 204107 - DNA, 20 bp, Artificial Sequence
  Description of Artificial Sequence: Synthetic oligonucleotide
  Target: ATXN1; (-) strand; PAM type: YTN; PAM sequence: TTT
accttagctgtttccaattt

SEQ ID NO: 204108 - DNA, 20 bp, Artificial Sequence
  Description of Artificial Sequence: Synthetic oligonucleotide
  Target: ATXN1; (-) strand; PAM type: YTN; PAM sequence: TTT
taccttagctgtttccaatt

SEQ ID NO: 204109 - DNA, 20 bp, Artificial Sequence
  Description of Artificial Sequence: Synthetic oligonucleotide
  Target: ATXN1; (-) strand; PAM type: YTN; PAM sequence: TTT
ttaccttagctgtttccaat

SEQ ID NO: 204110 - DNA, 20 bp, Artificial Sequence
  Description of Artificial Sequence: Synthetic oligonucleotide
  Target: ATXN1; (-) strand; PAM type: YTN; PAM sequence: TTT
tttaccttagctgtttccaa

SEQ ID NO: 204111 - DNA, 20 bp, Artificial Sequence
  Description of Artificial Sequence: Synthetic oligonucleotide
  Target: ATXN1; (-) strand; PAM type: YTN; PAM sequence: TTT
ttttaccttagctgtttcca

SEQ ID NO: 204112 - DNA, 20 bp, Artificial Sequence
  Description of Artificial Sequence: Synthetic oligonucleotide
  Target: ATXN1; (-) strand; PAM type: YTN; PAM sequence: TTT
tttttaccttagctgtttcc

SEQ ID NO: 204113 - DNA, 20 bp, Artificial Sequence
  Description of Artificial Sequence: Synthetic oligonucleotide
  Target: ATXN1; (-) strand; PAM type: YTN; PAM sequence: TTT
ttttttaccttagctgtttc

SEQ ID NO: 204114 - DNA, 20 bp, Artificial Sequence
  Description of Artificial Sequence: Synthetic oligonucleotide
  Target: ATXN1; (-) strand; PAM type: YTN; PAM sequence: TTT
tttttttaccttagctgttt

SEQ ID NO: 204115 - DNA, 20 bp, Artificial Sequence
  Description of Artificial Sequence: Synthetic oligonucleotide
  Target: ATXN1; (-) strand; PAM type: YTN; PAM sequence: TTT
ttttttttaccttagctgtt

SEQ ID NO: 204116 - DNA, 20 bp, Artificial Sequence
  Description of Artificial Sequence: Synthetic oligonucleotide
  Target: ATXN1; (-) strand; PAM type: YTN; PAM sequence: TTT
tttttttttaccttagctgt

SEQ ID NO: 204117 - DNA, 20 bp, Artificial Sequence
  Description of Artificial Sequence: Synthetic oligonucleotide
  Target: ATXN1; (-) strand; PAM type: YTN; PAM sequence: TTT
ttttttttttaccttagctg

SEQ ID NO: 204118 - DNA, 20 bp, Artificial Sequence
  Description of Artificial Sequence: Synthetic oligonucleotide
  Target: ATXN1; (-) strand; PAM type: YTN; PAM sequence: TTC
agatttttttttttttacct

SEQ ID NO: 204119 - DNA, 20 bp, Artificial Sequence
  Description of Artificial Sequence: Synthetic oligonucleotide
  Target: ATXN1; (-) strand; PAM type: YTN; PAM sequence: TTT
cagatttttttttttttacc

SEQ ID NO: 204120 - DNA, 20 bp, Artificial Sequence
  Description of Artificial Sequence: Synthetic oligonucleotide
  Target: ATXN1; (-) strand; PAM type: YTN; PAM sequence: TTT
tcagatttttttttttttac

SEQ ID NO: 204121 - DNA, 20 bp, Artificial Sequence
  Description of Artificial Sequence: Synthetic oligonucleotide
  Target: ATXN1; (-) strand; PAM type: YTN; PAM sequence: CTT
ttcagattttttttttttta

SEQ ID NO: 204122 - DNA, 20 bp, Artificial Sequence
  Description of Artificial Sequence: Synthetic oligonucleotide
  Target: ATXN1; (-) strand; PAM type: YTN; PAM sequence: TTA
agacaaatgacttttcagat

SEQ ID NO: 204123 - DNA, 20 bp, Artificial Sequence
  Description of Artificial Sequence: Synthetic oligonucleotide
  Target: ATXN1; (-) strand; PAM type: YTN; PAM sequence: CTG
gattaagacaaatgactttt

SEQ ID NO: 204124 - DNA, 20 bp, Artificial Sequence
  Description of Artificial Sequence: Synthetic oligonucleotide
  Target: ATXN1; (-) strand; PAM type: YTN; PAM sequence: TTG
aagactggattaagacaaat

SEQ ID NO: 204125 - DNA, 20 bp, Artificial Sequence
  Description of Artificial Sequence: Synthetic oligonucleotide
  Target: ATXN1; (-) strand; PAM type: YTN; PAM sequence: TTT
gaagactggattaagacaaa

SEQ ID NO: 204126 - DNA, 20 bp, Artificial Sequence
  Description of Artificial Sequence: Synthetic oligonucleotide
  Target: ATXN1; (-) strand; PAM type: YTN; PAM sequence: TTG
gatttgaagactggattaag

SEQ ID NO: 204127 - DNA, 20 bp, Artificial Sequence
  Description of Artificial Sequence: Synthetic oligonucleotide
  Target: ATXN1; (-) strand; PAM type: YTN; PAM sequence: CTG
tgaaggaataaaaacgatga

SEQ ID NO: 204128 - DNA, 20 bp, Artificial Sequence
  Description of Artificial Sequence: Synthetic oligonucleotide
  Target: ATXN1; (-) strand; PAM type: YTN; PAM sequence: TTC
cctgtgaaggaataaaaacg

SEQ ID NO: 204129 - DNA, 20 bp, Artificial Sequence
  Description of Artificial Sequence: Synthetic oligonucleotide
  Target: ATXN1; (-) strand; PAM type: YTN; PAM sequence: TTA
ttccctgtgaaggaataaaa

SEQ ID NO: 204130 - DNA, 20 bp, Artificial Sequence
  Description of Artificial Sequence: Synthetic oligonucleotide
  Target: ATXN1; (-) strand; PAM type: YTN; PAM sequence: TTC
attattccctgtgaaggaat

SEQ ID NO: 204131 - DNA, 20 bp, Artificial Sequence
  Description of Artificial Sequence: Synthetic oligonucleotide
  Target: ATXN1; (-) strand; PAM type: YTN; PAM sequence: CTT
cattattccctgtgaaggaa

SEQ ID NO: 204132 - DNA, 20 bp, Artificial Sequence
  Description of Artificial Sequence: Synthetic oligonucleotide
  Target: ATXN1; (-) strand; PAM type: YTN; PAM sequence: CTC
ttcattattccctgtgaagg

SEQ ID NO: 204133 - DNA, 20 bp, Artificial Sequence
  Description of Artificial Sequence: Synthetic oligonucleotide
  Target: ATXN1; (-) strand; PAM type: YTN; PAM sequence: TTG
ctcttcattattccctgtga

SEQ ID NO: 204134 - DNA, 20 bp, Artificial Sequence
  Description of Artificial Sequence: Synthetic oligonucleotide
  Target: ATXN1; (-) strand; PAM type: YTN; PAM sequence: TTT
gctcttcattattccctgtg

SEQ ID NO: 204135 - DNA, 20 bp, Artificial Sequence
  Description of Artificial Sequence: Synthetic oligonucleotide
  Target: ATXN1; (-) strand; PAM type: YTN; PAM sequence: TTA
tttgctcttcattattccct

SEQ ID NO: 204136 - DNA, 20 bp, Artificial Sequence
  Description of Artificial Sequence: Synthetic oligonucleotide
  Target: ATXN1; (-) strand; PAM type: YTN; PAM sequence: CTT
atttgctcttcattattccc

SEQ ID NO: 204137 - DNA, 20 bp, Artificial Sequence
  Description of Artificial Sequence: Synthetic oligonucleotide
  Target: ATXN1; (-) strand; PAM type: YTN; PAM sequence: TTC
cttatttgctcttcattatt

SEQ ID NO: 204138 - DNA, 20 bp, Artificial Sequence
  Description of Artificial Sequence: Synthetic oligonucleotide
  Target: ATXN1; (-) strand; PAM type: YTN; PAM sequence: CTG
atgatattccttatttgctc

SEQ ID NO: 204139 - DNA, 20 bp, Artificial Sequence
  Description of Artificial Sequence: Synthetic oligonucleotide
  Target: ATXN1; (-) strand; PAM type: YTN; PAM sequence: CTC
tgatgatattccttatttgc

SEQ ID NO: 204140 - DNA, 20 bp, Artificial Sequence
  Description of Artificial Sequence: Synthetic oligonucleotide
  Target: ATXN1; (-) strand; PAM type: YTN; PAM sequence: TTC
tctgatgatattccttattt

SEQ ID NO: 204141 - DNA, 20 bp, Artificial Sequence
  Description of Artificial Sequence: Synthetic oligonucleotide
  Target: ATXN1; (-) strand; PAM type: YTN; PAM sequence: TTT
ctctgatgatattccttatt

SEQ ID NO: 204142 - DNA, 20 bp, Artificial Sequence
  Description of Artificial Sequence: Synthetic oligonucleotide
  Target: ATXN1; (-) strand; PAM type: YTN; PAM sequence: CTT
tctctgatgatattccttat

SEQ ID NO: 204143 - DNA, 20 bp, Artificial Sequence
  Description of Artificial Sequence: Synthetic oligonucleotide
  Target: ATXN1; (-) strand; PAM type: YTN; PAM sequence: TTA
gggagtccatctttctctga

SEQ ID NO: 204144 - DNA, 20 bp, Artificial Sequence
  Description of Artificial Sequence: Synthetic oligonucleotide
  Target: ATXN1; (-) strand; PAM type: YTN; PAM sequence: CTT
agggagtccatctttctctg

SEQ ID NO: 204145 - DNA, 20 bp, Artificial Sequence
  Description of Artificial Sequence: Synthetic oligonucleotide
  Target: ATXN1; (-) strand; PAM type: YTN; PAM sequence: TTA
agtaaagagacttagggagt

SEQ ID NO: 204146 - DNA, 20 bp, Artificial Sequence
  Description of Artificial Sequence: Synthetic oligonucleotide
  Target: ATXN1; (-) strand; PAM type: YTN; PAM sequence: TTG
aattaagtaaagagacttag

SEQ ID NO: 204147 - DNA, 20 bp, Artificial Sequence
  Description of Artificial Sequence: Synthetic oligonucleotide
  Target: ATXN1; (-) strand; PAM type: YTN; PAM sequence: CTG
taagagcagtacaagaaaat

SEQ ID NO: 204148 - DNA, 20 bp, Artificial Sequence
  Description of Artificial Sequence: Synthetic oligonucleotide
  Target: ATXN1; (-) strand; PAM type: YTN; PAM sequence: TTG
gaaaatactgtaagagcagt

SEQ ID NO: 204149 - DNA, 20 bp, Artificial Sequence
  Description of Artificial Sequence: Synthetic oligonucleotide
  Target: ATXN1; (-) strand; PAM type: YTN; PAM sequence: TTT
ggaaaatactgtaagagcag

SEQ ID NO: 204150 - DNA, 20 bp, Artificial Sequence
  Description of Artificial Sequence: Synthetic oligonucleotide
  Target: ATXN1; (-) strand; PAM type: YTN; PAM sequence: TTG
tttggaaaatactgtaagag

SEQ ID NO: 204151 - DNA, 20 bp, Artificial Sequence
  Description of Artificial Sequence: Synthetic oligonucleotide
  Target: ATXN1; (-) strand; PAM type: YTN; PAM sequence: TTT
gtttggaaaatactgtaaga

SEQ ID NO: 204152 - DNA, 20 bp, Artificial Sequence
  Description of Artificial Sequence: Synthetic oligonucleotide
  Target: ATXN1; (-) strand; PAM type: YTN; PAM sequence: CTT
tgtttggaaaatactgtaag

SEQ ID NO: 204153 - DNA, 20 bp, Artificial Sequence
  Description of Artificial Sequence: Synthetic oligonucleotide
  Target: ATXN1; (-) strand; PAM type: YTN; PAM sequence: CTA
tcatatgtagaaaagaacag

SEQ ID NO: 204154 - DNA, 20 bp, Artificial Sequence
  Description of Artificial Sequence: Synthetic oligonucleotide
  Target: ATXN1; (-) strand; PAM type: YTN; PAM sequence: CTG
aactatcatatgtagaaaag

SEQ ID NO: 204155 - DNA, 20 bp, Artificial Sequence
  Description of Artificial Sequence: Synthetic oligonucleotide
  Target: ATXN1; (-) strand; PAM type: YTN; PAM sequence: CTG
ggctgaactatcatatgtag

SEQ ID NO: 204156 - DNA, 20 bp, Artificial Sequence
  Description of Artificial Sequence: Synthetic oligonucleotide
  Target: ATXN1; (-) strand; PAM type: YTN; PAM sequence: TTG
ctgggctgaactatcatatg

SEQ ID NO: 204157 - DNA, 20 bp, Artificial Sequence
  Description of Artificial Sequence: Synthetic oligonucleotide
  Target: ATXN1; (-) strand; PAM type: YTN; PAM sequence: TTT
gctgggctgaactatcatat

SEQ ID NO: 204158 - DNA, 20 bp, Artificial Sequence
  Description of Artificial Sequence: Synthetic oligonucleotide
  Target: ATXN1; (-) strand; PAM type: YTN; PAM sequence: CTG
aggacatttgctgggctgaa

SEQ ID NO: 204159 - DNA, 20 bp, Artificial Sequence
  Description of Artificial Sequence: Synthetic oligonucleotide
  Target: ATXN1; (-) strand; PAM type: YTN; PAM sequence: TTC
ctgaggacatttgctgggct

SEQ ID NO: 204160 - DNA, 20 bp, Artificial Sequence
  Description of Artificial Sequence: Synthetic oligonucleotide
  Target: ATXN1; (-) strand; PAM type: YTN; PAM sequence: TTA
ttcctgaggacatttgctgg

SEQ ID NO: 204161 - DNA, 20 bp, Artificial Sequence
  Description of Artificial Sequence: Synthetic oligonucleotide
  Target: ATXN1; (-) strand; PAM type: YTN; PAM sequence: TTA
ttattcctgaggacatttgc

SEQ ID NO: 204162 - DNA, 20 bp, Artificial Sequence
  Description of Artificial Sequence: Synthetic oligonucleotide
  Target: ATXN1; (-) strand; PAM type: YTN; PAM sequence: TTT
attattcctgaggacatttg

SEQ ID NO: 204163 - DNA, 20 bp, Artificial Sequence
  Description of Artificial Sequence: Synthetic oligonucleotide
  Target: ATXN1; (-) strand; PAM type: YTN; PAM sequence: TTG
tttattattcctgaggacat

SEQ ID NO: 204164 - DNA, 20 bp, Artificial Sequence
  Description of Artificial Sequence: Synthetic oligonucleotide
  Target: ATXN1; (-) strand; PAM type: YTN; PAM sequence: TTT
gtttattattcctgaggaca

SEQ ID NO: 204165 - DNA, 20 bp, Artificial Sequence
  Description of Artificial Sequence: Synthetic oligonucleotide
  Target: ATXN1; (-) strand; PAM type: YTN; PAM sequence: CTG
tttgtttattattcctgagg

SEQ ID NO: 204166 - DNA, 20 bp, Artificial Sequence
  Description of Artificial Sequence: Synthetic oligonucleotide
  Target: ATXN1; (-) strand; PAM type: YTN; PAM sequence: TTG
tggcagaaaatatgccccca

SEQ ID NO: 204167 - DNA, 20 bp, Artificial Sequence
  Description of Artificial Sequence: Synthetic oligonucleotide
  Target: ATXN1; (-) strand; PAM type: YTN; PAM sequence: TTT
gtggcagaaaatatgccccc

SEQ ID NO: 204168 - DNA, 20 bp, Artificial Sequence
  Description of Artificial Sequence: Synthetic oligonucleotide
  Target: ATXN1; (-) strand; PAM type: YTN; PAM sequence: TTG
cagagtgtaatttgtggcag

SEQ ID NO: 204169 - DNA, 20 bp, Artificial Sequence
  Description of Artificial Sequence: Synthetic oligonucleotide
  Target: ATXN1; (-) strand; PAM type: YTN; PAM sequence: TTG
gatgaagaatgttgcagagt

SEQ ID NO: 204170 - DNA, 20 bp, Artificial Sequence
  Description of Artificial Sequence: Synthetic oligonucleotide
  Target: ATXN1; (-) strand; PAM type: YTN; PAM sequence: TTT
ggatgaagaatgttgcagag

SEQ ID NO: 204171 - DNA, 20 bp, Artificial Sequence
  Description of Artificial Sequence: Synthetic oligonucleotide
  Target: ATXN1; (-) strand; PAM type: YTN; PAM sequence: CTT
tggatgaagaatgttgcaga

SEQ ID NO: 204172 - DNA, 20 bp, Artificial Sequence
  Description of Artificial Sequence: Synthetic oligonucleotide
  Target: ATXN1; (-) strand; PAM type: YTN; PAM sequence: TTG
aaaatgctttggatgaagaa

SEQ ID NO: 204173 - DNA, 20 bp, Artificial Sequence
  Description of Artificial Sequence: Synthetic oligonucleotide
  Target: ATXN1; (-) strand; PAM type: YTN; PAM sequence: TTG
gaattgaaaatgctttggat

SEQ ID NO: 204174 - DNA, 20 bp, Artificial Sequence
  Description of Artificial Sequence: Synthetic oligonucleotide
  Target: ATXN1; (-) strand; PAM type: YTN; PAM sequence: CTT
ggaattgaaaatgctttgga

SEQ ID NO: 204175 - DNA, 20 bp, Artificial Sequence
  Description of Artificial Sequence: Synthetic oligonucleotide
  Target: ATXN1; (-) strand; PAM type: YTN; PAM sequence: TTG
cttggaattgaaaatgcttt

SEQ ID NO: 204176 - DNA, 20 bp, Artificial Sequence
  Description of Artificial Sequence: Synthetic oligonucleotide
  Target: ATXN1; (-) strand; PAM type: YTN; PAM sequence: CTT
gcttggaattgaaaatgctt

SEQ ID NO: 204177 - DNA, 20 bp, Artificial Sequence
  Description of Artificial Sequence: Synthetic oligonucleotide
  Target: ATXN1; (-) strand; PAM type: YTN; PAM sequence: TTG
cttgcttggaattgaaaatg

SEQ ID NO: 204178 - DNA, 20 bp, Artificial Sequence
  Description of Artificial Sequence: Synthetic oligonucleotide
  Target: ATXN1; (-) strand; PAM type: YTN; PAM sequence: TTT
gcttgcttggaattgaaaat

SEQ ID NO: 204179 - DNA, 20 bp, Artificial Sequence
  Description of Artificial Sequence: Synthetic oligonucleotide
  Target: ATXN1; (-) strand; PAM type: YTN; PAM sequence: CTT
tgcttgcttggaattgaaaa

SEQ ID NO: 204180 - DNA, 20 bp, Artificial Sequence
  Description of Artificial Sequence: Synthetic oligonucleotide
  Target: ATXN1; (-) strand; PAM type: YTN; PAM sequence: TTG
tgtctttgcttgcttggaat

SEQ ID NO: 204181 - DNA, 20 bp, Artificial Sequence
  Description of Artificial Sequence: Synthetic oligonucleotide
  Target: ATXN1; (-) strand; PAM type: YTN; PAM sequence: CTT
gtgtctttgcttgcttggaa

SEQ ID NO: 204182 - DNA, 20 bp, Artificial Sequence
  Description of Artificial Sequence: Synthetic oligonucleotide
  Target: ATXN1; (-) strand; PAM type: YTN; PAM sequence: TTC
cttgtgtctttgcttgcttg

SEQ ID NO: 204183 - DNA, 20 bp, Artificial Sequence
  Description of Artificial Sequence: Synthetic oligonucleotide
  Target: ATXN1; (-) strand; PAM type: YTN; PAM sequence: TTT
ccttgtgtctttgcttgctt

SEQ ID NO: 204184 - DNA, 20 bp, Artificial Sequence
  Description of Artificial Sequence: Synthetic oligonucleotide
  Target: ATXN1; (-) strand; PAM type: YTN; PAM sequence: TTT
tccttgtgtctttgcttgct

SEQ ID NO: 204185 - DNA, 20 bp, Artificial Sequence
  Description of Artificial Sequence: Synthetic oligonucleotide
  Target: ATXN1; (-) strand; PAM type: YTN; PAM sequence: TTG
taataaggcagtgtattttc

SEQ ID NO: 204186 - DNA, 20 bp, Artificial Sequence
  Description of Artificial Sequence: Synthetic oligonucleotide
  Target: ATXN1; (-) strand; PAM type: YTN; PAM sequence: CTT
gtaataaggcagtgtatttt

SEQ ID NO: 204187 - DNA, 20 bp, Artificial Sequence
  Description of Artificial Sequence: Synthetic oligonucleotide
  Target: ATXN1; (-) strand; PAM type: YTN; PAM sequence: TTC
ttgtaataaggcagtgtatt

SEQ ID NO: 204188 - DNA, 20 bp, Artificial Sequence
  Description of Artificial Sequence: Synthetic oligonucleotide
  Target: ATXN1; (-) strand; PAM type: YTN; PAM sequence: TTG
tgtgcagttcttgtaataag

SEQ ID NO: 204189 - DNA, 20 bp, Artificial Sequence
  Description of Artificial Sequence: Synthetic oligonucleotide
  Target: ATXN1; (-) strand; PAM type: YTN; PAM sequence: CTA
ttgtgtgcagttcttgtaat

SEQ ID NO: 204190 - DNA, 20 bp, Artificial Sequence
  Description of Artificial Sequence: Synthetic oligonucleotide
  Target: ATXN1; (-) strand; PAM type: YTN; PAM sequence: CTC
tattgtgtgcagttcttgta

SEQ ID NO: 204191 - DNA, 20 bp, Artificial Sequence
  Description of Artificial Sequence: Synthetic oligonucleotide
  Target: ATXN1; (-) strand; PAM type: YTN; PAM sequence: TTC
tctattgtgtgcagttcttg

SEQ ID NO: 204192 - DNA, 20 bp, Artificial Sequence
  Description of Artificial Sequence: Synthetic oligonucleotide
  Target: ATXN1; (-) strand; PAM type: YTN; PAM sequence: CTG
aatacagattctctattgtg

SEQ ID NO: 204193 - DNA, 20 bp, Artificial Sequence
  Description of Artificial Sequence: Synthetic oligonucleotide
  Target: ATXN1; (-) strand; PAM type: YTN; PAM sequence: TTA
agtgtcaataagtgtctgaa

SEQ ID NO: 204194 - DNA, 20 bp, Artificial Sequence
  Description of Artificial Sequence: Synthetic oligonucleotide
  Target: ATXN1; (-) strand; PAM type: YTN; PAM sequence: TTT
aagtgtcaataagtgtctga

SEQ ID NO: 204195 - DNA, 20 bp, Artificial Sequence
  Description of Artificial Sequence: Synthetic oligonucleotide
  Target: ATXN1; (-) strand; PAM type: YTN; PAM sequence: TTA
acaggtttaagtgtcaataa

SEQ ID NO: 204196 - DNA, 20 bp, Artificial Sequence
  Description of Artificial Sequence: Synthetic oligonucleotide
  Target: ATXN1; (-) strand; PAM type: YTN; PAM sequence: TTA
catattaacaggtttaagtg

SEQ ID NO: 204197 - DNA, 20 bp, Artificial Sequence
  Description of Artificial Sequence: Synthetic oligonucleotide
  Target: ATXN1; (-) strand; PAM type: YTN; PAM sequence: TTA
gaacaatagtaggagttaca

SEQ ID NO: 204198 - DNA, 20 bp, Artificial Sequence
  Description of Artificial Sequence: Synthetic oligonucleotide
  Target: ATXN1; (-) strand; PAM type: YTN; PAM sequence: TTT
agaacaatagtaggagttac

SEQ ID NO: 204199 - DNA, 20 bp, Artificial Sequence
  Description of Artificial Sequence: Synthetic oligonucleotide
  Target: ATXN1; (-) strand; PAM type: YTN; PAM sequence: CTT
tagaacaatagtaggagtta

SEQ ID NO: 204200 - DNA, 20 bp, Artificial Sequence
  Description of Artificial Sequence: Synthetic oligonucleotide
  Target: ATXN1; (-) strand; PAM type: YTN; PAM sequence: TTC
atcctttagaacaatagtag

SEQ ID NO: 204201 - DNA, 20 bp, Artificial Sequence
  Description of Artificial Sequence: Synthetic oligonucleotide
  Target: ATXN1; (-) strand; PAM type: YTN; PAM sequence: TTA
ttcatcctttagaacaatag

SEQ ID NO: 204202 - DNA, 20 bp, Artificial Sequence
  Description of Artificial Sequence: Synthetic oligonucleotide
  Target: ATXN1; (-) strand; PAM type: YTN; PAM sequence: CTT
attcatcctttagaacaata

SEQ ID NO: 204203 - DNA, 20 bp, Artificial Sequence
  Description of Artificial Sequence: Synthetic oligonucleotide
  Target: ATXN1; (-) strand; PAM type: YTN; PAM sequence: TTG
cttattcatcctttagaaca

SEQ ID NO: 204204 - DNA, 20 bp, Artificial Sequence
  Description of Artificial Sequence: Synthetic oligonucleotide
  Target: ATXN1; (-) strand; PAM type: YTN; PAM sequence: TTT
gcttattcatcctttagaac

SEQ ID NO: 204205 - DNA, 20 bp, Artificial Sequence
  Description of Artificial Sequence: Synthetic oligonucleotide
  Target: ATXN1; (-) strand; PAM type: YTN; PAM sequence: TTA
tatgtgcaggagaatttgct

SEQ ID NO: 204206 - DNA, 20 bp, Artificial Sequence
  Description of Artificial Sequence: Synthetic oligonucleotide
  Target: ATXN1; (-) strand; PAM type: YTN; PAM sequence: TTA
aagtgcatgatgtaacatta

SEQ ID NO: 204207 - DNA, 20 bp, Artificial Sequence
  Description of Artificial Sequence: Synthetic oligonucleotide
  Target: ATXN1; (-) strand; PAM type: YTN; PAM sequence: TTG
taattaaagtgcatgatgta

SEQ ID NO: 204208 - DNA, 20 bp, Artificial Sequence
  Description of Artificial Sequence: Synthetic oligonucleotide
  Target: ATXN1; (-) strand; PAM type: YTN; PAM sequence: CTA
ttgtaattaaagtgcatgat

SEQ ID NO: 204209 - DNA, 20 bp, Artificial Sequence
  Description of Artificial Sequence: Synthetic oligonucleotide
  Target: ATXN1; (-) strand; PAM type: YTN; PAM sequence: TTA
ctattgtaattaaagtgcat

SEQ ID NO: 204210 - DNA, 20 bp, Artificial Sequence
  Description of Artificial Sequence: Synthetic oligonucleotide
  Target: ATXN1; (-) strand; PAM type: YTN; PAM sequence: TTT
actattgtaattaaagtgca

SEQ ID NO: 204211 - DNA, 20 bp, Artificial Sequence
  Description of Artificial Sequence: Synthetic oligonucleotide
  Target: ATXN1; (-) strand; PAM type: YTN; PAM sequence: TTC
ggcagtatttactattgtaa

SEQ ID NO: 204212 - DNA, 20 bp, Artificial Sequence
  Description of Artificial Sequence: Synthetic oligonucleotide
  Target: ATXN1; (-) strand; PAM type: YTN; PAM sequence: TTT
cggcagtatttactattgta

SEQ ID NO: 204213 - DNA, 20 bp, Artificial Sequence
  Description of Artificial Sequence: Synthetic oligonucleotide
  Target: ATXN1; (-) strand; PAM type: YTN; PAM sequence: CTT
tcggcagtatttactattgt

SEQ ID NO: 204214 - DNA, 20 bp, Artificial Sequence
  Description of Artificial Sequence: Synthetic oligonucleotide
  Target: ATXN1; (-) strand; PAM type: YTN; PAM sequence: TTC
ctttcggcagtatttactat

SEQ ID NO: 204215 - DNA, 20 bp, Artificial Sequence
  Description of Artificial Sequence: Synthetic oligonucleotide
  Target: ATXN1; (-) strand; PAM type: YTN; PAM sequence: TTA
gaaaaggtgatatgaaacag

SEQ ID NO: 204216 - DNA, 20 bp, Artificial Sequence
  Description of Artificial Sequence: Synthetic oligonucleotide
  Target: ATXN1; (-) strand; PAM type: YTN; PAM sequence: TTA
attagaaaaggtgatatgaa

SEQ ID NO: 204217 - DNA, 20 bp, Artificial Sequence
  Description of Artificial Sequence: Synthetic oligonucleotide
  Target: ATXN1; (-) strand; PAM type: YTN; PAM sequence: TTG
acattaattagaaaaggtga

SEQ ID NO: 204218 - DNA, 20 bp, Artificial Sequence
  Description of Artificial Sequence: Synthetic oligonucleotide
  Target: ATXN1; (-) strand; PAM type: YTN; PAM sequence: TTA
catggaaaagacacattgac

SEQ ID NO: 204219 - DNA, 20 bp, Artificial Sequence
  Description of Artificial Sequence: Synthetic oligonucleotide
  Target: ATXN1; (-) strand; PAM type: YTN; PAM sequence: CTT
acatggaaaagacacattga

SEQ ID NO: 204220 - DNA, 20 bp, Artificial Sequence
  Description of Artificial Sequence: Synthetic oligonucleotide
  Target: ATXN1; (-) strand; PAM type: YTN; PAM sequence: CTC
ttacatggaaaagacacatt

SEQ ID NO: 204221 - DNA, 20 bp, Artificial Sequence
  Description of Artificial Sequence: Synthetic oligonucleotide
  Target: ATXN1; (-) strand; PAM type: YTN; PAM sequence: CTC
tcttacatggaaaagacaca

SEQ ID NO: 204222 - DNA, 20 bp, Artificial Sequence
  Description of Artificial Sequence: Synthetic oligonucleotide
  Target: ATXN1; (-) strand; PAM type: YTN; PAM sequence: CTG
tatgctctcttacatggaaa

SEQ ID NO: 204223 - DNA, 20 bp, Artificial Sequence
  Description of Artificial Sequence: Synthetic oligonucleotide
  Target: ATXN1; (-) strand; PAM type: YTN; PAM sequence: CTG
ctgtatgctctcttacatgg

SEQ ID NO: 204224 - DNA, 20 bp, Artificial Sequence
  Description of Artificial Sequence: Synthetic oligonucleotide
  Target: ATXN1; (-) strand; PAM type: YTN; PAM sequence: CTC
tgctgtatgctctcttacat

SEQ ID NO: 204225 - DNA, 20 bp, Artificial Sequence
  Description of Artificial Sequence: Synthetic oligonucleotide
  Target: ATXN1; (-) strand; PAM type: YTN; PAM sequence: TTG
ggcagatacacaaagacaca

SEQ ID NO: 204226 - DNA, 20 bp, Artificial Sequence
  Description of Artificial Sequence: Synthetic oligonucleotide
  Target: ATXN1; (-) strand; PAM type: YTN; PAM sequence: TTT
gggcagatacacaaagacac

SEQ ID NO: 204227 - DNA, 20 bp, Artificial Sequence
  Description of Artificial Sequence: Synthetic oligonucleotide
  Target: ATXN1; (-) strand; PAM type: YTN; PAM sequence: TTC
atgaatatgtgtacatttgg

SEQ ID NO: 204228 - DNA, 20 bp, Artificial Sequence
  Description of Artificial Sequence: Synthetic oligonucleotide
  Target: ATXN1; (-) strand; PAM type: YTN; PAM sequence: TTG
tatgtgcattcatgaatatg

SEQ ID NO: 204229 - DNA, 20 bp, Artificial Sequence
  Description of Artificial Sequence: Synthetic oligonucleotide
  Target: ATXN1; (-) strand; PAM type: YTN; PAM sequence: TTT
gtatgtgcattcatgaatat

SEQ ID NO: 204230 - DNA, 20 bp, Artificial Sequence
  Description of Artificial Sequence: Synthetic oligonucleotide
  Target: ATXN1; (-) strand; PAM type: YTN; PAM sequence: TTA
tttgtatgtgcattcatgaa

SEQ ID NO: 204231 - DNA, 20 bp, Artificial Sequence
  Description of Artificial Sequence: Synthetic oligonucleotide
  Target: ATXN1; (-) strand; PAM type: YTN; PAM sequence: CTT
atttgtatgtgcattcatga

SEQ ID NO: 204232 - DNA, 20 bp, Artificial Sequence
  Description of Artificial Sequence: Synthetic oligonucleotide
  Target: ATXN1; (-) strand; PAM type: YTN; PAM sequence: CTG
tgtgcataagagcttatttg

SEQ ID NO: 204233 - DNA, 20 bp, Artificial Sequence
  Description of Artificial Sequence: Synthetic oligonucleotide
  Target: ATXN1; (-) strand; PAM type: YTN; PAM sequence: CTC
tgtgtgcataagagcttatt

SEQ ID NO: 204234 - DNA, 20 bp, Artificial Sequence
  Description of Artificial Sequence: Synthetic oligonucleotide
  Target: ATXN1; (-) strand; PAM type: YTN; PAM sequence: TTA
ctctgtgtgcataagagctt

SEQ ID NO: 204235 - DNA, 20 bp, Artificial Sequence
  Description of Artificial Sequence: Synthetic oligonucleotide
  Target: ATXN1; (-) strand; PAM type: YTN; PAM sequence: CTA
acatgggggttactctgtgt

SEQ ID NO: 204236 - DNA, 20 bp, Artificial Sequence
  Description of Artificial Sequence: Synthetic oligonucleotide
  Target: ATXN1; (-) strand; PAM type: YTN; PAM sequence: TTA
taaatgcatgctaacatggg

SEQ ID NO: 204237 - DNA, 20 bp, Artificial Sequence
  Description of Artificial Sequence: Synthetic oligonucleotide
  Target: ATXN1; (-) strand; PAM type: YTN; PAM sequence: TTT
ataaatgcatgctaacatgg

SEQ ID NO: 204238 - DNA, 20 bp, Artificial Sequence
  Description of Artificial Sequence: Synthetic oligonucleotide
  Target: ATXN1; (-) strand; PAM type: YTN; PAM sequence: CTG
tatttataaatgcatgctaa

SEQ ID NO: 204239 - DNA, 20 bp, Artificial Sequence
  Description of Artificial Sequence: Synthetic oligonucleotide
  Target: ATXN1; (-) strand; PAM type: YTN; PAM sequence: CTC
ggggtggggccagctgtatt

SEQ ID NO: 204240 - DNA, 20 bp, Artificial Sequence
  Description of Artificial Sequence: Synthetic oligonucleotide
  Target: ATXN1; (-) strand; PAM type: YTN; PAM sequence: CTC
catgcatgctcggggtgggg

SEQ ID NO: 204241 - DNA, 20 bp, Artificial Sequence
  Description of Artificial Sequence: Synthetic oligonucleotide
  Target: ATXN1; (-) strand; PAM type: YTN; PAM sequence: TTG
tgtatactccatgcatgctc

SEQ ID NO: 204242 - DNA, 20 bp, Artificial Sequence
  Description of Artificial Sequence: Synthetic oligonucleotide
  Target: ATXN1; (-) strand; PAM type: YTN; PAM sequence: TTT
gtgtatactccatgcatgct

SEQ ID NO: 204243 - DNA, 20 bp, Artificial Sequence
  Description of Artificial Sequence: Synthetic oligonucleotide
  Target: ATXN1; (-) strand; PAM type: YTN; PAM sequence: CTG
tttgtgtatactccatgcat

SEQ ID NO: 204244 - DNA, 20 bp, Artificial Sequence
  Description of Artificial Sequence: Synthetic oligonucleotide
  Target: ATXN1; (-) strand; PAM type: YTN; PAM sequence: TTA
tgctgtttgtgtatactcca

SEQ ID NO: 204245 - DNA, 20 bp, Artificial Sequence
  Description of Artificial Sequence: Synthetic oligonucleotide
  Target: ATXN1; (-) strand; PAM type: YTN; PAM sequence: TTT
atgctgtttgtgtatactcc

SEQ ID NO: 204246 - DNA, 20 bp, Artificial Sequence
  Description of Artificial Sequence: Synthetic oligonucleotide
  Target: ATXN1; (-) strand; PAM type: YTN; PAM sequence: CTT
tatgctgtttgtgtatactc

SEQ ID NO: 204247 - DNA, 20 bp, Artificial Sequence
  Description of Artificial Sequence: Synthetic oligonucleotide
  Target: ATXN1; (-) strand; PAM type: YTN; PAM sequence: CTG
gcctttatgctgtttgtgta

SEQ ID NO: 204248 - DNA, 20 bp, Artificial Sequence
  Description of Artificial Sequence: Synthetic oligonucleotide
  Target: ATXN1; (-) strand; PAM type: YTN; PAM sequence: CTA
taaaagcaaaaggaagtcaa

SEQ ID NO: 204249 - DNA, 20 bp, Artificial Sequence
  Description of Artificial Sequence: Synthetic oligonucleotide
  Target: ATXN1; (-) strand; PAM type: YTN; PAM sequence: CTC
ctataaaagcaaaaggaagt

SEQ ID NO: 204250 - DNA, 20 bp, Artificial Sequence
  Description of Artificial Sequence: Synthetic oligonucleotide
  Target: ATXN1; (-) strand; PAM type: YTN; PAM sequence: TTA
tgtcaatctcctataaaagc

SEQ ID NO: 204251 - DNA, 20 bp, Artificial Sequence
  Description of Artificial Sequence: Synthetic oligonucleotide
  Target: ATXN1; (-) strand; PAM type: YTN; PAM sequence: TTT
atgtcaatctcctataaaag

SEQ ID NO: 204252 - DNA, 20 bp, Artificial Sequence
  Description of Artificial Sequence: Synthetic oligonucleotide
  Target: ATXN1; (-) strand; PAM type: YTN; PAM sequence: TTT
tatgtcaatctcctataaaa

SEQ ID NO: 204253 - DNA, 20 bp, Artificial Sequence
  Description of Artificial Sequence: Synthetic oligonucleotide
  Target: ATXN1; (-) strand; PAM type: YTN; PAM sequence: TTT
ttatgtcaatctcctataaa

SEQ ID NO: 204254 - DNA, 20 bp, Artificial Sequence
  Description of Artificial Sequence: Synthetic oligonucleotide
  Target: ATXN1; (-) strand; PAM type: YTN; PAM sequence: CTT
tttatgtcaatctcctataa

SEQ ID NO: 204255 - DNA, 20 bp, Artificial Sequence
  Description of Artificial Sequence: Synthetic oligonucleotide
  Target: ATXN1; (-) strand; PAM type: YTN; PAM sequence: TTA
gctttttatgtcaatctcct

SEQ ID NO: 204256 - DNA, 20 bp, Artificial Sequence
  Description of Artificial Sequence: Synthetic oligonucleotide
  Target: ATXN1; (-) strand; PAM type: YTN; PAM sequence: TTT
agctttttatgtcaatctcc

SEQ ID NO: 204257 - DNA, 20 bp, Artificial Sequence
  Description of Artificial Sequence: Synthetic oligonucleotide
  Target: ATXN1; (-) strand; PAM type: YTN; PAM sequence: TTT
tagctttttatgtcaatctc

SEQ ID NO: 204258 - DNA, 20 bp, Artificial Sequence
  Description of Artificial Sequence: Synthetic oligonucleotide
  Target: ATXN1; (-) strand; PAM type: YTN; PAM sequence: TTT
ttagctttttatgtcaatct

SEQ ID NO: 204259 - DNA, 20 bp, Artificial Sequence
  Description of Artificial Sequence: Synthetic oligonucleotide
  Target: ATXN1; (-) strand; PAM type: YTN; PAM sequence: TTT
tttagctttttatgtcaatc

SEQ ID NO: 204260 - DNA, 20 bp, Artificial Sequence
  Description of Artificial Sequence: Synthetic oligonucleotide
  Target: ATXN1; (-) strand; PAM type: YTN; PAM sequence: TTT
ttttagctttttatgtcaat

SEQ ID NO: 204261 - DNA, 20 bp, Artificial Sequence
  Description of Artificial Sequence: Synthetic oligonucleotide
  Target: ATXN1; (-) strand; PAM type: YTN; PAM sequence: CTT
tttttagctttttatgtcaa

SEQ ID NO: 204262 - DNA, 20 bp, Artificial Sequence
  Description of Artificial Sequence: Synthetic oligonucleotide
  Target: ATXN1; (-) strand; PAM type: YTN; PAM sequence: TTG
tctttttttagctttttatg

SEQ ID NO: 204263 - DNA, 20 bp, Artificial Sequence
  Description of Artificial Sequence: Synthetic oligonucleotide
  Target: ATXN1; (-) strand; PAM type: YTN; PAM sequence: CTT
gtctttttttagctttttat

SEQ ID NO: 204264 - DNA, 20 bp, Artificial Sequence
  Description of Artificial Sequence: Synthetic oligonucleotide
  Target: ATXN1; (-) strand; PAM type: YTN; PAM sequence: CTA
cttgtctttttttagctttt

SEQ ID NO: 204265 - DNA, 20 bp, Artificial Sequence
  Description of Artificial Sequence: Synthetic oligonucleotide
  Target: ATXN1; (-) strand; PAM type: YTN; PAM sequence: CTC
catgaagtgtctacttgtct

SEQ ID NO: 204266 - DNA, 20 bp, Artificial Sequence
  Description of Artificial Sequence: Synthetic oligonucleotide
  Target: ATXN1; (-) strand; PAM type: YTN; PAM sequence: TTA
atcacaggctccatgaagtg

SEQ ID NO: 204267 - DNA, 20 bp, Artificial Sequence
  Description of Artificial Sequence: Synthetic oligonucleotide
  Target: ATXN1; (-) strand; PAM type: YTN; PAM sequence: CTT
aatcacaggctccatgaagt

SEQ ID NO: 204268 - DNA, 20 bp, Artificial Sequence
  Description of Artificial Sequence: Synthetic oligonucleotide
  Target: ATXN1; (-) strand; PAM type: YTN; PAM sequence: CTC
ttaatcacaggctccatgaa

SEQ ID NO: 204269 - DNA, 20 bp, Artificial Sequence
  Description of Artificial Sequence: Synthetic oligonucleotide
  Target: ATXN1; (-) strand; PAM type: YTN; PAM sequence: CTC
tcttaatcacaggctccatg

SEQ ID NO: 204270 - DNA, 20 bp, Artificial Sequence
  Description of Artificial Sequence: Synthetic oligonucleotide
  Target: ATXN1; (-) strand; PAM type: YTN; PAM sequence: TTC
tctcttaatcacaggctcca

SEQ ID NO: 204271 - DNA, 20 bp, Artificial Sequence
  Description of Artificial Sequence: Synthetic oligonucleotide
  Target: ATXN1; (-) strand; PAM type: YTN; PAM sequence: CTT
ctctcttaatcacaggctcc

SEQ ID NO: 204272 - DNA, 20 bp, Artificial Sequence
  Description of Artificial Sequence: Synthetic oligonucleotide
  Target: ATXN1; (-) strand; PAM type: YTN; PAM sequence: TTA
gcttctctcttaatcacagg

SEQ ID NO: 204273 - DNA, 20 bp, Artificial Sequence
  Description of Artificial Sequence: Synthetic oligonucleotide
  Target: ATXN1; (-) strand; PAM type: YTN; PAM sequence: CTC
attagcttctctcttaatca

SEQ ID NO: 204274 - DNA, 20 bp, Artificial Sequence
  Description of Artificial Sequence: Synthetic oligonucleotide
  Target: ATXN1; (-) strand; PAM type: YTN; PAM sequence: CTG
tctcattagcttctctctta

SEQ ID NO: 204275 - DNA, 20 bp, Artificial Sequence
  Description of Artificial Sequence: Synthetic oligonucleotide
  Target: ATXN1; (-) strand; PAM type: YTN; PAM sequence: TTA
tgcatcagcccatctgtctc

SEQ ID NO: 204276 - DNA, 20 bp, Artificial Sequence
  Description of Artificial Sequence: Synthetic oligonucleotide
  Target: ATXN1; (-) strand; PAM type: YTN; PAM sequence: TTT
atgcatcagcccatctgtct

SEQ ID NO: 204277 - DNA, 20 bp, Artificial Sequence
  Description of Artificial Sequence: Synthetic oligonucleotide
  Target: ATXN1; (-) strand; PAM type: YTN; PAM sequence: CTT
tatgcatcagcccatctgtc

SEQ ID NO: 204278 - DNA, 20 bp, Artificial Sequence
  Description of Artificial Sequence: Synthetic oligonucleotide
  Target: ATXN1; (-) strand; PAM type: YTN; PAM sequence: TTC
cctttatgcatcagcccatc

SEQ ID NO: 204279 - DNA, 20 bp, Artificial Sequence
  Description of Artificial Sequence: Synthetic oligonucleotide
  Target: ATXN1; (-) strand; PAM type: YTN; PAM sequence: CTG
aagttccctttatgcatcag

SEQ ID NO: 204280 - DNA, 20 bp, Artificial Sequence
  Description of Artificial Sequence: Synthetic oligonucleotide
  Target: ATXN1; (-) strand; PAM type: YTN; PAM sequence: CTG
gtgtgctgaagttcccttta

SEQ ID NO: 204281 - DNA, 20 bp, Artificial Sequence
  Description of Artificial Sequence: Synthetic oligonucleotide
  Target: ATXN1; (-) strand; PAM type: YTN; PAM sequence: CTG
agtgtgggctggtgtgctga

SEQ ID NO: 204282 - DNA, 20 bp, Artificial Sequence
  Description of Artificial Sequence: Synthetic oligonucleotide
  Target: ATXN1; (-) strand; PAM type: YTN; PAM sequence: TTA
ctgagtgtgggctggtgtgc

SEQ ID NO: 204283 - DNA, 20 bp, Artificial Sequence
  Description of Artificial Sequence: Synthetic oligonucleotide
  Target: ATXN1; (-) strand; PAM type: YTN; PAM sequence: TTT
actgagtgtgggctggtgtg

SEQ ID NO: 204284 - DNA, 20 bp, Artificial Sequence
  Description of Artificial Sequence: Synthetic oligonucleotide
  Target: ATXN1; (-) strand; PAM type: YTN; PAM sequence: CTT
tactgagtgtgggctggtgt

SEQ ID NO: 204285 - DNA, 20 bp, Artificial Sequence
  Description of Artificial Sequence: Synthetic oligonucleotide
  Target: ATXN1; (-) strand; PAM type: YTN; PAM sequence: CTG
aaacggagacagtgaagcac

SEQ ID NO: 204286 - DNA, 20 bp, Artificial Sequence
  Description of Artificial Sequence: Synthetic oligonucleotide
  Target: ATXN1; (-) strand; PAM type: YTN; PAM sequence: CTG
gggacaagagtaatgtaagt

SEQ ID NO: 204287 - DNA, 20 bp, Artificial Sequence
  Description of Artificial Sequence: Synthetic oligonucleotide
  Target: ATXN1; (-) strand; PAM type: YTN; PAM sequence: CTG
tggtctggggacaagagtaa

SEQ ID NO: 204288 - DNA, 20 bp, Artificial Sequence
  Description of Artificial Sequence: Synthetic oligonucleotide
  Target: ATXN1; (-) strand; PAM type: YTN; PAM sequence: CTG
ggcagagaaaagcggggtgt

SEQ ID NO: 204289 - DNA, 20 bp, Artificial Sequence
  Description of Artificial Sequence: Synthetic oligonucleotide
  Target: ATXN1; (-) strand; PAM type: YTN; PAM sequence: TTA
gggaggtctgggcagagaaa

SEQ ID NO: 204290 - DNA, 20 bp, Artificial Sequence
  Description of Artificial Sequence: Synthetic oligonucleotide
  Target: ATXN1; (-) strand; PAM type: YTN; PAM sequence: TTT
agggaggtctgggcagagaa

SEQ ID NO: 204291 - DNA, 20 bp, Artificial Sequence
  Description of Artificial Sequence: Synthetic oligonucleotide
  Target: ATXN1; (-) strand; PAM type: YTN; PAM sequence: CTA
atttagggaggtctgggcag

SEQ ID NO: 204292 - DNA, 20 bp, Artificial Sequence
  Description of Artificial Sequence: Synthetic oligonucleotide
  Target: ATXN1; (-) strand; PAM type: YTN; PAM sequence: TTG
ataatcctaatttagggagg

SEQ ID NO: 204293 - DNA, 20 bp, Artificial Sequence
  Description of Artificial Sequence: Synthetic oligonucleotide
  Target: ATXN1; (-) strand; PAM type: YTN; PAM sequence: TTT
gataatcctaatttagggag

SEQ ID NO: 204294 - DNA, 20 bp, Artificial Sequence
  Description of Artificial Sequence: Synthetic oligonucleotide
  Target: ATXN1; (-) strand; PAM type: YTN; PAM sequence: TTG
tgtcatttgataatcctaat

SEQ ID NO: 204295 - DNA, 20 bp, Artificial Sequence
  Description of Artificial Sequence: Synthetic oligonucleotide
  Target: ATXN1; (-) strand; PAM type: YTN; PAM sequence: CTT
gtgtcatttgataatcctaa

SEQ ID NO: 204296 - DNA, 20 bp, Artificial Sequence
  Description of Artificial Sequence: Synthetic oligonucleotide
  Target: ATXN1; (-) strand; PAM type: YTN; PAM sequence: CTA
tcttgtgtcatttgataatc

SEQ ID NO: 204297 - DNA, 20 bp, Artificial Sequence
  Description of Artificial Sequence: Synthetic oligonucleotide
  Target: ATXN1; (-) strand; PAM type: YTN; PAM sequence: CTG
ctatcttgtgtcatttgata

SEQ ID NO: 204298 - DNA, 20 bp, Artificial Sequence
  Description of Artificial Sequence: Synthetic oligonucleotide
  Target: ATXN1; (-) strand; PAM type: YTN; PAM sequence: TTA
aagcagaagactgctatctt

SEQ ID NO: 204299 - DNA, 20 bp, Artificial Sequence
  Description of Artificial Sequence: Synthetic oligonucleotide
  Target: ATXN1; (-) strand; PAM type: YTN; PAM sequence: TTG
aataacaacattaaagcaga

SEQ ID NO: 204300 - DNA, 20 bp, Artificial Sequence
  Description of Artificial Sequence: Synthetic oligonucleotide
  Target: ATXN1; (-) strand; PAM type: YTN; PAM sequence: CTT
gaataacaacattaaagcag

SEQ ID NO: 204301 - DNA, 20 bp, Artificial Sequence
  Description of Artificial Sequence: Synthetic oligonucleotide
  Target: ATXN1; (-) strand; PAM type: YTN; PAM sequence: CTG
tgagtaaaccttgaataaca

SEQ ID NO: 204302 - DNA, 20 bp, Artificial Sequence
  Description of Artificial Sequence: Synthetic oligonucleotide
  Target: ATXN1; (-) strand; PAM type: YTN; PAM sequence: TTG
cctgtgagtaaaccttgaat

SEQ ID NO: 204303 - DNA, 20 bp, Artificial Sequence
  Description of Artificial Sequence: Synthetic oligonucleotide
  Target: ATXN1; (-) strand; PAM type: YTN; PAM sequence: TTA
tagtaaatattgcctgtgag

SEQ ID NO: 204304 - DNA, 20 bp, Artificial Sequence
  Description of Artificial Sequence: Synthetic oligonucleotide
  Target: ATXN1; (-) strand; PAM type: YTN; PAM sequence: TTT
atagtaaatattgcctgtga

SEQ ID NO: 204305 - DNA, 20 bp, Artificial Sequence
  Description of Artificial Sequence: Synthetic oligonucleotide
  Target: ATXN1; (-) strand; PAM type: YTN; PAM sequence: TTT
tatagtaaatattgcctgtg

SEQ ID NO: 204306 - DNA, 20 bp, Artificial Sequence
  Description of Artificial Sequence: Synthetic oligonucleotide
  Target: ATXN1; (-) strand; PAM type: YTN; PAM sequence: TTG
caggcatgagccaccgtgcc

SEQ ID NO: 204307 - DNA, 20 bp, Artificial Sequence
  Description of Artificial Sequence: Synthetic oligonucleotide
  Target: ATXN1; (-) strand; PAM type: YTN; PAM sequence: CTG
ggattgcaggcatgagccac

SEQ ID NO: 204308 - DNA, 20 bp, Artificial Sequence
  Description of Artificial Sequence: Synthetic oligonucleotide
  Target: ATXN1; (-) strand; PAM type: YTN; PAM sequence: CTC
ccaaagggctgggattgcag

SEQ ID NO: 204309 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagggctggga

SEQ ID NO: 204310 - DNA, 20 bp, Artificial Sequence
  Description of Artificial Sequence: Synthetic oligonucleotide
  Target: ATXN1; (-) strand; PAM type: YTN; PAM sequence: CTC
ctcggcctcccaaagggctg

SEQ ID NO: 204311 - DNA, 20 bp, Artificial Sequence
  Description of Artificial Sequence: Synthetic oligonucleotide
  Target: ATXN1; (-) strand; PAM type: YTN; PAM sequence: CTC
aggtgatccaccctcctcgg

SEQ ID NO: 204312 - DNA, 20 bp, Artificial Sequence
  Description of Artificial Sequence: Synthetic oligonucleotide
  Target: ATXN1; (-) strand; PAM type: YTN; PAM sequence: CTG
gcctcaggtgatccaccctc

SEQ ID NO: 204313 - DNA, 20 bp, Artificial Sequence
  Description of Artificial Sequence: Synthetic oligonucleotide
  Target: ATXN1; (-) strand; PAM type: YTN; PAM sequence: CTC
ctggcctcaggtgatccacc

SEQ ID NO: 204314 - DNA, 20 bp, Artificial Sequence
  Description of Artificial Sequence: Synthetic oligonucleotide
  Target: ATXN1; (-) strand; PAM type: YTN; PAM sequence: CTC
gaactcctggcctcaggtga

SEQ ID NO: 204315 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctggcctca

SEQ ID NO: 204316 - DNA, 20 bp, Artificial Sequence
  Description of Artificial Sequence: Synthetic oligonucleotide
  Target: ATXN1; (-) strand; PAM type: YTN; PAM sequence: CTA
ggctggtctcgaactcctgg

SEQ ID NO: 204317 - DNA, 20 bp, Artificial Sequence
  Description of Artificial Sequence: Synthetic oligonucleotide
  Target: ATXN1; (-) strand; PAM type: YTN; PAM sequence: TTG
gctaggctggtctcgaactc

SEQ ID NO: 204318 - DNA, 20 bp, Artificial Sequence
  Description of Artificial Sequence: Synthetic oligonucleotide
  Target: ATXN1; (-) strand; PAM type: YTN; PAM sequence: CTA
tgttggctaggctggtctcg

SEQ ID NO: 204319 - DNA, 20 bp, Artificial Sequence
  Description of Artificial Sequence: Synthetic oligonucleotide
  Target: ATXN1; (-) strand; PAM type: YTN; PAM sequence: TTC
actatgttggctaggctggt

SEQ ID NO: 204320 - DNA, 20 bp, Artificial Sequence
  Description of Artificial Sequence: Synthetic oligonucleotide
  Target: ATXN1; (-) strand; PAM type: YTN; PAM sequence: TTT
cactatgttggctaggctgg

SEQ ID NO: 204321 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcacta

SEQ ID NO: 204322 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcact

SEQ ID NO: 204323 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 204324 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 204325 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 204326 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 204327 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 204328 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 204329 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 204330 - DNA, 20 bp, Artificial Sequence
  Description of Artificial Sequence: Synthetic oligonucleotide
  Target: ATXN1; (-) strand; PAM type: YTN; PAM sequence: CTG
gctaatttttgtatttttag

SEQ ID NO: 204331 - DNA, 20 bp, Artificial Sequence
  Description of Artificial Sequence: Synthetic oligonucleotide
  Target: ATXN1; (-) strand; PAM type: YTN; PAM sequence: CTG
cacctggctaatttttgtat

SEQ ID NO: 204332 - DNA, 20 bp, Artificial Sequence
  Description of Artificial Sequence: Synthetic oligonucleotide
  Target: ATXN1; (-) strand; PAM type: YTN; PAM sequence: CTA
caggtgtgcgccactgcacc

SEQ ID NO: 204333 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgtgcgccac

SEQ ID NO: 204334 - DNA, 20 bp, Artificial Sequence
  Description of Artificial Sequence: Synthetic oligonucleotide
  Target: ATXN1; (-) strand; PAM type: YTN; PAM sequence: TTC
ccaagtagctgggactacag

SEQ ID NO: 204335 - DNA, 20 bp, Artificial Sequence
  Description of Artificial Sequence: Synthetic oligonucleotide
  Target: ATXN1; (-) strand; PAM type: YTN; PAM sequence: CTT
cccaagtagctgggactaca

SEQ ID NO: 204336 - DNA, 20 bp, Artificial Sequence
  Description of Artificial Sequence: Synthetic oligonucleotide
  Target: ATXN1; (-) strand; PAM type: YTN; PAM sequence: CTC
agcttcccaagtagctggga

SEQ ID NO: 204337 - DNA, 20 bp, Artificial Sequence
  Description of Artificial Sequence: Synthetic oligonucleotide
  Target: ATXN1; (-) strand; PAM type: YTN; PAM sequence: TTG
cctcagcttcccaagtagct

SEQ ID NO: 204338 - DNA, 20 bp, Artificial Sequence
  Description of Artificial Sequence: Synthetic oligonucleotide
  Target: ATXN1; (-) strand; PAM type: YTN; PAM sequence: TTT
gcctcagcttcccaagtagc

SEQ ID NO: 204339 - DNA, 20 bp, Artificial Sequence
  Description of Artificial Sequence: Synthetic oligonucleotide
  Target: ATXN1; (-) strand; PAM type: YTN; PAM sequence: TTT
tgcctcagcttcccaagtag

SEQ ID NO: 204340 - DNA, 20 bp, Artificial Sequence
  Description of Artificial Sequence: Synthetic oligonucleotide
  Target: ATXN1; (-) strand; PAM type: YTN; PAM sequence: CTT
ttgcctcagcttcccaagta

SEQ ID NO: 204341 - DNA, 20 bp, Artificial Sequence
  Description of Artificial Sequence: Synthetic oligonucleotide
  Target: ATXN1; (-) strand; PAM type: YTN; PAM sequence: TTC
aagcaatccttttgcctcag

SEQ ID NO: 204342 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcaatccttt

SEQ ID NO: 204343 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcaagcaatc

SEQ ID NO: 204344 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggttcaagcaa

SEQ ID NO: 204345 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccaggtt

SEQ ID NO: 204346 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgcctccca

SEQ ID NO: 204347 - DNA, 20 bp, Artificial Sequence
  Description of Artificial Sequence: Synthetic oligonucleotide
  Target: ATXN1; (-) strand; PAM type: YTN; PAM sequence: CTC
ggctcactgcaacctctgcc

SEQ ID NO: 204348 - DNA, 20 bp, Artificial Sequence
  Description of Artificial Sequence: Synthetic oligonucleotide
  Target: ATXN1; (-) strand; PAM type: YTN; PAM sequence: CTG
gagtgcaatggcacgatctc

SEQ ID NO: 204349 - DNA, 20 bp, Artificial Sequence
  Description of Artificial Sequence: Synthetic oligonucleotide
  Target: ATXN1; (-) strand; PAM type: YTN; PAM sequence: TTG
cccaagctggagtgcaatgg

SEQ ID NO: 204350 - DNA, 20 bp, Artificial Sequence
  Description of Artificial Sequence: Synthetic oligonucleotide
  Target: ATXN1; (-) strand; PAM type: YTN; PAM sequence: CTG
ttgcccaagctggagtgcaa

SEQ ID NO: 204351 - DNA, 20 bp, Artificial Sequence
  Description of Artificial Sequence: Synthetic oligonucleotide
  Target: ATXN1; (-) strand; PAM type: YTN; PAM sequence: CTC
tgttgcccaagctggagtgc

SEQ ID NO: 204352 - DNA, 20 bp, Artificial Sequence
  Description of Artificial Sequence: Synthetic oligonucleotide
  Target: ATXN1; (-) strand; PAM type: YTN; PAM sequence: TTG
ctctgttgcccaagctggag

SEQ ID NO: 204353 - DNA, 20 bp, Artificial Sequence
  Description of Artificial Sequence: Synthetic oligonucleotide
  Target: ATXN1; (-) strand; PAM type: YTN; PAM sequence: CTT
gctctgttgcccaagctgga

SEQ ID NO: 204354 - DNA, 20 bp, Artificial Sequence
  Description of Artificial Sequence: Synthetic oligonucleotide
  Target: ATXN1; (-) strand; PAM type: YTN; PAM sequence: TTG
agacagagtcttgctctgtt

SEQ ID NO: 204355 - DNA, 20 bp, Artificial Sequence
  Description of Artificial Sequence: Synthetic oligonucleotide
  Target: ATXN1; (-) strand; PAM type: YTN; PAM sequence: TTT
gagacagagtcttgctctgt

SEQ ID NO: 204356 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtcttgctctg

SEQ ID NO: 204357 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtcttgctct

SEQ ID NO: 204358 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtcttgctc

SEQ ID NO: 204359 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtcttgct

SEQ ID NO: 204360 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtcttgc

SEQ ID NO: 204361 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtcttg

SEQ ID NO: 204362 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtctt

SEQ ID NO: 204363 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagtct

SEQ ID NO: 204364 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtc

SEQ ID NO: 204365 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 204366 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 204367 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaga

SEQ ID NO: 204368 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacag

SEQ ID NO: 204369 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagaca

SEQ ID NO: 204370 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttgagac

SEQ ID NO: 204371 - DNA, 20 bp, Artificial Sequence
  Description of Artificial Sequence: Synthetic oligonucleotide
  Target: ATXN1; (-) strand; PAM type: YTN; PAM sequence: CTT
ttttttttttttttttgaga

SEQ ID NO: 204372 - DNA, 20 bp, Artificial Sequence
  Description of Artificial Sequence: Synthetic oligonucleotide
  Target: ATXN1; (-) strand; PAM type: YTN; PAM sequence: TTC
cttttttttttttttttttg

SEQ ID NO: 204373 - DNA, 20 bp, Artificial Sequence
  Description of Artificial Sequence: Synthetic oligonucleotide
  Target: ATXN1; (-) strand; PAM type: YTN; PAM sequence: TTT
cctttttttttttttttttt

SEQ ID NO: 204374 - DNA, 20 bp, Artificial Sequence
  Description of Artificial Sequence: Synthetic oligonucleotide
  Target: ATXN1; (-) strand; PAM type: YTN; PAM sequence: TTT
tccttttttttttttttttt

SEQ ID NO: 204375 - DNA, 20 bp, Artificial Sequence
  Description of Artificial Sequence: Synthetic oligonucleotide
  Target: ATXN1; (-) strand; PAM type: YTN; PAM sequence: TTT
ttcctttttttttttttttt

SEQ ID NO: 204376 - DNA, 20 bp, Artificial Sequence
  Description of Artificial Sequence: Synthetic oligonucleotide
  Target: ATXN1; (-) strand; PAM type: YTN; PAM sequence: TTT
tttccttttttttttttttt

SEQ ID NO: 204377 - DNA, 20 bp, Artificial Sequence
  Description of Artificial Sequence: Synthetic oligonucleotide
  Target: ATXN1; (-) strand; PAM type: YTN; PAM sequence: TTT
ttttcctttttttttttttt

SEQ ID NO: 204378 - DNA, 20 bp, Artificial Sequence
  Description of Artificial Sequence: Synthetic oligonucleotide
  Target: ATXN1; (-) strand; PAM type: YTN; PAM sequence: TTT
tttttccttttttttttttt

SEQ ID NO: 204379 - DNA, 20 bp, Artificial Sequence
  Description of Artificial Sequence: Synthetic oligonucleotide
  Target: ATXN1; (-) strand; PAM type: YTN; PAM sequence: TTA
agcggtaaaccacatgattt

SEQ ID NO: 204380 - DNA, 20 bp, Artificial Sequence
  Description of Artificial Sequence: Synthetic oligonucleotide
  Target: ATXN1; (-) strand; PAM type: YTN; PAM sequence: CTG
ttaagcggtaaaccacatga

SEQ ID NO: 204381 - DNA, 20 bp, Artificial Sequence
  Description of Artificial Sequence: Synthetic oligonucleotide
  Target: ATXN1; (-) strand; PAM type: YTN; PAM sequence: CTC
tgttaagcggtaaaccacat

SEQ ID NO: 204382 - DNA, 20 bp, Artificial Sequence
  Description of Artificial Sequence: Synthetic oligonucleotide
  Target: ATXN1; (-) strand; PAM type: YTN; PAM sequence: CTC
tctgttaagcggtaaaccac

SEQ ID NO: 204383 - DNA, 20 bp, Artificial Sequence
  Description of Artificial Sequence: Synthetic oligonucleotide
  Target: ATXN1; (-) strand; PAM type: YTN; PAM sequence: TTG
tccactctctgttaagcggt

SEQ ID NO: 204384 - DNA, 20 bp, Artificial Sequence
  Description of Artificial Sequence: Synthetic oligonucleotide
  Target: ATXN1; (-) strand; PAM type: YTN; PAM sequence: CTG
taacagaattgtccactctc

SEQ ID NO: 204385 - DNA, 20 bp, Artificial Sequence
  Description of Artificial Sequence: Synthetic oligonucleotide
  Target: ATXN1; (-) strand; PAM type: YTN; PAM sequence: CTG
gtaagccctgtaacagaatt

SEQ ID NO: 204386 - DNA, 20 bp, Artificial Sequence
  Description of Artificial Sequence: Synthetic oligonucleotide
  Target: ATXN1; (-) strand; PAM type: YTN; PAM sequence: TTC
tggtaagccctgtaacagaa

SEQ ID NO: 204387 - DNA, 20 bp, Artificial Sequence
  Description of Artificial Sequence: Synthetic oligonucleotide
  Target: ATXN1; (-) strand; PAM type: YTN; PAM sequence: TTC
caaaaatattctggtaagcc

SEQ ID NO: 204388 - DNA, 20 bp, Artificial Sequence
  Description of Artificial Sequence: Synthetic oligonucleotide
  Target: ATXN1; (-) strand; PAM type: YTN; PAM sequence: TTT
ccaaaaatattctggtaagc

SEQ ID NO: 204389 - DNA, 20 bp, Artificial Sequence
  Description of Artificial Sequence: Synthetic oligonucleotide
  Target: ATXN1; (-) strand; PAM type: YTN; PAM sequence: TTT
tccaaaaatattctggtaag

SEQ ID NO: 204390 - DNA, 20 bp, Artificial Sequence
  Description of Artificial Sequence: Synthetic oligonucleotide
  Target: ATXN1; (-) strand; PAM type: YTN; PAM sequence: TTT
ttccaaaaatattctggtaa

SEQ ID NO: 204391 - DNA, 20 bp, Artificial Sequence
  Description of Artificial Sequence: Synthetic oligonucleotide
  Target: ATXN1; (-) strand; PAM type: YTN; PAM sequence: TTA
cagaatttttccaaaaatat

SEQ ID NO: 204392 - DNA, 20 bp, Artificial Sequence
  Description of Artificial Sequence: Synthetic oligonucleotide
  Target: ATXN1; (-) strand; PAM type: YTN; PAM sequence: TTT
acagaatttttccaaaaata

SEQ ID NO: 204393 - DNA, 20 bp, Artificial Sequence
  Description of Artificial Sequence: Synthetic oligonucleotide
  Target: ATXN1; (-) strand; PAM type: YTN; PAM sequence: CTA
tgtttacagaatttttccaa

SEQ ID NO: 204394 - DNA, 20 bp, Artificial Sequence
  Description of Artificial Sequence: Synthetic oligonucleotide
  Target: ATXN1; (-) strand; PAM type: YTN; PAM sequence: TTC
tatgtttacagaatttttcc

SEQ ID NO: 204395 - DNA, 20 bp, Artificial Sequence
  Description of Artificial Sequence: Synthetic oligonucleotide
  Target: ATXN1; (-) strand; PAM type: YTN; PAM sequence: CTT
ctatgtttacagaatttttc

SEQ ID NO: 204396 - DNA, 20 bp, Artificial Sequence
  Description of Artificial Sequence: Synthetic oligonucleotide
  Target: ATXN1; (-) strand; PAM type: YTN; PAM sequence: TTC
ttctatgtttacagaatttt

SEQ ID NO: 204397 - DNA, 20 bp, Artificial Sequence
  Description of Artificial Sequence: Synthetic oligonucleotide
  Target: ATXN1; (-) strand; PAM type: YTN; PAM sequence: CTC
agaaattcttctatgtttac

SEQ ID NO: 204398 - DNA, 20 bp, Artificial Sequence
  Description of Artificial Sequence: Synthetic oligonucleotide
  Target: ATXN1; (-) strand; PAM type: YTN; PAM sequence: CTG
gctcagaaattcttctatgt

SEQ ID NO: 204399 - DNA, 20 bp, Artificial Sequence
  Description of Artificial Sequence: Synthetic oligonucleotide
  Target: ATXN1; (-) strand; PAM type: YTN; PAM sequence: TTC
tggctcagaaattcttctat

SEQ ID NO: 204400 - DNA, 20 bp, Artificial Sequence
  Description of Artificial Sequence: Synthetic oligonucleotide
  Target: ATXN1; (-) strand; PAM type: YTN; PAM sequence: TTT
ctggctcagaaattcttcta

SEQ ID NO: 204401 - DNA, 20 bp, Artificial Sequence
  Description of Artificial Sequence: Synthetic oligonucleotide
  Target: ATXN1; (-) strand; PAM type: YTN; PAM sequence: TTT
tctggctcagaaattcttct

SEQ ID NO: 204402 - DNA, 20 bp, Artificial Sequence
  Description of Artificial Sequence: Synthetic oligonucleotide
  Target: ATXN1; (-) strand; PAM type: YTN; PAM sequence: TTT
ttctggctcagaaattcttc

SEQ ID NO: 204403 - DNA, 20 bp, Artificial Sequence
  Description of Artificial Sequence: Synthetic oligonucleotide
  Target: ATXN1; (-) strand; PAM type: YTN; PAM sequence: CTC
atttttctggctcagaaatt

SEQ ID NO: 204404 - DNA, 20 bp, Artificial Sequence
  Description of Artificial Sequence: Synthetic oligonucleotide
  Target: ATXN1; (-) strand; PAM type: YTN; PAM sequence: TTC
tcatttttctggctcagaaa

SEQ ID NO: 204405 - DNA, 20 bp, Artificial Sequence
  Description of Artificial Sequence: Synthetic oligonucleotide
  Target: ATXN1; (-) strand; PAM type: YTN; PAM sequence: CTT
ctcatttttctggctcagaa

SEQ ID NO: 204406 - DNA, 20 bp, Artificial Sequence
  Description of Artificial Sequence: Synthetic oligonucleotide
  Target: ATXN1; (-) strand; PAM type: YTN; PAM sequence: CTG
cttctcatttttctggctca

SEQ ID NO: 204407 - DNA, 20 bp, Artificial Sequence
  Description of Artificial Sequence: Synthetic oligonucleotide
  Target: ATXN1; (-) strand; PAM type: YTN; PAM sequence: TTC
tgcttctcatttttctggct

SEQ ID NO: 204408 - DNA, 20 bp, Artificial Sequence
  Description of Artificial Sequence: Synthetic oligonucleotide
  Target: ATXN1; (-) strand; PAM type: YTN; PAM sequence: TTT
ctgcttctcatttttctggc

SEQ ID NO: 204409 - DNA, 20 bp, Artificial Sequence
  Description of Artificial Sequence: Synthetic oligonucleotide
  Target: ATXN1; (-) strand; PAM type: YTN; PAM sequence: TTT
tctgcttctcatttttctgg

SEQ ID NO: 204410 - DNA, 20 bp, Artificial Sequence
  Description of Artificial Sequence: Synthetic oligonucleotide
  Target: ATXN1; (-) strand; PAM type: YTN; PAM sequence: TTT
ttctgcttctcatttttctg

SEQ ID NO: 204411 - DNA, 20 bp, Artificial Sequence
  Description of Artificial Sequence: Synthetic oligonucleotide
  Target: ATXN1; (-) strand; PAM type: YTN; PAM sequence: TTT
tttctgcttctcatttttct

SEQ ID NO: 204412 - DNA, 20 bp, Artificial Sequence
  Description of Artificial Sequence: Synthetic oligonucleotide
  Target: ATXN1; (-) strand; PAM type: YTN; PAM sequence: TTA
ttttttctgcttctcatttt

SEQ ID NO: 204413 - DNA, 20 bp, Artificial Sequence
  Description of Artificial Sequence: Synthetic oligonucleotide
  Target: ATXN1; (-) strand; PAM type: YTN; PAM sequence: TTC
atatgaattattttttctgc

SEQ ID NO: 204414 - DNA, 20 bp, Artificial Sequence
  Description of Artificial Sequence: Synthetic oligonucleotide
  Target: ATXN1; (-) strand; PAM type: YTN; PAM sequence: TTA
aaaattcatatgaattattt

SEQ ID NO: 204415 - DNA, 20 bp, Artificial Sequence
  Description of Artificial Sequence: Synthetic oligonucleotide
  Target: ATXN1; (-) strand; PAM type: YTN; PAM sequence: TTT
aaaaattcatatgaattatt

SEQ ID NO: 204416 - DNA, 20 bp, Artificial Sequence
  Description of Artificial Sequence: Synthetic oligonucleotide
  Target: ATXN1; (-) strand; PAM type: YTN; PAM sequence: TTG
tataaaaatttaaaaattca

SEQ ID NO: 204417 - DNA, 20 bp, Artificial Sequence
  Description of Artificial Sequence: Synthetic oligonucleotide
  Target: ATXN1; (-) strand; PAM type: YTN; PAM sequence: CTA
ttgtataaaaatttaaaaat

SEQ ID NO: 204418 - DNA, 20 bp, Artificial Sequence
  Description of Artificial Sequence: Synthetic oligonucleotide
  Target: ATXN1; (-) strand; PAM type: YTN; PAM sequence: TTA
gagaagcagtcatatcagag

SEQ ID NO: 204419 - DNA, 20 bp, Artificial Sequence
  Description of Artificial Sequence: Synthetic oligonucleotide
  Target: ATXN1; (-) strand; PAM type: YTN; PAM sequence: CTT
agagaagcagtcatatcaga

SEQ ID NO: 204420 - DNA, 20 bp, Artificial Sequence
  Description of Artificial Sequence: Synthetic oligonucleotide
  Target: ATXN1; (-) strand; PAM type: YTN; PAM sequence: CTC
agagacagtaatcacatgtg

SEQ ID NO: 204421 - DNA, 20 bp, Artificial Sequence
  Description of Artificial Sequence: Synthetic oligonucleotide
  Target: ATXN1; (-) strand; PAM type: YTN; PAM sequence: CTC
tcagagacagtaatcacatg

SEQ ID NO: 204422 - DNA, 20 bp, Artificial Sequence
  Description of Artificial Sequence: Synthetic oligonucleotide
  Target: ATXN1; (-) strand; PAM type: YTN; PAM sequence: TTA
tggcatggagtgagctctca

SEQ ID NO: 204423 - DNA, 20 bp, Artificial Sequence
  Description of Artificial Sequence: Synthetic oligonucleotide
  Target: ATXN1; (-) strand; PAM type: YTN; PAM sequence: CTT
atggcatggagtgagctctc

SEQ ID NO: 204424 - DNA, 20 bp, Artificial Sequence
  Description of Artificial Sequence: Synthetic oligonucleotide
  Target: ATXN1; (-) strand; PAM type: YTN; PAM sequence: TTC
ttatggcatggagtgagctc

SEQ ID NO: 204425 - DNA, 20 bp, Artificial Sequence
  Description of Artificial Sequence: Synthetic oligonucleotide
  Target: ATXN1; (-) strand; PAM type: YTN; PAM sequence: TTT
cttatggcatggagtgagct

SEQ ID NO: 204426 - DNA, 20 bp, Artificial Sequence
  Description of Artificial Sequence: Synthetic oligonucleotide
  Target: ATXN1; (-) strand; PAM type: YTN; PAM sequence: CTG
caatttcttatggcatggag

SEQ ID NO: 204427 - DNA, 20 bp, Artificial Sequence
  Description of Artificial Sequence: Synthetic oligonucleotide
  Target: ATXN1; (-) strand; PAM type: YTN; PAM sequence: CTC
tgcaatttcttatggcatgg

SEQ ID NO: 204428 - DNA, 20 bp, Artificial Sequence
  Description of Artificial Sequence: Synthetic oligonucleotide
  Target: ATXN1; (-) strand; PAM type: YTN; PAM sequence: CTA
taactctgcaatttcttatg

SEQ ID NO: 204429 - DNA, 20 bp, Artificial Sequence
  Description of Artificial Sequence: Synthetic oligonucleotide
  Target: ATXN1; (-) strand; PAM type: YTN; PAM sequence: TTC
tataactctgcaatttctta

SEQ ID NO: 204430 - DNA, 20 bp, Artificial Sequence
  Description of Artificial Sequence: Synthetic oligonucleotide
  Target: ATXN1; (-) strand; PAM type: YTN; PAM sequence: TTT
ctataactctgcaatttctt

SEQ ID NO: 204431 - DNA, 20 bp, Artificial Sequence
  Description of Artificial Sequence: Synthetic oligonucleotide
  Target: ATXN1; (-) strand; PAM type: YTN; PAM sequence: CTA
tttctataactctgcaattt

SEQ ID NO: 204432 - DNA, 20 bp, Artificial Sequence
  Description of Artificial Sequence: Synthetic oligonucleotide
  Target: ATXN1; (-) strand; PAM type: YTN; PAM sequence: CTA
catatgctatttctataact

SEQ ID NO: 204433 - DNA, 20 bp, Artificial Sequence
  Description of Artificial Sequence: Synthetic oligonucleotide
  Target: ATXN1; (-) strand; PAM type: YTN; PAM sequence: CTC
tacatatgctatttctataa

SEQ ID NO: 204434 - DNA, 20 bp, Artificial Sequence
  Description of Artificial Sequence: Synthetic oligonucleotide
  Target: ATXN1; (-) strand; PAM type: YTN; PAM sequence: TTG
tagagccctctacatatgct

SEQ ID NO: 204435 - DNA, 20 bp, Artificial Sequence
  Description of Artificial Sequence: Synthetic oligonucleotide
  Target: ATXN1; (-) strand; PAM type: YTN; PAM sequence: TTG
taaattgtagagccctctac

SEQ ID NO: 204436 - DNA, 20 bp, Artificial Sequence
  Description of Artificial Sequence: Synthetic oligonucleotide
  Target: ATXN1; (-) strand; PAM type: YTN; PAM sequence: TTT
gtaaattgtagagccctcta

SEQ ID NO: 204437 - DNA, 20 bp, Artificial Sequence
  Description of Artificial Sequence: Synthetic oligonucleotide
  Target: ATXN1; (-) strand; PAM type: YTN; PAM sequence: TTT
tgtaaattgtagagccctct

SEQ ID NO: 204438 - DNA, 20 bp, Artificial Sequence
  Description of Artificial Sequence: Synthetic oligonucleotide
  Target: ATXN1; (-) strand; PAM type: YTN; PAM sequence: TTG
aaaatgttttgtaaattgta

SEQ ID NO: 204439 - DNA, 20 bp, Artificial Sequence
  Description of Artificial Sequence: Synthetic oligonucleotide
  Target: ATXN1; (-) strand; PAM type: YTN; PAM sequence: TTG
tgatgatcaaatgagataat

SEQ ID NO: 204440 - DNA, 20 bp, Artificial Sequence
  Description of Artificial Sequence: Synthetic oligonucleotide
  Target: ATXN1; (-) strand; PAM type: YTN; PAM sequence: CTC
acaggggtattgtgatgatc

SEQ ID NO: 204441 - DNA, 20 bp, Artificial Sequence
  Description of Artificial Sequence: Synthetic oligonucleotide
  Target: ATXN1; (-) strand; PAM type: YTN; PAM sequence: CTG
tctcacaggggtattgtgat

SEQ ID NO: 204442 - DNA, 20 bp, Artificial Sequence
  Description of Artificial Sequence: Synthetic oligonucleotide
  Target: ATXN1; (-) strand; PAM type: YTN; PAM sequence: TTA
taatatctgtctcacagggg

SEQ ID NO: 204443 - DNA, 20 bp, Artificial Sequence
  Description of Artificial Sequence: Synthetic oligonucleotide
  Target: ATXN1; (-) strand; PAM type: YTN; PAM sequence: CTA
taaaatagaaataattataa

SEQ ID NO: 204444 - DNA, 20 bp, Artificial Sequence
  Description of Artificial Sequence: Synthetic oligonucleotide
  Target: ATXN1; (-) strand; PAM type: YTN; PAM sequence: CTC
tataaaatagaaataattat

SEQ ID NO: 204445 - DNA, 20 bp, Artificial Sequence
  Description of Artificial Sequence: Synthetic oligonucleotide
  Target: ATXN1; (-) strand; PAM type: YTN; PAM sequence: TTC
cgcatctctataaaatagaa

SEQ ID NO: 204446 - DNA, 20 bp, Artificial Sequence
  Description of Artificial Sequence: Synthetic oligonucleotide
  Target: ATXN1; (-) strand; PAM type: YTN; PAM sequence: TTT
ccgcatctctataaaataga

SEQ ID NO: 204447 - DNA, 20 bp, Artificial Sequence
  Description of Artificial Sequence: Synthetic oligonucleotide
  Target: ATXN1; (-) strand; PAM type: YTN; PAM sequence: TTT
tccgcatctctataaaatag

SEQ ID NO: 204448 - DNA, 20 bp, Artificial Sequence
  Description of Artificial Sequence: Synthetic oligonucleotide
  Target: ATXN1; (-) strand; PAM type: YTN; PAM sequence: TTT
ttccgcatctctataaaata

SEQ ID NO: 204449 - DNA, 20 bp, Artificial Sequence
  Description of Artificial Sequence: Synthetic oligonucleotide
  Target: ATXN1; (-) strand; PAM type: YTN; PAM sequence: TTT
tttccgcatctctataaaat

SEQ ID NO: 204450 - DNA, 20 bp, Artificial Sequence
  Description of Artificial Sequence: Synthetic oligonucleotide
  Target: ATXN1; (-) strand; PAM type: YTN; PAM sequence: CTG
agggttttttccgcatctct

SEQ ID NO: 204451 - DNA, 20 bp, Artificial Sequence
  Description of Artificial Sequence: Synthetic oligonucleotide
  Target: ATXN1; (-) strand; PAM type: YTN; PAM sequence: CTC
aaaatctgagggttttttcc

SEQ ID NO: 204452 - DNA, 20 bp, Artificial Sequence
  Description of Artificial Sequence: Synthetic oligonucleotide
  Target: ATXN1; (-) strand; PAM type: YTN; PAM sequence: TTA
gggaaatcactcaaaatctg

SEQ ID NO: 204453 - DNA, 20 bp, Artificial Sequence
  Description of Artificial Sequence: Synthetic oligonucleotide
  Target: ATXN1; (-) strand; PAM type: YTN; PAM sequence: CTT
agggaaatcactcaaaatct

SEQ ID NO: 204454 - DNA, 20 bp, Artificial Sequence
  Description of Artificial Sequence: Synthetic oligonucleotide
  Target: ATXN1; (-) strand; PAM type: YTN; PAM sequence: TTG
tgaccttagggaaatcactc

SEQ ID NO: 204455 - DNA, 20 bp, Artificial Sequence
  Description of Artificial Sequence: Synthetic oligonucleotide
  Target: ATXN1; (-) strand; PAM type: YTN; PAM sequence: TTT
gtgaccttagggaaatcact

SEQ ID NO: 204456 - DNA, 20 bp, Artificial Sequence
  Description of Artificial Sequence: Synthetic oligonucleotide
  Target: ATXN1; (-) strand; PAM type: YTN; PAM sequence: CTT
tgtgaccttagggaaatcac

SEQ ID NO: 204457 - DNA, 20 bp, Artificial Sequence
  Description of Artificial Sequence: Synthetic oligonucleotide
  Target: ATXN1; (-) strand; PAM type: YTN; PAM sequence: TTA
tcagctttgtgaccttaggg

SEQ ID NO: 204458 - DNA, 20 bp, Artificial Sequence
  Description of Artificial Sequence: Synthetic oligonucleotide
  Target: ATXN1; (-) strand; PAM type: YTN; PAM sequence: CTT
atcagctttgtgaccttagg

SEQ ID NO: 204459 - DNA, 20 bp, Artificial Sequence
  Description of Artificial Sequence: Synthetic oligonucleotide
  Target: ATXN1; (-) strand; PAM type: YTN; PAM sequence: CTG
caacttatcagctttgtgac

SEQ ID NO: 204460 - DNA, 20 bp, Artificial Sequence
  Description of Artificial Sequence: Synthetic oligonucleotide
  Target: ATXN1; (-) strand; PAM type: YTN; PAM sequence: TTC
tgcaacttatcagctttgtg

SEQ ID NO: 204461 - DNA, 20 bp, Artificial Sequence
  Description of Artificial Sequence: Synthetic oligonucleotide
  Target: ATXN1; (-) strand; PAM type: YTN; PAM sequence: CTC
agttctgcaacttatcagct

SEQ ID NO: 204462 - DNA, 20 bp, Artificial Sequence
  Description of Artificial Sequence: Synthetic oligonucleotide
  Target: ATXN1; (-) strand; PAM type: YTN; PAM sequence: TTG
aatctcagttctgcaactta

SEQ ID NO: 204463 - DNA, 20 bp, Artificial Sequence
  Description of Artificial Sequence: Synthetic oligonucleotide
  Target: ATXN1; (-) strand; PAM type: YTN; PAM sequence: TTT
gaatctcagttctgcaactt

SEQ ID NO: 204464 - DNA, 20 bp, Artificial Sequence
  Description of Artificial Sequence: Synthetic oligonucleotide
  Target: ATXN1; (-) strand; PAM type: YTN; PAM sequence: TTT
tgaatctcagttctgcaact

SEQ ID NO: 204465 - DNA, 20 bp, Artificial Sequence
  Description of Artificial Sequence: Synthetic oligonucleotide
  Target: ATXN1; (-) strand; PAM type: YTN; PAM sequence: CTA
gttttgaatctcagttctgc

SEQ ID NO: 204466 - DNA, 20 bp, Artificial Sequence
  Description of Artificial Sequence: Synthetic oligonucleotide
  Target: ATXN1; (-) strand; PAM type: YTN; PAM sequence: TTC
tagttttgaatctcagttct

SEQ ID NO: 204467 - DNA, 20 bp, Artificial Sequence
  Description of Artificial Sequence: Synthetic oligonucleotide
  Target: ATXN1; (-) strand; PAM type: YTN; PAM sequence: TTA
atgtagtgggagaaaatgaa

SEQ ID NO: 204468 - DNA, 20 bp, Artificial Sequence
  Description of Artificial Sequence: Synthetic oligonucleotide
  Target: ATXN1; (-) strand; PAM type: YTN; PAM sequence: TTC
aagaaaaatgtaataaaatt

SEQ ID NO: 204469 - DNA, 20 bp, Artificial Sequence
  Description of Artificial Sequence: Synthetic oligonucleotide
  Target: ATXN1; (-) strand; PAM type: YTN; PAM sequence: TTA
taaaatagaaccaaaaatga

SEQ ID NO: 204470 - DNA, 20 bp, Artificial Sequence
  Description of Artificial Sequence: Synthetic oligonucleotide
  Target: ATXN1; (-) strand; PAM type: YTN; PAM sequence: CTA
ttataaaatagaaccaaaaa

SEQ ID NO: 204471 - DNA, 20 bp, Artificial Sequence
  Description of Artificial Sequence: Synthetic oligonucleotide
  Target: ATXN1; (-) strand; PAM type: YTN; PAM sequence: CTA
ctattataaaatagaaccaa

SEQ ID NO: 204472 - DNA, 20 bp, Artificial Sequence
  Description of Artificial Sequence: Synthetic oligonucleotide
  Target: ATXN1; (-) strand; PAM type: YTN; PAM sequence: TTA
tagagtctactattataaaa

SEQ ID NO: 204473 - DNA, 20 bp, Artificial Sequence
  Description of Artificial Sequence: Synthetic oligonucleotide
  Target: ATXN1; (-) strand; PAM type: YTN; PAM sequence: TTT
atagagtctactattataaa

SEQ ID NO: 204474 - DNA, 20 bp, Artificial Sequence
  Description of Artificial Sequence: Synthetic oligonucleotide
  Target: ATXN1; (-) strand; PAM type: YTN; PAM sequence: TTA
tgtaatgagcagaatttata

SEQ ID NO: 204475 - DNA, 20 bp, Artificial Sequence
  Description of Artificial Sequence: Synthetic oligonucleotide
  Target: ATXN1; (-) strand; PAM type: YTN; PAM sequence: TTT
atgtaatgagcagaatttat

SEQ ID NO: 204476 - DNA, 20 bp, Artificial Sequence
  Description of Artificial Sequence: Synthetic oligonucleotide
  Target: ATXN1; (-) strand; PAM type: YTN; PAM sequence: TTA
gaagcacataaaatgtttat

SEQ ID NO: 204477 - DNA, 20 bp, Artificial Sequence
  Description of Artificial Sequence: Synthetic oligonucleotide
  Target: ATXN1; (-) strand; PAM type: YTN; PAM sequence: TTT
agaagcacataaaatgttta

SEQ ID NO: 204478 - DNA, 20 bp, Artificial Sequence
  Description of Artificial Sequence: Synthetic oligonucleotide
  Target: ATXN1; (-) strand; PAM type: YTN; PAM sequence: TTC
atttagaagcacataaaatg

SEQ ID NO: 204479 - DNA, 20 bp, Artificial Sequence
  Description of Artificial Sequence: Synthetic oligonucleotide
  Target: ATXN1; (-) strand; PAM type: YTN; PAM sequence: TTT
catttagaagcacataaaat

SEQ ID NO: 204480 - DNA, 20 bp, Artificial Sequence
  Description of Artificial Sequence: Synthetic oligonucleotide
  Target: ATXN1; (-) strand; PAM type: YTN; PAM sequence: TTA
aagagtcagtttcatttaga

SEQ ID NO: 204481 - DNA, 20 bp, Artificial Sequence
  Description of Artificial Sequence: Synthetic oligonucleotide
  Target: ATXN1; (-) strand; PAM type: YTN; PAM sequence: TTA
gagattaaagagtcagtttc

SEQ ID NO: 204482 - DNA, 20 bp, Artificial Sequence
  Description of Artificial Sequence: Synthetic oligonucleotide
  Target: ATXN1; (-) strand; PAM type: YTN; PAM sequence: TTT
agagattaaagagtcagttt

SEQ ID NO: 204483 - DNA, 20 bp, Artificial Sequence
  Description of Artificial Sequence: Synthetic oligonucleotide
  Target: ATXN1; (-) strand; PAM type: YTN; PAM sequence: TTA
ccaaaaaatttagagattaa

SEQ ID NO: 204484 - DNA, 20 bp, Artificial Sequence
  Description of Artificial Sequence: Synthetic oligonucleotide
  Target: ATXN1; (-) strand; PAM type: YTN; PAM sequence: TTA
accagaaaatagaacgttac

SEQ ID NO: 204485 - DNA, 20 bp, Artificial Sequence
  Description of Artificial Sequence: Synthetic oligonucleotide
  Target: ATXN1; (-) strand; PAM type: YTN; PAM sequence: TTT
aaccagaaaatagaacgtta

SEQ ID NO: 204486 - DNA, 20 bp, Artificial Sequence
  Description of Artificial Sequence: Synthetic oligonucleotide
  Target: ATXN1; (-) strand; PAM type: YTN; PAM sequence: TTA
gtttaaccagaaaatagaac

SEQ ID NO: 204487 - DNA, 20 bp, Artificial Sequence
  Description of Artificial Sequence: Synthetic oligonucleotide
  Target: ATXN1; (-) strand; PAM type: YTN; PAM sequence: TTT
agtttaaccagaaaatagaa

SEQ ID NO: 204488 - DNA, 20 bp, Artificial Sequence
  Description of Artificial Sequence: Synthetic oligonucleotide
  Target: ATXN1; (-) strand; PAM type: YTN; PAM sequence: TTT
tagtttaaccagaaaataga

SEQ ID NO: 204489 - DNA, 20 bp, Artificial Sequence
  Description of Artificial Sequence: Synthetic oligonucleotide
  Target: ATXN1; (-) strand; PAM type: YTN; PAM sequence: CTG
ggcattttagtttaaccaga

SEQ ID NO: 204490 - DNA, 20 bp, Artificial Sequence
  Description of Artificial Sequence: Synthetic oligonucleotide
  Target: ATXN1; (-) strand; PAM type: YTN; PAM sequence: TTC
cagggaataaagaaagcaga

SEQ ID NO: 204491 - DNA, 20 bp, Artificial Sequence
  Description of Artificial Sequence: Synthetic oligonucleotide
  Target: ATXN1; (-) strand; PAM type: YTN; PAM sequence: CTC
aaaaggaagattccagggaa

SEQ ID NO: 204492 - DNA, 20 bp, Artificial Sequence
  Description of Artificial Sequence: Synthetic oligonucleotide
  Target: ATXN1; (-) strand; PAM type: YTN; PAM sequence: CTC
tcaaaaggaagattccaggg

SEQ ID NO: 204493 - DNA, 20 bp, Artificial Sequence
  Description of Artificial Sequence: Synthetic oligonucleotide
  Target: ATXN1; (-) strand; PAM type: YTN; PAM sequence: CTC
agataatggaacatcatatc

SEQ ID NO: 204494 - DNA, 20 bp, Artificial Sequence
  Description of Artificial Sequence: Synthetic oligonucleotide
  Target: ATXN1; (-) strand; PAM type: YTN; PAM sequence: CTC
agatcctcagataatggaac

SEQ ID NO: 204495 - DNA, 20 bp, Artificial Sequence
  Description of Artificial Sequence: Synthetic oligonucleotide
  Target: ATXN1; (-) strand; PAM type: YTN; PAM sequence: TTA
gaaatcctcagatcctcaga

SEQ ID NO: 204496 - DNA, 20 bp, Artificial Sequence
  Description of Artificial Sequence: Synthetic oligonucleotide
  Target: ATXN1; (-) strand; PAM type: YTN; PAM sequence: TTG
tcaacatagttagaaatcct

SEQ ID NO: 204497 - DNA, 20 bp, Artificial Sequence
  Description of Artificial Sequence: Synthetic oligonucleotide
  Target: ATXN1; (-) strand; PAM type: YTN; PAM sequence: TTT
gtcaacatagttagaaatcc

SEQ ID NO: 204498 - DNA, 20 bp, Artificial Sequence
  Description of Artificial Sequence: Synthetic oligonucleotide
  Target: ATXN1; (-) strand; PAM type: YTN; PAM sequence: TTA
aaaagcaaaaggaagatttg

SEQ ID NO: 204499 - DNA, 20 bp, Artificial Sequence
  Description of Artificial Sequence: Synthetic oligonucleotide
  Target: ATXN1; (-) strand; PAM type: YTN; PAM sequence: TTT
aaaaagcaaaaggaagattt

SEQ ID NO: 204500 - DNA, 20 bp, Artificial Sequence
  Description of Artificial Sequence: Synthetic oligonucleotide
  Target: ATXN1; (-) strand; PAM type: YTN; PAM sequence: TTT
taaaaagcaaaaggaagatt

SEQ ID NO: 204501 - DNA, 20 bp, Artificial Sequence
  Description of Artificial Sequence: Synthetic oligonucleotide
  Target: ATXN1; (-) strand; PAM type: YTN; PAM sequence: TTT
ttaaaaagcaaaaggaagat

SEQ ID NO: 204502 - DNA, 20 bp, Artificial Sequence
  Description of Artificial Sequence: Synthetic oligonucleotide
  Target: ATXN1; (-) strand; PAM type: YTN; PAM sequence: CTC
agcaatatgtgcagcaacag

SEQ ID NO: 204503 - DNA, 20 bp, Artificial Sequence
  Description of Artificial Sequence: Synthetic oligonucleotide
  Target: ATXN1; (-) strand; PAM type: YTN; PAM sequence: CTA
ctcagcaatatgtgcagcaa

SEQ ID NO: 204504 - DNA, 20 bp, Artificial Sequence
  Description of Artificial Sequence: Synthetic oligonucleotide
  Target: ATXN1; (-) strand; PAM type: YTN; PAM sequence: TTG
aaagctactcagcaatatgt

SEQ ID NO: 204505 - DNA, 20 bp, Artificial Sequence
  Description of Artificial Sequence: Synthetic oligonucleotide
  Target: ATXN1; (-) strand; PAM type: YTN; PAM sequence: TTT
gaaagctactcagcaatatg

SEQ ID NO: 204506 - DNA, 20 bp, Artificial Sequence
  Description of Artificial Sequence: Synthetic oligonucleotide
  Target: ATXN1; (-) strand; PAM type: YTN; PAM sequence: TTA
ggatatgagcgtggaagtcg

SEQ ID NO: 204507 - DNA, 20 bp, Artificial Sequence
  Description of Artificial Sequence: Synthetic oligonucleotide
  Target: ATXN1; (-) strand; PAM type: YTN; PAM sequence: TTG
tgataaatattaggatatga

SEQ ID NO: 204508 - DNA, 20 bp, Artificial Sequence
  Description of Artificial Sequence: Synthetic oligonucleotide
  Target: ATXN1; (-) strand; PAM type: YTN; PAM sequence: CTG
gaatggggtagccattgtga

SEQ ID NO: 204509 - DNA, 20 bp, Artificial Sequence
  Description of Artificial Sequence: Synthetic oligonucleotide
  Target: ATXN1; (-) strand; PAM type: YTN; PAM sequence: TTC
tggaatggggtagccattgt

SEQ ID NO: 204510 - DNA, 20 bp, Artificial Sequence
  Description of Artificial Sequence: Synthetic oligonucleotide
  Target: ATXN1; (-) strand; PAM type: YTN; PAM sequence: TTT
ctggaatggggtagccattg

SEQ ID NO: 204511 - DNA, 20 bp, Artificial Sequence
  Description of Artificial Sequence: Synthetic oligonucleotide
  Target: ATXN1; (-) strand; PAM type: YTN; PAM sequence: TTT
tctggaatggggtagccatt

SEQ ID NO: 204512 - DNA, 20 bp, Artificial Sequence
  Description of Artificial Sequence: Synthetic oligonucleotide
  Target: ATXN1; (-) strand; PAM type: YTN; PAM sequence: TTC
agattttctggaatggggta

SEQ ID NO: 204513 - DNA, 20 bp, Artificial Sequence
  Description of Artificial Sequence: Synthetic oligonucleotide
  Target: ATXN1; (-) strand; PAM type: YTN; PAM sequence: CTT
cagattttctggaatggggt

SEQ ID NO: 204514 - DNA, 20 bp, Artificial Sequence
  Description of Artificial Sequence: Synthetic oligonucleotide
  Target: ATXN1; (-) strand; PAM type: YTN; PAM sequence: CTC
ttcagattttctggaatggg

SEQ ID NO: 204515 - DNA, 20 bp, Artificial Sequence
  Description of Artificial Sequence: Synthetic oligonucleotide
  Target: ATXN1; (-) strand; PAM type: YTN; PAM sequence: TTG
agtacaaatgtagaactctt

SEQ ID NO: 204516 - DNA, 20 bp, Artificial Sequence
  Description of Artificial Sequence: Synthetic oligonucleotide
  Target: ATXN1; (-) strand; PAM type: YTN; PAM sequence: TTC
gagaagtagatgtggttgag

SEQ ID NO: 204517 - DNA, 20 bp, Artificial Sequence
  Description of Artificial Sequence: Synthetic oligonucleotide
  Target: ATXN1; (-) strand; PAM type: YTN; PAM sequence: TTG
ggaataacagtgacagagaa

SEQ ID NO: 204518 - DNA, 20 bp, Artificial Sequence
  Description of Artificial Sequence: Synthetic oligonucleotide
  Target: ATXN1; (-) strand; PAM type: YTN; PAM sequence: CTT
gggaataacagtgacagaga

SEQ ID NO: 204519 - DNA, 20 bp, Artificial Sequence
  Description of Artificial Sequence: Synthetic oligonucleotide
  Target: ATXN1; (-) strand; PAM type: YTN; PAM sequence: TTC
caggatcttgggaataacag

SEQ ID NO: 204520 - DNA, 20 bp, Artificial Sequence
  Description of Artificial Sequence: Synthetic oligonucleotide
  Target: ATXN1; (-) strand; PAM type: YTN; PAM sequence: TTA
attccaggatcttgggaata

SEQ ID NO: 204521 - DNA, 20 bp, Artificial Sequence
  Description of Artificial Sequence: Synthetic oligonucleotide
  Target: ATXN1; (-) strand; PAM type: YTN; PAM sequence: TTT
aattccaggatcttgggaat

SEQ ID NO: 204522 - DNA, 20 bp, Artificial Sequence
  Description of Artificial Sequence: Synthetic oligonucleotide
  Target: ATXN1; (-) strand; PAM type: YTN; PAM sequence: CTG
tttaattccaggatcttggg

SEQ ID NO: 204523 - DNA, 20 bp, Artificial Sequence
  Description of Artificial Sequence: Synthetic oligonucleotide
  Target: ATXN1; (-) strand; PAM type: YTN; PAM sequence: TTC
tgtttaattccaggatcttg

SEQ ID NO: 204524 - DNA, 20 bp, Artificial Sequence
  Description of Artificial Sequence: Synthetic oligonucleotide
  Target: ATXN1; (-) strand; PAM type: YTN; PAM sequence: CTT
ctgtttaattccaggatctt

SEQ ID NO: 204525 - DNA, 20 bp, Artificial Sequence
  Description of Artificial Sequence: Synthetic oligonucleotide
  Target: ATXN1; (-) strand; PAM type: YTN; PAM sequence: CTC
ttctgtttaattccaggatc

SEQ ID NO: 204526 - DNA, 20 bp, Artificial Sequence
  Description of Artificial Sequence: Synthetic oligonucleotide
  Target: ATXN1; (-) strand; PAM type: YTN; PAM sequence: CTG
accagaaaggaaaactcttc

SEQ ID NO: 204527 - DNA, 20 bp, Artificial Sequence
  Description of Artificial Sequence: Synthetic oligonucleotide
  Target: ATXN1; (-) strand; PAM type: YTN; PAM sequence: CTG
actgaccagaaaggaaaact

SEQ ID NO: 204528 - DNA, 20 bp, Artificial Sequence
  Description of Artificial Sequence: Synthetic oligonucleotide
  Target: ATXN1; (-) strand; PAM type: YTN; PAM sequence: CTG
gaaggatgaactgactgacc

SEQ ID NO: 204529 - DNA, 20 bp, Artificial Sequence
  Description of Artificial Sequence: Synthetic oligonucleotide
  Target: ATXN1; (-) strand; PAM type: YTN; PAM sequence: CTC
tggaaggatgaactgactga

SEQ ID NO: 204530 - DNA, 20 bp, Artificial Sequence
  Description of Artificial Sequence: Synthetic oligonucleotide
  Target: ATXN1; (-) strand; PAM type: YTN; PAM sequence: CTG
gctctggaaggatgaactga

SEQ ID NO: 204531 - DNA, 20 bp, Artificial Sequence
  Description of Artificial Sequence: Synthetic oligonucleotide
  Target: ATXN1; (-) strand; PAM type: YTN; PAM sequence: TTG
ggctggctctggaaggatga

SEQ ID NO: 204532 - DNA, 20 bp, Artificial Sequence
  Description of Artificial Sequence: Synthetic oligonucleotide
  Target: ATXN1; (-) strand; PAM type: YTN; PAM sequence: TTT
gggctggctctggaaggatg

SEQ ID NO: 204533 - DNA, 20 bp, Artificial Sequence
  Description of Artificial Sequence: Synthetic oligonucleotide
  Target: ATXN1; (-) strand; PAM type: YTN; PAM sequence: CTT
tgggctggctctggaaggat

SEQ ID NO: 204534 - DNA, 20 bp, Artificial Sequence
  Description of Artificial Sequence: Synthetic oligonucleotide
  Target: ATXN1; (-) strand; PAM type: YTN; PAM sequence: TTA
aagcaccctttgggctggct

SEQ ID NO: 204535 - DNA, 20 bp, Artificial Sequence
  Description of Artificial Sequence: Synthetic oligonucleotide
  Target: ATXN1; (-) strand; PAM type: YTN; PAM sequence: CTG
agaaggagtgatgttaaagc

SEQ ID NO: 204536 - DNA, 20 bp, Artificial Sequence
  Description of Artificial Sequence: Synthetic oligonucleotide
  Target: ATXN1; (-) strand; PAM type: YTN; PAM sequence: CTC
agctgagaaggagtgatgtt

SEQ ID NO: 204537 - DNA, 20 bp, Artificial Sequence
  Description of Artificial Sequence: Synthetic oligonucleotide
  Target: ATXN1; (-) strand; PAM type: YTN; PAM sequence: TTA
taacatcagaaagtactcag

SEQ ID NO: 204538 - DNA, 20 bp, Artificial Sequence
  Description of Artificial Sequence: Synthetic oligonucleotide
  Target: ATXN1; (-) strand; PAM type: YTN; PAM sequence: TTG
taggtaagcatgttataaca

SEQ ID NO: 204539 - DNA, 20 bp, Artificial Sequence
  Description of Artificial Sequence: Synthetic oligonucleotide
  Target: ATXN1; (-) strand; PAM type: YTN; PAM sequence: CTG
cataagatagtgttgtaggt

SEQ ID NO: 204540 - DNA, 20 bp, Artificial Sequence
  Description of Artificial Sequence: Synthetic oligonucleotide
  Target: ATXN1; (-) strand; PAM type: YTN; PAM sequence: TTG
ccccctgcataagatagtgt

SEQ ID NO: 204541 - DNA, 20 bp, Artificial Sequence
  Description of Artificial Sequence: Synthetic oligonucleotide
  Target: ATXN1; (-) strand; PAM type: YTN; PAM sequence: TTT
gccccctgcataagatagtg

SEQ ID NO: 204542 - DNA, 20 bp, Artificial Sequence
  Description of Artificial Sequence: Synthetic oligonucleotide
  Target: ATXN1; (-) strand; PAM type: YTN; PAM sequence: TTT
tgccccctgcataagatagt

SEQ ID NO: 204543 - DNA, 20 bp, Artificial Sequence
  Description of Artificial Sequence: Synthetic oligonucleotide
  Target: ATXN1; (-) strand; PAM type: YTN; PAM sequence: CTT
ttgccccctgcataagatag

SEQ ID NO: 204544 - DNA, 20 bp, Artificial Sequence
  Description of Artificial Sequence: Synthetic oligonucleotide
  Target: ATXN1; (-) strand; PAM type: YTN; PAM sequence: TTC
cttttgccccctgcataaga

SEQ ID NO: 204545 - DNA, 20 bp, Artificial Sequence
  Description of Artificial Sequence: Synthetic oligonucleotide
  Target: ATXN1; (-) strand; PAM type: YTN; PAM sequence: CTT
ccttttgccccctgcataag

SEQ ID NO: 204546 - DNA, 20 bp, Artificial Sequence
  Description of Artificial Sequence: Synthetic oligonucleotide
  Target: ATXN1; (-) strand; PAM type: YTN; PAM sequence: CTC
ttccttttgccccctgcata

SEQ ID NO: 204547 - DNA, 20 bp, Artificial Sequence
  Description of Artificial Sequence: Synthetic oligonucleotide
  Target: ATXN1; (-) strand; PAM type: YTN; PAM sequence: CTA
cctcttccttttgccccctg

SEQ ID NO: 204548 - DNA, 20 bp, Artificial Sequence
  Description of Artificial Sequence: Synthetic oligonucleotide
  Target: ATXN1; (-) strand; PAM type: YTN; PAM sequence: TTA
aagctacctcttccttttgc

SEQ ID NO: 204549 - DNA, 20 bp, Artificial Sequence
  Description of Artificial Sequence: Synthetic oligonucleotide
  Target: ATXN1; (-) strand; PAM type: YTN; PAM sequence: TTT
aaagctacctcttccttttg

SEQ ID NO: 204550 - DNA, 20 bp, Artificial Sequence
  Description of Artificial Sequence: Synthetic oligonucleotide
  Target: ATXN1; (-) strand; PAM type: YTN; PAM sequence: TTT
taaagctacctcttcctttt

SEQ ID NO: 204551 - DNA, 20 bp, Artificial Sequence
  Description of Artificial Sequence: Synthetic oligonucleotide
  Target: ATXN1; (-) strand; PAM type: YTN; PAM sequence: TTT
ttaaagctacctcttccttt

SEQ ID NO: 204552 - DNA, 20 bp, Artificial Sequence
  Description of Artificial Sequence: Synthetic oligonucleotide
  Target: ATXN1; (-) strand; PAM type: YTN; PAM sequence: CTT
tttaaagctacctcttcctt

SEQ ID NO: 204553 - DNA, 20 bp, Artificial Sequence
  Description of Artificial Sequence: Synthetic oligonucleotide
  Target: ATXN1; (-) strand; PAM type: YTN; PAM sequence: CTG
tctttttaaagctacctctt

SEQ ID NO: 204554 - DNA, 20 bp, Artificial Sequence
  Description of Artificial Sequence: Synthetic oligonucleotide
  Target: ATXN1; (-) strand; PAM type: YTN; PAM sequence: CTG
gcacataaatggatctgtct

SEQ ID NO: 204555 - DNA, 20 bp, Artificial Sequence
  Description of Artificial Sequence: Synthetic oligonucleotide
  Target: ATXN1; (-) strand; PAM type: YTN; PAM sequence: CTG
tgctggcacataaatggatc

SEQ ID NO: 204556 - DNA, 20 bp, Artificial Sequence
  Description of Artificial Sequence: Synthetic oligonucleotide
  Target: ATXN1; (-) strand; PAM type: YTN; PAM sequence: TTA
tcaggctgtgctggcacata

SEQ ID NO: 204557 - DNA, 20 bp, Artificial Sequence
  Description of Artificial Sequence: Synthetic oligonucleotide
  Target: ATXN1; (-) strand; PAM type: YTN; PAM sequence: CTA
gttatcaggctgtgctggca

SEQ ID NO: 204558 - DNA, 20 bp, Artificial Sequence
  Description of Artificial Sequence: Synthetic oligonucleotide
  Target: ATXN1; (-) strand; PAM type: YTN; PAM sequence: CTC
tagttatcaggctgtgctgg

SEQ ID NO: 204559 - DNA, 20 bp, Artificial Sequence
  Description of Artificial Sequence: Synthetic oligonucleotide
  Target: ATXN1; (-) strand; PAM type: YTN; PAM sequence: CTA
ctctagttatcaggctgtgc

SEQ ID NO: 204560 - DNA, 20 bp, Artificial Sequence
  Description of Artificial Sequence: Synthetic oligonucleotide
  Target: ATXN1; (-) strand; PAM type: YTN; PAM sequence: CTG
ctactctagttatcaggctg

SEQ ID NO: 204561 - DNA, 20 bp, Artificial Sequence
  Description of Artificial Sequence: Synthetic oligonucleotide
  Target: ATXN1; (-) strand; PAM type: YTN; PAM sequence: TTC
ctgctactctagttatcagg

SEQ ID NO: 204562 - DNA, 20 bp, Artificial Sequence
  Description of Artificial Sequence: Synthetic oligonucleotide
  Target: ATXN1; (-) strand; PAM type: YTN; PAM sequence: TTT
cctgctactctagttatcag

SEQ ID NO: 204563 - DNA, 20 bp, Artificial Sequence
  Description of Artificial Sequence: Synthetic oligonucleotide
  Target: ATXN1; (-) strand; PAM type: YTN; PAM sequence: TTT
tcctgctactctagttatca

SEQ ID NO: 204564 - DNA, 20 bp, Artificial Sequence
  Description of Artificial Sequence: Synthetic oligonucleotide
  Target: ATXN1; (-) strand; PAM type: YTN; PAM sequence: TTT
ttcctgctactctagttatc

SEQ ID NO: 204565 - DNA, 20 bp, Artificial Sequence
  Description of Artificial Sequence: Synthetic oligonucleotide
  Target: ATXN1; (-) strand; PAM type: YTN; PAM sequence: CTT
tttcctgctactctagttat

SEQ ID NO: 204566 - DNA, 20 bp, Artificial Sequence
  Description of Artificial Sequence: Synthetic oligonucleotide
  Target: ATXN1; (-) strand; PAM type: YTN; PAM sequence: CTC
tttttcctgctactctagtt

SEQ ID NO: 204567 - DNA, 20 bp, Artificial Sequence
  Description of Artificial Sequence: Synthetic oligonucleotide
  Target: ATXN1; (-) strand; PAM type: YTN; PAM sequence: TTC
tctttttcctgctactctag

SEQ ID NO: 204568 - DNA, 20 bp, Artificial Sequence
  Description of Artificial Sequence: Synthetic oligonucleotide
  Target: ATXN1; (-) strand; PAM type: YTN; PAM sequence: TTT
ctctttttcctgctactcta

SEQ ID NO: 204569 - DNA, 20 bp, Artificial Sequence
  Description of Artificial Sequence: Synthetic oligonucleotide
  Target: ATXN1; (-) strand; PAM type: YTN; PAM sequence: TTT
tctctttttcctgctactct

SEQ ID NO: 204570 - DNA, 20 bp, Artificial Sequence
  Description of Artificial Sequence: Synthetic oligonucleotide
  Target: ATXN1; (-) strand; PAM type: YTN; PAM sequence: TTT
ttctctttttcctgctactc

SEQ ID NO: 204571 - DNA, 20 bp, Artificial Sequence
  Description of Artificial Sequence: Synthetic oligonucleotide
  Target: ATXN1; (-) strand; PAM type: YTN; PAM sequence: TTT
tttctctttttcctgctact

SEQ ID NO: 204572 - DNA, 20 bp, Artificial Sequence
  Description of Artificial Sequence: Synthetic oligonucleotide
  Target: ATXN1; (-) strand; PAM type: YTN; PAM sequence: TTT
ttttctctttttcctgctac

SEQ ID NO: 204573 - DNA, 20 bp, Artificial Sequence
  Description of Artificial Sequence: Synthetic oligonucleotide
  Target: ATXN1; (-) strand; PAM type: YTN; PAM sequence: TTT
tttttctctttttcctgcta

SEQ ID NO: 204574 - DNA, 20 bp, Artificial Sequence
  Description of Artificial Sequence: Synthetic oligonucleotide
  Target: ATXN1; (-) strand; PAM type: YTN; PAM sequence: TTT
ttttttctctttttcctgct

SEQ ID NO: 204575 - DNA, 20 bp, Artificial Sequence
  Description of Artificial Sequence: Synthetic oligonucleotide
  Target: ATXN1; (-) strand; PAM type: YTN; PAM sequence: TTT
tttttttctctttttcctgc

SEQ ID NO: 204576 - DNA, 20 bp, Artificial Sequence
  Description of Artificial Sequence: Synthetic oligonucleotide
  Target: ATXN1; (-) strand; PAM type: YTN; PAM sequence: TTT
ttttttttctctttttcctg

SEQ ID NO: 204577 - DNA, 20 bp, Artificial Sequence
  Description of Artificial Sequence: Synthetic oligonucleotide
  Target: ATXN1; (-) strand; PAM type: YTN; PAM sequence: TTT
tttttttttctctttttcct

SEQ ID NO: 204578 - DNA, 20 bp, Artificial Sequence
  Description of Artificial Sequence: Synthetic oligonucleotide
  Target: ATXN1; (-) strand; PAM type: YTN; PAM sequence: TTT
ttttttttttctctttttcc

SEQ ID NO: 204579 - DNA, 20 bp, Artificial Sequence
  Description of Artificial Sequence: Synthetic oligonucleotide
  Target: ATXN1; (-) strand; PAM type: YTN; PAM sequence: TTG
tgatttttttttttttctct

SEQ ID NO: 204580 - DNA, 20 bp, Artificial Sequence
  Description of Artificial Sequence: Synthetic oligonucleotide
  Target: ATXN1; (-) strand; PAM type: YTN; PAM sequence: CTT
gtgatttttttttttttctc

SEQ ID NO: 204581 - DNA, 20 bp, Artificial Sequence
  Description of Artificial Sequence: Synthetic oligonucleotide
  Target: ATXN1; (-) strand; PAM type: YTN; PAM sequence: CTA
tcgtcttgtgattttttttt

SEQ ID NO: 204582 - DNA, 20 bp, Artificial Sequence
  Description of Artificial Sequence: Synthetic oligonucleotide
  Target: ATXN1; (-) strand; PAM type: YTN; PAM sequence: TTG
atctatcgtcttgtgatttt

SEQ ID NO: 204583 - DNA, 20 bp, Artificial Sequence
  Description of Artificial Sequence: Synthetic oligonucleotide
  Target: ATXN1; (-) strand; PAM type: YTN; PAM sequence: CTA
atgtcccattgatctatcgt

SEQ ID NO: 204584 - DNA, 20 bp, Artificial Sequence
  Description of Artificial Sequence: Synthetic oligonucleotide
  Target: ATXN1; (-) strand; PAM type: YTN; PAM sequence: TTA
tctaatgtcccattgatcta

SEQ ID NO: 204585 - DNA, 20 bp, Artificial Sequence
  Description of Artificial Sequence: Synthetic oligonucleotide
  Target: ATXN1; (-) strand; PAM type: YTN; PAM sequence: CTT
atctaatgtcccattgatct

SEQ ID NO: 204586 - DNA, 20 bp, Artificial Sequence
  Description of Artificial Sequence: Synthetic oligonucleotide
  Target: ATXN1; (-) strand; PAM type: YTN; PAM sequence: CTA
cacacaccccaaaaaggggg

SEQ ID NO: 204587 - DNA, 20 bp, Artificial Sequence
  Description of Artificial Sequence: Synthetic oligonucleotide
  Target: ATXN1; (-) strand; PAM type: YTN; PAM sequence: CTG
gaatatagtgaccacagtca

SEQ ID NO: 204588 - DNA, 20 bp, Artificial Sequence
  Description of Artificial Sequence: Synthetic oligonucleotide
  Target: ATXN1; (-) strand; PAM type: YTN; PAM sequence: CTG
ctggaatatagtgaccacag

SEQ ID NO: 204589 - DNA, 20 bp, Artificial Sequence
  Description of Artificial Sequence: Synthetic oligonucleotide
  Target: ATXN1; (-) strand; PAM type: YTN; PAM sequence: TTG
tgtcactgctggaatatagt

SEQ ID NO: 204590 - DNA, 20 bp, Artificial Sequence
  Description of Artificial Sequence: Synthetic oligonucleotide
  Target: ATXN1; (-) strand; PAM type: YTN; PAM sequence: CTT
gtgtcactgctggaatatag

SEQ ID NO: 204591 - DNA, 20 bp, Artificial Sequence
  Description of Artificial Sequence: Synthetic oligonucleotide
  Target: ATXN1; (-) strand; PAM type: YTN; PAM sequence: CTA
acttgtgtcactgctggaat

SEQ ID NO: 204592 - DNA, 20 bp, Artificial Sequence
  Description of Artificial Sequence: Synthetic oligonucleotide
  Target: ATXN1; (-) strand; PAM type: YTN; PAM sequence: CTC
taacttgtgtcactgctgga

SEQ ID NO: 204593 - DNA, 20 bp, Artificial Sequence
  Description of Artificial Sequence: Synthetic oligonucleotide
  Target: ATXN1; (-) strand; PAM type: YTN; PAM sequence: TTC
agccccagaagctctaactt

SEQ ID NO: 204594 - DNA, 20 bp, Artificial Sequence
  Description of Artificial Sequence: Synthetic oligonucleotide
  Target: ATXN1; (-) strand; PAM type: YTN; PAM sequence: CTT
cagccccagaagctctaact

SEQ ID NO: 204595 - DNA, 20 bp, Artificial Sequence
  Description of Artificial Sequence: Synthetic oligonucleotide
  Target: ATXN1; (-) strand; PAM type: YTN; PAM sequence: TTA
gacaatgcggacttcagccc

SEQ ID NO: 204596 - DNA, 20 bp, Artificial Sequence
  Description of Artificial Sequence: Synthetic oligonucleotide
  Target: ATXN1; (-) strand; PAM type: YTN; PAM sequence: TTT
agacaatgcggacttcagcc

SEQ ID NO: 204597 - DNA, 20 bp, Artificial Sequence
  Description of Artificial Sequence: Synthetic oligonucleotide
  Target: ATXN1; (-) strand; PAM type: YTN; PAM sequence: CTG
tttagacaatgcggacttca

SEQ ID NO: 204598 - DNA, 20 bp, Artificial Sequence
  Description of Artificial Sequence: Synthetic oligonucleotide
  Target: ATXN1; (-) strand; PAM type: YTN; PAM sequence: CTG
tcctgtttagacaatgcgga

SEQ ID NO: 204599 - DNA, 20 bp, Artificial Sequence
  Description of Artificial Sequence: Synthetic oligonucleotide
  Target: ATXN1; (-) strand; PAM type: YTN; PAM sequence: CTG
actgtcctgtttagacaatg

SEQ ID NO: 204600 - DNA, 20 bp, Artificial Sequence
  Description of Artificial Sequence: Synthetic oligonucleotide
  Target: ATXN1; (-) strand; PAM type: YTN; PAM sequence: TTG
ccccaaagtctgactgtcct

SEQ ID NO: 204601 - DNA, 20 bp, Artificial Sequence
  Description of Artificial Sequence: Synthetic oligonucleotide
  Target: ATXN1; (-) strand; PAM type: YTN; PAM sequence: TTT
gccccaaagtctgactgtcc

SEQ ID NO: 204602 - DNA, 20 bp, Artificial Sequence
  Description of Artificial Sequence: Synthetic oligonucleotide
  Target: ATXN1; (-) strand; PAM type: YTN; PAM sequence: TTG
ggcaataagatgggaggatg

SEQ ID NO: 204603 - DNA, 20 bp, Artificial Sequence
  Description of Artificial Sequence: Synthetic oligonucleotide
  Target: ATXN1; (-) strand; PAM type: YTN; PAM sequence: TTA
aaacagcagggaaagtggaa

SEQ ID NO: 204604 - DNA, 20 bp, Artificial Sequence
  Description of Artificial Sequence: Synthetic oligonucleotide
  Target: ATXN1; (-) strand; PAM type: YTN; PAM sequence: TTC
caaaataatcccattaaaac

SEQ ID NO: 204605 - DNA, 20 bp, Artificial Sequence
  Description of Artificial Sequence: Synthetic oligonucleotide
  Target: ATXN1; (-) strand; PAM type: YTN; PAM sequence: TTG
gggaaaaggagtgagacaga

SEQ ID NO: 204606 - DNA, 20 bp, Artificial Sequence
  Description of Artificial Sequence: Synthetic oligonucleotide
  Target: ATXN1; (-) strand; PAM type: YTN; PAM sequence: TTT
ggggaaaaggagtgagacag

SEQ ID NO: 204607 - DNA, 20 bp, Artificial Sequence
  Description of Artificial Sequence: Synthetic oligonucleotide
  Target: ATXN1; (-) strand; PAM type: YTN; PAM sequence: TTA
tatgacagtttggggaaaag

SEQ ID NO: 204608 - DNA, 20 bp, Artificial Sequence
  Description of Artificial Sequence: Synthetic oligonucleotide
  Target: ATXN1; (-) strand; PAM type: YTN; PAM sequence: CTT
atatgacagtttggggaaaa

SEQ ID NO: 204609 - DNA, 20 bp, Artificial Sequence
  Description of Artificial Sequence: Synthetic oligonucleotide
  Target: ATXN1; (-) strand; PAM type: YTN; PAM sequence: CTG
cagtacttatatgacagttt

SEQ ID NO: 204610 - DNA, 20 bp, Artificial Sequence
  Description of Artificial Sequence: Synthetic oligonucleotide
  Target: ATXN1; (-) strand; PAM type: YTN; PAM sequence: CTG
ggaagtagtcaagctgcagt

SEQ ID NO: 204611 - DNA, 20 bp, Artificial Sequence
  Description of Artificial Sequence: Synthetic oligonucleotide
  Target: ATXN1; (-) strand; PAM type: YTN; PAM sequence: TTG
gcagctgggaagtagtcaag

SEQ ID NO: 204612 - DNA, 20 bp, Artificial Sequence
  Description of Artificial Sequence: Synthetic oligonucleotide
  Target: ATXN1; (-) strand; PAM type: YTN; PAM sequence: TTT
ggcagctgggaagtagtcaa

SEQ ID NO: 204613 - DNA, 20 bp, Artificial Sequence
  Description of Artificial Sequence: Synthetic oligonucleotide
  Target: ATXN1; (-) strand; PAM type: YTN; PAM sequence: CTG
gagtgaaatttggcagctgg

SEQ ID NO: 204614 - DNA, 20 bp, Artificial Sequence
  Description of Artificial Sequence: Synthetic oligonucleotide
  Target: ATXN1; (-) strand; PAM type: YTN; PAM sequence: CTC
tggagtgaaatttggcagct

SEQ ID NO: 204615 - DNA, 20 bp, Artificial Sequence
  Description of Artificial Sequence: Synthetic oligonucleotide
  Target: ATXN1; (-) strand; PAM type: YTN; PAM sequence: CTG
aaatacagccatctctggag

SEQ ID NO: 204616 - DNA, 20 bp, Artificial Sequence
  Description of Artificial Sequence: Synthetic oligonucleotide
  Target: ATXN1; (-) strand; PAM type: YTN; PAM sequence: TTG
ccactgaaatacagccatct

SEQ ID NO: 204617 - DNA, 20 bp, Artificial Sequence
  Description of Artificial Sequence: Synthetic oligonucleotide
  Target: ATXN1; (-) strand; PAM type: YTN; PAM sequence: CTT
gccactgaaatacagccatc

SEQ ID NO: 204618 - DNA, 20 bp, Artificial Sequence
  Description of Artificial Sequence: Synthetic oligonucleotide
  Target: ATXN1; (-) strand; PAM type: YTN; PAM sequence: TTC
acttgccactgaaatacagc

SEQ ID NO: 204619 - DNA, 20 bp, Artificial Sequence
  Description of Artificial Sequence: Synthetic oligonucleotide
  Target: ATXN1; (-) strand; PAM type: YTN; PAM sequence: CTT
cacttgccactgaaatacag

SEQ ID NO: 204620 - DNA, 20 bp, Artificial Sequence
  Description of Artificial Sequence: Synthetic oligonucleotide
  Target: ATXN1; (-) strand; PAM type: YTN; PAM sequence: TTC
gatgacacagagggatcatc

SEQ ID NO: 204621 - DNA, 20 bp, Artificial Sequence
  Description of Artificial Sequence: Synthetic oligonucleotide
  Target: ATXN1; (-) strand; PAM type: YTN; PAM sequence: TTT
cgatgacacagagggatcat

SEQ ID NO: 204622 - DNA, 20 bp, Artificial Sequence
  Description of Artificial Sequence: Synthetic oligonucleotide
  Target: ATXN1; (-) strand; PAM type: YTN; PAM sequence: TTA
aatgagtatttcgatgacac

SEQ ID NO: 204623 - DNA, 20 bp, Artificial Sequence
  Description of Artificial Sequence: Synthetic oligonucleotide
  Target: ATXN1; (-) strand; PAM type: YTN; PAM sequence: CTT
aaatgagtatttcgatgaca

SEQ ID NO: 204624 - DNA, 20 bp, Artificial Sequence
  Description of Artificial Sequence: Synthetic oligonucleotide
  Target: ATXN1; (-) strand; PAM type: YTN; PAM sequence: TTA
accccttaaatgagtatttc

SEQ ID NO: 204625 - DNA, 20 bp, Artificial Sequence
  Description of Artificial Sequence: Synthetic oligonucleotide
  Target: ATXN1; (-) strand; PAM type: YTN; PAM sequence: CTT
aaccccttaaatgagtattt

SEQ ID NO: 204626 - DNA, 20 bp, Artificial Sequence
  Description of Artificial Sequence: Synthetic oligonucleotide
  Target: ATXN1; (-) strand; PAM type: YTN; PAM sequence: TTC
cagatgcttaaccccttaaa

SEQ ID NO: 204627 - DNA, 20 bp, Artificial Sequence
  Description of Artificial Sequence: Synthetic oligonucleotide
  Target: ATXN1; (-) strand; PAM type: YTN; PAM sequence: CTT
ccagatgcttaaccccttaa

SEQ ID NO: 204628 - DNA, 20 bp, Artificial Sequence
  Description of Artificial Sequence: Synthetic oligonucleotide
  Target: ATXN1; (-) strand; PAM type: YTN; PAM sequence: CTC
ttccagatgcttaacccctt

SEQ ID NO: 204629 - DNA, 20 bp, Artificial Sequence
  Description of Artificial Sequence: Synthetic oligonucleotide
  Target: ATXN1; (-) strand; PAM type: YTN; PAM sequence: TTC
atgcacaaaggcaaccctct

SEQ ID NO: 204630 - DNA, 20 bp, Artificial Sequence
  Description of Artificial Sequence: Synthetic oligonucleotide
  Target: ATXN1; (-) strand; PAM type: YTN; PAM sequence: CTG
ttcatgcacaaaggcaaccc

SEQ ID NO: 204631 - DNA, 20 bp, Artificial Sequence
  Description of Artificial Sequence: Synthetic oligonucleotide
  Target: ATXN1; (-) strand; PAM type: YTN; PAM sequence: CTC
tgttcatgcacaaaggcaac

SEQ ID NO: 204632 - DNA, 20 bp, Artificial Sequence
  Description of Artificial Sequence: Synthetic oligonucleotide
  Target: ATXN1; (-) strand; PAM type: YTN; PAM sequence: CTC
caggatagacaataaaacaa

SEQ ID NO: 204633 - DNA, 20 bp, Artificial Sequence
  Description of Artificial Sequence: Synthetic oligonucleotide
  Target: ATXN1; (-) strand; PAM type: YTN; PAM sequence: TTC
tccaggatagacaataaaac

SEQ ID NO: 204634 - DNA, 20 bp, Artificial Sequence
  Description of Artificial Sequence: Synthetic oligonucleotide
  Target: ATXN1; (-) strand; PAM type: YTN; PAM sequence: CTT
ctccaggatagacaataaaa

SEQ ID NO: 204635 - DNA, 20 bp, Artificial Sequence
  Description of Artificial Sequence: Synthetic oligonucleotide
  Target: ATXN1; (-) strand; PAM type: YTN; PAM sequence: CTC
cttctccaggatagacaata

SEQ ID NO: 204636 - DNA, 20 bp, Artificial Sequence
  Description of Artificial Sequence: Synthetic oligonucleotide
  Target: ATXN1; (-) strand; PAM type: YTN; PAM sequence: CTA
atgacctccttctccaggat

SEQ ID NO: 204637 - DNA, 20 bp, Artificial Sequence
  Description of Artificial Sequence: Synthetic oligonucleotide
  Target: ATXN1; (-) strand; PAM type: YTN; PAM sequence: CTC
aggtggagctaatgacctcc

SEQ ID NO: 204638 - DNA, 20 bp, Artificial Sequence
  Description of Artificial Sequence: Synthetic oligonucleotide
  Target: ATXN1; (-) strand; PAM type: YTN; PAM sequence: TTG
ctcaggtggagctaatgacc

SEQ ID NO: 204639 - DNA, 20 bp, Artificial Sequence
  Description of Artificial Sequence: Synthetic oligonucleotide
  Target: ATXN1; (-) strand; PAM type: YTN; PAM sequence: CTT
gctcaggtggagctaatgac

SEQ ID NO: 204640 - DNA, 20 bp, Artificial Sequence
  Description of Artificial Sequence: Synthetic oligonucleotide
  Target: ATXN1; (-) strand; PAM type: YTN; PAM sequence: TTC
catcttgctcaggtggagct

SEQ ID NO: 204641 - DNA, 20 bp, Artificial Sequence
  Description of Artificial Sequence: Synthetic oligonucleotide
  Target: ATXN1; (-) strand; PAM type: YTN; PAM sequence: CTT
ccatcttgctcaggtggagc

SEQ ID NO: 204642 - DNA, 20 bp, Artificial Sequence
  Description of Artificial Sequence: Synthetic oligonucleotide
  Target: ATXN1; (-) strand; PAM type: YTN; PAM sequence: TTG
gtgtgtgtcttccatcttgc

SEQ ID NO: 204643 - DNA, 20 bp, Artificial Sequence
  Description of Artificial Sequence: Synthetic oligonucleotide
  Target: ATXN1; (-) strand; PAM type: YTN; PAM sequence: TTT
ggtgtgtgtcttccatcttg

SEQ ID NO: 204644 - DNA, 20 bp, Artificial Sequence
  Description of Artificial Sequence: Synthetic oligonucleotide
  Target: ATXN1; (-) strand; PAM type: YTN; PAM sequence: TTT
tggtgtgtgtcttccatctt

SEQ ID NO: 204645 - DNA, 20 bp, Artificial Sequence
  Description of Artificial Sequence: Synthetic oligonucleotide
  Target: ATXN1; (-) strand; PAM type: YTN; PAM sequence: TTT
ttggtgtgtgtcttccatct

SEQ ID NO: 204646 - DNA, 20 bp, Artificial Sequence
  Description of Artificial Sequence: Synthetic oligonucleotide
  Target: ATXN1; (-) strand; PAM type: YTN; PAM sequence: TTT
tttggtgtgtgtcttccatc

SEQ ID NO: 204647 - DNA, 20 bp, Artificial Sequence
  Description of Artificial Sequence: Synthetic oligonucleotide
  Target: ATXN1; (-) strand; PAM type: YTN; PAM sequence: CTG
catagagtgttttttggtgt

SEQ ID NO: 204648 - DNA, 20 bp, Artificial Sequence
  Description of Artificial Sequence: Synthetic oligonucleotide
  Target: ATXN1; (-) strand; PAM type: YTN; PAM sequence: TTA
gtggctgcatagagtgtttt

SEQ ID NO: 204649 - DNA, 20 bp, Artificial Sequence
  Description of Artificial Sequence: Synthetic oligonucleotide
  Target: ATXN1; (-) strand; PAM type: YTN; PAM sequence: TTT
agtggctgcatagagtgttt

SEQ ID NO: 204650 - DNA, 20 bp, Artificial Sequence
  Description of Artificial Sequence: Synthetic oligonucleotide
  Target: ATXN1; (-) strand; PAM type: YTN; PAM sequence: TTT
tagtggctgcatagagtgtt

SEQ ID NO: 204651 - DNA, 20 bp, Artificial Sequence
  Description of Artificial Sequence: Synthetic oligonucleotide
  Target: ATXN1; (-) strand; PAM type: YTN; PAM sequence: TTC
cccgtgcattttagtggctg

SEQ ID NO: 204652 - DNA, 20 bp, Artificial Sequence
  Description of Artificial Sequence: Synthetic oligonucleotide
  Target: ATXN1; (-) strand; PAM type: YTN; PAM sequence: TTT
ccccgtgcattttagtggct

SEQ ID NO: 204653 - DNA, 20 bp, Artificial Sequence
  Description of Artificial Sequence: Synthetic oligonucleotide
  Target: ATXN1; (-) strand; PAM type: YTN; PAM sequence: TTT
tccccgtgcattttagtggc

SEQ ID NO: 204654 - DNA, 20 bp, Artificial Sequence
  Description of Artificial Sequence: Synthetic oligonucleotide
  Target: ATXN1; (-) strand; PAM type: YTN; PAM sequence: CTG
ttttccccgtgcattttagt

SEQ ID NO: 204655 - DNA, 20 bp, Artificial Sequence
  Description of Artificial Sequence: Synthetic oligonucleotide
  Target: ATXN1; (-) strand; PAM type: YTN; PAM sequence: TTC
tgttttccccgtgcatttta

SEQ ID NO: 204656 - DNA, 20 bp, Artificial Sequence
  Description of Artificial Sequence: Synthetic oligonucleotide
  Target: ATXN1; (-) strand; PAM type: YTN; PAM sequence: TTT
ctgttttccccgtgcatttt

SEQ ID NO: 204657 - DNA, 20 bp, Artificial Sequence
  Description of Artificial Sequence: Synthetic oligonucleotide
  Target: ATXN1; (-) strand; PAM type: YTN; PAM sequence: CTG
tttctgttttccccgtgcat

SEQ ID NO: 204658 - DNA, 20 bp, Artificial Sequence
  Description of Artificial Sequence: Synthetic oligonucleotide
  Target: ATXN1; (-) strand; PAM type: YTN; PAM sequence: CTA
tgaaaagcggtcactgtttc

SEQ ID NO: 204659 - DNA, 20 bp, Artificial Sequence
  Description of Artificial Sequence: Synthetic oligonucleotide
  Target: ATXN1; (-) strand; PAM type: YTN; PAM sequence: CTG
tggaaaagaacctatgaaaa

SEQ ID NO: 204660 - DNA, 20 bp, Artificial Sequence
  Description of Artificial Sequence: Synthetic oligonucleotide
  Target: ATXN1; (-) strand; PAM type: YTN; PAM sequence: TTG
aagtccctgtggaaaagaac

SEQ ID NO: 204661 - DNA, 20 bp, Artificial Sequence
  Description of Artificial Sequence: Synthetic oligonucleotide
  Target: ATXN1; (-) strand; PAM type: YTN; PAM sequence: TTT
gaagtccctgtggaaaagaa

SEQ ID NO: 204662 - DNA, 20 bp, Artificial Sequence
  Description of Artificial Sequence: Synthetic oligonucleotide
  Target: ATXN1; (-) strand; PAM type: YTN; PAM sequence: CTT
tgaagtccctgtggaaaaga

SEQ ID NO: 204663 - DNA, 20 bp, Artificial Sequence
  Description of Artificial Sequence: Synthetic oligonucleotide
  Target: ATXN1; (-) strand; PAM type: YTN; PAM sequence: TTA
agactttgaagtccctgtgg

SEQ ID NO: 204664 - DNA, 20 bp, Artificial Sequence
  Description of Artificial Sequence: Synthetic oligonucleotide
  Target: ATXN1; (-) strand; PAM type: YTN; PAM sequence: TTT
aagactttgaagtccctgtg

SEQ ID NO: 204665 - DNA, 20 bp, Artificial Sequence
  Description of Artificial Sequence: Synthetic oligonucleotide
  Target: ATXN1; (-) strand; PAM type: YTN; PAM sequence: CTT
taagactttgaagtccctgt

SEQ ID NO: 204666 - DNA, 20 bp, Artificial Sequence
  Description of Artificial Sequence: Synthetic oligonucleotide
  Target: ATXN1; (-) strand; PAM type: YTN; PAM sequence: TTG
atgctttaagactttgaagt

SEQ ID NO: 204667 - DNA, 20 bp, Artificial Sequence
  Description of Artificial Sequence: Synthetic oligonucleotide
  Target: ATXN1; (-) strand; PAM type: YTN; PAM sequence: CTT
gatgctttaagactttgaag

SEQ ID NO: 204668 - DNA, 20 bp, Artificial Sequence
  Description of Artificial Sequence: Synthetic oligonucleotide
  Target: ATXN1; (-) strand; PAM type: YTN; PAM sequence: TTG
caaccttgatgctttaagac

SEQ ID NO: 204669 - DNA, 20 bp, Artificial Sequence
  Description of Artificial Sequence: Synthetic oligonucleotide
  Target: ATXN1; (-) strand; PAM type: YTN; PAM sequence: TTT
gcaaccttgatgctttaaga

SEQ ID NO: 204670 - DNA, 20 bp, Artificial Sequence
  Description of Artificial Sequence: Synthetic oligonucleotide
  Target: ATXN1; (-) strand; PAM type: YTN; PAM sequence: TTT
tgcaaccttgatgctttaag

SEQ ID NO: 204671 - DNA, 20 bp, Artificial Sequence
  Description of Artificial Sequence: Synthetic oligonucleotide
  Target: ATXN1; (-) strand; PAM type: YTN; PAM sequence: TTA
ccatcattttgcaaccttga

SEQ ID NO: 204672 - DNA, 20 bp, Artificial Sequence
  Description of Artificial Sequence: Synthetic oligonucleotide
  Target: ATXN1; (-) strand; PAM type: YTN; PAM sequence: CTA
aaaattaccatcattttgca

SEQ ID NO: 204673 - DNA, 20 bp, Artificial Sequence
  Description of Artificial Sequence: Synthetic oligonucleotide
  Target: ATXN1; (-) strand; PAM type: YTN; PAM sequence: CTC
taaaaattaccatcattttg

SEQ ID NO: 204674 - DNA, 20 bp, Artificial Sequence
  Description of Artificial Sequence: Synthetic oligonucleotide
  Target: ATXN1; (-) strand; PAM type: YTN; PAM sequence: TTC
cacctctaaaaattaccatc

SEQ ID NO: 204675 - DNA, 20 bp, Artificial Sequence
  Description of Artificial Sequence: Synthetic oligonucleotide
  Target: ATXN1; (-) strand; PAM type: YTN; PAM sequence: CTT
ccacctctaaaaattaccat

SEQ ID NO: 204676 - DNA, 20 bp, Artificial Sequence
  Description of Artificial Sequence: Synthetic oligonucleotide
  Target: ATXN1; (-) strand; PAM type: YTN; PAM sequence: TTC
ttccacctctaaaaattacc

SEQ ID NO: 204677 - DNA, 20 bp, Artificial Sequence
  Description of Artificial Sequence: Synthetic oligonucleotide
  Target: ATXN1; (-) strand; PAM type: YTN; PAM sequence: TTT
cttccacctctaaaaattac

SEQ ID NO: 204678 - DNA, 20 bp, Artificial Sequence
  Description of Artificial Sequence: Synthetic oligonucleotide
  Target: ATXN1; (-) strand; PAM type: YTN; PAM sequence: CTC
agaggtttcttccacctcta

SEQ ID NO: 204679 - DNA, 20 bp, Artificial Sequence
  Description of Artificial Sequence: Synthetic oligonucleotide
  Target: ATXN1; (-) strand; PAM type: YTN; PAM sequence: CTC
tcagaggtttcttccacctc

SEQ ID NO: 204680 - DNA, 20 bp, Artificial Sequence
  Description of Artificial Sequence: Synthetic oligonucleotide
  Target: ATXN1; (-) strand; PAM type: YTN; PAM sequence: TTG
ctctcagaggtttcttccac

SEQ ID NO: 204681 - DNA, 20 bp, Artificial Sequence
  Description of Artificial Sequence: Synthetic oligonucleotide
  Target: ATXN1; (-) strand; PAM type: YTN; PAM sequence: TTT
gctctcagaggtttcttcca

SEQ ID NO: 204682 - DNA, 20 bp, Artificial Sequence
  Description of Artificial Sequence: Synthetic oligonucleotide
  Target: ATXN1; (-) strand; PAM type: YTN; PAM sequence: CTG
taacatgagtggtttgctct

SEQ ID NO: 204683 - DNA, 20 bp, Artificial Sequence
  Description of Artificial Sequence: Synthetic oligonucleotide
  Target: ATXN1; (-) strand; PAM type: YTN; PAM sequence: CTC
catctgtaacatgagtggtt

SEQ ID NO: 204684 - DNA, 20 bp, Artificial Sequence
  Description of Artificial Sequence: Synthetic oligonucleotide
  Target: ATXN1; (-) strand; PAM type: YTN; PAM sequence: TTC
tccatctgtaacatgagtgg

SEQ ID NO: 204685 - DNA, 20 bp, Artificial Sequence
  Description of Artificial Sequence: Synthetic oligonucleotide
  Target: ATXN1; (-) strand; PAM type: YTN; PAM sequence: TTC
caagttctccatctgtaaca

SEQ ID NO: 204686 - DNA, 20 bp, Artificial Sequence
  Description of Artificial Sequence: Synthetic oligonucleotide
  Target: ATXN1; (-) strand; PAM type: YTN; PAM sequence: CTT
ccaagttctccatctgtaac

SEQ ID NO: 204687 - DNA, 20 bp, Artificial Sequence
  Description of Artificial Sequence: Synthetic oligonucleotide
  Target: ATXN1; (-) strand; PAM type: YTN; PAM sequence: CTG
tgcttccaagttctccatct

SEQ ID NO: 204688 - DNA, 20 bp, Artificial Sequence
  Description of Artificial Sequence: Synthetic oligonucleotide
  Target: ATXN1; (-) strand; PAM type: YTN; PAM sequence: CTC
agtgaccctgtgcttccaag

SEQ ID NO: 204689 - DNA, 20 bp, Artificial Sequence
  Description of Artificial Sequence: Synthetic oligonucleotide
  Target: ATXN1; (-) strand; PAM type: YTN; PAM sequence: TTG
accaaggtactcagtgaccc

SEQ ID NO: 204690 - DNA, 20 bp, Artificial Sequence
  Description of Artificial Sequence: Synthetic oligonucleotide
  Target: ATXN1; (-) strand; PAM type: YTN; PAM sequence: TTT
gaccaaggtactcagtgacc

SEQ ID NO: 204691 - DNA, 20 bp, Artificial Sequence
  Description of Artificial Sequence: Synthetic oligonucleotide
  Target: ATXN1; (-) strand; PAM type: YTN; PAM sequence: CTT
tgaccaaggtactcagtgac

SEQ ID NO: 204692 - DNA, 20 bp, Artificial Sequence
  Description of Artificial Sequence: Synthetic oligonucleotide
  Target: ATXN1; (-) strand; PAM type: YTN; PAM sequence: TTG
ggaatgaatcggcgggtggg

SEQ ID NO: 204693 - DNA, 20 bp, Artificial Sequence
  Description of Artificial Sequence: Synthetic oligonucleotide
  Target: ATXN1; (-) strand; PAM type: YTN; PAM sequence: CTT
gggaatgaatcggcgggtgg

SEQ ID NO: 204694 - DNA, 20 bp, Artificial Sequence
  Description of Artificial Sequence: Synthetic oligonucleotide
  Target: ATXN1; (-) strand; PAM type: YTN; PAM sequence: TTG
gacttgggaatgaatcggcg

SEQ ID NO: 204695 - DNA, 20 bp, Artificial Sequence
  Description of Artificial Sequence: Synthetic oligonucleotide
  Target: ATXN1; (-) strand; PAM type: YTN; PAM sequence: CTT
ggacttgggaatgaatcggc

SEQ ID NO: 204696 - DNA, 20 bp, Artificial Sequence
  Description of Artificial Sequence: Synthetic oligonucleotide
  Target: ATXN1; (-) strand; PAM type: YTN; PAM sequence: TTC
aagtgaaacgcccttggact

SEQ ID NO: 204697 - DNA, 20 bp, Artificial Sequence
  Description of Artificial Sequence: Synthetic oligonucleotide
  Target: ATXN1; (-) strand; PAM type: YTN; PAM sequence: TTC
aaaattcaagtgaaacgccc

SEQ ID NO: 204698 - DNA, 20 bp, Artificial Sequence
  Description of Artificial Sequence: Synthetic oligonucleotide
  Target: ATXN1; (-) strand; PAM type: YTN; PAM sequence: CTG
cagataaagccaaattcaaa

SEQ ID NO: 204699 - DNA, 20 bp, Artificial Sequence
  Description of Artificial Sequence: Synthetic oligonucleotide
  Target: ATXN1; (-) strand; PAM type: YTN; PAM sequence: CTG
agtgtgtctgcagataaagc

SEQ ID NO: 204700 - DNA, 20 bp, Artificial Sequence
  Description of Artificial Sequence: Synthetic oligonucleotide
  Target: ATXN1; (-) strand; PAM type: YTN; PAM sequence: CTC
tgagtgtgtctgcagataaa

SEQ ID NO: 204701 - DNA, 20 bp, Artificial Sequence
  Description of Artificial Sequence: Synthetic oligonucleotide
  Target: ATXN1; (-) strand; PAM type: YTN; PAM sequence: CTG
acggagatgtgatactctga

SEQ ID NO: 204702 - DNA, 20 bp, Artificial Sequence
  Description of Artificial Sequence: Synthetic oligonucleotide
  Target: ATXN1; (-) strand; PAM type: YTN; PAM sequence: TTG
actgacggagatgtgatact

SEQ ID NO: 204703 - DNA, 20 bp, Artificial Sequence
  Description of Artificial Sequence: Synthetic oligonucleotide
  Target: ATXN1; (-) strand; PAM type: YTN; PAM sequence: CTT
gactgacggagatgtgatac

SEQ ID NO: 204704 - DNA, 20 bp, Artificial Sequence
  Description of Artificial Sequence: Synthetic oligonucleotide
  Target: ATXN1; (-) strand; PAM type: YTN; PAM sequence: TTG
acttgactgacggagatgtg

SEQ ID NO: 204705 - DNA, 20 bp, Artificial Sequence
  Description of Artificial Sequence: Synthetic oligonucleotide
  Target: ATXN1; (-) strand; PAM type: YTN; PAM sequence: CTT
gacttgactgacggagatgt

SEQ ID NO: 204706 - DNA, 20 bp, Artificial Sequence
  Description of Artificial Sequence: Synthetic oligonucleotide
  Target: ATXN1; (-) strand; PAM type: YTN; PAM sequence: CTG
tgcttgacttgactgacgga

SEQ ID NO: 204707 - DNA, 20 bp, Artificial Sequence
  Description of Artificial Sequence: Synthetic oligonucleotide
  Target: ATXN1; (-) strand; PAM type: YTN; PAM sequence: CTG
ggtctgtgcttgacttgact

SEQ ID NO: 204708 - DNA, 20 bp, Artificial Sequence
  Description of Artificial Sequence: Synthetic oligonucleotide
  Target: ATXN1; (-) strand; PAM type: YTN; PAM sequence: TTA
gaagctgggtctgtgcttga

SEQ ID NO: 204709 - DNA, 20 bp, Artificial Sequence
  Description of Artificial Sequence: Synthetic oligonucleotide
  Target: ATXN1; (-) strand; PAM type: YTN; PAM sequence: TTT
agaagctgggtctgtgcttg

SEQ ID NO: 204710 - DNA, 20 bp, Artificial Sequence
  Description of Artificial Sequence: Synthetic oligonucleotide
  Target: ATXN1; (-) strand; PAM type: YTN; PAM sequence: CTT
tagaagctgggtctgtgctt

SEQ ID NO: 204711 - DNA, 20 bp, Artificial Sequence
  Description of Artificial Sequence: Synthetic oligonucleotide
  Target: ATXN1; (-) strand; PAM type: YTN; PAM sequence: CTG
atgccgtgtgctttagaagc

SEQ ID NO: 204712 - DNA, 20 bp, Artificial Sequence
  Description of Artificial Sequence: Synthetic oligonucleotide
  Target: ATXN1; (-) strand; PAM type: YTN; PAM sequence: TTC
agtgctgatgccgtgtgctt

SEQ ID NO: 204713 - DNA, 20 bp, Artificial Sequence
  Description of Artificial Sequence: Synthetic oligonucleotide
  Target: ATXN1; (-) strand; PAM type: YTN; PAM sequence: CTA
aacaaataaacatagccaaa

SEQ ID NO: 204714 - DNA, 20 bp, Artificial Sequence
  Description of Artificial Sequence: Synthetic oligonucleotide
  Target: ATXN1; (-) strand; PAM type: YTN; PAM sequence: CTG
agtacctaaacaaataaaca

SEQ ID NO: 204715 - DNA, 20 bp, Artificial Sequence
  Description of Artificial Sequence: Synthetic oligonucleotide
  Target: ATXN1; (-) strand; PAM type: YTN; PAM sequence: TTC
ctgagtacctaaacaaataa

SEQ ID NO: 204716 - DNA, 20 bp, Artificial Sequence
  Description of Artificial Sequence: Synthetic oligonucleotide
  Target: ATXN1; (-) strand; PAM type: YTN; PAM sequence: TTT
cctgagtacctaaacaaata

SEQ ID NO: 204717 - DNA, 20 bp, Artificial Sequence
  Description of Artificial Sequence: Synthetic oligonucleotide
  Target: ATXN1; (-) strand; PAM type: YTN; PAM sequence: TTT
tcctgagtacctaaacaaat

SEQ ID NO: 204718 - DNA, 20 bp, Artificial Sequence
  Description of Artificial Sequence: Synthetic oligonucleotide
  Target: ATXN1; (-) strand; PAM type: YTN; PAM sequence: CTG
gtggagattttcctgagtac

SEQ ID NO: 204719 - DNA, 20 bp, Artificial Sequence
  Description of Artificial Sequence: Synthetic oligonucleotide
  Target: ATXN1; (-) strand; PAM type: YTN; PAM sequence: TTC
ctggtggagattttcctgag

SEQ ID NO: 204720 - DNA, 20 bp, Artificial Sequence
  Description of Artificial Sequence: Synthetic oligonucleotide
  Target: ATXN1; (-) strand; PAM type: YTN; PAM sequence: TTT
cctggtggagattttcctga

SEQ ID NO: 204721 - DNA, 20 bp, Artificial Sequence
  Description of Artificial Sequence: Synthetic oligonucleotide
  Target: ATXN1; (-) strand; PAM type: YTN; PAM sequence: TTT
tcctggtggagattttcctg

SEQ ID NO: 204722 - DNA, 20 bp, Artificial Sequence
  Description of Artificial Sequence: Synthetic oligonucleotide
  Target: ATXN1; (-) strand; PAM type: YTN; PAM sequence: TTT
ttcctggtggagattttcct

SEQ ID NO: 204723 - DNA, 20 bp, Artificial Sequence
  Description of Artificial Sequence: Synthetic oligonucleotide
  Target: ATXN1; (-) strand; PAM type: YTN; PAM sequence: TTT
tttcctggtggagattttcc

SEQ ID NO: 204724 - DNA, 20 bp, Artificial Sequence
  Description of Artificial Sequence: Synthetic oligonucleotide
  Target: ATXN1; (-) strand; PAM type: YTN; PAM sequence: CTG
tattttttcctggtggagat

SEQ ID NO: 204725 - DNA, 20 bp, Artificial Sequence
  Description of Artificial Sequence: Synthetic oligonucleotide
  Target: ATXN1; (-) strand; PAM type: YTN; PAM sequence: TTC
aacaccctgtattttttcct

SEQ ID NO: 204726 - DNA, 20 bp, Artificial Sequence
  Description of Artificial Sequence: Synthetic oligonucleotide
  Target: ATXN1; (-) strand; PAM type: YTN; PAM sequence: CTG
ttcaacaccctgtatttttt

SEQ ID NO: 204727 - DNA, 20 bp, Artificial Sequence
  Description of Artificial Sequence: Synthetic oligonucleotide
  Target: ATXN1; (-) strand; PAM type: YTN; PAM sequence: CTC
tgttcaacaccctgtatttt

SEQ ID NO: 204728 - DNA, 20 bp, Artificial Sequence
  Description of Artificial Sequence: Synthetic oligonucleotide
  Target: ATXN1; (-) strand; PAM type: YTN; PAM sequence: TTC
cccctctgttcaacaccctg

SEQ ID NO: 204729 - DNA, 20 bp, Artificial Sequence
  Description of Artificial Sequence: Synthetic oligonucleotide
  Target: ATXN1; (-) strand; PAM type: YTN; PAM sequence: CTG
ttccccctctgttcaacacc

SEQ ID NO: 204730 - DNA, 20 bp, Artificial Sequence
  Description of Artificial Sequence: Synthetic oligonucleotide
  Target: ATXN1; (-) strand; PAM type: YTN; PAM sequence: TTC
tgttccccctctgttcaaca

SEQ ID NO: 204731 - DNA, 20 bp, Artificial Sequence
  Description of Artificial Sequence: Synthetic oligonucleotide
  Target: ATXN1; (-) strand; PAM type: YTN; PAM sequence: CTG
tgttctgttccccctctgtt

SEQ ID NO: 204732 - DNA, 20 bp, Artificial Sequence
  Description of Artificial Sequence: Synthetic oligonucleotide
  Target: ATXN1; (-) strand; PAM type: YTN; PAM sequence: CTA
ctgtgttctgttccccctct

SEQ ID NO: 204733 - DNA, 20 bp, Artificial Sequence
  Description of Artificial Sequence: Synthetic oligonucleotide
  Target: ATXN1; (-) strand; PAM type: YTN; PAM sequence: CTG
tatctactgtgttctgttcc

SEQ ID NO: 204734 - DNA, 20 bp, Artificial Sequence
  Description of Artificial Sequence: Synthetic oligonucleotide
  Target: ATXN1; (-) strand; PAM type: YTN; PAM sequence: CTA
ctgtatctactgtgttctgt

SEQ ID NO: 204735 - DNA, 20 bp, Artificial Sequence
  Description of Artificial Sequence: Synthetic oligonucleotide
  Target: ATXN1; (-) strand; PAM type: YTN; PAM sequence: TTG
ctactgtatctactgtgttc

SEQ ID NO: 204736 - DNA, 20 bp, Artificial Sequence
  Description of Artificial Sequence: Synthetic oligonucleotide
  Target: ATXN1; (-) strand; PAM type: YTN; PAM sequence: CTT
gctactgtatctactgtgtt

SEQ ID NO: 204737 - DNA, 20 bp, Artificial Sequence
  Description of Artificial Sequence: Synthetic oligonucleotide
  Target: ATXN1; (-) strand; PAM type: YTN; PAM sequence: TTC
ttgctactgtatctactgtg

SEQ ID NO: 204738 - DNA, 20 bp, Artificial Sequence
  Description of Artificial Sequence: Synthetic oligonucleotide
  Target: ATXN1; (-) strand; PAM type: YTN; PAM sequence: TTT
cttgctactgtatctactgt

SEQ ID NO: 204739 - DNA, 20 bp, Artificial Sequence
  Description of Artificial Sequence: Synthetic oligonucleotide
  Target: ATXN1; (-) strand; PAM type: YTN; PAM sequence: CTC
aataaacatttcttgctact

SEQ ID NO: 204740 - DNA, 20 bp, Artificial Sequence
  Description of Artificial Sequence: Synthetic oligonucleotide
  Target: ATXN1; (-) strand; PAM type: YTN; PAM sequence: CTG
gcacatagtcaatgctcaat

SEQ ID NO: 204741 - DNA, 20 bp, Artificial Sequence
  Description of Artificial Sequence: Synthetic oligonucleotide
  Target: ATXN1; (-) strand; PAM type: YTN; PAM sequence: CTG
gcctggcacatagtcaatgc

SEQ ID NO: 204742 - DNA, 20 bp, Artificial Sequence
  Description of Artificial Sequence: Synthetic oligonucleotide
  Target: ATXN1; (-) strand; PAM type: YTN; PAM sequence: TTG
cctggcctggcacatagtca

SEQ ID NO: 204743 - DNA, 20 bp, Artificial Sequence
  Description of Artificial Sequence: Synthetic oligonucleotide
  Target: ATXN1; (-) strand; PAM type: YTN; PAM sequence: CTG
agaacattgcctggcctggc

SEQ ID NO: 204744 - DNA, 20 bp, Artificial Sequence
  Description of Artificial Sequence: Synthetic oligonucleotide
  Target: ATXN1; (-) strand; PAM type: YTN; PAM sequence: TTG
tatacatataaacctgagaa

SEQ ID NO: 204745 - DNA, 20 bp, Artificial Sequence
  Description of Artificial Sequence: Synthetic oligonucleotide
  Target: ATXN1; (-) strand; PAM type: YTN; PAM sequence: CTG
tcagaattgtatacatataa

SEQ ID NO: 204746 - DNA, 20 bp, Artificial Sequence
  Description of Artificial Sequence: Synthetic oligonucleotide
  Target: ATXN1; (-) strand; PAM type: YTN; PAM sequence: CTA
aaatgggagccacagagcca

SEQ ID NO: 204747 - DNA, 20 bp, Artificial Sequence
  Description of Artificial Sequence: Synthetic oligonucleotide
  Target: ATXN1; (-) strand; PAM type: YTN; PAM sequence: CTC
taaaatgggagccacagagc

SEQ ID NO: 204748 - DNA, 20 bp, Artificial Sequence
  Description of Artificial Sequence: Synthetic oligonucleotide
  Target: ATXN1; (-) strand; PAM type: YTN; PAM sequence: CTC
tctaaaatgggagccacaga

SEQ ID NO: 204749 - DNA, 20 bp, Artificial Sequence
  Description of Artificial Sequence: Synthetic oligonucleotide
  Target: ATXN1; (-) strand; PAM type: YTN; PAM sequence: CTC
tctctaaaatgggagccaca

SEQ ID NO: 204750 - DNA, 20 bp, Artificial Sequence
  Description of Artificial Sequence: Synthetic oligonucleotide
  Target: ATXN1; (-) strand; PAM type: YTN; PAM sequence: CTC
tctctctaaaatgggagcca

SEQ ID NO: 204751 - DNA, 20 bp, Artificial Sequence
  Description of Artificial Sequence: Synthetic oligonucleotide
  Target: ATXN1; (-) strand; PAM type: YTN; PAM sequence: CTC
tctctctctaaaatgggagc

SEQ ID NO: 204752 - DNA, 20 bp, Artificial Sequence
  Description of Artificial Sequence: Synthetic oligonucleotide
  Target: ATXN1; (-) strand; PAM type: YTN; PAM sequence: CTC
tctctctctctaaaatggga

SEQ ID NO: 204753 - DNA, 20 bp, Artificial Sequence
  Description of Artificial Sequence: Synthetic oligonucleotide
  Target: ATXN1; (-) strand; PAM type: YTN; PAM sequence: CTC
tctctctctctctaaaatgg

SEQ ID NO: 204754 - DNA, 20 bp, Artificial Sequence
  Description of Artificial Sequence: Synthetic oligonucleotide
  Target: ATXN1; (-) strand; PAM type: YTN; PAM sequence: CTC
tctctctctctctctaaaat

SEQ ID NO: 204755 - DNA, 20 bp, Artificial Sequence
  Description of Artificial Sequence: Synthetic oligonucleotide
  Target: ATXN1; (-) strand; PAM type: YTN; PAM sequence: TTC
tctctctctctctctctaaa

SEQ ID NO: 204756 - DNA, 20 bp, Artificial Sequence
  Description of Artificial Sequence: Synthetic oligonucleotide
  Target: ATXN1; (-) strand; PAM type: YTN; PAM sequence: CTT
ctctctctctctctctctaa

SEQ ID NO: 204757 - DNA, 20 bp, Artificial Sequence
  Description of Artificial Sequence: Synthetic oligonucleotide
  Target: ATXN1; (-) strand; PAM type: YTN; PAM sequence: TTC
ttctctctctctctctctct

SEQ ID NO: 204758 - DNA, 20 bp, Artificial Sequence
  Description of Artificial Sequence: Synthetic oligonucleotide
  Target: ATXN1; (-) strand; PAM type: YTN; PAM sequence: TTC
caaaataatcattcttctct

SEQ ID NO: 204759 - DNA, 20 bp, Artificial Sequence
  Description of Artificial Sequence: Synthetic oligonucleotide
  Target: ATXN1; (-) strand; PAM type: YTN; PAM sequence: CTT
ccaaaataatcattcttctc

SEQ ID NO: 204760 - DNA, 20 bp, Artificial Sequence
  Description of Artificial Sequence: Synthetic oligonucleotide
  Target: ATXN1; (-) strand; PAM type: YTN; PAM sequence: CTC
ttccaaaataatcattcttc

SEQ ID NO: 204761 - DNA, 20 bp, Artificial Sequence
  Description of Artificial Sequence: Synthetic oligonucleotide
  Target: ATXN1; (-) strand; PAM type: YTN; PAM sequence: TTC
tcttccaaaataatcattct

SEQ ID NO: 204762 - DNA, 20 bp, Artificial Sequence
  Description of Artificial Sequence: Synthetic oligonucleotide
  Target: ATXN1; (-) strand; PAM type: YTN; PAM sequence: TTT
ctcttccaaaataatcattc

SEQ ID NO: 204763 - DNA, 20 bp, Artificial Sequence
  Description of Artificial Sequence: Synthetic oligonucleotide
  Target: ATXN1; (-) strand; PAM type: YTN; PAM sequence: TTT
tctcttccaaaataatcatt

SEQ ID NO: 204764 - DNA, 20 bp, Artificial Sequence
  Description of Artificial Sequence: Synthetic oligonucleotide
  Target: ATXN1; (-) strand; PAM type: YTN; PAM sequence: TTG
ttttctcttccaaaataatc

SEQ ID NO: 204765 - DNA, 20 bp, Artificial Sequence
  Description of Artificial Sequence: Synthetic oligonucleotide
  Target: ATXN1; (-) strand; PAM type: YTN; PAM sequence: CTT
gttttctcttccaaaataat

SEQ ID NO: 204766 - DNA, 20 bp, Artificial Sequence
  Description of Artificial Sequence: Synthetic oligonucleotide
  Target: ATXN1; (-) strand; PAM type: YTN; PAM sequence: CTC
ttgttttctcttccaaaata

SEQ ID NO: 204767 - DNA, 20 bp, Artificial Sequence
  Description of Artificial Sequence: Synthetic oligonucleotide
  Target: ATXN1; (-) strand; PAM type: YTN; PAM sequence: CTG
tccctcttgttttctcttcc

SEQ ID NO: 204768 - DNA, 20 bp, Artificial Sequence
  Description of Artificial Sequence: Synthetic oligonucleotide
  Target: ATXN1; (-) strand; PAM type: YTN; PAM sequence: TTA
tatgctgtccctcttgtttt

SEQ ID NO: 204769 - DNA, 20 bp, Artificial Sequence
  Description of Artificial Sequence: Synthetic oligonucleotide
  Target: ATXN1; (-) strand; PAM type: YTN; PAM sequence: TTG
gcaattatatgctgtccctc

SEQ ID NO: 204770 - DNA, 20 bp, Artificial Sequence
  Description of Artificial Sequence: Synthetic oligonucleotide
  Target: ATXN1; (-) strand; PAM type: YTN; PAM sequence: TTG
agttggcaattatatgctgt

SEQ ID NO: 204771 - DNA, 20 bp, Artificial Sequence
  Description of Artificial Sequence: Synthetic oligonucleotide
  Target: ATXN1; (-) strand; PAM type: YTN; PAM sequence: TTT
gagttggcaattatatgctg

SEQ ID NO: 204772 - DNA, 20 bp, Artificial Sequence
  Description of Artificial Sequence: Synthetic oligonucleotide
  Target: ATXN1; (-) strand; PAM type: YTN; PAM sequence: TTT
tgagttggcaattatatgct

SEQ ID NO: 204773 - DNA, 20 bp, Artificial Sequence
  Description of Artificial Sequence: Synthetic oligonucleotide
  Target: ATXN1; (-) strand; PAM type: YTN; PAM sequence: TTT
ttgagttggcaattatatgc

SEQ ID NO: 204774 - DNA, 20 bp, Artificial Sequence
  Description of Artificial Sequence: Synthetic oligonucleotide
  Target: ATXN1; (-) strand; PAM type: YTN; PAM sequence: TTT
tttgagttggcaattatatg

SEQ ID NO: 204775 - DNA, 20 bp, Artificial Sequence
  Description of Artificial Sequence: Synthetic oligonucleotide
  Target: ATXN1; (-) strand; PAM type: YTN; PAM sequence: TTT
ttttgagttggcaattatat

SEQ ID NO: 204776 - DNA, 20 bp, Artificial Sequence
  Description of Artificial Sequence: Synthetic oligonucleotide
  Target: ATXN1; (-) strand; PAM type: YTN; PAM sequence: TTT
tttttgagttggcaattata

SEQ ID NO: 204777 - DNA, 20 bp, Artificial Sequence
  Description of Artificial Sequence: Synthetic oligonucleotide
  Target: ATXN1; (-) strand; PAM type: YTN; PAM sequence: TTT
ttttttgagttggcaattat

SEQ ID NO: 204778 - DNA, 20 bp, Artificial Sequence
  Description of Artificial Sequence: Synthetic oligonucleotide
  Target: ATXN1; (-) strand; PAM type: YTN; PAM sequence: TTG
ggaaggtagtttttttttga

SEQ ID NO: 204779 - DNA, 20 bp, Artificial Sequence
  Description of Artificial Sequence: Synthetic oligonucleotide
  Target: ATXN1; (-) strand; PAM type: YTN; PAM sequence: TTT
gggaaggtagtttttttttg

SEQ ID NO: 204780 - DNA, 20 bp, Artificial Sequence
  Description of Artificial Sequence: Synthetic oligonucleotide
  Target: ATXN1; (-) strand; PAM type: YTN; PAM sequence: TTA
gtaaaatttgggaaggtagt

SEQ ID NO: 204781 - DNA, 20 bp, Artificial Sequence
  Description of Artificial Sequence: Synthetic oligonucleotide
  Target: ATXN1; (-) strand; PAM type: YTN; PAM sequence: TTT
agtaaaatttgggaaggtag

SEQ ID NO: 204782 - DNA, 20 bp, Artificial Sequence
  Description of Artificial Sequence: Synthetic oligonucleotide
  Target: ATXN1; (-) strand; PAM type: YTN; PAM sequence: TTT
tagtaaaatttgggaaggta

SEQ ID NO: 204783 - DNA, 20 bp, Artificial Sequence
  Description of Artificial Sequence: Synthetic oligonucleotide
  Target: ATXN1; (-) strand; PAM type: YTN; PAM sequence: CTG
aatgttttagtaaaatttgg

SEQ ID NO: 204784 - DNA, 20 bp, Artificial Sequence
  Description of Artificial Sequence: Synthetic oligonucleotide
  Target: ATXN1; (-) strand; PAM type: YTN; PAM sequence: TTG
ctgaatgttttagtaaaatt

SEQ ID NO: 204785 - DNA, 20 bp, Artificial Sequence
  Description of Artificial Sequence: Synthetic oligonucleotide
  Target: ATXN1; (-) strand; PAM type: YTN; PAM sequence: TTT
gctgaatgttttagtaaaat

SEQ ID NO: 204786 - DNA, 20 bp, Artificial Sequence
  Description of Artificial Sequence: Synthetic oligonucleotide
  Target: ATXN1; (-) strand; PAM type: YTN; PAM sequence: TTT
tgctgaatgttttagtaaaa

SEQ ID NO: 204787 - DNA, 20 bp, Artificial Sequence
  Description of Artificial Sequence: Synthetic oligonucleotide
  Target: ATXN1; (-) strand; PAM type: YTN; PAM sequence: TTT
ttgctgaatgttttagtaaa

SEQ ID NO: 204788 - DNA, 20 bp, Artificial Sequence
  Description of Artificial Sequence: Synthetic oligonucleotide
  Target: ATXN1; (-) strand; PAM type: YTN; PAM sequence: TTA
gatttttgctgaatgtttta

SEQ ID NO: 204789 - DNA, 20 bp, Artificial Sequence
  Description of Artificial Sequence: Synthetic oligonucleotide
  Target: ATXN1; (-) strand; PAM type: YTN; PAM sequence: TTT
agatttttgctgaatgtttt

SEQ ID NO: 204790 - DNA, 20 bp, Artificial Sequence
  Description of Artificial Sequence: Synthetic oligonucleotide
  Target: ATXN1; (-) strand; PAM type: YTN; PAM sequence: TTT
tagatttttgctgaatgttt

SEQ ID NO: 204791 - DNA, 20 bp, Artificial Sequence
  Description of Artificial Sequence: Synthetic oligonucleotide
  Target: ATXN1; (-) strand; PAM type: YTN; PAM sequence: TTT
ttagatttttgctgaatgtt

SEQ ID NO: 204792 - DNA, 20 bp, Artificial Sequence
  Description of Artificial Sequence: Synthetic oligonucleotide
  Target: ATXN1; (-) strand; PAM type: YTN; PAM sequence: TTT
tttagatttttgctgaatgt

SEQ ID NO: 204793 - DNA, 20 bp, Artificial Sequence
  Description of Artificial Sequence: Synthetic oligonucleotide
  Target: ATXN1; (-) strand; PAM type: YTN; PAM sequence: CTG
gtaattttttagatttttgc

SEQ ID NO: 204794 - DNA, 20 bp, Artificial Sequence
  Description of Artificial Sequence: Synthetic oligonucleotide
  Target: ATXN1; (-) strand; PAM type: YTN; PAM sequence: TTC
agaataagtgagaagtatat

SEQ ID NO: 204795 - DNA, 20 bp, Artificial Sequence
  Description of Artificial Sequence: Synthetic oligonucleotide
  Target: ATXN1; (-) strand; PAM type: YTN; PAM sequence: CTT
cagaataagtgagaagtata

SEQ ID NO: 204796 - DNA, 20 bp, Artificial Sequence
  Description of Artificial Sequence: Synthetic oligonucleotide
  Target: ATXN1; (-) strand; PAM type: YTN; PAM sequence: CTC
ttcagaataagtgagaagta

SEQ ID NO: 204797 - DNA, 20 bp, Artificial Sequence
  Description of Artificial Sequence: Synthetic oligonucleotide
  Target: ATXN1; (-) strand; PAM type: YTN; PAM sequence: TTA
agaaggatcatctcttcaga

SEQ ID NO: 204798 - DNA, 20 bp, Artificial Sequence
  Description of Artificial Sequence: Synthetic oligonucleotide
  Target: ATXN1; (-) strand; PAM type: YTN; PAM sequence: CTA
tatgccaaaagtattaagaa

SEQ ID NO: 204799 - DNA, 20 bp, Artificial Sequence
  Description of Artificial Sequence: Synthetic oligonucleotide
  Target: ATXN1; (-) strand; PAM type: YTN; PAM sequence: TTA
gcaagaagcagctatatgcc

SEQ ID NO: 204800 - DNA, 20 bp, Artificial Sequence
  Description of Artificial Sequence: Synthetic oligonucleotide
  Target: ATXN1; (-) strand; PAM type: YTN; PAM sequence: TTA
ttagcaagaagcagctatat

SEQ ID NO: 204801 - DNA, 20 bp, Artificial Sequence
  Description of Artificial Sequence: Synthetic oligonucleotide
  Target: ATXN1; (-) strand; PAM type: YTN; PAM sequence: TTT
attagcaagaagcagctata

SEQ ID NO: 204802 - DNA, 20 bp, Artificial Sequence
  Description of Artificial Sequence: Synthetic oligonucleotide
  Target: ATXN1; (-) strand; PAM type: YTN; PAM sequence: TTT
tattagcaagaagcagctat

SEQ ID NO: 204803 - DNA, 20 bp, Artificial Sequence
  Description of Artificial Sequence: Synthetic oligonucleotide
  Target: ATXN1; (-) strand; PAM type: YTN; PAM sequence: TTT
ttattagcaagaagcagcta

SEQ ID NO: 204804 - DNA, 20 bp, Artificial Sequence
  Description of Artificial Sequence: Synthetic oligonucleotide
  Target: ATXN1; (-) strand; PAM type: YTN; PAM sequence: TTT
tttattagcaagaagcagct

SEQ ID NO: 204805 - DNA, 20 bp, Artificial Sequence
  Description of Artificial Sequence: Synthetic oligonucleotide
  Target: ATXN1; (-) strand; PAM type: YTN; PAM sequence: TTT
ttttattagcaagaagcagc

SEQ ID NO: 204806 - DNA, 20 bp, Artificial Sequence
  Description of Artificial Sequence: Synthetic oligonucleotide
  Target: ATXN1; (-) strand; PAM type: YTN; PAM sequence: TTT
tttttattagcaagaagcag

SEQ ID NO: 204807 - DNA, 20 bp, Artificial Sequence
  Description of Artificial Sequence: Synthetic oligonucleotide
  Target: ATXN1; (-) strand; PAM type: YTN; PAM sequence: TTT
ttttttattagcaagaagca

SEQ ID NO: 204808 - DNA, 20 bp, Artificial Sequence
  Description of Artificial Sequence: Synthetic oligonucleotide
  Target: ATXN1; (-) strand; PAM type: YTN; PAM sequence: CTT
tttttttattagcaagaagc

SEQ ID NO: 204809 - DNA, 20 bp, Artificial Sequence
  Description of Artificial Sequence: Synthetic oligonucleotide
  Target: ATXN1; (-) strand; PAM type: YTN; PAM sequence: TTG
gaagtactttttttttatta

SEQ ID NO: 204810 - DNA, 20 bp, Artificial Sequence
  Description of Artificial Sequence: Synthetic oligonucleotide
  Target: ATXN1; (-) strand; PAM type: YTN; PAM sequence: CTT
ggaagtactttttttttatt

SEQ ID NO: 204811 - DNA, 20 bp, Artificial Sequence
  Description of Artificial Sequence: Synthetic oligonucleotide
  Target: ATXN1; (-) strand; PAM type: YTN; PAM sequence: TTG
gaaataatatacagaacatc

SEQ ID NO: 204812 - DNA, 20 bp, Artificial Sequence
  Description of Artificial Sequence: Synthetic oligonucleotide
  Target: ATXN1; (-) strand; PAM type: YTN; PAM sequence: TTT
ggaaataatatacagaacat

SEQ ID NO: 204813 - DNA, 20 bp, Artificial Sequence
  Description of Artificial Sequence: Synthetic oligonucleotide
  Target: ATXN1; (-) strand; PAM type: YTN; PAM sequence: TTA
taagatttggaaataatata

SEQ ID NO: 204814 - DNA, 20 bp, Artificial Sequence
  Description of Artificial Sequence: Synthetic oligonucleotide
  Target: ATXN1; (-) strand; PAM type: YTN; PAM sequence: CTG
ttataagatttggaaataat

SEQ ID NO: 204815 - DNA, 20 bp, Artificial Sequence
  Description of Artificial Sequence: Synthetic oligonucleotide
  Target: ATXN1; (-) strand; PAM type: YTN; PAM sequence: TTG
aaacaactgttataagattt

SEQ ID NO: 204816 - DNA, 20 bp, Artificial Sequence
  Description of Artificial Sequence: Synthetic oligonucleotide
  Target: ATXN1; (-) strand; PAM type: YTN; PAM sequence: TTG
ttgaaacaactgttataaga

SEQ ID NO: 204817 - DNA, 20 bp, Artificial Sequence
  Description of Artificial Sequence: Synthetic oligonucleotide
  Target: ATXN1; (-) strand; PAM type: YTN; PAM sequence: CTG
attgttgaaacaactgttat

SEQ ID NO: 204818 - DNA, 20 bp, Artificial Sequence
  Description of Artificial Sequence: Synthetic oligonucleotide
  Target: ATXN1; (-) strand; PAM type: YTN; PAM sequence: TTC
actgattgttgaaacaactg

SEQ ID NO: 204819 - DNA, 20 bp, Artificial Sequence
  Description of Artificial Sequence: Synthetic oligonucleotide
  Target: ATXN1; (-) strand; PAM type: YTN; PAM sequence: TTC
attcactgattgttgaaaca

SEQ ID NO: 204820 - DNA, 20 bp, Artificial Sequence
  Description of Artificial Sequence: Synthetic oligonucleotide
  Target: ATXN1; (-) strand; PAM type: YTN; PAM sequence: TTC
aaatagtgaatcattcattc

SEQ ID NO: 204821 - DNA, 20 bp, Artificial Sequence
  Description of Artificial Sequence: Synthetic oligonucleotide
  Target: ATXN1; (-) strand; PAM type: YTN; PAM sequence: TTC
atcagtgttcaaatagtgaa

SEQ ID NO: 204822 - DNA, 20 bp, Artificial Sequence
  Description of Artificial Sequence: Synthetic oligonucleotide
  Target: ATXN1; (-) strand; PAM type: YTN; PAM sequence: TTT
catcagtgttcaaatagtga

SEQ ID NO: 204823 - DNA, 20 bp, Artificial Sequence
  Description of Artificial Sequence: Synthetic oligonucleotide
  Target: ATXN1; (-) strand; PAM type: YTN; PAM sequence: CTC
atttcatcagtgttcaaata

SEQ ID NO: 204824 - DNA, 20 bp, Artificial Sequence
  Description of Artificial Sequence: Synthetic oligonucleotide
  Target: ATXN1; (-) strand; PAM type: YTN; PAM sequence: TTC
tcatttcatcagtgttcaaa

SEQ ID NO: 204825 - DNA, 20 bp, Artificial Sequence
  Description of Artificial Sequence: Synthetic oligonucleotide
  Target: ATXN1; (-) strand; PAM type: YTN; PAM sequence: CTT
ctcatttcatcagtgttcaa

SEQ ID NO: 204826 - DNA, 20 bp, Artificial Sequence
  Description of Artificial Sequence: Synthetic oligonucleotide
  Target: ATXN1; (-) strand; PAM type: YTN; PAM sequence: TTA
gtgcttctcatttcatcagt

SEQ ID NO: 204827 - DNA, 20 bp, Artificial Sequence
  Description of Artificial Sequence: Synthetic oligonucleotide
  Target: ATXN1; (-) strand; PAM type: YTN; PAM sequence: CTG
aatatcattagtgcttctca

SEQ ID NO: 204828 - DNA, 20 bp, Artificial Sequence
  Description of Artificial Sequence: Synthetic oligonucleotide
  Target: ATXN1; (-) strand; PAM type: YTN; PAM sequence: CTC
cctgaatatcattagtgctt

SEQ ID NO: 204829 - DNA, 20 bp, Artificial Sequence
  Description of Artificial Sequence: Synthetic oligonucleotide
  Target: ATXN1; (-) strand; PAM type: YTN; PAM sequence: CTG
tgctccctgaatatcattag

SEQ ID NO: 204830 - DNA, 20 bp, Artificial Sequence
  Description of Artificial Sequence: Synthetic oligonucleotide
  Target: ATXN1; (-) strand; PAM type: YTN; PAM sequence: CTC
aagatctgtgctccctgaat

SEQ ID NO: 204831 - DNA, 20 bp, Artificial Sequence
  Description of Artificial Sequence: Synthetic oligonucleotide
  Target: ATXN1; (-) strand; PAM type: YTN; PAM sequence: CTA
actcaagatctgtgctccct

SEQ ID NO: 204832 - DNA, 20 bp, Artificial Sequence
  Description of Artificial Sequence: Synthetic oligonucleotide
  Target: ATXN1; (-) strand; PAM type: YTN; PAM sequence: CTC
cctaactcaagatctgtgct

SEQ ID NO: 204833 - DNA, 20 bp, Artificial Sequence
  Description of Artificial Sequence: Synthetic oligonucleotide
  Target: ATXN1; (-) strand; PAM type: YTN; PAM sequence: TTC
tccctaactcaagatctgtg

SEQ ID NO: 204834 - DNA, 20 bp, Artificial Sequence
  Description of Artificial Sequence: Synthetic oligonucleotide
  Target: ATXN1; (-) strand; PAM type: YTN; PAM sequence: TTT
ctccctaactcaagatctgt

SEQ ID NO: 204835 - DNA, 20 bp, Artificial Sequence
  Description of Artificial Sequence: Synthetic oligonucleotide
  Target: ATXN1; (-) strand; PAM type: YTN; PAM sequence: CTT
tctccctaactcaagatctg

SEQ ID NO: 204836 - DNA, 20 bp, Artificial Sequence
  Description of Artificial Sequence: Synthetic oligonucleotide
  Target: ATXN1; (-) strand; PAM type: YTN; PAM sequence: TTC
cctttctccctaactcaaga

SEQ ID NO: 204837 - DNA, 20 bp, Artificial Sequence
  Description of Artificial Sequence: Synthetic oligonucleotide
  Target: ATXN1; (-) strand; PAM type: YTN; PAM sequence: TTC
agcggtggaagagaaaatga

SEQ ID NO: 204838 - DNA, 20 bp, Artificial Sequence
  Description of Artificial Sequence: Synthetic oligonucleotide
  Target: ATXN1; (-) strand; PAM type: YTN; PAM sequence: TTA
taggattcagcggtggaaga

SEQ ID NO: 204839 - DNA, 20 bp, Artificial Sequence
  Description of Artificial Sequence: Synthetic oligonucleotide
  Target: ATXN1; (-) strand; PAM type: YTN; PAM sequence: TTG
acattataggattcagcggt

SEQ ID NO: 204840 - DNA, 20 bp, Artificial Sequence
  Description of Artificial Sequence: Synthetic oligonucleotide
  Target: ATXN1; (-) strand; PAM type: YTN; PAM sequence: TTT
gacattataggattcagcgg

SEQ ID NO: 204841 - DNA, 20 bp, Artificial Sequence
  Description of Artificial Sequence: Synthetic oligonucleotide
  Target: ATXN1; (-) strand; PAM type: YTN; PAM sequence: TTT
tgacattataggattcagcg

SEQ ID NO: 204842 - DNA, 20 bp, Artificial Sequence
  Description of Artificial Sequence: Synthetic oligonucleotide
  Target: ATXN1; (-) strand; PAM type: YTN; PAM sequence: CTT
ttgacattataggattcagc

SEQ ID NO: 204843 - DNA, 20 bp, Artificial Sequence
  Description of Artificial Sequence: Synthetic oligonucleotide
  Target: ATXN1; (-) strand; PAM type: YTN; PAM sequence: TTC
aggaatgtgagataggagag

SEQ ID NO: 204844 - DNA, 20 bp, Artificial Sequence
  Description of Artificial Sequence: Synthetic oligonucleotide
  Target: ATXN1; (-) strand; PAM type: YTN; PAM sequence: CTA
aattcaggaatgtgagatag

SEQ ID NO: 204845 - DNA, 20 bp, Artificial Sequence
  Description of Artificial Sequence: Synthetic oligonucleotide
  Target: ATXN1; (-) strand; PAM type: YTN; PAM sequence: TTC
taaattcaggaatgtgagat

SEQ ID NO: 204846 - DNA, 20 bp, Artificial Sequence
  Description of Artificial Sequence: Synthetic oligonucleotide
  Target: ATXN1; (-) strand; PAM type: YTN; PAM sequence: TTT
ctaaattcaggaatgtgaga

SEQ ID NO: 204847 - DNA, 20 bp, Artificial Sequence
  Description of Artificial Sequence: Synthetic oligonucleotide
  Target: ATXN1; (-) strand; PAM type: YTN; PAM sequence: TTT
tctaaattcaggaatgtgag

SEQ ID NO: 204848 - DNA, 20 bp, Artificial Sequence
  Description of Artificial Sequence: Synthetic oligonucleotide
  Target: ATXN1; (-) strand; PAM type: YTN; PAM sequence: TTA
aatatgttttctaaattcag

SEQ ID NO: 204849 - DNA, 20 bp, Artificial Sequence
  Description of Artificial Sequence: Synthetic oligonucleotide
  Target: ATXN1; (-) strand; PAM type: YTN; PAM sequence: TTT
aaatatgttttctaaattca

SEQ ID NO: 204850 - DNA, 20 bp, Artificial Sequence
  Description of Artificial Sequence: Synthetic oligonucleotide
  Target: ATXN1; (-) strand; PAM type: YTN; PAM sequence: TTA
tcaaatgaaatgaagcattt

SEQ ID NO: 204851 - DNA, 20 bp, Artificial Sequence
  Description of Artificial Sequence: Synthetic oligonucleotide
  Target: ATXN1; (-) strand; PAM type: YTN; PAM sequence: TTA
gaggttatcaaatgaaatga

SEQ ID NO: 204852 - DNA, 20 bp, Artificial Sequence
  Description of Artificial Sequence: Synthetic oligonucleotide
  Target: ATXN1; (-) strand; PAM type: YTN; PAM sequence: CTT
agaggttatcaaatgaaatg

SEQ ID NO: 204853 - DNA, 20 bp, Artificial Sequence
  Description of Artificial Sequence: Synthetic oligonucleotide
  Target: ATXN1; (-) strand; PAM type: YTN; PAM sequence: CTC
ttagaggttatcaaatgaaa

SEQ ID NO: 204854 - DNA, 20 bp, Artificial Sequence
  Description of Artificial Sequence: Synthetic oligonucleotide
  Target: ATXN1; (-) strand; PAM type: YTN; PAM sequence: TTC
tcttagaggttatcaaatga

SEQ ID NO: 204855 - DNA, 20 bp, Artificial Sequence
  Description of Artificial Sequence: Synthetic oligonucleotide
  Target: ATXN1; (-) strand; PAM type: YTN; PAM sequence: TTT
ctcttagaggttatcaaatg

SEQ ID NO: 204856 - DNA, 20 bp, Artificial Sequence
  Description of Artificial Sequence: Synthetic oligonucleotide
  Target: ATXN1; (-) strand; PAM type: YTN; PAM sequence: TTT
tctcttagaggttatcaaat

SEQ ID NO: 204857 - DNA, 20 bp, Artificial Sequence
  Description of Artificial Sequence: Synthetic oligonucleotide
  Target: ATXN1; (-) strand; PAM type: YTN; PAM sequence: TTT
ttctcttagaggttatcaaa

SEQ ID NO: 204858 - DNA, 20 bp, Artificial Sequence
  Description of Artificial Sequence: Synthetic oligonucleotide
  Target: ATXN1; (-) strand; PAM type: YTN; PAM sequence: TTT
tttctcttagaggttatcaa

SEQ ID NO: 204859 - DNA, 20 bp, Artificial Sequence
  Description of Artificial Sequence: Synthetic oligonucleotide
  Target: ATXN1; (-) strand; PAM type: YTN; PAM sequence: TTT
ttttctcttagaggttatca

SEQ ID NO: 204860 - DNA, 20 bp, Artificial Sequence
  Description of Artificial Sequence: Synthetic oligonucleotide
  Target: ATXN1; (-) strand; PAM type: YTN; PAM sequence: CTA
tttttttctcttagaggtta

SEQ ID NO: 204861 - DNA, 20 bp, Artificial Sequence
  Description of Artificial Sequence: Synthetic oligonucleotide
  Target: ATXN1; (-) strand; PAM type: YTN; PAM sequence: TTC
aaatcactatttttttctct

SEQ ID NO: 204862 - DNA, 20 bp, Artificial Sequence
  Description of Artificial Sequence: Synthetic oligonucleotide
  Target: ATXN1; (-) strand; PAM type: YTN; PAM sequence: TTT
caaatcactatttttttctc

SEQ ID NO: 204863 - DNA, 20 bp, Artificial Sequence
  Description of Artificial Sequence: Synthetic oligonucleotide
  Target: ATXN1; (-) strand; PAM type: YTN; PAM sequence: TTT
tcaaatcactatttttttct

SEQ ID NO: 204864 - DNA, 20 bp, Artificial Sequence
  Description of Artificial Sequence: Synthetic oligonucleotide
  Target: ATXN1; (-) strand; PAM type: YTN; PAM sequence: CTT
ttcaaatcactatttttttc

SEQ ID NO: 204865 - DNA, 20 bp, Artificial Sequence
  Description of Artificial Sequence: Synthetic oligonucleotide
  Target: ATXN1; (-) strand; PAM type: YTN; PAM sequence: CTA
tggtacttttcaaatcacta

SEQ ID NO: 204866 - DNA, 20 bp, Artificial Sequence
  Description of Artificial Sequence: Synthetic oligonucleotide
  Target: ATXN1; (-) strand; PAM type: YTN; PAM sequence: TTC
tatggtacttttcaaatcac

SEQ ID NO: 204867 - DNA, 20 bp, Artificial Sequence
  Description of Artificial Sequence: Synthetic oligonucleotide
  Target: ATXN1; (-) strand; PAM type: YTN; PAM sequence: TTA
tcaaaatgacagtattctat

SEQ ID NO: 204868 - DNA, 20 bp, Artificial Sequence
  Description of Artificial Sequence: Synthetic oligonucleotide
  Target: ATXN1; (-) strand; PAM type: YTN; PAM sequence: TTT
atcaaaatgacagtattcta

SEQ ID NO: 204869 - DNA, 20 bp, Artificial Sequence
  Description of Artificial Sequence: Synthetic oligonucleotide
  Target: ATXN1; (-) strand; PAM type: YTN; PAM sequence: CTT
tatcaaaatgacagtattct

SEQ ID NO: 204870 - DNA, 20 bp, Artificial Sequence
  Description of Artificial Sequence: Synthetic oligonucleotide
  Target: ATXN1; (-) strand; PAM type: YTN; PAM sequence: TTC
atacagctttatcaaaatga

SEQ ID NO: 204871 - DNA, 20 bp, Artificial Sequence
  Description of Artificial Sequence: Synthetic oligonucleotide
  Target: ATXN1; (-) strand; PAM type: YTN; PAM sequence: TTT
catacagctttatcaaaatg

SEQ ID NO: 204872 - DNA, 20 bp, Artificial Sequence
  Description of Artificial Sequence: Synthetic oligonucleotide
  Target: ATXN1; (-) strand; PAM type: YTN; PAM sequence: CTT
tcatacagctttatcaaaat

SEQ ID NO: 204873 - DNA, 20 bp, Artificial Sequence
  Description of Artificial Sequence: Synthetic oligonucleotide
  Target: ATXN1; (-) strand; PAM type: YTN; PAM sequence: CTC
gaggtagaaatccaactttc

SEQ ID NO: 204874 - DNA, 20 bp, Artificial Sequence
  Description of Artificial Sequence: Synthetic oligonucleotide
  Target: ATXN1; (-) strand; PAM type: YTN; PAM sequence: CTC
aaagtgcgggcaaaactcga

SEQ ID NO: 204875 - DNA, 20 bp, Artificial Sequence
  Description of Artificial Sequence: Synthetic oligonucleotide
  Target: ATXN1; (-) strand; PAM type: YTN; PAM sequence: CTA
ctcaaagtgcgggcaaaact

SEQ ID NO: 204876 - DNA, 20 bp, Artificial Sequence
  Description of Artificial Sequence: Synthetic oligonucleotide
  Target: ATXN1; (-) strand; PAM type: YTN; PAM sequence: TTG
gcaaaccatactactcaaag

SEQ ID NO: 204877 - DNA, 20 bp, Artificial Sequence
  Description of Artificial Sequence: Synthetic oligonucleotide
  Target: ATXN1; (-) strand; PAM type: YTN; PAM sequence: TTC
aatgttggcaaaccatacta

SEQ ID NO: 204878 - DNA, 20 bp, Artificial Sequence
  Description of Artificial Sequence: Synthetic oligonucleotide
  Target: ATXN1; (-) strand; PAM type: YTN; PAM sequence: TTT
caatgttggcaaaccatact

SEQ ID NO: 204879 - DNA, 20 bp, Artificial Sequence
  Description of Artificial Sequence: Synthetic oligonucleotide
  Target: ATXN1; (-) strand; PAM type: YTN; PAM sequence: CTT
tcaatgttggcaaaccatac

SEQ ID NO: 204880 - DNA, 20 bp, Artificial Sequence
  Description of Artificial Sequence: Synthetic oligonucleotide
  Target: ATXN1; (-) strand; PAM type: YTN; PAM sequence: CTG
ctttcaatgttggcaaacca

SEQ ID NO: 204881 - DNA, 20 bp, Artificial Sequence
  Description of Artificial Sequence: Synthetic oligonucleotide
  Target: ATXN1; (-) strand; PAM type: YTN; PAM sequence: CTA
atgctgctttcaatgttggc

SEQ ID NO: 204882 - DNA, 20 bp, Artificial Sequence
  Description of Artificial Sequence: Synthetic oligonucleotide
  Target: ATXN1; (-) strand; PAM type: YTN; PAM sequence: CTA
cactaatgctgctttcaatg

SEQ ID NO: 204883 - DNA, 20 bp, Artificial Sequence
  Description of Artificial Sequence: Synthetic oligonucleotide
  Target: ATXN1; (-) strand; PAM type: YTN; PAM sequence: CTG
ctacactaatgctgctttca

SEQ ID NO: 204884 - DNA, 20 bp, Artificial Sequence
  Description of Artificial Sequence: Synthetic oligonucleotide
  Target: ATXN1; (-) strand; PAM type: YTN; PAM sequence: TTC
ccctgctacactaatgctgc

SEQ ID NO: 204885 - DNA, 20 bp, Artificial Sequence
  Description of Artificial Sequence: Synthetic oligonucleotide
  Target: ATXN1; (-) strand; PAM type: YTN; PAM sequence: CTT
cccctgctacactaatgctg

SEQ ID NO: 204886 - DNA, 20 bp, Artificial Sequence
  Description of Artificial Sequence: Synthetic oligonucleotide
  Target: ATXN1; (-) strand; PAM type: YTN; PAM sequence: CTG
cacagaccttcccctgctac

SEQ ID NO: 204887 - DNA, 20 bp, Artificial Sequence
  Description of Artificial Sequence: Synthetic oligonucleotide
  Target: ATXN1; (-) strand; PAM type: YTN; PAM sequence: CTG
ctgcacagaccttcccctgc

SEQ ID NO: 204888 - DNA, 20 bp, Artificial Sequence
  Description of Artificial Sequence: Synthetic oligonucleotide
  Target: ATXN1; (-) strand; PAM type: YTN; PAM sequence: CTA
aagcagactgctgcacagac

SEQ ID NO: 204889 - DNA, 20 bp, Artificial Sequence
  Description of Artificial Sequence: Synthetic oligonucleotide
  Target: ATXN1; (-) strand; PAM type: YTN; PAM sequence: CTA
ccctaaagcagactgctgca

SEQ ID NO: 204890 - DNA, 20 bp, Artificial Sequence
  Description of Artificial Sequence: Synthetic oligonucleotide
  Target: ATXN1; (-) strand; PAM type: YTN; PAM sequence: TTG
ctaccctaaagcagactgct

SEQ ID NO: 204891 - DNA, 20 bp, Artificial Sequence
  Description of Artificial Sequence: Synthetic oligonucleotide
  Target: ATXN1; (-) strand; PAM type: YTN; PAM sequence: TTA
ttgctaccctaaagcagact

SEQ ID NO: 204892 - DNA, 20 bp, Artificial Sequence
  Description of Artificial Sequence: Synthetic oligonucleotide
  Target: ATXN1; (-) strand; PAM type: YTN; PAM sequence: CTT
attgctaccctaaagcagac

SEQ ID NO: 204893 - DNA, 20 bp, Artificial Sequence
  Description of Artificial Sequence: Synthetic oligonucleotide
  Target: ATXN1; (-) strand; PAM type: YTN; PAM sequence: TTC
ttattgctaccctaaagcag

SEQ ID NO: 204894 - DNA, 20 bp, Artificial Sequence
  Description of Artificial Sequence: Synthetic oligonucleotide
  Target: ATXN1; (-) strand; PAM type: YTN; PAM sequence: TTT
cttattgctaccctaaagca

SEQ ID NO: 204895 - DNA, 20 bp, Artificial Sequence
  Description of Artificial Sequence: Synthetic oligonucleotide
  Target: ATXN1; (-) strand; PAM type: YTN; PAM sequence: CTT
tcttattgctaccctaaagc

SEQ ID NO: 204896 - DNA, 20 bp, Artificial Sequence
  Description of Artificial Sequence: Synthetic oligonucleotide
  Target: ATXN1; (-) strand; PAM type: YTN; PAM sequence: TTG
tctttcttattgctacccta

SEQ ID NO: 204897 - DNA, 20 bp, Artificial Sequence
  Description of Artificial Sequence: Synthetic oligonucleotide
  Target: ATXN1; (-) strand; PAM type: YTN; PAM sequence: TTT
gtctttcttattgctaccct

SEQ ID NO: 204898 - DNA, 20 bp, Artificial Sequence
  Description of Artificial Sequence: Synthetic oligonucleotide
  Target: ATXN1; (-) strand; PAM type: YTN; PAM sequence: TTT
tgtctttcttattgctaccc

SEQ ID NO: 204899 - DNA, 20 bp, Artificial Sequence
  Description of Artificial Sequence: Synthetic oligonucleotide
  Target: ATXN1; (-) strand; PAM type: YTN; PAM sequence: TTA
caattttgtctttcttattg

SEQ ID NO: 204900 - DNA, 20 bp, Artificial Sequence
  Description of Artificial Sequence: Synthetic oligonucleotide
  Target: ATXN1; (-) strand; PAM type: YTN; PAM sequence: CTT
acaattttgtctttcttatt

SEQ ID NO: 204901 - DNA, 20 bp, Artificial Sequence
  Description of Artificial Sequence: Synthetic oligonucleotide
  Target: ATXN1; (-) strand; PAM type: YTN; PAM sequence: TTG
atatcaaagcttacaatttt

SEQ ID NO: 204902 - DNA, 20 bp, Artificial Sequence
  Description of Artificial Sequence: Synthetic oligonucleotide
  Target: ATXN1; (-) strand; PAM type: YTN; PAM sequence: TTA
gaaaatggttgatatcaaag

SEQ ID NO: 204903 - DNA, 20 bp, Artificial Sequence
  Description of Artificial Sequence: Synthetic oligonucleotide
  Target: ATXN1; (-) strand; PAM type: YTN; PAM sequence: TTA
aaacacattagaaaatggtt

SEQ ID NO: 204904 - DNA, 20 bp, Artificial Sequence
  Description of Artificial Sequence: Synthetic oligonucleotide
  Target: ATXN1; (-) strand; PAM type: YTN; PAM sequence: CTT
aaaacacattagaaaatggt

SEQ ID NO: 204905 - DNA, 20 bp, Artificial Sequence
  Description of Artificial Sequence: Synthetic oligonucleotide
  Target: ATXN1; (-) strand; PAM type: YTN; PAM sequence: CTC
ttaaaacacattagaaaatg

SEQ ID NO: 204906 - DNA, 20 bp, Artificial Sequence
  Description of Artificial Sequence: Synthetic oligonucleotide
  Target: ATXN1; (-) strand; PAM type: YTN; PAM sequence: TTA
ctcttaaaacacattagaaa

SEQ ID NO: 204907 - DNA, 20 bp, Artificial Sequence
  Description of Artificial Sequence: Synthetic oligonucleotide
  Target: ATXN1; (-) strand; PAM type: YTN; PAM sequence: TTT
actcttaaaacacattagaa

SEQ ID NO: 204908 - DNA, 20 bp, Artificial Sequence
  Description of Artificial Sequence: Synthetic oligonucleotide
  Target: ATXN1; (-) strand; PAM type: YTN; PAM sequence: CTG
tgtttactcttaaaacacat

SEQ ID NO: 204909 - DNA, 20 bp, Artificial Sequence
  Description of Artificial Sequence: Synthetic oligonucleotide
  Target: ATXN1; (-) strand; PAM type: YTN; PAM sequence: TTC
catcatctgtgtttactctt

SEQ ID NO: 204910 - DNA, 20 bp, Artificial Sequence
  Description of Artificial Sequence: Synthetic oligonucleotide
  Target: ATXN1; (-) strand; PAM type: YTN; PAM sequence: CTA
ttccatcatctgtgtttact

SEQ ID NO: 204911 - DNA, 20 bp, Artificial Sequence
  Description of Artificial Sequence: Synthetic oligonucleotide
  Target: ATXN1; (-) strand; PAM type: YTN; PAM sequence: CTC
atgaaataaggtagactatt

SEQ ID NO: 204912 - DNA, 20 bp, Artificial Sequence
  Description of Artificial Sequence: Synthetic oligonucleotide
  Target: ATXN1; (-) strand; PAM type: YTN; PAM sequence: CTC
tcatgaaataaggtagacta

SEQ ID NO: 204913 - DNA, 20 bp, Artificial Sequence
  Description of Artificial Sequence: Synthetic oligonucleotide
  Target: ATXN1; (-) strand; PAM type: YTN; PAM sequence: TTG
taataactctcatgaaataa

SEQ ID NO: 204914 - DNA, 20 bp, Artificial Sequence
  Description of Artificial Sequence: Synthetic oligonucleotide
  Target: ATXN1; (-) strand; PAM type: YTN; PAM sequence: TTC
acatagttgtaataactctc

SEQ ID NO: 204915 - DNA, 20 bp, Artificial Sequence
  Description of Artificial Sequence: Synthetic oligonucleotide
  Target: ATXN1; (-) strand; PAM type: YTN; PAM sequence: CTG
gtgtcagtatggaaacattc

SEQ ID NO: 204916 - DNA, 20 bp, Artificial Sequence
  Description of Artificial Sequence: Synthetic oligonucleotide
  Target: ATXN1; (-) strand; PAM type: YTN; PAM sequence: TTC
tggtgtcagtatggaaacat

SEQ ID NO: 204917 - DNA, 20 bp, Artificial Sequence
  Description of Artificial Sequence: Synthetic oligonucleotide
  Target: ATXN1; (-) strand; PAM type: YTN; PAM sequence: TTT
ctggtgtcagtatggaaaca

SEQ ID NO: 204918 - DNA, 20 bp, Artificial Sequence
  Description of Artificial Sequence: Synthetic oligonucleotide
  Target: ATXN1; (-) strand; PAM type: YTN; PAM sequence: TTA
taaataatatgatttctggt

SEQ ID NO: 204919 - DNA, 20 bp, Artificial Sequence
  Description of Artificial Sequence: Synthetic oligonucleotide
  Target: ATXN1; (-) strand; PAM type: YTN; PAM sequence: TTT
ataaataatatgatttctgg

SEQ ID NO: 204920 - DNA, 20 bp, Artificial Sequence
  Description of Artificial Sequence: Synthetic oligonucleotide
  Target: ATXN1; (-) strand; PAM type: YTN; PAM sequence: TTT
tataaataatatgatttctg

SEQ ID NO: 204921 - DNA, 20 bp, Artificial Sequence
  Description of Artificial Sequence: Synthetic oligonucleotide
  Target: ATXN1; (-) strand; PAM type: YTN; PAM sequence: TTG
aaagttttataaataatatg

SEQ ID NO: 204922 - DNA, 20 bp, Artificial Sequence
  Description of Artificial Sequence: Synthetic oligonucleotide
  Target: ATXN1; (-) strand; PAM type: YTN; PAM sequence: TTT
gaaagttttataaataatat

SEQ ID NO: 204923 - DNA, 20 bp, Artificial Sequence
  Description of Artificial Sequence: Synthetic oligonucleotide
  Target: ATXN1; (-) strand; PAM type: YTN; PAM sequence: CTT
tgaaagttttataaataata

SEQ ID NO: 204924 - DNA, 20 bp, Artificial Sequence
  Description of Artificial Sequence: Synthetic oligonucleotide
  Target: ATXN1; (-) strand; PAM type: YTN; PAM sequence: TTC
tttgaaagttttataaataa

SEQ ID NO: 204925 - DNA, 20 bp, Artificial Sequence
  Description of Artificial Sequence: Synthetic oligonucleotide
  Target: ATXN1; (-) strand; PAM type: YTN; PAM sequence: TTA
ttctttgaaagttttataaa

SEQ ID NO: 204926 - DNA, 20 bp, Artificial Sequence
  Description of Artificial Sequence: Synthetic oligonucleotide
  Target: ATXN1; (-) strand; PAM type: YTN; PAM sequence: TTT
attctttgaaagttttataa

SEQ ID NO: 204927 - DNA, 20 bp, Artificial Sequence
  Description of Artificial Sequence: Synthetic oligonucleotide
  Target: ATXN1; (-) strand; PAM type: YTN; PAM sequence: TTT
tattctttgaaagttttata

SEQ ID NO: 204928 - DNA, 20 bp, Artificial Sequence
  Description of Artificial Sequence: Synthetic oligonucleotide
  Target: ATXN1; (-) strand; PAM type: YTN; PAM sequence: TTA
tgaagcattttattctttga

SEQ ID NO: 204929 - DNA, 20 bp, Artificial Sequence
  Description of Artificial Sequence: Synthetic oligonucleotide
  Target: ATXN1; (-) strand; PAM type: YTN; PAM sequence: TTT
atgaagcattttattctttg

SEQ ID NO: 204930 - DNA, 20 bp, Artificial Sequence
  Description of Artificial Sequence: Synthetic oligonucleotide
  Target: ATXN1; (-) strand; PAM type: YTN; PAM sequence: CTT
tatgaagcattttattcttt

SEQ ID NO: 204931 - DNA, 20 bp, Artificial Sequence
  Description of Artificial Sequence: Synthetic oligonucleotide
  Target: ATXN1; (-) strand; PAM type: YTN; PAM sequence: TTC
tttatgaagcattttattct

SEQ ID NO: 204932 - DNA, 20 bp, Artificial Sequence
  Description of Artificial Sequence: Synthetic oligonucleotide
  Target: ATXN1; (-) strand; PAM type: YTN; PAM sequence: CTT
ctttatgaagcattttattc

SEQ ID NO: 204933 - DNA, 20 bp, Artificial Sequence
  Description of Artificial Sequence: Synthetic oligonucleotide
  Target: ATXN1; (-) strand; PAM type: YTN; PAM sequence: TTA
ccaggcttctttatgaagca

SEQ ID NO: 204934 - DNA, 20 bp, Artificial Sequence
  Description of Artificial Sequence: Synthetic oligonucleotide
  Target: ATXN1; (-) strand; PAM type: YTN; PAM sequence: CTT
accaggcttctttatgaagc

SEQ ID NO: 204935 - DNA, 20 bp, Artificial Sequence
  Description of Artificial Sequence: Synthetic oligonucleotide
  Target: ATXN1; (-) strand; PAM type: YTN; PAM sequence: TTA
aaataacttaccaggcttct

SEQ ID NO: 204936 - DNA, 20 bp, Artificial Sequence
  Description of Artificial Sequence: Synthetic oligonucleotide
  Target: ATXN1; (-) strand; PAM type: YTN; PAM sequence: TTT
aaaataacttaccaggcttc

SEQ ID NO: 204937 - DNA, 20 bp, Artificial Sequence
  Description of Artificial Sequence: Synthetic oligonucleotide
  Target: ATXN1; (-) strand; PAM type: YTN; PAM sequence: TTT
taaaataacttaccaggctt

SEQ ID NO: 204938 - DNA, 20 bp, Artificial Sequence
  Description of Artificial Sequence: Synthetic oligonucleotide
  Target: ATXN1; (-) strand; PAM type: YTN; PAM sequence: TTA
aagttttaaaataacttacc

SEQ ID NO: 204939 - DNA, 20 bp, Artificial Sequence
  Description of Artificial Sequence: Synthetic oligonucleotide
  Target: ATXN1; (-) strand; PAM type: YTN; PAM sequence: TTT
aaagttttaaaataacttac

SEQ ID NO: 204940 - DNA, 20 bp, Artificial Sequence
  Description of Artificial Sequence: Synthetic oligonucleotide
  Target: ATXN1; (-) strand; PAM type: YTN; PAM sequence: CTT
taaagttttaaaataactta

SEQ ID NO: 204941 - DNA, 20 bp, Artificial Sequence
  Description of Artificial Sequence: Synthetic oligonucleotide
  Target: ATXN1; (-) strand; PAM type: YTN; PAM sequence: TTG
gatactttaaagttttaaaa

SEQ ID NO: 204942 - DNA, 20 bp, Artificial Sequence
  Description of Artificial Sequence: Synthetic oligonucleotide
  Target: ATXN1; (-) strand; PAM type: YTN; PAM sequence: TTT
ggatactttaaagttttaaa

SEQ ID NO: 204943 - DNA, 20 bp, Artificial Sequence
  Description of Artificial Sequence: Synthetic oligonucleotide
  Target: ATXN1; (-) strand; PAM type: YTN; PAM sequence: TTT
tggatactttaaagttttaa

SEQ ID NO: 204944 - DNA, 20 bp, Artificial Sequence
  Description of Artificial Sequence: Synthetic oligonucleotide
  Target: ATXN1; (-) strand; PAM type: YTN; PAM sequence: CTA
ttttggatactttaaagttt

SEQ ID NO: 204945 - DNA, 20 bp, Artificial Sequence
  Description of Artificial Sequence: Synthetic oligonucleotide
  Target: ATXN1; (-) strand; PAM type: YTN; PAM sequence: TTA
aactattttggatactttaa

SEQ ID NO: 204946 - DNA, 20 bp, Artificial Sequence
  Description of Artificial Sequence: Synthetic oligonucleotide
  Target: ATXN1; (-) strand; PAM type: YTN; PAM sequence: TTT
aaactattttggatacttta

SEQ ID NO: 204947 - DNA, 20 bp, Artificial Sequence
  Description of Artificial Sequence: Synthetic oligonucleotide
  Target: ATXN1; (-) strand; PAM type: YTN; PAM sequence: TTT
taaactattttggatacttt

SEQ ID NO: 204948 - DNA, 20 bp, Artificial Sequence
  Description of Artificial Sequence: Synthetic oligonucleotide
  Target: ATXN1; (-) strand; PAM type: YTN; PAM sequence: CTT
ttaaactattttggatactt

SEQ ID NO: 204949 - DNA, 20 bp, Artificial Sequence
  Description of Artificial Sequence: Synthetic oligonucleotide
  Target: ATXN1; (-) strand; PAM type: YTN; PAM sequence: TTA
tatgtaggcgtagcttttaa

SEQ ID NO: 204950 - DNA, 20 bp, Artificial Sequence
  Description of Artificial Sequence: Synthetic oligonucleotide
  Target: ATXN1; (-) strand; PAM type: YTN; PAM sequence: TTT
atatgtaggcgtagctttta

SEQ ID NO: 204951 - DNA, 20 bp, Artificial Sequence
  Description of Artificial Sequence: Synthetic oligonucleotide
  Target: ATXN1; (-) strand; PAM type: YTN; PAM sequence: TTT
tatatgtaggcgtagctttt

SEQ ID NO: 204952 - DNA, 20 bp, Artificial Sequence
  Description of Artificial Sequence: Synthetic oligonucleotide
  Target: ATXN1; (-) strand; PAM type: YTN; PAM sequence: TTG
tgttttatatgtaggcgtag

SEQ ID NO: 204953 - DNA, 20 bp, Artificial Sequence
  Description of Artificial Sequence: Synthetic oligonucleotide
  Target: ATXN1; (-) strand; PAM type: YTN; PAM sequence: TTC
aagagtatattgtgttttat

SEQ ID NO: 204954 - DNA, 20 bp, Artificial Sequence
  Description of Artificial Sequence: Synthetic oligonucleotide
  Target: ATXN1; (-) strand; PAM type: YTN; PAM sequence: TTA
ggaaaagcgaaaaaatgtag

SEQ ID NO: 204955 - DNA, 20 bp, Artificial Sequence
  Description of Artificial Sequence: Synthetic oligonucleotide
  Target: ATXN1; (-) strand; PAM type: YTN; PAM sequence: TTT
aggaaaagcgaaaaaatgta

SEQ ID NO: 204956 - DNA, 20 bp, Artificial Sequence
  Description of Artificial Sequence: Synthetic oligonucleotide
  Target: ATXN1; (-) strand; PAM type: YTN; PAM sequence: TTT
taggaaaagcgaaaaaatgt

SEQ ID NO: 204957 - DNA, 20 bp, Artificial Sequence
  Description of Artificial Sequence: Synthetic oligonucleotide
  Target: ATXN1; (-) strand; PAM type: YTN; PAM sequence: TTT
ttaggaaaagcgaaaaaatg

SEQ ID NO: 204958 - DNA, 20 bp, Artificial Sequence
  Description of Artificial Sequence: Synthetic oligonucleotide
  Target: ATXN1; (-) strand; PAM type: YTN; PAM sequence: TTT
tttaggaaaagcgaaaaaat

SEQ ID NO: 204959 - DNA, 20 bp, Artificial Sequence
  Description of Artificial Sequence: Synthetic oligonucleotide
  Target: ATXN1; (-) strand; PAM type: YTN; PAM sequence: TTT
ttttaggaaaagcgaaaaaa

SEQ ID NO: 204960 - DNA, 20 bp, Artificial Sequence
  Description of Artificial Sequence: Synthetic oligonucleotide
  Target: ATXN1; (-) strand; PAM type: YTN; PAM sequence: TTA
atgatttttttaggaaaagc

SEQ ID NO: 204961 - DNA, 20 bp, Artificial Sequence
  Description of Artificial Sequence: Synthetic oligonucleotide
  Target: ATXN1; (-) strand; PAM type: YTN; PAM sequence: TTT
aatgatttttttaggaaaag

SEQ ID NO: 204962 - DNA, 20 bp, Artificial Sequence
  Description of Artificial Sequence: Synthetic oligonucleotide
  Target: ATXN1; (-) strand; PAM type: YTN; PAM sequence: TTG
agacatttaatgattttttt

SEQ ID NO: 204963 - DNA, 20 bp, Artificial Sequence
  Description of Artificial Sequence: Synthetic oligonucleotide
  Target: ATXN1; (-) strand; PAM type: YTN; PAM sequence: TTT
gagacatttaatgatttttt

SEQ ID NO: 204964 - DNA, 20 bp, Artificial Sequence
  Description of Artificial Sequence: Synthetic oligonucleotide
  Target: ATXN1; (-) strand; PAM type: YTN; PAM sequence: TTT
tgagacatttaatgattttt

SEQ ID NO: 204965 - DNA, 20 bp, Artificial Sequence
  Description of Artificial Sequence: Synthetic oligonucleotide
  Target: ATXN1; (-) strand; PAM type: YTN; PAM sequence: TTA
ttttgagacatttaatgatt

SEQ ID NO: 204966 - DNA, 20 bp, Artificial Sequence
  Description of Artificial Sequence: Synthetic oligonucleotide
  Target: ATXN1; (-) strand; PAM type: YTN; PAM sequence: TTG
ggtaaaggcattattttgag

SEQ ID NO: 204967 - DNA, 20 bp, Artificial Sequence
  Description of Artificial Sequence: Synthetic oligonucleotide
  Target: ATXN1; (-) strand; PAM type: YTN; PAM sequence: TTT
gggtaaaggcattattttga

SEQ ID NO: 204968 - DNA, 20 bp, Artificial Sequence
  Description of Artificial Sequence: Synthetic oligonucleotide
  Target: ATXN1; (-) strand; PAM type: YTN; PAM sequence: TTC
atagccagtttgggtaaagg

SEQ ID NO: 204969 - DNA, 20 bp, Artificial Sequence
  Description of Artificial Sequence: Synthetic oligonucleotide
  Target: ATXN1; (-) strand; PAM type: YTN; PAM sequence: CTC
cataattcatagccagtttg

SEQ ID NO: 204970 - DNA, 20 bp, Artificial Sequence
  Description of Artificial Sequence: Synthetic oligonucleotide
  Target: ATXN1; (-) strand; PAM type: YTN; PAM sequence: CTG
tagatagcctccataattca

SEQ ID NO: 204971 - DNA, 20 bp, Artificial Sequence
  Description of Artificial Sequence: Synthetic oligonucleotide
  Target: ATXN1; (-) strand; PAM type: YTN; PAM sequence: TTC
aatctgtagatagcctccat

SEQ ID NO: 204972 - DNA, 20 bp, Artificial Sequence
  Description of Artificial Sequence: Synthetic oligonucleotide
  Target: ATXN1; (-) strand; PAM type: YTN; PAM sequence: CTT
caatctgtagatagcctcca

SEQ ID NO: 204973 - DNA, 20 bp, Artificial Sequence
  Description of Artificial Sequence: Synthetic oligonucleotide
  Target: ATXN1; (-) strand; PAM type: YTN; PAM sequence: TTC
cttcaatctgtagatagcct

SEQ ID NO: 204974 - DNA, 20 bp, Artificial Sequence
  Description of Artificial Sequence: Synthetic oligonucleotide
  Target: ATXN1; (-) strand; PAM type: YTN; PAM sequence: CTT
ccttcaatctgtagatagcc

SEQ ID NO: 204975 - DNA, 20 bp, Artificial Sequence
  Description of Artificial Sequence: Synthetic oligonucleotide
  Target: ATXN1; (-) strand; PAM type: YTN; PAM sequence: CTC
ccacccttccttcaatctgt

SEQ ID NO: 204976 - DNA, 20 bp, Artificial Sequence
  Description of Artificial Sequence: Synthetic oligonucleotide
  Target: ATXN1; (-) strand; PAM type: YTN; PAM sequence: TTC
tcccacccttccttcaatct

SEQ ID NO: 204977 - DNA, 20 bp, Artificial Sequence
  Description of Artificial Sequence: Synthetic oligonucleotide
  Target: ATXN1; (-) strand; PAM type: YTN; PAM sequence: TTT
ctcccacccttccttcaatc

SEQ ID NO: 204978 - DNA, 20 bp, Artificial Sequence
  Description of Artificial Sequence: Synthetic oligonucleotide
  Target: ATXN1; (-) strand; PAM type: YTN; PAM sequence: TTT
tctcccacccttccttcaat

SEQ ID NO: 204979 - DNA, 20 bp, Artificial Sequence
  Description of Artificial Sequence: Synthetic oligonucleotide
  Target: ATXN1; (-) strand; PAM type: YTN; PAM sequence: CTT
ttctcccacccttccttcaa

SEQ ID NO: 204980 - DNA, 20 bp, Artificial Sequence
  Description of Artificial Sequence: Synthetic oligonucleotide
  Target: ATXN1; (-) strand; PAM type: YTN; PAM sequence: TTC
ccttttctcccacccttcct

SEQ ID NO: 204981 - DNA, 20 bp, Artificial Sequence
  Description of Artificial Sequence: Synthetic oligonucleotide
  Target: ATXN1; (-) strand; PAM type: YTN; PAM sequence: CTT
cccttttctcccacccttcc

SEQ ID NO: 204982 - DNA, 20 bp, Artificial Sequence
  Description of Artificial Sequence: Synthetic oligonucleotide
  Target: ATXN1; (-) strand; PAM type: YTN; PAM sequence: TTC
agcataaatatgcccttccc

SEQ ID NO: 204983 - DNA, 20 bp, Artificial Sequence
  Description of Artificial Sequence: Synthetic oligonucleotide
  Target: ATXN1; (-) strand; PAM type: YTN; PAM sequence: TTT
cagcataaatatgcccttcc

SEQ ID NO: 204984 - DNA, 20 bp, Artificial Sequence
  Description of Artificial Sequence: Synthetic oligonucleotide
  Target: ATXN1; (-) strand; PAM type: YTN; PAM sequence: CTT
tcagcataaatatgcccttc

SEQ ID NO: 204985 - DNA, 20 bp, Artificial Sequence
  Description of Artificial Sequence: Synthetic oligonucleotide
  Target: ATXN1; (-) strand; PAM type: YTN; PAM sequence: TTA
tctttcagcataaatatgcc

SEQ ID NO: 204986 - DNA, 20 bp, Artificial Sequence
  Description of Artificial Sequence: Synthetic oligonucleotide
  Target: ATXN1; (-) strand; PAM type: YTN; PAM sequence: TTT
atctttcagcataaatatgc

SEQ ID NO: 204987 - DNA, 20 bp, Artificial Sequence
  Description of Artificial Sequence: Synthetic oligonucleotide
  Target: ATXN1; (-) strand; PAM type: YTN; PAM sequence: TTC
cccaaaatttatctttcagc

SEQ ID NO: 204988 - DNA, 20 bp, Artificial Sequence
  Description of Artificial Sequence: Synthetic oligonucleotide
  Target: ATXN1; (-) strand; PAM type: YTN; PAM sequence: CTT
ccccaaaatttatctttcag

SEQ ID NO: 204989 - DNA, 20 bp, Artificial Sequence
  Description of Artificial Sequence: Synthetic oligonucleotide
  Target: ATXN1; (-) strand; PAM type: YTN; PAM sequence: TTA
aaacacagacttccccaaaa

SEQ ID NO: 204990 - DNA, 20 bp, Artificial Sequence
  Description of Artificial Sequence: Synthetic oligonucleotide
  Target: ATXN1; (-) strand; PAM type: YTN; PAM sequence: TTT
aaaacacagacttccccaaa

SEQ ID NO: 204991 - DNA, 20 bp, Artificial Sequence
  Description of Artificial Sequence: Synthetic oligonucleotide
  Target: ATXN1; (-) strand; PAM type: YTN; PAM sequence: TTA
agtatttaaaacacagactt

SEQ ID NO: 204992 - DNA, 20 bp, Artificial Sequence
  Description of Artificial Sequence: Synthetic oligonucleotide
  Target: ATXN1; (-) strand; PAM type: YTN; PAM sequence: CTG
atattaagtatttaaaacac

SEQ ID NO: 204993 - DNA, 20 bp, Artificial Sequence
  Description of Artificial Sequence: Synthetic oligonucleotide
  Target: ATXN1; (-) strand; PAM type: YTN; PAM sequence: CTA
ctgatattaagtatttaaaa

SEQ ID NO: 204994 - DNA, 20 bp, Artificial Sequence
  Description of Artificial Sequence: Synthetic oligonucleotide
  Target: ATXN1; (-) strand; PAM type: YTN; PAM sequence: TTA
agaaaatcctactgatatta

SEQ ID NO: 204995 - DNA, 20 bp, Artificial Sequence
  Description of Artificial Sequence: Synthetic oligonucleotide
  Target: ATXN1; (-) strand; PAM type: YTN; PAM sequence: CTA
aggttaagaaaatcctactg

SEQ ID NO: 204996 - DNA, 20 bp, Artificial Sequence
  Description of Artificial Sequence: Synthetic oligonucleotide
  Target: ATXN1; (-) strand; PAM type: YTN; PAM sequence: TTC
taaggttaagaaaatcctac

SEQ ID NO: 204997 - DNA, 20 bp, Artificial Sequence
  Description of Artificial Sequence: Synthetic oligonucleotide
  Target: ATXN1; (-) strand; PAM type: YTN; PAM sequence: TTT
ctaaggttaagaaaatccta

SEQ ID NO: 204998 - DNA, 20 bp, Artificial Sequence
  Description of Artificial Sequence: Synthetic oligonucleotide
  Target: ATXN1; (-) strand; PAM type: YTN; PAM sequence: TTG
aaatgtacatttctaaggtt

SEQ ID NO: 204999 - DNA, 20 bp, Artificial Sequence
  Description of Artificial Sequence: Synthetic oligonucleotide
  Target: ATXN1; (-) strand; PAM type: YTN; PAM sequence: TTG
aaaatgaaatgaaaaaggtt

SEQ ID NO: 205000 - DNA, 20 bp, Artificial Sequence
  Description of Artificial Sequence: Synthetic oligonucleotide
  Target: ATXN1; (-) strand; PAM type: YTN; PAM sequence: CTA
tatcataaggttgaaaatga

SEQ ID NO: 205001 - DNA, 20 bp, Artificial Sequence
  Description of Artificial Sequence: Synthetic oligonucleotide
  Target: ATXN1; (-) strand; PAM type: YTN; PAM sequence: CTA
catctatatcataaggttga

SEQ ID NO: 205002 - DNA, 20 bp, Artificial Sequence
  Description of Artificial Sequence: Synthetic oligonucleotide
  Target: ATXN1; (-) strand; PAM type: YTN; PAM sequence: TTC
gactacatctatatcataag

SEQ ID NO: 205003 - DNA, 20 bp, Artificial Sequence
  Description of Artificial Sequence: Synthetic oligonucleotide
  Target: ATXN1; (-) strand; PAM type: YTN; PAM sequence: CTT
cgactacatctatatcataa

SEQ ID NO: 205004 - DNA, 20 bp, Artificial Sequence
  Description of Artificial Sequence: Synthetic oligonucleotide
  Target: ATXN1; (-) strand; PAM type: YTN; PAM sequence: CTC
aacccttcgactacatctat

SEQ ID NO: 205005 - DNA, 20 bp, Artificial Sequence
  Description of Artificial Sequence: Synthetic oligonucleotide
  Target: ATXN1; (-) strand; PAM type: YTN; PAM sequence: CTC
tcaacccttcgactacatct

SEQ ID NO: 205006 - DNA, 20 bp, Artificial Sequence
  Description of Artificial Sequence: Synthetic oligonucleotide
  Target: ATXN1; (-) strand; PAM type: YTN; PAM sequence: TTG
tgagtccctctcaacccttc

SEQ ID NO: 205007 - DNA, 20 bp, Artificial Sequence
  Description of Artificial Sequence: Synthetic oligonucleotide
  Target: ATXN1; (-) strand; PAM type: YTN; PAM sequence: CTG
tagggttgtgagtccctctc

SEQ ID NO: 205008 - DNA, 20 bp, Artificial Sequence
  Description of Artificial Sequence: Synthetic oligonucleotide
  Target: ATXN1; (-) strand; PAM type: YTN; PAM sequence: CTA
cagaaacacaaaaagaaaaa

SEQ ID NO: 205009 - DNA, 20 bp, Artificial Sequence
  Description of Artificial Sequence: Synthetic oligonucleotide
  Target: ATXN1; (-) strand; PAM type: YTN; PAM sequence: TTA
tcctacagaaacacaaaaag

SEQ ID NO: 205010 - DNA, 20 bp, Artificial Sequence
  Description of Artificial Sequence: Synthetic oligonucleotide
  Target: ATXN1; (-) strand; PAM type: YTN; PAM sequence: TTT
atcctacagaaacacaaaaa

SEQ ID NO: 205011 - DNA, 20 bp, Artificial Sequence
  Description of Artificial Sequence: Synthetic oligonucleotide
  Target: ATXN1; (-) strand; PAM type: YTN; PAM sequence: CTT
tatcctacagaaacacaaaa

SEQ ID NO: 205012 - DNA, 20 bp, Artificial Sequence
  Description of Artificial Sequence: Synthetic oligonucleotide
  Target: ATXN1; (-) strand; PAM type: YTN; PAM sequence: TTC
ctttatcctacagaaacaca

SEQ ID NO: 205013 - DNA, 20 bp, Artificial Sequence
  Description of Artificial Sequence: Synthetic oligonucleotide
  Target: ATXN1; (-) strand; PAM type: YTN; PAM sequence: TTT
cctttatcctacagaaacac

SEQ ID NO: 205014 - DNA, 20 bp, Artificial Sequence
  Description of Artificial Sequence: Synthetic oligonucleotide
  Target: ATXN1; (-) strand; PAM type: YTN; PAM sequence: TTA
ggaaatgtttcctttatcct

SEQ ID NO: 205015 - DNA, 20 bp, Artificial Sequence
  Description of Artificial Sequence: Synthetic oligonucleotide
  Target: ATXN1; (-) strand; PAM type: YTN; PAM sequence: CTT
aggaaatgtttcctttatcc

SEQ ID NO: 205016 - DNA, 20 bp, Artificial Sequence
  Description of Artificial Sequence: Synthetic oligonucleotide
  Target: ATXN1; (-) strand; PAM type: YTN; PAM sequence: CTC
ttaggaaatgtttcctttat

SEQ ID NO: 205017 - DNA, 20 bp, Artificial Sequence
  Description of Artificial Sequence: Synthetic oligonucleotide
  Target: ATXN1; (-) strand; PAM type: YTN; PAM sequence: CTC
agctcttaggaaatgtttcc

SEQ ID NO: 205018 - DNA, 20 bp, Artificial Sequence
  Description of Artificial Sequence: Synthetic oligonucleotide
  Target: ATXN1; (-) strand; PAM type: YTN; PAM sequence: TTC
aggcaccgtatgtaacccac

SEQ ID NO: 205019 - DNA, 20 bp, Artificial Sequence
  Description of Artificial Sequence: Synthetic oligonucleotide
  Target: ATXN1; (-) strand; PAM type: YTN; PAM sequence: CTT
caggcaccgtatgtaaccca

SEQ ID NO: 205020 - DNA, 20 bp, Artificial Sequence
  Description of Artificial Sequence: Synthetic oligonucleotide
  Target: ATXN1; (-) strand; PAM type: YTN; PAM sequence: TTC
cccttcaggcaccgtatgta

SEQ ID NO: 205021 - DNA, 20 bp, Artificial Sequence
  Description of Artificial Sequence: Synthetic oligonucleotide
  Target: ATXN1; (-) strand; PAM type: YTN; PAM sequence: TTT
ccccttcaggcaccgtatgt

SEQ ID NO: 205022 - DNA, 20 bp, Artificial Sequence
  Description of Artificial Sequence: Synthetic oligonucleotide
  Target: ATXN1; (-) strand; PAM type: YTN; PAM sequence: TTT
tccccttcaggcaccgtatg

SEQ ID NO: 205023 - DNA, 20 bp, Artificial Sequence
  Description of Artificial Sequence: Synthetic oligonucleotide
  Target: ATXN1; (-) strand; PAM type: YTN; PAM sequence: CTT
ttccccttcaggcaccgtat

SEQ ID NO: 205024 - DNA, 20 bp, Artificial Sequence
  Description of Artificial Sequence: Synthetic oligonucleotide
  Target: ATXN1; (-) strand; PAM type: YTN; PAM sequence: CTC
gaacatggggtcttttcccc

SEQ ID NO: 205025 - DNA, 20 bp, Artificial Sequence
  Description of Artificial Sequence: Synthetic oligonucleotide
  Target: ATXN1; (-) strand; PAM type: YTN; PAM sequence: TTC
tcgaacatggggtcttttcc

SEQ ID NO: 205026 - DNA, 20 bp, Artificial Sequence
  Description of Artificial Sequence: Synthetic oligonucleotide
  Target: ATXN1; (-) strand; PAM type: YTN; PAM sequence: CTC
cccatccacacacccaccca

SEQ ID NO: 205027 - DNA, 20 bp, Artificial Sequence
  Description of Artificial Sequence: Synthetic oligonucleotide
  Target: ATXN1; (-) strand; PAM type: YTN; PAM sequence: CTA
ctccccatccacacacccac

SEQ ID NO: 205028 - DNA, 20 bp, Artificial Sequence
  Description of Artificial Sequence: Synthetic oligonucleotide
  Target: ATXN1; (-) strand; PAM type: YTN; PAM sequence: TTG
cccatatcatcccctactcc

SEQ ID NO: 205029 - DNA, 20 bp, Artificial Sequence
  Description of Artificial Sequence: Synthetic oligonucleotide
  Target: ATXN1; (-) strand; PAM type: YTN; PAM sequence: TTG
agttgcccatatcatcccct

SEQ ID NO: 205030 - DNA, 20 bp, Artificial Sequence
  Description of Artificial Sequence: Synthetic oligonucleotide
  Target: ATXN1; (-) strand; PAM type: YTN; PAM sequence: TTA
acatgtccagttgagttgcc

SEQ ID NO: 205031 - DNA, 20 bp, Artificial Sequence
  Description of Artificial Sequence: Synthetic oligonucleotide
  Target: ATXN1; (-) strand; PAM type: YTN; PAM sequence: TTT
aacatgtccagttgagttgc

SEQ ID NO: 205032 - DNA, 20 bp, Artificial Sequence
  Description of Artificial Sequence: Synthetic oligonucleotide
  Target: ATXN1; (-) strand; PAM type: YTN; PAM sequence: CTT
taacatgtccagttgagttg

SEQ ID NO: 205033 - DNA, 20 bp, Artificial Sequence
  Description of Artificial Sequence: Synthetic oligonucleotide
  Target: ATXN1; (-) strand; PAM type: YTN; PAM sequence: TTC
tttaacatgtccagttgagt

SEQ ID NO: 205034 - DNA, 20 bp, Artificial Sequence
  Description of Artificial Sequence: Synthetic oligonucleotide
  Target: ATXN1; (-) strand; PAM type: YTN; PAM sequence: TTT
ctttaacatgtccagttgag

SEQ ID NO: 205035 - DNA, 20 bp, Artificial Sequence
  Description of Artificial Sequence: Synthetic oligonucleotide
  Target: ATXN1; (-) strand; PAM type: YTN; PAM sequence: CTT
tctttaacatgtccagttga

SEQ ID NO: 205036 - DNA, 20 bp, Artificial Sequence
  Description of Artificial Sequence: Synthetic oligonucleotide
  Target: ATXN1; (-) strand; PAM type: YTN; PAM sequence: TTC
tttctttaacatgtccagtt

SEQ ID NO: 205037 - DNA, 20 bp, Artificial Sequence
  Description of Artificial Sequence: Synthetic oligonucleotide
  Target: ATXN1; (-) strand; PAM type: YTN; PAM sequence: CTT
ctttctttaacatgtccagt

SEQ ID NO: 205038 - DNA, 20 bp, Artificial Sequence
  Description of Artificial Sequence: Synthetic oligonucleotide
  Target: ATXN1; (-) strand; PAM type: YTN; PAM sequence: TTC
ttctttctttaacatgtcca

SEQ ID NO: 205039 - DNA, 20 bp, Artificial Sequence
  Description of Artificial Sequence: Synthetic oligonucleotide
  Target: ATXN1; (-) strand; PAM type: YTN; PAM sequence: TTT
cttctttctttaacatgtcc

SEQ ID NO: 205040 - DNA, 20 bp, Artificial Sequence
  Description of Artificial Sequence: Synthetic oligonucleotide
  Target: ATXN1; (-) strand; PAM type: YTN; PAM sequence: TTT
tcttctttctttaacatgtc

SEQ ID NO: 205041 - DNA, 20 bp, Artificial Sequence
  Description of Artificial Sequence: Synthetic oligonucleotide
  Target: ATXN1; (-) strand; PAM type: YTN; PAM sequence: CTA
cccagatgttttcttctttc

SEQ ID NO: 205042 - DNA, 20 bp, Artificial Sequence
  Description of Artificial Sequence: Synthetic oligonucleotide
  Target: ATXN1; (-) strand; PAM type: YTN; PAM sequence: CTC
tacccagatgttttcttctt

SEQ ID NO: 205043 - DNA, 20 bp, Artificial Sequence
  Description of Artificial Sequence: Synthetic oligonucleotide
  Target: ATXN1; (-) strand; PAM type: YTN; PAM sequence: CTC
aaacatccaccacgtactct

SEQ ID NO: 205044 - DNA, 20 bp, Artificial Sequence
  Description of Artificial Sequence: Synthetic oligonucleotide
  Target: ATXN1; (-) strand; PAM type: YTN; PAM sequence: TTC
gggccctcaaacatccacca

SEQ ID NO: 205045 - DNA, 20 bp, Artificial Sequence
  Description of Artificial Sequence: Synthetic oligonucleotide
  Target: ATXN1; (-) strand; PAM type: YTN; PAM sequence: CTT
cgggccctcaaacatccacc

SEQ ID NO: 205046 - DNA, 20 bp, Artificial Sequence
  Description of Artificial Sequence: Synthetic oligonucleotide
  Target: ATXN1; (-) strand; PAM type: YTN; PAM sequence: CTC
ttcgggccctcaaacatcca

SEQ ID NO: 205047 - DNA, 20 bp, Artificial Sequence
  Description of Artificial Sequence: Synthetic oligonucleotide
  Target: ATXN1; (-) strand; PAM type: YTN; PAM sequence: CTC
tcttcgggccctcaaacatc

SEQ ID NO: 205048 - DNA, 20 bp, Artificial Sequence
  Description of Artificial Sequence: Synthetic oligonucleotide
  Target: ATXN1; (-) strand; PAM type: YTN; PAM sequence: CTG
ctctcttcgggccctcaaac

SEQ ID NO: 205049 - DNA, 20 bp, Artificial Sequence
  Description of Artificial Sequence: Synthetic oligonucleotide
  Target: ATXN1; (-) strand; PAM type: YTN; PAM sequence: CTG
gtcagctgctctcttcgggc

SEQ ID NO: 205050 - DNA, 20 bp, Artificial Sequence
  Description of Artificial Sequence: Synthetic oligonucleotide
  Target: ATXN1; (-) strand; PAM type: YTN; PAM sequence: CTC
cctggtcagctgctctcttc

SEQ ID NO: 205051 - DNA, 20 bp, Artificial Sequence
  Description of Artificial Sequence: Synthetic oligonucleotide
  Target: ATXN1; (-) strand; PAM type: YTN; PAM sequence: TTG
tatccctccctggtcagctg

SEQ ID NO: 205052 - DNA, 20 bp, Artificial Sequence
  Description of Artificial Sequence: Synthetic oligonucleotide
  Target: ATXN1; (-) strand; PAM type: YTN; PAM sequence: CTA
ttgtatccctccctggtcag

SEQ ID NO: 205053 - DNA, 20 bp, Artificial Sequence
  Description of Artificial Sequence: Synthetic oligonucleotide
  Target: ATXN1; (-) strand; PAM type: YTN; PAM sequence: CTC
tattgtatccctccctggtc

SEQ ID NO: 205054 - DNA, 20 bp, Artificial Sequence
  Description of Artificial Sequence: Synthetic oligonucleotide
  Target: ATXN1; (-) strand; PAM type: YTN; PAM sequence: TTC
tctattgtatccctccctgg

SEQ ID NO: 205055 - DNA, 20 bp, Artificial Sequence
  Description of Artificial Sequence: Synthetic oligonucleotide
  Target: ATXN1; (-) strand; PAM type: YTN; PAM sequence: TTT
ctctattgtatccctccctg

SEQ ID NO: 205056 - DNA, 20 bp, Artificial Sequence
  Description of Artificial Sequence: Synthetic oligonucleotide
  Target: ATXN1; (-) strand; PAM type: YTN; PAM sequence: TTT
tctctattgtatccctccct

SEQ ID NO: 205057 - DNA, 20 bp, Artificial Sequence
  Description of Artificial Sequence: Synthetic oligonucleotide
  Target: ATXN1; (-) strand; PAM type: YTN; PAM sequence: TTT
ttctctattgtatccctccc

SEQ ID NO: 205058 - DNA, 20 bp, Artificial Sequence
  Description of Artificial Sequence: Synthetic oligonucleotide
  Target: ATXN1; (-) strand; PAM type: YTN; PAM sequence: CTT
tttctctattgtatccctcc

SEQ ID NO: 205059 - DNA, 20 bp, Artificial Sequence
  Description of Artificial Sequence: Synthetic oligonucleotide
  Target: ATXN1; (-) strand; PAM type: YTN; PAM sequence: TTG
acgaacctttttctctattg

SEQ ID NO: 205060 - DNA, 20 bp, Artificial Sequence
  Description of Artificial Sequence: Synthetic oligonucleotide
  Target: ATXN1; (-) strand; PAM type: YTN; PAM sequence: TTT
gacgaacctttttctctatt

SEQ ID NO: 205061 - DNA, 20 bp, Artificial Sequence
  Description of Artificial Sequence: Synthetic oligonucleotide
  Target: ATXN1; (-) strand; PAM type: YTN; PAM sequence: CTT
tgacgaacctttttctctat

SEQ ID NO: 205062 - DNA, 20 bp, Artificial Sequence
  Description of Artificial Sequence: Synthetic oligonucleotide
  Target: ATXN1; (-) strand; PAM type: YTN; PAM sequence: CTG
tctttgacgaacctttttct

SEQ ID NO: 205063 - DNA, 20 bp, Artificial Sequence
  Description of Artificial Sequence: Synthetic oligonucleotide
  Target: ATXN1; (-) strand; PAM type: YTN; PAM sequence: TTA
ctgtctttgacgaacctttt

SEQ ID NO: 205064 - DNA, 20 bp, Artificial Sequence
  Description of Artificial Sequence: Synthetic oligonucleotide
  Target: ATXN1; (-) strand; PAM type: YTN; PAM sequence: TTT
actgtctttgacgaaccttt

SEQ ID NO: 205065 - DNA, 20 bp, Artificial Sequence
  Description of Artificial Sequence: Synthetic oligonucleotide
  Target: ATXN1; (-) strand; PAM type: YTN; PAM sequence: TTC
ggatttactgtctttgacga

SEQ ID NO: 205066 - DNA, 20 bp, Artificial Sequence
  Description of Artificial Sequence: Synthetic oligonucleotide
  Target: ATXN1; (-) strand; PAM type: YTN; PAM sequence: CTT
cggatttactgtctttgacg

SEQ ID NO: 205067 - DNA, 20 bp, Artificial Sequence
  Description of Artificial Sequence: Synthetic oligonucleotide
  Target: ATXN1; (-) strand; PAM type: YTN; PAM sequence: TTA
gcttcggatttactgtcttt

SEQ ID NO: 205068 - DNA, 20 bp, Artificial Sequence
  Description of Artificial Sequence: Synthetic oligonucleotide
  Target: ATXN1; (-) strand; PAM type: YTN; PAM sequence: TTT
agcttcggatttactgtctt

SEQ ID NO: 205069 - DNA, 20 bp, Artificial Sequence
  Description of Artificial Sequence: Synthetic oligonucleotide
  Target: ATXN1; (-) strand; PAM type: YTN; PAM sequence: TTT
tagcttcggatttactgtct

SEQ ID NO: 205070 - DNA, 20 bp, Artificial Sequence
  Description of Artificial Sequence: Synthetic oligonucleotide
  Target: ATXN1; (-) strand; PAM type: YTN; PAM sequence: TTT
ttagcttcggatttactgtc

SEQ ID NO: 205071 - DNA, 20 bp, Artificial Sequence
  Description of Artificial Sequence: Synthetic oligonucleotide
  Target: ATXN1; (-) strand; PAM type: YTN; PAM sequence: CTG
catttttagcttcggattta

SEQ ID NO: 205072 - DNA, 20 bp, Artificial Sequence
  Description of Artificial Sequence: Synthetic oligonucleotide
  Target: ATXN1; (-) strand; PAM type: YTN; PAM sequence: TTG
gtaaaggctgcatttttagc

SEQ ID NO: 205073 - DNA, 20 bp, Artificial Sequence
  Description of Artificial Sequence: Synthetic oligonucleotide
  Target: ATXN1; (-) strand; PAM type: YTN; PAM sequence: TTT
ggtaaaggctgcatttttag

SEQ ID NO: 205074 - DNA, 20 bp, Artificial Sequence
  Description of Artificial Sequence: Synthetic oligonucleotide
  Target: ATXN1; (-) strand; PAM type: YTN; PAM sequence: CTG
catttggtaaaggctgcatt

SEQ ID NO: 205075 - DNA, 20 bp, Artificial Sequence
  Description of Artificial Sequence: Synthetic oligonucleotide
  Target: ATXN1; (-) strand; PAM type: YTN; PAM sequence: TTG
acctgcatttggtaaaggct

SEQ ID NO: 205076 - DNA, 20 bp, Artificial Sequence
  Description of Artificial Sequence: Synthetic oligonucleotide
  Target: ATXN1; (-) strand; PAM type: YTN; PAM sequence: CTT
gacctgcatttggtaaaggc

SEQ ID NO: 205077 - DNA, 20 bp, Artificial Sequence
  Description of Artificial Sequence: Synthetic oligonucleotide
  Target: ATXN1; (-) strand; PAM type: YTN; PAM sequence: TTA
ggccttgacctgcatttggt

SEQ ID NO: 205078 - DNA, 20 bp, Artificial Sequence
  Description of Artificial Sequence: Synthetic oligonucleotide
  Target: ATXN1; (-) strand; PAM type: YTN; PAM sequence: CTT
aggccttgacctgcatttgg

SEQ ID NO: 205079 - DNA, 20 bp, Artificial Sequence
  Description of Artificial Sequence: Synthetic oligonucleotide
  Target: ATXN1; (-) strand; PAM type: YTN; PAM sequence: CTC
cttaggccttgacctgcatt

SEQ ID NO: 205080 - DNA, 20 bp, Artificial Sequence
  Description of Artificial Sequence: Synthetic oligonucleotide
  Target: ATXN1; (-) strand; PAM type: YTN; PAM sequence: TTA
tctccttaggccttgacctg

SEQ ID NO: 205081 - DNA, 20 bp, Artificial Sequence
  Description of Artificial Sequence: Synthetic oligonucleotide
  Target: ATXN1; (-) strand; PAM type: YTN; PAM sequence: TTT
atctccttaggccttgacct

SEQ ID NO: 205082 - DNA, 20 bp, Artificial Sequence
  Description of Artificial Sequence: Synthetic oligonucleotide
  Target: ATXN1; (-) strand; PAM type: YTN; PAM sequence: TTT
tatctccttaggccttgacc

SEQ ID NO: 205083 - DNA, 20 bp, Artificial Sequence
  Description of Artificial Sequence: Synthetic oligonucleotide
  Target: ATXN1; (-) strand; PAM type: YTN; PAM sequence: CTT
ttatctccttaggccttgac

SEQ ID NO: 205084 - DNA, 20 bp, Artificial Sequence
  Description of Artificial Sequence: Synthetic oligonucleotide
  Target: ATXN1; (-) strand; PAM type: YTN; PAM sequence: TTC
ttttatctccttaggccttg

SEQ ID NO: 205085 - DNA, 20 bp, Artificial Sequence
  Description of Artificial Sequence: Synthetic oligonucleotide
  Target: ATXN1; (-) strand; PAM type: YTN; PAM sequence: TTT
cttttatctccttaggcctt

SEQ ID NO: 205086 - DNA, 20 bp, Artificial Sequence
  Description of Artificial Sequence: Synthetic oligonucleotide
  Target: ATXN1; (-) strand; PAM type: YTN; PAM sequence: CTC
agagatttcttttatctcct

SEQ ID NO: 205087 - DNA, 20 bp, Artificial Sequence
  Description of Artificial Sequence: Synthetic oligonucleotide
  Target: ATXN1; (-) strand; PAM type: YTN; PAM sequence: CTG
ctcagagatttcttttatct

SEQ ID NO: 205088 - DNA, 20 bp, Artificial Sequence
  Description of Artificial Sequence: Synthetic oligonucleotide
  Target: ATXN1; (-) strand; PAM type: YTN; PAM sequence: CTC
tgctcagagatttcttttat

SEQ ID NO: 205089 - DNA, 20 bp, Artificial Sequence
  Description of Artificial Sequence: Synthetic oligonucleotide
  Target: ATXN1; (-) strand; PAM type: YTN; PAM sequence: TTA
aataacaggctctgctcaga

SEQ ID NO: 205090 - DNA, 20 bp, Artificial Sequence
  Description of Artificial Sequence: Synthetic oligonucleotide
  Target: ATXN1; (-) strand; PAM type: YTN; PAM sequence: CTT
aaataacaggctctgctcag

SEQ ID NO: 205091 - DNA, 20 bp, Artificial Sequence
  Description of Artificial Sequence: Synthetic oligonucleotide
  Target: ATXN1; (-) strand; PAM type: YTN; PAM sequence: CTC
ttaaataacaggctctgctc

SEQ ID NO: 205092 - DNA, 20 bp, Artificial Sequence
  Description of Artificial Sequence: Synthetic oligonucleotide
  Target: ATXN1; (-) strand; PAM type: YTN; PAM sequence: TTA
gtggtctcttaaataacagg

SEQ ID NO: 205093 - DNA, 20 bp, Artificial Sequence
  Description of Artificial Sequence: Synthetic oligonucleotide
  Target: ATXN1; (-) strand; PAM type: YTN; PAM sequence: TTT
agtggtctcttaaataacag

SEQ ID NO: 205094 - DNA, 20 bp, Artificial Sequence
  Description of Artificial Sequence: Synthetic oligonucleotide
  Target: ATXN1; (-) strand; PAM type: YTN; PAM sequence: TTT
tagtggtctcttaaataaca

SEQ ID NO: 205095 - DNA, 20 bp, Artificial Sequence
  Description of Artificial Sequence: Synthetic oligonucleotide
  Target: ATXN1; (-) strand; PAM type: YTN; PAM sequence: CTT
ttagtggtctcttaaataac

SEQ ID NO: 205096 - DNA, 20 bp, Artificial Sequence
  Description of Artificial Sequence: Synthetic oligonucleotide
  Target: ATXN1; (-) strand; PAM type: YTN; PAM sequence: CTG
ggtgcttttagtggtctctt

SEQ ID NO: 205097 - DNA, 20 bp, Artificial Sequence
  Description of Artificial Sequence: Synthetic oligonucleotide
  Target: ATXN1; (-) strand; PAM type: YTN; PAM sequence: TTC
ctgggtgcttttagtggtct

SEQ ID NO: 205098 - DNA, 20 bp, Artificial Sequence
  Description of Artificial Sequence: Synthetic oligonucleotide
  Target: ATXN1; (-) strand; PAM type: YTN; PAM sequence: CTC
cattcctgggtgcttttagt

SEQ ID NO: 205099 - DNA, 20 bp, Artificial Sequence
  Description of Artificial Sequence: Synthetic oligonucleotide
  Target: ATXN1; (-) strand; PAM type: YTN; PAM sequence: CTC
cctccattcctgggtgcttt

SEQ ID NO: 205100 - DNA, 20 bp, Artificial Sequence
  Description of Artificial Sequence: Synthetic oligonucleotide
  Target: ATXN1; (-) strand; PAM type: YTN; PAM sequence: TTC
ctccctccattcctgggtgc

SEQ ID NO: 205101 - DNA, 20 bp, Artificial Sequence
  Description of Artificial Sequence: Synthetic oligonucleotide
  Target: ATXN1; (-) strand; PAM type: YTN; PAM sequence: CTT
cctccctccattcctgggtg

SEQ ID NO: 205102 - DNA, 20 bp, Artificial Sequence
  Description of Artificial Sequence: Synthetic oligonucleotide
  Target: ATXN1; (-) strand; PAM type: YTN; PAM sequence: TTA
ccttcctccctccattcctg

SEQ ID NO: 205103 - DNA, 20 bp, Artificial Sequence
  Description of Artificial Sequence: Synthetic oligonucleotide
  Target: ATXN1; (-) strand; PAM type: YTN; PAM sequence: CTT
accttcctccctccattcct

SEQ ID NO: 205104 - DNA, 20 bp, Artificial Sequence
  Description of Artificial Sequence: Synthetic oligonucleotide
  Target: ATXN1; (-) strand; PAM type: YTN; PAM sequence: TTC
ttaccttcctccctccattc

SEQ ID NO: 205105 - DNA, 20 bp, Artificial Sequence
  Description of Artificial Sequence: Synthetic oligonucleotide
  Target: ATXN1; (-) strand; PAM type: YTN; PAM sequence: CTT
cttaccttcctccctccatt

SEQ ID NO: 205106 - DNA, 20 bp, Artificial Sequence
  Description of Artificial Sequence: Synthetic oligonucleotide
  Target: ATXN1; (-) strand; PAM type: YTN; PAM sequence: TTC
ttcttaccttcctccctcca

SEQ ID NO: 205107 - DNA, 20 bp, Artificial Sequence
  Description of Artificial Sequence: Synthetic oligonucleotide
  Target: ATXN1; (-) strand; PAM type: YTN; PAM sequence: TTG
tggttcttcttaccttcctc

SEQ ID NO: 205108 - DNA, 20 bp, Artificial Sequence
  Description of Artificial Sequence: Synthetic oligonucleotide
  Target: ATXN1; (-) strand; PAM type: YTN; PAM sequence: TTG
tgggattgtggttcttctta

SEQ ID NO: 205109 - DNA, 20 bp, Artificial Sequence
  Description of Artificial Sequence: Synthetic oligonucleotide
  Target: ATXN1; (-) strand; PAM type: YTN; PAM sequence: TTT
gtgggattgtggttcttctt

SEQ ID NO: 205110 - DNA, 20 bp, Artificial Sequence
  Description of Artificial Sequence: Synthetic oligonucleotide
  Target: ATXN1; (-) strand; PAM type: YTN; PAM sequence: TTG
tttgtgggattgtggttctt

SEQ ID NO: 205111 - DNA, 20 bp, Artificial Sequence
  Description of Artificial Sequence: Synthetic oligonucleotide
  Target: ATXN1; (-) strand; PAM type: YTN; PAM sequence: CTC
agcattgtttgtgggattgt

SEQ ID NO: 205112 - DNA, 20 bp, Artificial Sequence
  Description of Artificial Sequence: Synthetic oligonucleotide
  Target: ATXN1; (-) strand; PAM type: YTN; PAM sequence: TTC
cactcagcattgtttgtggg

SEQ ID NO: 205113 - DNA, 20 bp, Artificial Sequence
  Description of Artificial Sequence: Synthetic oligonucleotide
  Target: ATXN1; (-) strand; PAM type: YTN; PAM sequence: CTT
ccactcagcattgtttgtgg

SEQ ID NO: 205114 - DNA, 20 bp, Artificial Sequence
  Description of Artificial Sequence: Synthetic oligonucleotide
  Target: ATXN1; (-) strand; PAM type: YTN; PAM sequence: TTG
gtacccttccactcagcatt

SEQ ID NO: 205115 - DNA, 20 bp, Artificial Sequence
  Description of Artificial Sequence: Synthetic oligonucleotide
  Target: ATXN1; (-) strand; PAM type: YTN; PAM sequence: TTT
ggtacccttccactcagcat

SEQ ID NO: 205116 - DNA, 20 bp, Artificial Sequence
  Description of Artificial Sequence: Synthetic oligonucleotide
  Target: ATXN1; (-) strand; PAM type: YTN; PAM sequence: CTA
tttggtacccttccactcag

SEQ ID NO: 205117 - DNA, 20 bp, Artificial Sequence
  Description of Artificial Sequence: Synthetic oligonucleotide
  Target: ATXN1; (-) strand; PAM type: YTN; PAM sequence: TTA
ctatttggtacccttccact

SEQ ID NO: 205118 - DNA, 20 bp, Artificial Sequence
  Description of Artificial Sequence: Synthetic oligonucleotide
  Target: ATXN1; (-) strand; PAM type: YTN; PAM sequence: TTT
actatttggtacccttccac

SEQ ID NO: 205119 - DNA, 20 bp, Artificial Sequence
  Description of Artificial Sequence: Synthetic oligonucleotide
  Target: ATXN1; (-) strand; PAM type: YTN; PAM sequence: CTT
tactatttggtacccttcca

SEQ ID NO: 205120 - DNA, 20 bp, Artificial Sequence
  Description of Artificial Sequence: Synthetic oligonucleotide
  Target: ATXN1; (-) strand; PAM type: YTN; PAM sequence: CTC
tttactatttggtacccttc

SEQ ID NO: 205121 - DNA, 20 bp, Artificial Sequence
  Description of Artificial Sequence: Synthetic oligonucleotide
  Target: ATXN1; (-) strand; PAM type: YTN; PAM sequence: TTG
acctctttactatttggtac

SEQ ID NO: 205122 - DNA, 20 bp, Artificial Sequence
  Description of Artificial Sequence: Synthetic oligonucleotide
  Target: ATXN1; (-) strand; PAM type: YTN; PAM sequence: CTT
gacctctttactatttggta

SEQ ID NO: 205123 - DNA, 20 bp, Artificial Sequence
  Description of Artificial Sequence: Synthetic oligonucleotide
  Target: ATXN1; (-) strand; PAM type: YTN; PAM sequence: TTG
tcacatcttgacctctttac

SEQ ID NO: 205124 - DNA, 20 bp, Artificial Sequence
  Description of Artificial Sequence: Synthetic oligonucleotide
  Target: ATXN1; (-) strand; PAM type: YTN; PAM sequence: TTT
gtcacatcttgacctcttta

SEQ ID NO: 205125 - DNA, 20 bp, Artificial Sequence
  Description of Artificial Sequence: Synthetic oligonucleotide
  Target: ATXN1; (-) strand; PAM type: YTN; PAM sequence: CTC
catttgtcacatcttgacct

SEQ ID NO: 205126 - DNA, 20 bp, Artificial Sequence
  Description of Artificial Sequence: Synthetic oligonucleotide
  Target: ATXN1; (-) strand; PAM type: YTN; PAM sequence: CTA
aataatagcccctccatttg

SEQ ID NO: 205127 - DNA, 20 bp, Artificial Sequence
  Description of Artificial Sequence: Synthetic oligonucleotide
  Target: ATXN1; (-) strand; PAM type: YTN; PAM sequence: TTC
cagatctaaataatagcccc

SEQ ID NO: 205128 - DNA, 20 bp, Artificial Sequence
  Description of Artificial Sequence: Synthetic oligonucleotide
  Target: ATXN1; (-) strand; PAM type: YTN; PAM sequence: TTA
ggttccagatctaaataata

SEQ ID NO: 205129 - DNA, 20 bp, Artificial Sequence
  Description of Artificial Sequence: Synthetic oligonucleotide
  Target: ATXN1; (-) strand; PAM type: YTN; PAM sequence: TTT
aggttccagatctaaataat

SEQ ID NO: 205130 - DNA, 20 bp, Artificial Sequence
  Description of Artificial Sequence: Synthetic oligonucleotide
  Target: ATXN1; (-) strand; PAM type: YTN; PAM sequence: TTT
taggttccagatctaaataa

SEQ ID NO: 205131 - DNA, 20 bp, Artificial Sequence
  Description of Artificial Sequence: Synthetic oligonucleotide
  Target: ATXN1; (-) strand; PAM type: YTN; PAM sequence: TTA
aacagattttaggttccaga

SEQ ID NO: 205132 - DNA, 20 bp, Artificial Sequence
  Description of Artificial Sequence: Synthetic oligonucleotide
  Target: ATXN1; (-) strand; PAM type: YTN; PAM sequence: TTT
aaacagattttaggttccag

SEQ ID NO: 205133 - DNA, 20 bp, Artificial Sequence
  Description of Artificial Sequence: Synthetic oligonucleotide
  Target: ATXN1; (-) strand; PAM type: YTN; PAM sequence: CTT
taaacagattttaggttcca

SEQ ID NO: 205134 - DNA, 20 bp, Artificial Sequence
  Description of Artificial Sequence: Synthetic oligonucleotide
  Target: ATXN1; (-) strand; PAM type: YTN; PAM sequence: TTC
actttaaacagattttaggt

SEQ ID NO: 205135 - DNA, 20 bp, Artificial Sequence
  Description of Artificial Sequence: Synthetic oligonucleotide
  Target: ATXN1; (-) strand; PAM type: YTN; PAM sequence: TTA
gttcactttaaacagatttt

SEQ ID NO: 205136 - DNA, 20 bp, Artificial Sequence
  Description of Artificial Sequence: Synthetic oligonucleotide
  Target: ATXN1; (-) strand; PAM type: YTN; PAM sequence: TTT
agttcactttaaacagattt

SEQ ID NO: 205137 - DNA, 20 bp, Artificial Sequence
  Description of Artificial Sequence: Synthetic oligonucleotide
  Target: ATXN1; (-) strand; PAM type: YTN; PAM sequence: TTA
tttagttcactttaaacaga

SEQ ID NO: 205138 - DNA, 20 bp, Artificial Sequence
  Description of Artificial Sequence: Synthetic oligonucleotide
  Target: ATXN1; (-) strand; PAM type: YTN; PAM sequence: TTT
atttagttcactttaaacag

SEQ ID NO: 205139 - DNA, 20 bp, Artificial Sequence
  Description of Artificial Sequence: Synthetic oligonucleotide
  Target: ATXN1; (-) strand; PAM type: YTN; PAM sequence: CTT
tatttagttcactttaaaca

SEQ ID NO: 205140 - DNA, 20 bp, Artificial Sequence
  Description of Artificial Sequence: Synthetic oligonucleotide
  Target: ATXN1; (-) strand; PAM type: YTN; PAM sequence: TTA
actttatttagttcacttta

SEQ ID NO: 205141 - DNA, 20 bp, Artificial Sequence
  Description of Artificial Sequence: Synthetic oligonucleotide
  Target: ATXN1; (-) strand; PAM type: YTN; PAM sequence: TTG
tgcacatgcataattaactt

SEQ ID NO: 205142 - DNA, 20 bp, Artificial Sequence
  Description of Artificial Sequence: Synthetic oligonucleotide
  Target: ATXN1; (-) strand; PAM type: YTN; PAM sequence: TTT
gtgcacatgcataattaact

SEQ ID NO: 205143 - DNA, 20 bp, Artificial Sequence
  Description of Artificial Sequence: Synthetic oligonucleotide
  Target: ATXN1; (-) strand; PAM type: YTN; PAM sequence: TTT
tgtgcacatgcataattaac

SEQ ID NO: 205144 - DNA, 20 bp, Artificial Sequence
  Description of Artificial Sequence: Synthetic oligonucleotide
  Target: ATXN1; (-) strand; PAM type: YTN; PAM sequence: CTT
ttgtgcacatgcataattaa

SEQ ID NO: 205145 - DNA, 20 bp, Artificial Sequence
  Description of Artificial Sequence: Synthetic oligonucleotide
  Target: ATXN1; (-) strand; PAM type: YTN; PAM sequence: CTA
ccttttgtgcacatgcataa

SEQ ID NO: 205146 - DNA, 20 bp, Artificial Sequence
  Description of Artificial Sequence: Synthetic oligonucleotide
  Target: ATXN1; (-) strand; PAM type: YTN; PAM sequence: TTA
atcctaccttttgtgcacat

SEQ ID NO: 205147 - DNA, 20 bp, Artificial Sequence
  Description of Artificial Sequence: Synthetic oligonucleotide
  Target: ATXN1; (-) strand; PAM type: YTN; PAM sequence: TTA
tataattaatcctacctttt

SEQ ID NO: 205148 - DNA, 20 bp, Artificial Sequence
  Description of Artificial Sequence: Synthetic oligonucleotide
  Target: ATXN1; (-) strand; PAM type: YTN; PAM sequence: TTA
attatataattaatcctacc

SEQ ID NO: 205149 - DNA, 20 bp, Artificial Sequence
  Description of Artificial Sequence: Synthetic oligonucleotide
  Target: ATXN1; (-) strand; PAM type: YTN; PAM sequence: CTC
agagagtgagattaattata

SEQ ID NO: 205150 - DNA, 20 bp, Artificial Sequence
  Description of Artificial Sequence: Synthetic oligonucleotide
  Target: ATXN1; (-) strand; PAM type: YTN; PAM sequence: TTC
acctcagagagtgagattaa

SEQ ID NO: 205151 - DNA, 20 bp, Artificial Sequence
  Description of Artificial Sequence: Synthetic oligonucleotide
  Target: ATXN1; (-) strand; PAM type: YTN; PAM sequence: CTA
taattcacctcagagagtga

SEQ ID NO: 205152 - DNA, 20 bp, Artificial Sequence
  Description of Artificial Sequence: Synthetic oligonucleotide
  Target: ATXN1; (-) strand; PAM type: YTN; PAM sequence: TTA
cccactataattcacctcag

SEQ ID NO: 205153 - DNA, 20 bp, Artificial Sequence
  Description of Artificial Sequence: Synthetic oligonucleotide
  Target: ATXN1; (-) strand; PAM type: YTN; PAM sequence: TTT
acccactataattcacctca

SEQ ID NO: 205154 - DNA, 20 bp, Artificial Sequence
  Description of Artificial Sequence: Synthetic oligonucleotide
  Target: ATXN1; (-) strand; PAM type: YTN; PAM sequence: CTT
tacccactataattcacctc

SEQ ID NO: 205155 - DNA, 20 bp, Artificial Sequence
  Description of Artificial Sequence: Synthetic oligonucleotide
  Target: ATXN1; (-) strand; PAM type: YTN; PAM sequence: TTA
ctttacccactataattcac

SEQ ID NO: 205156 - DNA, 20 bp, Artificial Sequence
  Description of Artificial Sequence: Synthetic oligonucleotide
  Target: ATXN1; (-) strand; PAM type: YTN; PAM sequence: CTT
actttacccactataattca

SEQ ID NO: 205157 - DNA, 20 bp, Artificial Sequence
  Description of Artificial Sequence: Synthetic oligonucleotide
  Target: ATXN1; (-) strand; PAM type: YTN; PAM sequence: TTC
ttactttacccactataatt

SEQ ID NO: 205158 - DNA, 20 bp, Artificial Sequence
  Description of Artificial Sequence: Synthetic oligonucleotide
  Target: ATXN1; (-) strand; PAM type: YTN; PAM sequence: TTT
cttactttacccactataat

SEQ ID NO: 205159 - DNA, 20 bp, Artificial Sequence
  Description of Artificial Sequence: Synthetic oligonucleotide
  Target: ATXN1; (-) strand; PAM type: YTN; PAM sequence: TTT
tcttactttacccactataa

SEQ ID NO: 205160 - DNA, 20 bp, Artificial Sequence
  Description of Artificial Sequence: Synthetic oligonucleotide
  Target: ATXN1; (-) strand; PAM type: YTN; PAM sequence: TTT
ttcttactttacccactata

SEQ ID NO: 205161 - DNA, 20 bp, Artificial Sequence
  Description of Artificial Sequence: Synthetic oligonucleotide
  Target: ATXN1; (-) strand; PAM type: YTN; PAM sequence: CTT
tttcttactttacccactat

SEQ ID NO: 205162 - DNA, 20 bp, Artificial Sequence
  Description of Artificial Sequence: Synthetic oligonucleotide
  Target: ATXN1; (-) strand; PAM type: YTN; PAM sequence: TTA
accatatcctttttcttact

SEQ ID NO: 205163 - DNA, 20 bp, Artificial Sequence
  Description of Artificial Sequence: Synthetic oligonucleotide
  Target: ATXN1; (-) strand; PAM type: YTN; PAM sequence: TTA
ttaaccatatcctttttctt

SEQ ID NO: 205164 - DNA, 20 bp, Artificial Sequence
  Description of Artificial Sequence: Synthetic oligonucleotide
  Target: ATXN1; (-) strand; PAM type: YTN; PAM sequence: CTT
attaaccatatcctttttct

SEQ ID NO: 205165 - DNA, 20 bp, Artificial Sequence
  Description of Artificial Sequence: Synthetic oligonucleotide
  Target: ATXN1; (-) strand; PAM type: YTN; PAM sequence: CTC
ttattaaccatatccttttt

SEQ ID NO: 205166 - DNA, 20 bp, Artificial Sequence
  Description of Artificial Sequence: Synthetic oligonucleotide
  Target: ATXN1; (-) strand; PAM type: YTN; PAM sequence: TTC
tcttattaaccatatccttt

SEQ ID NO: 205167 - DNA, 20 bp, Artificial Sequence
  Description of Artificial Sequence: Synthetic oligonucleotide
  Target: ATXN1; (-) strand; PAM type: YTN; PAM sequence: TTG
ttctcttattaaccatatcc

SEQ ID NO: 205168 - DNA, 20 bp, Artificial Sequence
  Description of Artificial Sequence: Synthetic oligonucleotide
  Target: ATXN1; (-) strand; PAM type: YTN; PAM sequence: CTT
gttctcttattaaccatatc

SEQ ID NO: 205169 - DNA, 20 bp, Artificial Sequence
  Description of Artificial Sequence: Synthetic oligonucleotide
  Target: ATXN1; (-) strand; PAM type: YTN; PAM sequence: TTA
accacccaaaggaagaatcg

SEQ ID NO: 205170 - DNA, 20 bp, Artificial Sequence
  Description of Artificial Sequence: Synthetic oligonucleotide
  Target: ATXN1; (-) strand; PAM type: YTN; PAM sequence: CTT
aaccacccaaaggaagaatc

SEQ ID NO: 205171 - DNA, 20 bp, Artificial Sequence
  Description of Artificial Sequence: Synthetic oligonucleotide
  Target: ATXN1; (-) strand; PAM type: YTN; PAM sequence: TTC
ttaaccacccaaaggaagaa

SEQ ID NO: 205172 - DNA, 20 bp, Artificial Sequence
  Description of Artificial Sequence: Synthetic oligonucleotide
  Target: ATXN1; (-) strand; PAM type: YTN; PAM sequence: TTT
cttaaccacccaaaggaaga

SEQ ID NO: 205173 - DNA, 20 bp, Artificial Sequence
  Description of Artificial Sequence: Synthetic oligonucleotide
  Target: ATXN1; (-) strand; PAM type: YTN; PAM sequence: TTT
tcttaaccacccaaaggaag

SEQ ID NO: 205174 - DNA, 20 bp, Artificial Sequence
  Description of Artificial Sequence: Synthetic oligonucleotide
  Target: ATXN1; (-) strand; PAM type: YTN; PAM sequence: TTT
ttcttaaccacccaaaggaa

SEQ ID NO: 205175 - DNA, 20 bp, Artificial Sequence
  Description of Artificial Sequence: Synthetic oligonucleotide
  Target: ATXN1; (-) strand; PAM type: YTN; PAM sequence: TTA
tcacagtatggtgatttttc

SEQ ID NO: 205176 - DNA, 20 bp, Artificial Sequence
  Description of Artificial Sequence: Synthetic oligonucleotide
  Target: ATXN1; (-) strand; PAM type: YTN; PAM sequence: TTT
atcacagtatggtgattttt

SEQ ID NO: 205177 - DNA, 20 bp, Artificial Sequence
  Description of Artificial Sequence: Synthetic oligonucleotide
  Target: ATXN1; (-) strand; PAM type: YTN; PAM sequence: CTT
tatcacagtatggtgatttt

SEQ ID NO: 205178 - DNA, 20 bp, Artificial Sequence
  Description of Artificial Sequence: Synthetic oligonucleotide
  Target: ATXN1; (-) strand; PAM type: YTN; PAM sequence: TTA
gaaagatggatgtcaccgtg

SEQ ID NO: 205179 - DNA, 20 bp, Artificial Sequence
  Description of Artificial Sequence: Synthetic oligonucleotide
  Target: ATXN1; (-) strand; PAM type: YTN; PAM sequence: CTA
caaacatgttagaaagatgg

SEQ ID NO: 205180 - DNA, 20 bp, Artificial Sequence
  Description of Artificial Sequence: Synthetic oligonucleotide
  Target: ATXN1; (-) strand; PAM type: YTN; PAM sequence: CTC
tacaaacatgttagaaagat

SEQ ID NO: 205181 - DNA, 20 bp, Artificial Sequence
  Description of Artificial Sequence: Synthetic oligonucleotide
  Target: ATXN1; (-) strand; PAM type: YTN; PAM sequence: TTA
taactctacaaacatgttag

SEQ ID NO: 205182 - DNA, 20 bp, Artificial Sequence
  Description of Artificial Sequence: Synthetic oligonucleotide
  Target: ATXN1; (-) strand; PAM type: YTN; PAM sequence: TTT
ataactctacaaacatgtta

SEQ ID NO: 205183 - DNA, 20 bp, Artificial Sequence
  Description of Artificial Sequence: Synthetic oligonucleotide
  Target: ATXN1; (-) strand; PAM type: YTN; PAM sequence: TTT
tataactctacaaacatgtt

SEQ ID NO: 205184 - DNA, 20 bp, Artificial Sequence
  Description of Artificial Sequence: Synthetic oligonucleotide
  Target: ATXN1; (-) strand; PAM type: YTN; PAM sequence: TTT
ttataactctacaaacatgt

SEQ ID NO: 205185 - DNA, 20 bp, Artificial Sequence
  Description of Artificial Sequence: Synthetic oligonucleotide
  Target: ATXN1; (-) strand; PAM type: YTN; PAM sequence: CTT
tttataactctacaaacatg

SEQ ID NO: 205186 - DNA, 20 bp, Artificial Sequence
  Description of Artificial Sequence: Synthetic oligonucleotide
  Target: ATXN1; (-) strand; PAM type: YTN; PAM sequence: TTA
ctttttataactctacaaac

SEQ ID NO: 205187 - DNA, 20 bp, Artificial Sequence
  Description of Artificial Sequence: Synthetic oligonucleotide
  Target: ATXN1; (-) strand; PAM type: YTN; PAM sequence: TTT
actttttataactctacaaa

SEQ ID NO: 205188 - DNA, 20 bp, Artificial Sequence
  Description of Artificial Sequence: Synthetic oligonucleotide
  Target: ATXN1; (-) strand; PAM type: YTN; PAM sequence: TTT
tactttttataactctacaa

SEQ ID NO: 205189 - DNA, 20 bp, Artificial Sequence
  Description of Artificial Sequence: Synthetic oligonucleotide
  Target: ATXN1; (-) strand; PAM type: YTN; PAM sequence: CTT
ttactttttataactctaca

SEQ ID NO: 205190 - DNA, 20 bp, Artificial Sequence
  Description of Artificial Sequence: Synthetic oligonucleotide
  Target: ATXN1; (-) strand; PAM type: YTN; PAM sequence: TTG
tgaaatgagtcttttacttt

SEQ ID NO: 205191 - DNA, 20 bp, Artificial Sequence
  Description of Artificial Sequence: Synthetic oligonucleotide
  Target: ATXN1; (-) strand; PAM type: YTN; PAM sequence: TTA
agaaattgtgaaatgagtct

SEQ ID NO: 205192 - DNA, 20 bp, Artificial Sequence
  Description of Artificial Sequence: Synthetic oligonucleotide
  Target: ATXN1; (-) strand; PAM type: YTN; PAM sequence: CTT
aagaaattgtgaaatgagtc

SEQ ID NO: 205193 - DNA, 20 bp, Artificial Sequence
  Description of Artificial Sequence: Synthetic oligonucleotide
  Target: ATXN1; (-) strand; PAM type: YTN; PAM sequence: TTG
acaatccatatccttaagaa

SEQ ID NO: 205194 - DNA, 20 bp, Artificial Sequence
  Description of Artificial Sequence: Synthetic oligonucleotide
  Target: ATXN1; (-) strand; PAM type: YTN; PAM sequence: TTA
ttgacaatccatatccttaa

SEQ ID NO: 205195 - DNA, 20 bp, Artificial Sequence
  Description of Artificial Sequence: Synthetic oligonucleotide
  Target: ATXN1; (-) strand; PAM type: YTN; PAM sequence: CTT
attgacaatccatatcctta

SEQ ID NO: 205196 - DNA, 20 bp, Artificial Sequence
  Description of Artificial Sequence: Synthetic oligonucleotide
  Target: ATXN1; (-) strand; PAM type: YTN; PAM sequence: TTA
ggtaatgtaaatgatgcatc

SEQ ID NO: 205197 - DNA, 20 bp, Artificial Sequence
  Description of Artificial Sequence: Synthetic oligonucleotide
  Target: ATXN1; (-) strand; PAM type: YTN; PAM sequence: TTT
aggtaatgtaaatgatgcat

SEQ ID NO: 205198 - DNA, 20 bp, Artificial Sequence
  Description of Artificial Sequence: Synthetic oligonucleotide
  Target: ATXN1; (-) strand; PAM type: YTN; PAM sequence: CTC
aatttaggtaatgtaaatga

SEQ ID NO: 205199 - DNA, 20 bp, Artificial Sequence
  Description of Artificial Sequence: Synthetic oligonucleotide
  Target: ATXN1; (-) strand; PAM type: YTN; PAM sequence: CTC
tcaatttaggtaatgtaaat

SEQ ID NO: 205200 - DNA, 20 bp, Artificial Sequence
  Description of Artificial Sequence: Synthetic oligonucleotide
  Target: ATXN1; (-) strand; PAM type: YTN; PAM sequence: CTC
atctctcaatttaggtaatg

SEQ ID NO: 205201 - DNA, 20 bp, Artificial Sequence
  Description of Artificial Sequence: Synthetic oligonucleotide
  Target: ATXN1; (-) strand; PAM type: YTN; PAM sequence: CTA
ctcatctctcaatttaggta

SEQ ID NO: 205202 - DNA, 20 bp, Artificial Sequence
  Description of Artificial Sequence: Synthetic oligonucleotide
  Target: ATXN1; (-) strand; PAM type: YTN; PAM sequence: CTA
gggccagtaaagatcatcgg

SEQ ID NO: 205203 - DNA, 20 bp, Artificial Sequence
  Description of Artificial Sequence: Synthetic oligonucleotide
  Target: ATXN1; (-) strand; PAM type: YTN; PAM sequence: TTG
ctagggccagtaaagatcat

SEQ ID NO: 205204 - DNA, 20 bp, Artificial Sequence
  Description of Artificial Sequence: Synthetic oligonucleotide
  Target: ATXN1; (-) strand; PAM type: YTN; PAM sequence: CTC
gaatgcacagttgctagggc

SEQ ID NO: 205205 - DNA, 20 bp, Artificial Sequence
  Description of Artificial Sequence: Synthetic oligonucleotide
  Target: ATXN1; (-) strand; PAM type: YTN; PAM sequence: CTA
acacccctcgaatgcacagt

SEQ ID NO: 205206 - DNA, 20 bp, Artificial Sequence
  Description of Artificial Sequence: Synthetic oligonucleotide
  Target: ATXN1; (-) strand; PAM type: YTN; PAM sequence: CTG
tctaacacccctcgaatgca

SEQ ID NO: 205207 - DNA, 20 bp, Artificial Sequence
  Description of Artificial Sequence: Synthetic oligonucleotide
  Target: ATXN1; (-) strand; PAM type: YTN; PAM sequence: TTG
acagccggaccaggccagga

SEQ ID NO: 205208 - DNA, 20 bp, Artificial Sequence
  Description of Artificial Sequence: Synthetic oligonucleotide
  Target: ATXN1; (-) strand; PAM type: YTN; PAM sequence: TTG
ttgacagccggaccaggcca

SEQ ID NO: 205209 - DNA, 20 bp, Artificial Sequence
  Description of Artificial Sequence: Synthetic oligonucleotide
  Target: ATXN1; (-) strand; PAM type: YTN; PAM sequence: TTG
tgattgttgacagccggacc

SEQ ID NO: 205210 - DNA, 20 bp, Artificial Sequence
  Description of Artificial Sequence: Synthetic oligonucleotide
  Target: ATXN1; (-) strand; PAM type: YTN; PAM sequence: CTG
acaatgaggttgtgattgtt

SEQ ID NO: 205211 - DNA, 20 bp, Artificial Sequence
  Description of Artificial Sequence: Synthetic oligonucleotide
  Target: ATXN1; (-) strand; PAM type: YTN; PAM sequence: CTG
gaaggcatagaacagaaaga

SEQ ID NO: 205212 - DNA, 20 bp, Artificial Sequence
  Description of Artificial Sequence: Synthetic oligonucleotide
  Target: ATXN1; (-) strand; PAM type: YTN; PAM sequence: TTG
atctggaaggcatagaacag

SEQ ID NO: 205213 - DNA, 20 bp, Artificial Sequence
  Description of Artificial Sequence: Synthetic oligonucleotide
  Target: ATXN1; (-) strand; PAM type: YTN; PAM sequence: CTG
ttgatctggaaggcatagaa

SEQ ID NO: 205214 - DNA, 20 bp, Artificial Sequence
  Description of Artificial Sequence: Synthetic oligonucleotide
  Target: ATXN1; (-) strand; PAM type: YTN; PAM sequence: CTG
gagaaaccaggggagacaga

SEQ ID NO: 205215 - DNA, 20 bp, Artificial Sequence
  Description of Artificial Sequence: Synthetic oligonucleotide
  Target: ATXN1; (-) strand; PAM type: YTN; PAM sequence: TTG
gaaactggagaaaccagggg

SEQ ID NO: 205216 - DNA, 20 bp, Artificial Sequence
  Description of Artificial Sequence: Synthetic oligonucleotide
  Target: ATXN1; (-) strand; PAM type: YTN; PAM sequence: CTG
aaattggaaactggagaaac

SEQ ID NO: 205217 - DNA, 20 bp, Artificial Sequence
  Description of Artificial Sequence: Synthetic oligonucleotide
  Target: ATXN1; (-) strand; PAM type: YTN; PAM sequence: CTA
aaaggaggcaagaggtgcat

SEQ ID NO: 205218 - DNA, 20 bp, Artificial Sequence
  Description of Artificial Sequence: Synthetic oligonucleotide
  Target: ATXN1; (-) strand; PAM type: YTN; PAM sequence: TTC
taaaaggaggcaagaggtgc

SEQ ID NO: 205219 - DNA, 20 bp, Artificial Sequence
  Description of Artificial Sequence: Synthetic oligonucleotide
  Target: ATXN1; (-) strand; PAM type: YTN; PAM sequence: CTG
gaccattctaaaaggaggca

SEQ ID NO: 205220 - DNA, 20 bp, Artificial Sequence
  Description of Artificial Sequence: Synthetic oligonucleotide
  Target: ATXN1; (-) strand; PAM type: YTN; PAM sequence: TTG
ggggaacaggggagatgaac

SEQ ID NO: 205221 - DNA, 20 bp, Artificial Sequence
  Description of Artificial Sequence: Synthetic oligonucleotide
  Target: ATXN1; (-) strand; PAM type: YTN; PAM sequence: TTT
gggggaacaggggagatgaa

SEQ ID NO: 205222 - DNA, 20 bp, Artificial Sequence
  Description of Artificial Sequence: Synthetic oligonucleotide
  Target: ATXN1; (-) strand; PAM type: YTN; PAM sequence: CTG
gtttgggggaacaggggaga

SEQ ID NO: 205223 - DNA, 20 bp, Artificial Sequence
  Description of Artificial Sequence: Synthetic oligonucleotide
  Target: ATXN1; (-) strand; PAM type: YTN; PAM sequence: CTC
agggagatacagtcaacacc

SEQ ID NO: 205224 - DNA, 20 bp, Artificial Sequence
  Description of Artificial Sequence: Synthetic oligonucleotide
  Target: ATXN1; (-) strand; PAM type: YTN; PAM sequence: TTC
tcagggagatacagtcaaca

SEQ ID NO: 205225 - DNA, 20 bp, Artificial Sequence
  Description of Artificial Sequence: Synthetic oligonucleotide
  Target: ATXN1; (-) strand; PAM type: YTN; PAM sequence: TTA
cagttctcagggagatacag

SEQ ID NO: 205226 - DNA, 20 bp, Artificial Sequence
  Description of Artificial Sequence: Synthetic oligonucleotide
  Target: ATXN1; (-) strand; PAM type: YTN; PAM sequence: TTT
acagttctcagggagataca

SEQ ID NO: 205227 - DNA, 20 bp, Artificial Sequence
  Description of Artificial Sequence: Synthetic oligonucleotide
  Target: ATXN1; (-) strand; PAM type: YTN; PAM sequence: CTA
atggagtttacagttctcag

SEQ ID NO: 205228 - DNA, 20 bp, Artificial Sequence
  Description of Artificial Sequence: Synthetic oligonucleotide
  Target: ATXN1; (-) strand; PAM type: YTN; PAM sequence: CTG
gccctaatggagtttacagt

SEQ ID NO: 205229 - DNA, 20 bp, Artificial Sequence
  Description of Artificial Sequence: Synthetic oligonucleotide
  Target: ATXN1; (-) strand; PAM type: YTN; PAM sequence: TTG
acaaaagactggccctaatg

SEQ ID NO: 205230 - DNA, 20 bp, Artificial Sequence
  Description of Artificial Sequence: Synthetic oligonucleotide
  Target: ATXN1; (-) strand; PAM type: YTN; PAM sequence: TTG
aagataatggaggaaaacaa

SEQ ID NO: 205231 - DNA, 20 bp, Artificial Sequence
  Description of Artificial Sequence: Synthetic oligonucleotide
  Target: ATXN1; (-) strand; PAM type: YTN; PAM sequence: CTG
ggcattgaagataatggagg

SEQ ID NO: 205232 - DNA, 20 bp, Artificial Sequence
  Description of Artificial Sequence: Synthetic oligonucleotide
  Target: ATXN1; (-) strand; PAM type: YTN; PAM sequence: CTA
tgtcccagtatagggctggg

SEQ ID NO: 205233 - DNA, 20 bp, Artificial Sequence
  Description of Artificial Sequence: Synthetic oligonucleotide
  Target: ATXN1; (-) strand; PAM type: YTN; PAM sequence: TTA
ggggcagctatgtcccagta

SEQ ID NO: 205234 - DNA, 20 bp, Artificial Sequence
  Description of Artificial Sequence: Synthetic oligonucleotide
  Target: ATXN1; (-) strand; PAM type: YTN; PAM sequence: TTT
aggggcagctatgtcccagt

SEQ ID NO: 205235 - DNA, 20 bp, Artificial Sequence
  Description of Artificial Sequence: Synthetic oligonucleotide
  Target: ATXN1; (-) strand; PAM type: YTN; PAM sequence: TTT
taggggcagctatgtcccag

SEQ ID NO: 205236 - DNA, 20 bp, Artificial Sequence
  Description of Artificial Sequence: Synthetic oligonucleotide
  Target: ATXN1; (-) strand; PAM type: YTN; PAM sequence: TTT
ttaggggcagctatgtccca

SEQ ID NO: 205237 - DNA, 20 bp, Artificial Sequence
  Description of Artificial Sequence: Synthetic oligonucleotide
  Target: ATXN1; (-) strand; PAM type: YTN; PAM sequence: CTT
tttaggggcagctatgtccc

SEQ ID NO: 205238 - DNA, 20 bp, Artificial Sequence
  Description of Artificial Sequence: Synthetic oligonucleotide
  Target: ATXN1; (-) strand; PAM type: YTN; PAM sequence: TTA
gcaaaggcctttttaggggc

SEQ ID NO: 205239 - DNA, 20 bp, Artificial Sequence
  Description of Artificial Sequence: Synthetic oligonucleotide
  Target: ATXN1; (-) strand; PAM type: YTN; PAM sequence: TTT
agcaaaggcctttttagggg

SEQ ID NO: 205240 - DNA, 20 bp, Artificial Sequence
  Description of Artificial Sequence: Synthetic oligonucleotide
  Target: ATXN1; (-) strand; PAM type: YTN; PAM sequence: TTA
atttagcaaaggccttttta

SEQ ID NO: 205241 - DNA, 20 bp, Artificial Sequence
  Description of Artificial Sequence: Synthetic oligonucleotide
  Target: ATXN1; (-) strand; PAM type: YTN; PAM sequence: TTA
ttaatttagcaaaggccttt

SEQ ID NO: 205242 - DNA, 20 bp, Artificial Sequence
  Description of Artificial Sequence: Synthetic oligonucleotide
  Target: ATXN1; (-) strand; PAM type: YTN; PAM sequence: TTT
attaatttagcaaaggcctt

SEQ ID NO: 205243 - DNA, 20 bp, Artificial Sequence
  Description of Artificial Sequence: Synthetic oligonucleotide
  Target: ATXN1; (-) strand; PAM type: YTN; PAM sequence: CTC
atttattaatttagcaaagg

SEQ ID NO: 205244 - DNA, 20 bp, Artificial Sequence
  Description of Artificial Sequence: Synthetic oligonucleotide
  Target: ATXN1; (-) strand; PAM type: YTN; PAM sequence: CTC
actcatttattaatttagca

SEQ ID NO: 205245 - DNA, 20 bp, Artificial Sequence
  Description of Artificial Sequence: Synthetic oligonucleotide
  Target: ATXN1; (-) strand; PAM type: YTN; PAM sequence: TTC
ctcactcatttattaattta

SEQ ID NO: 205246 - DNA, 20 bp, Artificial Sequence
  Description of Artificial Sequence: Synthetic oligonucleotide
  Target: ATXN1; (-) strand; PAM type: YTN; PAM sequence: TTC
agtcattcctcactcattta

SEQ ID NO: 205247 - DNA, 20 bp, Artificial Sequence
  Description of Artificial Sequence: Synthetic oligonucleotide
  Target: ATXN1; (-) strand; PAM type: YTN; PAM sequence: TTA
atcccattcagtcattcctc

SEQ ID NO: 205248 - DNA, 20 bp, Artificial Sequence
  Description of Artificial Sequence: Synthetic oligonucleotide
  Target: ATXN1; (-) strand; PAM type: YTN; PAM sequence: TTT
aatcccattcagtcattcct

SEQ ID NO: 205249 - DNA, 20 bp, Artificial Sequence
  Description of Artificial Sequence: Synthetic oligonucleotide
  Target: ATXN1; (-) strand; PAM type: YTN; PAM sequence: TTT
taatcccattcagtcattcc

SEQ ID NO: 205250 - DNA, 20 bp, Artificial Sequence
  Description of Artificial Sequence: Synthetic oligonucleotide
  Target: ATXN1; (-) strand; PAM type: YTN; PAM sequence: TTA
attttaatcccattcagtca

SEQ ID NO: 205251 - DNA, 20 bp, Artificial Sequence
  Description of Artificial Sequence: Synthetic oligonucleotide
  Target: ATXN1; (-) strand; PAM type: YTN; PAM sequence: TTT
aattttaatcccattcagtc

SEQ ID NO: 205252 - DNA, 20 bp, Artificial Sequence
  Description of Artificial Sequence: Synthetic oligonucleotide
  Target: ATXN1; (-) strand; PAM type: YTN; PAM sequence: CTT
taattttaatcccattcagt

SEQ ID NO: 205253 - DNA, 20 bp, Artificial Sequence
  Description of Artificial Sequence: Synthetic oligonucleotide
  Target: ATXN1; (-) strand; PAM type: YTN; PAM sequence: CTG
agacaaggtctttaatttta

SEQ ID NO: 205254 - DNA, 20 bp, Artificial Sequence
  Description of Artificial Sequence: Synthetic oligonucleotide
  Target: ATXN1; (-) strand; PAM type: YTN; PAM sequence: TTG
tgagaaactgagacaaggtc

SEQ ID NO: 205255 - DNA, 20 bp, Artificial Sequence
  Description of Artificial Sequence: Synthetic oligonucleotide
  Target: ATXN1; (-) strand; PAM type: YTN; PAM sequence: TTG
aattgtgagaaactgagaca

SEQ ID NO: 205256 - DNA, 20 bp, Artificial Sequence
  Description of Artificial Sequence: Synthetic oligonucleotide
  Target: ATXN1; (-) strand; PAM type: YTN; PAM sequence: TTT
gaattgtgagaaactgagac

SEQ ID NO: 205257 - DNA, 20 bp, Artificial Sequence
  Description of Artificial Sequence: Synthetic oligonucleotide
  Target: ATXN1; (-) strand; PAM type: YTN; PAM sequence: TTT
tgaattgtgagaaactgaga

SEQ ID NO: 205258 - DNA, 20 bp, Artificial Sequence
  Description of Artificial Sequence: Synthetic oligonucleotide
  Target: ATXN1; (-) strand; PAM type: YTN; PAM sequence: CTT
ttgaattgtgagaaactgag

SEQ ID NO: 205259 - DNA, 20 bp, Artificial Sequence
  Description of Artificial Sequence: Synthetic oligonucleotide
  Target: ATXN1; (-) strand; PAM type: YTN; PAM sequence: TTA
aagcacaacttttgaattgt

SEQ ID NO: 205260 - DNA, 20 bp, Artificial Sequence
  Description of Artificial Sequence: Synthetic oligonucleotide
  Target: ATXN1; (-) strand; PAM type: YTN; PAM sequence: TTG
ccagcacaaagttaaagcac

SEQ ID NO: 205261 - DNA, 20 bp, Artificial Sequence
  Description of Artificial Sequence: Synthetic oligonucleotide
  Target: ATXN1; (-) strand; PAM type: YTN; PAM sequence: TTT
gccagcacaaagttaaagca

SEQ ID NO: 205262 - DNA, 20 bp, Artificial Sequence
  Description of Artificial Sequence: Synthetic oligonucleotide
  Target: ATXN1; (-) strand; PAM type: YTN; PAM sequence: TTT
tgccagcacaaagttaaagc

SEQ ID NO: 205263 - DNA, 20 bp, Artificial Sequence
  Description of Artificial Sequence: Synthetic oligonucleotide
  Target: ATXN1; (-) strand; PAM type: YTN; PAM sequence: TTA
ggattttgccagcacaaagt

SEQ ID NO: 205264 - DNA, 20 bp, Artificial Sequence
  Description of Artificial Sequence: Synthetic oligonucleotide
  Target: ATXN1; (-) strand; PAM type: YTN; PAM sequence: CTT
aggattttgccagcacaaag

SEQ ID NO: 205265 - DNA, 20 bp, Artificial Sequence
  Description of Artificial Sequence: Synthetic oligonucleotide
  Target: ATXN1; (-) strand; PAM type: YTN; PAM sequence: TTG
gggtgtcttaggattttgcc

SEQ ID NO: 205266 - DNA, 20 bp, Artificial Sequence
  Description of Artificial Sequence: Synthetic oligonucleotide
  Target: ATXN1; (-) strand; PAM type: YTN; PAM sequence: TTT
ggggtgtcttaggattttgc

SEQ ID NO: 205267 - DNA, 20 bp, Artificial Sequence
  Description of Artificial Sequence: Synthetic oligonucleotide
  Target: ATXN1; (-) strand; PAM type: YTN; PAM sequence: CTT
tggggtgtcttaggattttg

SEQ ID NO: 205268 - DNA, 20 bp, Artificial Sequence
  Description of Artificial Sequence: Synthetic oligonucleotide
  Target: ATXN1; (-) strand; PAM type: YTN; PAM sequence: TTC
gcaaagtcccatggggactt

SEQ ID NO: 205269 - DNA, 20 bp, Artificial Sequence
  Description of Artificial Sequence: Synthetic oligonucleotide
  Target: ATXN1; (-) strand; PAM type: YTN; PAM sequence: TTA
gttcgcaaagtcccatgggg

SEQ ID NO: 205270 - DNA, 20 bp, Artificial Sequence
  Description of Artificial Sequence: Synthetic oligonucleotide
  Target: ATXN1; (-) strand; PAM type: YTN; PAM sequence: CTT
agttcgcaaagtcccatggg

SEQ ID NO: 205271 - DNA, 20 bp, Artificial Sequence
  Description of Artificial Sequence: Synthetic oligonucleotide
  Target: ATXN1; (-) strand; PAM type: YTN; PAM sequence: TTG
aaatcttagttcgcaaagtc

SEQ ID NO: 205272 - DNA, 20 bp, Artificial Sequence
  Description of Artificial Sequence: Synthetic oligonucleotide
  Target: ATXN1; (-) strand; PAM type: YTN; PAM sequence: TTG
ttgaaatcttagttcgcaaa

SEQ ID NO: 205273 - DNA, 20 bp, Artificial Sequence
  Description of Artificial Sequence: Synthetic oligonucleotide
  Target: ATXN1; (-) strand; PAM type: YTN; PAM sequence: CTG
caagaccaggcagaatcatt

SEQ ID NO: 205274 - DNA, 20 bp, Artificial Sequence
  Description of Artificial Sequence: Synthetic oligonucleotide
  Target: ATXN1; (-) strand; PAM type: YTN; PAM sequence: CTA
tctgcaagaccaggcagaat

SEQ ID NO: 205275 - DNA, 20 bp, Artificial Sequence
  Description of Artificial Sequence: Synthetic oligonucleotide
  Target: ATXN1; (-) strand; PAM type: YTN; PAM sequence: TTC
atgtacaagacctatctgca

SEQ ID NO: 205276 - DNA, 20 bp, Artificial Sequence
  Description of Artificial Sequence: Synthetic oligonucleotide
  Target: ATXN1; (-) strand; PAM type: YTN; PAM sequence: TTG
cattcatgtacaagacctat

SEQ ID NO: 205277 - DNA, 20 bp, Artificial Sequence
  Description of Artificial Sequence: Synthetic oligonucleotide
  Target: ATXN1; (-) strand; PAM type: YTN; PAM sequence: TTT
gcattcatgtacaagaccta

SEQ ID NO: 205278 - DNA, 20 bp, Artificial Sequence
  Description of Artificial Sequence: Synthetic oligonucleotide
  Target: ATXN1; (-) strand; PAM type: YTN; PAM sequence: TTT
tgcattcatgtacaagacct

SEQ ID NO: 205279 - DNA, 20 bp, Artificial Sequence
  Description of Artificial Sequence: Synthetic oligonucleotide
  Target: ATXN1; (-) strand; PAM type: YTN; PAM sequence: TTT
ttgcattcatgtacaagacc

SEQ ID NO: 205280 - DNA, 20 bp, Artificial Sequence
  Description of Artificial Sequence: Synthetic oligonucleotide
  Target: ATXN1; (-) strand; PAM type: YTN; PAM sequence: TTG
cccacaccatttttgcattc

SEQ ID NO: 205281 - DNA, 20 bp, Artificial Sequence
  Description of Artificial Sequence: Synthetic oligonucleotide
  Target: ATXN1; (-) strand; PAM type: YTN; PAM sequence: CTG
cacatggttgcccacaccat

SEQ ID NO: 205282 - DNA, 20 bp, Artificial Sequence
  Description of Artificial Sequence: Synthetic oligonucleotide
  Target: ATXN1; (-) strand; PAM type: YTN; PAM sequence: TTC
catatactgcacatggttgc

SEQ ID NO: 205283 - DNA, 20 bp, Artificial Sequence
  Description of Artificial Sequence: Synthetic oligonucleotide
  Target: ATXN1; (-) strand; PAM type: YTN; PAM sequence: TTT
ccatatactgcacatggttg

SEQ ID NO: 205284 - DNA, 20 bp, Artificial Sequence
  Description of Artificial Sequence: Synthetic oligonucleotide
  Target: ATXN1; (-) strand; PAM type: YTN; PAM sequence: TTG
tttccatatactgcacatgg

SEQ ID NO: 205285 - DNA, 20 bp, Artificial Sequence
  Description of Artificial Sequence: Synthetic oligonucleotide
  Target: ATXN1; (-) strand; PAM type: YTN; PAM sequence: TTG
gttgtttccatatactgcac

SEQ ID NO: 205286 - DNA, 20 bp, Artificial Sequence
  Description of Artificial Sequence: Synthetic oligonucleotide
  Target: ATXN1; (-) strand; PAM type: YTN; PAM sequence: TTT
ggttgtttccatatactgca

SEQ ID NO: 205287 - DNA, 20 bp, Artificial Sequence
  Description of Artificial Sequence: Synthetic oligonucleotide
  Target: ATXN1; (-) strand; PAM type: YTN; PAM sequence: TTT
tggttgtttccatatactgc

SEQ ID NO: 205288 - DNA, 20 bp, Artificial Sequence
  Description of Artificial Sequence: Synthetic oligonucleotide
  Target: ATXN1; (-) strand; PAM type: YTN; PAM sequence: TTT
ttggttgtttccatatactg

SEQ ID NO: 205289 - DNA, 20 bp, Artificial Sequence
  Description of Artificial Sequence: Synthetic oligonucleotide
  Target: ATXN1; (-) strand; PAM type: YTN; PAM sequence: CTG
tggtcagcagtttttggttg

SEQ ID NO: 205290 - DNA, 20 bp, Artificial Sequence
  Description of Artificial Sequence: Synthetic oligonucleotide
  Target: ATXN1; (-) strand; PAM type: YTN; PAM sequence: CTC
agatctgtggtcagcagttt

SEQ ID NO: 205291 - DNA, 20 bp, Artificial Sequence
  Description of Artificial Sequence: Synthetic oligonucleotide
  Target: ATXN1; (-) strand; PAM type: YTN; PAM sequence: CTG
tgacctcagatctgtggtca

SEQ ID NO: 205292 - DNA, 20 bp, Artificial Sequence
  Description of Artificial Sequence: Synthetic oligonucleotide
  Target: ATXN1; (-) strand; PAM type: YTN; PAM sequence: TTG
tgctgtgacctcagatctgt

SEQ ID NO: 205293 - DNA, 20 bp, Artificial Sequence
  Description of Artificial Sequence: Synthetic oligonucleotide
  Target: ATXN1; (-) strand; PAM type: YTN; PAM sequence: TTA
attgtgctgtgacctcagat

SEQ ID NO: 205294 - DNA, 20 bp, Artificial Sequence
  Description of Artificial Sequence: Synthetic oligonucleotide
  Target: ATXN1; (-) strand; PAM type: YTN; PAM sequence: TTA
accatattaattgtgctgtg

SEQ ID NO: 205295 - DNA, 20 bp, Artificial Sequence
  Description of Artificial Sequence: Synthetic oligonucleotide
  Target: ATXN1; (-) strand; PAM type: YTN; PAM sequence: CTT
aaccatattaattgtgctgt

SEQ ID NO: 205296 - DNA, 20 bp, Artificial Sequence
  Description of Artificial Sequence: Synthetic oligonucleotide
  Target: ATXN1; (-) strand; PAM type: YTN; PAM sequence: CTA
gggagacaggagagtgggaa

SEQ ID NO: 205297 - DNA, 20 bp, Artificial Sequence
  Description of Artificial Sequence: Synthetic oligonucleotide
  Target: ATXN1; (-) strand; PAM type: YTN; PAM sequence: CTC
tagggagacaggagagtggg

SEQ ID NO: 205298 - DNA, 20 bp, Artificial Sequence
  Description of Artificial Sequence: Synthetic oligonucleotide
  Target: ATXN1; (-) strand; PAM type: YTN; PAM sequence: TTC
tctagggagacaggagagtg

SEQ ID NO: 205299 - DNA, 20 bp, Artificial Sequence
  Description of Artificial Sequence: Synthetic oligonucleotide
  Target: ATXN1; (-) strand; PAM type: YTN; PAM sequence: TTT
ctctagggagacaggagagt

SEQ ID NO: 205300 - DNA, 20 bp, Artificial Sequence
  Description of Artificial Sequence: Synthetic oligonucleotide
  Target: ATXN1; (-) strand; PAM type: YTN; PAM sequence: TTA
ccagaataaatttctctagg

SEQ ID NO: 205301 - DNA, 20 bp, Artificial Sequence
  Description of Artificial Sequence: Synthetic oligonucleotide
  Target: ATXN1; (-) strand; PAM type: YTN; PAM sequence: CTT
accagaataaatttctctag

SEQ ID NO: 205302 - DNA, 20 bp, Artificial Sequence
  Description of Artificial Sequence: Synthetic oligonucleotide
  Target: ATXN1; (-) strand; PAM type: YTN; PAM sequence: TTG
tcaagggcttaccagaataa

SEQ ID NO: 205303 - DNA, 20 bp, Artificial Sequence
  Description of Artificial Sequence: Synthetic oligonucleotide
  Target: ATXN1; (-) strand; PAM type: YTN; PAM sequence: TTG
gttgtcaagggcttaccaga

SEQ ID NO: 205304 - DNA, 20 bp, Artificial Sequence
  Description of Artificial Sequence: Synthetic oligonucleotide
  Target: ATXN1; (-) strand; PAM type: YTN; PAM sequence: CTG
gtgtgcagaaatgcagacgt

SEQ ID NO: 205305 - DNA, 20 bp, Artificial Sequence
  Description of Artificial Sequence: Synthetic oligonucleotide
  Target: ATXN1; (-) strand; PAM type: YTN; PAM sequence: CTG
gctggtgtgcagaaatgcag

SEQ ID NO: 205306 - DNA, 20 bp, Artificial Sequence
  Description of Artificial Sequence: Synthetic oligonucleotide
  Target: ATXN1; (-) strand; PAM type: YTN; PAM sequence: CTG
tggatcactggctggtgtgc

SEQ ID NO: 205307 - DNA, 20 bp, Artificial Sequence
  Description of Artificial Sequence: Synthetic oligonucleotide
  Target: ATXN1; (-) strand; PAM type: YTN; PAM sequence: TTG
ctgtggatcactggctggtg

SEQ ID NO: 205308 - DNA, 20 bp, Artificial Sequence
  Description of Artificial Sequence: Synthetic oligonucleotide
  Target: ATXN1; (-) strand; PAM type: YTN; PAM sequence: CTT
gctgtggatcactggctggt

SEQ ID NO: 205309 - DNA, 20 bp, Artificial Sequence
  Description of Artificial Sequence: Synthetic oligonucleotide
  Target: ATXN1; (-) strand; PAM type: YTN; PAM sequence: CTC
ttgctgtggatcactggctg

SEQ ID NO: 205310 - DNA, 20 bp, Artificial Sequence
  Description of Artificial Sequence: Synthetic oligonucleotide
  Target: ATXN1; (-) strand; PAM type: YTN; PAM sequence: TTC
tcttgctgtggatcactggc

SEQ ID NO: 205311 - DNA, 20 bp, Artificial Sequence
  Description of Artificial Sequence: Synthetic oligonucleotide
  Target: ATXN1; (-) strand; PAM type: YTN; PAM sequence: CTC
agagaggaagaaaggattct

SEQ ID NO: 205312 - DNA, 20 bp, Artificial Sequence
  Description of Artificial Sequence: Synthetic oligonucleotide
  Target: ATXN1; (-) strand; PAM type: YTN; PAM sequence: CTA
caaaatcaataaagactcag

SEQ ID NO: 205313 - DNA, 20 bp, Artificial Sequence
  Description of Artificial Sequence: Synthetic oligonucleotide
  Target: ATXN1; (-) strand; PAM type: YTN; PAM sequence: CTC
ccaaactacaaaatcaataa

SEQ ID NO: 205314 - DNA, 20 bp, Artificial Sequence
  Description of Artificial Sequence: Synthetic oligonucleotide
  Target: ATXN1; (-) strand; PAM type: YTN; PAM sequence: TTC
ctcccaaactacaaaatcaa

SEQ ID NO: 205315 - DNA, 20 bp, Artificial Sequence
  Description of Artificial Sequence: Synthetic oligonucleotide
  Target: ATXN1; (-) strand; PAM type: YTN; PAM sequence: CTT
cctcccaaactacaaaatca

SEQ ID NO: 205316 - DNA, 20 bp, Artificial Sequence
  Description of Artificial Sequence: Synthetic oligonucleotide
  Target: ATXN1; (-) strand; PAM type: YTN; PAM sequence: TTA
gcttcctcccaaactacaaa

SEQ ID NO: 205317 - DNA, 20 bp, Artificial Sequence
  Description of Artificial Sequence: Synthetic oligonucleotide
  Target: ATXN1; (-) strand; PAM type: YTN; PAM sequence: CTT
agcttcctcccaaactacaa

SEQ ID NO: 205318 - DNA, 20 bp, Artificial Sequence
  Description of Artificial Sequence: Synthetic oligonucleotide
  Target: ATXN1; (-) strand; PAM type: YTN; PAM sequence: TTG
aatagcacttagcttcctcc

SEQ ID NO: 205319 - DNA, 20 bp, Artificial Sequence
  Description of Artificial Sequence: Synthetic oligonucleotide
  Target: ATXN1; (-) strand; PAM type: YTN; PAM sequence: TTT
gaatagcacttagcttcctc

SEQ ID NO: 205320 - DNA, 20 bp, Artificial Sequence
  Description of Artificial Sequence: Synthetic oligonucleotide
  Target: ATXN1; (-) strand; PAM type: YTN; PAM sequence: TTG
gtatttgaatagcacttagc

SEQ ID NO: 205321 - DNA, 20 bp, Artificial Sequence
  Description of Artificial Sequence: Synthetic oligonucleotide
  Target: ATXN1; (-) strand; PAM type: YTN; PAM sequence: TTT
ggtatttgaatagcacttag

SEQ ID NO: 205322 - DNA, 20 bp, Artificial Sequence
  Description of Artificial Sequence: Synthetic oligonucleotide
  Target: ATXN1; (-) strand; PAM type: YTN; PAM sequence: CTA
ccatatggaacatttggtat

SEQ ID NO: 205323 - DNA, 20 bp, Artificial Sequence
  Description of Artificial Sequence: Synthetic oligonucleotide
  Target: ATXN1; (-) strand; PAM type: YTN; PAM sequence: CTC
aagtaacggtagtgggaatg

SEQ ID NO: 205324 - DNA, 20 bp, Artificial Sequence
  Description of Artificial Sequence: Synthetic oligonucleotide
  Target: ATXN1; (-) strand; PAM type: YTN; PAM sequence: CTC
atgagtgtaggtagaaggcc

SEQ ID NO: 205325 - DNA, 20 bp, Artificial Sequence
  Description of Artificial Sequence: Synthetic oligonucleotide
  Target: ATXN1; (-) strand; PAM type: YTN; PAM sequence: CTG
atgaggcacctcatgagtgt

SEQ ID NO: 205326 - DNA, 20 bp, Artificial Sequence
  Description of Artificial Sequence: Synthetic oligonucleotide
  Target: ATXN1; (-) strand; PAM type: YTN; PAM sequence: TTC
tgatgaggcacctcatgagt

SEQ ID NO: 205327 - DNA, 20 bp, Artificial Sequence
  Description of Artificial Sequence: Synthetic oligonucleotide
  Target: ATXN1; (-) strand; PAM type: YTN; PAM sequence: CTG
ccagattctgatgaggcacc

SEQ ID NO: 205328 - DNA, 20 bp, Artificial Sequence
  Description of Artificial Sequence: Synthetic oligonucleotide
  Target: ATXN1; (-) strand; PAM type: YTN; PAM sequence: TTC
tgccagattctgatgaggca

SEQ ID NO: 205329 - DNA, 20 bp, Artificial Sequence
  Description of Artificial Sequence: Synthetic oligonucleotide
  Target: ATXN1; (-) strand; PAM type: YTN; PAM sequence: TTC
ataatgttctgccagattct

SEQ ID NO: 205330 - DNA, 20 bp, Artificial Sequence
  Description of Artificial Sequence: Synthetic oligonucleotide
  Target: ATXN1; (-) strand; PAM type: YTN; PAM sequence: TTA
gcaaatataggtcaggaaaa

SEQ ID NO: 205331 - DNA, 20 bp, Artificial Sequence
  Description of Artificial Sequence: Synthetic oligonucleotide
  Target: ATXN1; (-) strand; PAM type: YTN; PAM sequence: TTC
atagagggagagaggacaac

SEQ ID NO: 205332 - DNA, 20 bp, Artificial Sequence
  Description of Artificial Sequence: Synthetic oligonucleotide
  Target: ATXN1; (-) strand; PAM type: YTN; PAM sequence: TTA
ataagttcatagagggagag

SEQ ID NO: 205333 - DNA, 20 bp, Artificial Sequence
  Description of Artificial Sequence: Synthetic oligonucleotide
  Target: ATXN1; (-) strand; PAM type: YTN; PAM sequence: TTC
aacaaaattaataagttcat

SEQ ID NO: 205334 - DNA, 20 bp, Artificial Sequence
  Description of Artificial Sequence: Synthetic oligonucleotide
  Target: ATXN1; (-) strand; PAM type: YTN; PAM sequence: TTT
caacaaaattaataagttca

SEQ ID NO: 205335 - DNA, 20 bp, Artificial Sequence
  Description of Artificial Sequence: Synthetic oligonucleotide
  Target: ATXN1; (-) strand; PAM type: YTN; PAM sequence: TTA
tttcaacaaaattaataagt

SEQ ID NO: 205336 - DNA, 20 bp, Artificial Sequence
  Description of Artificial Sequence: Synthetic oligonucleotide
  Target: ATXN1; (-) strand; PAM type: YTN; PAM sequence: TTA
tacacacatgtatattattt

SEQ ID NO: 205337 - DNA, 20 bp, Artificial Sequence
  Description of Artificial Sequence: Synthetic oligonucleotide
  Target: ATXN1; (-) strand; PAM type: YTN; PAM sequence: TTT
atacacacatgtatattatt

SEQ ID NO: 205338 - DNA, 20 bp, Artificial Sequence
  Description of Artificial Sequence: Synthetic oligonucleotide
  Target: ATXN1; (-) strand; PAM type: YTN; PAM sequence: TTG
gatttatacacacatgtata

SEQ ID NO: 205339 - DNA, 20 bp, Artificial Sequence
  Description of Artificial Sequence: Synthetic oligonucleotide
  Target: ATXN1; (-) strand; PAM type: YTN; PAM sequence: CTT
ggatttatacacacatgtat

SEQ ID NO: 205340 - DNA, 20 bp, Artificial Sequence
  Description of Artificial Sequence: Synthetic oligonucleotide
  Target: ATXN1; (-) strand; PAM type: YTN; PAM sequence: CTA
tgaggatgaataagaaaaca

SEQ ID NO: 205341 - DNA, 20 bp, Artificial Sequence
  Description of Artificial Sequence: Synthetic oligonucleotide
  Target: ATXN1; (-) strand; PAM type: YTN; PAM sequence: CTG
tgactatgaggatgaataag

SEQ ID NO: 205342 - DNA, 20 bp, Artificial Sequence
  Description of Artificial Sequence: Synthetic oligonucleotide
  Target: ATXN1; (-) strand; PAM type: YTN; PAM sequence: TTC
ccctgtgactatgaggatga

SEQ ID NO: 205343 - DNA, 20 bp, Artificial Sequence
  Description of Artificial Sequence: Synthetic oligonucleotide
  Target: ATXN1; (-) strand; PAM type: YTN; PAM sequence: TTA
atgtgtcataaatcattccc

SEQ ID NO: 205344 - DNA, 20 bp, Artificial Sequence
  Description of Artificial Sequence: Synthetic oligonucleotide
  Target: ATXN1; (-) strand; PAM type: YTN; PAM sequence: CTT
aatgtgtcataaatcattcc

SEQ ID NO: 205345 - DNA, 20 bp, Artificial Sequence
  Description of Artificial Sequence: Synthetic oligonucleotide
  Target: ATXN1; (-) strand; PAM type: YTN; PAM sequence: CTC
cttaatgtgtcataaatcat

SEQ ID NO: 205346 - DNA, 20 bp, Artificial Sequence
  Description of Artificial Sequence: Synthetic oligonucleotide
  Target: ATXN1; (-) strand; PAM type: YTN; PAM sequence: TTA
agaatacctccttaatgtgt

SEQ ID NO: 205347 - DNA, 20 bp, Artificial Sequence
  Description of Artificial Sequence: Synthetic oligonucleotide
  Target: ATXN1; (-) strand; PAM type: YTN; PAM sequence: CTT
aagaatacctccttaatgtg

SEQ ID NO: 205348 - DNA, 20 bp, Artificial Sequence
  Description of Artificial Sequence: Synthetic oligonucleotide
  Target: ATXN1; (-) strand; PAM type: YTN; PAM sequence: TTA
gcttaagaatacctccttaa

SEQ ID NO: 205349 - DNA, 20 bp, Artificial Sequence
  Description of Artificial Sequence: Synthetic oligonucleotide
  Target: ATXN1; (-) strand; PAM type: YTN; PAM sequence: TTA
agacatgttagcttaagaat

SEQ ID NO: 205350 - DNA, 20 bp, Artificial Sequence
  Description of Artificial Sequence: Synthetic oligonucleotide
  Target: ATXN1; (-) strand; PAM type: YTN; PAM sequence: CTA
attaagacatgttagcttaa

SEQ ID NO: 205351 - DNA, 20 bp, Artificial Sequence
  Description of Artificial Sequence: Synthetic oligonucleotide
  Target: ATXN1; (-) strand; PAM type: YTN; PAM sequence: TTC
ctaattaagacatgttagct

SEQ ID NO: 205352 - DNA, 20 bp, Artificial Sequence
  Description of Artificial Sequence: Synthetic oligonucleotide
  Target: ATXN1; (-) strand; PAM type: YTN; PAM sequence: CTG
aattcctaattaagacatgt

SEQ ID NO: 205353 - DNA, 20 bp, Artificial Sequence
  Description of Artificial Sequence: Synthetic oligonucleotide
  Target: ATXN1; (-) strand; PAM type: YTN; PAM sequence: CTC
agcagaagaggaatatctga

SEQ ID NO: 205354 - DNA, 20 bp, Artificial Sequence
  Description of Artificial Sequence: Synthetic oligonucleotide
  Target: ATXN1; (-) strand; PAM type: YTN; PAM sequence: TTC
tcagcagaagaggaatatct

SEQ ID NO: 205355 - DNA, 20 bp, Artificial Sequence
  Description of Artificial Sequence: Synthetic oligonucleotide
  Target: ATXN1; (-) strand; PAM type: YTN; PAM sequence: TTT
ctcagcagaagaggaatatc

SEQ ID NO: 205356 - DNA, 20 bp, Artificial Sequence
  Description of Artificial Sequence: Synthetic oligonucleotide
  Target: ATXN1; (-) strand; PAM type: YTN; PAM sequence: CTG
tatttctcagcagaagagga

SEQ ID NO: 205357 - DNA, 20 bp, Artificial Sequence
  Description of Artificial Sequence: Synthetic oligonucleotide
  Target: ATXN1; (-) strand; PAM type: YTN; PAM sequence: CTC
tgtatttctcagcagaagag

SEQ ID NO: 205358 - DNA, 20 bp, Artificial Sequence
  Description of Artificial Sequence: Synthetic oligonucleotide
  Target: ATXN1; (-) strand; PAM type: YTN; PAM sequence: TTG
aacagctctgtatttctcag

SEQ ID NO: 205359 - DNA, 20 bp, Artificial Sequence
  Description of Artificial Sequence: Synthetic oligonucleotide
  Target: ATXN1; (-) strand; PAM type: YTN; PAM sequence: TTT
gaacagctctgtatttctca

SEQ ID NO: 205360 - DNA, 20 bp, Artificial Sequence
  Description of Artificial Sequence: Synthetic oligonucleotide
  Target: ATXN1; (-) strand; PAM type: YTN; PAM sequence: CTA
atttgaacagctctgtattt

SEQ ID NO: 205361 - DNA, 20 bp, Artificial Sequence
  Description of Artificial Sequence: Synthetic oligonucleotide
  Target: ATXN1; (-) strand; PAM type: YTN; PAM sequence: CTG
gtctaatttgaacagctctg

SEQ ID NO: 205362 - DNA, 20 bp, Artificial Sequence
  Description of Artificial Sequence: Synthetic oligonucleotide
  Target: ATXN1; (-) strand; PAM type: YTN; PAM sequence: TTC
tggtctaatttgaacagctc

SEQ ID NO: 205363 - DNA, 20 bp, Artificial Sequence
  Description of Artificial Sequence: Synthetic oligonucleotide
  Target: ATXN1; (-) strand; PAM type: YTN; PAM sequence: TTT
ctggtctaatttgaacagct

SEQ ID NO: 205364 - DNA, 20 bp, Artificial Sequence
  Description of Artificial Sequence: Synthetic oligonucleotide
  Target: ATXN1; (-) strand; PAM type: YTN; PAM sequence: CTA
atttctggtctaatttgaac

SEQ ID NO: 205365 - DNA, 20 bp, Artificial Sequence
  Description of Artificial Sequence: Synthetic oligonucleotide
  Target: ATXN1; (-) strand; PAM type: YTN; PAM sequence: TTG
gccctaatttctggtctaat

SEQ ID NO: 205366 - DNA, 20 bp, Artificial Sequence
  Description of Artificial Sequence: Synthetic oligonucleotide
  Target: ATXN1; (-) strand; PAM type: YTN; PAM sequence: TTT
ggccctaatttctggtctaa

SEQ ID NO: 205367 - DNA, 20 bp, Artificial Sequence
  Description of Artificial Sequence: Synthetic oligonucleotide
  Target: ATXN1; (-) strand; PAM type: YTN; PAM sequence: TTT
tggccctaatttctggtcta

SEQ ID NO: 205368 - DNA, 20 bp, Artificial Sequence
  Description of Artificial Sequence: Synthetic oligonucleotide
  Target: ATXN1; (-) strand; PAM type: YTN; PAM sequence: TTC
gttttggccctaatttctgg

SEQ ID NO: 205369 - DNA, 20 bp, Artificial Sequence
  Description of Artificial Sequence: Synthetic oligonucleotide
  Target: ATXN1; (-) strand; PAM type: YTN; PAM sequence: CTG
cattcgttttggccctaatt

SEQ ID NO: 205370 - DNA, 20 bp, Artificial Sequence
  Description of Artificial Sequence: Synthetic oligonucleotide
  Target: ATXN1; (-) strand; PAM type: YTN; PAM sequence: TTG
tgtatgtagacgctgcattc

SEQ ID NO: 205371 - DNA, 20 bp, Artificial Sequence
  Description of Artificial Sequence: Synthetic oligonucleotide
  Target: ATXN1; (-) strand; PAM type: YTN; PAM sequence: CTT
gtgtatgtagacgctgcatt

SEQ ID NO: 205372 - DNA, 20 bp, Artificial Sequence
  Description of Artificial Sequence: Synthetic oligonucleotide
  Target: ATXN1; (-) strand; PAM type: YTN; PAM sequence: CTA
tgagcttgtgtatgtagacg

SEQ ID NO: 205373 - DNA, 20 bp, Artificial Sequence
  Description of Artificial Sequence: Synthetic oligonucleotide
  Target: ATXN1; (-) strand; PAM type: YTN; PAM sequence: CTG
ctatgagcttgtgtatgtag

SEQ ID NO: 205374 - DNA, 20 bp, Artificial Sequence
  Description of Artificial Sequence: Synthetic oligonucleotide
  Target: ATXN1; (-) strand; PAM type: YTN; PAM sequence: TTA
ccctgctatgagcttgtgta

SEQ ID NO: 205375 - DNA, 20 bp, Artificial Sequence
  Description of Artificial Sequence: Synthetic oligonucleotide
  Target: ATXN1; (-) strand; PAM type: YTN; PAM sequence: CTG
gttaccctgctatgagcttg

SEQ ID NO: 205376 - DNA, 20 bp, Artificial Sequence
  Description of Artificial Sequence: Synthetic oligonucleotide
  Target: ATXN1; (-) strand; PAM type: YTN; PAM sequence: TTC
actggttaccctgctatgag

SEQ ID NO: 205377 - DNA, 20 bp, Artificial Sequence
  Description of Artificial Sequence: Synthetic oligonucleotide
  Target: ATXN1; (-) strand; PAM type: YTN; PAM sequence: TTT
cactggttaccctgctatga

SEQ ID NO: 205378 - DNA, 20 bp, Artificial Sequence
  Description of Artificial Sequence: Synthetic oligonucleotide
  Target: ATXN1; (-) strand; PAM type: YTN; PAM sequence: CTT
tcactggttaccctgctatg

SEQ ID NO: 205379 - DNA, 20 bp, Artificial Sequence
  Description of Artificial Sequence: Synthetic oligonucleotide
  Target: ATXN1; (-) strand; PAM type: YTN; PAM sequence: CTG
cctttcactggttaccctgc

SEQ ID NO: 205380 - DNA, 20 bp, Artificial Sequence
  Description of Artificial Sequence: Synthetic oligonucleotide
  Target: ATXN1; (-) strand; PAM type: YTN; PAM sequence: CTC
tgcctttcactggttaccct

SEQ ID NO: 205381 - DNA, 20 bp, Artificial Sequence
  Description of Artificial Sequence: Synthetic oligonucleotide
  Target: ATXN1; (-) strand; PAM type: YTN; PAM sequence: TTC
agcctctgcctttcactggt

SEQ ID NO: 205382 - DNA, 20 bp, Artificial Sequence
  Description of Artificial Sequence: Synthetic oligonucleotide
  Target: ATXN1; (-) strand; PAM type: YTN; PAM sequence: CTT
cagcctctgcctttcactgg

SEQ ID NO: 205383 - DNA, 20 bp, Artificial Sequence
  Description of Artificial Sequence: Synthetic oligonucleotide
  Target: ATXN1; (-) strand; PAM type: YTN; PAM sequence: TTG
gcatgaaggagacaaacaca

SEQ ID NO: 205384 - DNA, 20 bp, Artificial Sequence
  Description of Artificial Sequence: Synthetic oligonucleotide
  Target: ATXN1; (-) strand; PAM type: YTN; PAM sequence: TTT
ggcatgaaggagacaaacac

SEQ ID NO: 205385 - DNA, 20 bp, Artificial Sequence
  Description of Artificial Sequence: Synthetic oligonucleotide
  Target: ATXN1; (-) strand; PAM type: YTN; PAM sequence: TTG
aaaagtgaaaggaaaagtgg

SEQ ID NO: 205386 - DNA, 20 bp, Artificial Sequence
  Description of Artificial Sequence: Synthetic oligonucleotide
  Target: ATXN1; (-) strand; PAM type: YTN; PAM sequence: CTC
catcgtaacgttgaaaagtg

SEQ ID NO: 205387 - DNA, 20 bp, Artificial Sequence
  Description of Artificial Sequence: Synthetic oligonucleotide
  Target: ATXN1; (-) strand; PAM type: YTN; PAM sequence: TTG
gctccatcgtaacgttgaaa

SEQ ID NO: 205388 - DNA, 20 bp, Artificial Sequence
  Description of Artificial Sequence: Synthetic oligonucleotide
  Target: ATXN1; (-) strand; PAM type: YTN; PAM sequence: TTT
ggctccatcgtaacgttgaa

SEQ ID NO: 205389 - DNA, 20 bp, Artificial Sequence
  Description of Artificial Sequence: Synthetic oligonucleotide
  Target: ATXN1; (-) strand; PAM type: YTN; PAM sequence: CTT
tggctccatcgtaacgttga

SEQ ID NO: 205390 - DNA, 20 bp, Artificial Sequence
  Description of Artificial Sequence: Synthetic oligonucleotide
  Target: ATXN1; (-) strand; PAM type: YTN; PAM sequence: TTG
accctttggctccatcgtaa

SEQ ID NO: 205391 - DNA, 20 bp, Artificial Sequence
  Description of Artificial Sequence: Synthetic oligonucleotide
  Target: ATXN1; (-) strand; PAM type: YTN; PAM sequence: CTT
gaccctttggctccatcgta

SEQ ID NO: 205392 - DNA, 20 bp, Artificial Sequence
  Description of Artificial Sequence: Synthetic oligonucleotide
  Target: ATXN1; (-) strand; PAM type: YTN; PAM sequence: CTC
ttgaccctttggctccatcg

SEQ ID NO: 205393 - DNA, 20 bp, Artificial Sequence
  Description of Artificial Sequence: Synthetic oligonucleotide
  Target: ATXN1; (-) strand; PAM type: YTN; PAM sequence: TTG
tgaatctcttgaccctttgg

SEQ ID NO: 205394 - DNA, 20 bp, Artificial Sequence
  Description of Artificial Sequence: Synthetic oligonucleotide
  Target: ATXN1; (-) strand; PAM type: YTN; PAM sequence: TTT
gtgaatctcttgaccctttg

SEQ ID NO: 205395 - DNA, 20 bp, Artificial Sequence
  Description of Artificial Sequence: Synthetic oligonucleotide
  Target: ATXN1; (-) strand; PAM type: YTN; PAM sequence: CTG
taggtttgtgaatctcttga

SEQ ID NO: 205396 - DNA, 20 bp, Artificial Sequence
  Description of Artificial Sequence: Synthetic oligonucleotide
  Target: ATXN1; (-) strand; PAM type: YTN; PAM sequence: CTA
cagatgcatgaaggggaagg

SEQ ID NO: 205397 - DNA, 20 bp, Artificial Sequence
  Description of Artificial Sequence: Synthetic oligonucleotide
  Target: ATXN1; (-) strand; PAM type: YTN; PAM sequence: TTA
tcctacagatgcatgaaggg

SEQ ID NO: 205398 - DNA, 20 bp, Artificial Sequence
  Description of Artificial Sequence: Synthetic oligonucleotide
  Target: ATXN1; (-) strand; PAM type: YTN; PAM sequence: TTT
atcctacagatgcatgaagg

SEQ ID NO: 205399 - DNA, 20 bp, Artificial Sequence
  Description of Artificial Sequence: Synthetic oligonucleotide
  Target: ATXN1; (-) strand; PAM type: YTN; PAM sequence: CTT
tatcctacagatgcatgaag

SEQ ID NO: 205400 - DNA, 20 bp, Artificial Sequence
  Description of Artificial Sequence: Synthetic oligonucleotide
  Target: ATXN1; (-) strand; PAM type: YTN; PAM sequence: TTA
ggaaacgcatgctttatcct

SEQ ID NO: 205401 - DNA, 20 bp, Artificial Sequence
  Description of Artificial Sequence: Synthetic oligonucleotide
  Target: ATXN1; (-) strand; PAM type: YTN; PAM sequence: CTT
aggaaacgcatgctttatcc

SEQ ID NO: 205402 - DNA, 20 bp, Artificial Sequence
  Description of Artificial Sequence: Synthetic oligonucleotide
  Target: ATXN1; (-) strand; PAM type: YTN; PAM sequence: CTC
ttaggaaacgcatgctttat

SEQ ID NO: 205403 - DNA, 20 bp, Artificial Sequence
  Description of Artificial Sequence: Synthetic oligonucleotide
  Target: ATXN1; (-) strand; PAM type: YTN; PAM sequence: CTA
aataaatgaaagagaaggta

SEQ ID NO: 205404 - DNA, 20 bp, Artificial Sequence
  Description of Artificial Sequence: Synthetic oligonucleotide
  Target: ATXN1; (-) strand; PAM type: YTN; PAM sequence: TTC
actaaataaatgaaagagaa

SEQ ID NO: 205405 - DNA, 20 bp, Artificial Sequence
  Description of Artificial Sequence: Synthetic oligonucleotide
  Target: ATXN1; (-) strand; PAM type: YTN; PAM sequence: TTT
cactaaataaatgaaagaga

SEQ ID NO: 205406 - DNA, 20 bp, Artificial Sequence
  Description of Artificial Sequence: Synthetic oligonucleotide
  Target: ATXN1; (-) strand; PAM type: YTN; PAM sequence: TTC
atttcactaaataaatgaaa

SEQ ID NO: 205407 - DNA, 20 bp, Artificial Sequence
  Description of Artificial Sequence: Synthetic oligonucleotide
  Target: ATXN1; (-) strand; PAM type: YTN; PAM sequence: CTT
catttcactaaataaatgaa

SEQ ID NO: 205408 - DNA, 20 bp, Artificial Sequence
  Description of Artificial Sequence: Synthetic oligonucleotide
  Target: ATXN1; (-) strand; PAM type: YTN; PAM sequence: CTA
aataagcttcatttcactaa

SEQ ID NO: 205409 - DNA, 20 bp, Artificial Sequence
  Description of Artificial Sequence: Synthetic oligonucleotide
  Target: ATXN1; (-) strand; PAM type: YTN; PAM sequence: TTA
ctaaataagcttcatttcac

SEQ ID NO: 205410 - DNA, 20 bp, Artificial Sequence
  Description of Artificial Sequence: Synthetic oligonucleotide
  Target: ATXN1; (-) strand; PAM type: YTN; PAM sequence: TTC
ccgtcattactaaataagct

SEQ ID NO: 205411 - DNA, 20 bp, Artificial Sequence
  Description of Artificial Sequence: Synthetic oligonucleotide
  Target: ATXN1; (-) strand; PAM type: YTN; PAM sequence: CTT
cccgtcattactaaataagc

SEQ ID NO: 205412 - DNA, 20 bp, Artificial Sequence
  Description of Artificial Sequence: Synthetic oligonucleotide
  Target: ATXN1; (-) strand; PAM type: YTN; PAM sequence: CTC
ttcccgtcattactaaataa

SEQ ID NO: 205413 - DNA, 20 bp, Artificial Sequence
  Description of Artificial Sequence: Synthetic oligonucleotide
  Target: ATXN1; (-) strand; PAM type: YTN; PAM sequence: CTC
atctcttcccgtcattacta

SEQ ID NO: 205414 - DNA, 20 bp, Artificial Sequence
  Description of Artificial Sequence: Synthetic oligonucleotide
  Target: ATXN1; (-) strand; PAM type: YTN; PAM sequence: TTG
gctcatctcttcccgtcatt

SEQ ID NO: 205415 - DNA, 20 bp, Artificial Sequence
  Description of Artificial Sequence: Synthetic oligonucleotide
  Target: ATXN1; (-) strand; PAM type: YTN; PAM sequence: CTA
gttggctcatctcttcccgt

SEQ ID NO: 205416 - DNA, 20 bp, Artificial Sequence
  Description of Artificial Sequence: Synthetic oligonucleotide
  Target: ATXN1; (-) strand; PAM type: YTN; PAM sequence: CTG
ccctagttggctcatctctt

SEQ ID NO: 205417 - DNA, 20 bp, Artificial Sequence
  Description of Artificial Sequence: Synthetic oligonucleotide
  Target: ATXN1; (-) strand; PAM type: YTN; PAM sequence: CTG
gcaccatatgtgagctgccc

SEQ ID NO: 205418 - DNA, 20 bp, Artificial Sequence
  Description of Artificial Sequence: Synthetic oligonucleotide
  Target: ATXN1; (-) strand; PAM type: YTN; PAM sequence: CTC
accgtctggcaccatatgtg

SEQ ID NO: 205419 - DNA, 20 bp, Artificial Sequence
  Description of Artificial Sequence: Synthetic oligonucleotide
  Target: ATXN1; (-) strand; PAM type: YTN; PAM sequence: TTG
ggcacagagtccctcaccgt

SEQ ID NO: 205420 - DNA, 20 bp, Artificial Sequence
  Description of Artificial Sequence: Synthetic oligonucleotide
  Target: ATXN1; (-) strand; PAM type: YTN; PAM sequence: CTT
gggcacagagtccctcaccg

SEQ ID NO: 205421 - DNA, 20 bp, Artificial Sequence
  Description of Artificial Sequence: Synthetic oligonucleotide
  Target: ATXN1; (-) strand; PAM type: YTN; PAM sequence: CTG
tggtacagcaagtgccttgg

SEQ ID NO: 205422 - DNA, 20 bp, Artificial Sequence
  Description of Artificial Sequence: Synthetic oligonucleotide
  Target: ATXN1; (-) strand; PAM type: YTN; PAM sequence: CTC
ctgtggtacagcaagtgcct

SEQ ID NO: 205423 - DNA, 20 bp, Artificial Sequence
  Description of Artificial Sequence: Synthetic oligonucleotide
  Target: ATXN1; (-) strand; PAM type: YTN; PAM sequence: CTA
gctcctgtggtacagcaagt

SEQ ID NO: 205424 - DNA, 20 bp, Artificial Sequence
  Description of Artificial Sequence: Synthetic oligonucleotide
  Target: ATXN1; (-) strand; PAM type: YTN; PAM sequence: CTG
cctagctcctgtggtacagc

SEQ ID NO: 205425 - DNA, 20 bp, Artificial Sequence
  Description of Artificial Sequence: Synthetic oligonucleotide
  Target: ATXN1; (-) strand; PAM type: YTN; PAM sequence: TTC
ccagccagggctgcctagct

SEQ ID NO: 205426 - DNA, 20 bp, Artificial Sequence
  Description of Artificial Sequence: Synthetic oligonucleotide
  Target: ATXN1; (-) strand; PAM type: YTN; PAM sequence: CTT
cccagccagggctgcctagc

SEQ ID NO: 205427 - DNA, 20 bp, Artificial Sequence
  Description of Artificial Sequence: Synthetic oligonucleotide
  Target: ATXN1; (-) strand; PAM type: YTN; PAM sequence: TTC
cttcccagccagggctgcct

SEQ ID NO: 205428 - DNA, 20 bp, Artificial Sequence
  Description of Artificial Sequence: Synthetic oligonucleotide
  Target: ATXN1; (-) strand; PAM type: YTN; PAM sequence: CTT
ccttcccagccagggctgcc

SEQ ID NO: 205429 - DNA, 20 bp, Artificial Sequence
  Description of Artificial Sequence: Synthetic oligonucleotide
  Target: ATXN1; (-) strand; PAM type: YTN; PAM sequence: TTG
ggtgagagcagagcttcctt

SEQ ID NO: 205430 - DNA, 20 bp, Artificial Sequence
  Description of Artificial Sequence: Synthetic oligonucleotide
  Target: ATXN1; (-) strand; PAM type: YTN; PAM sequence: TTG
gagcagccgttgggtgagag

SEQ ID NO: 205431 - DNA, 20 bp, Artificial Sequence
  Description of Artificial Sequence: Synthetic oligonucleotide
  Target: ATXN1; (-) strand; PAM type: YTN; PAM sequence: CTT
ggagcagccgttgggtgaga

SEQ ID NO: 205432 - DNA, 20 bp, Artificial Sequence
  Description of Artificial Sequence: Synthetic oligonucleotide
  Target: ATXN1; (-) strand; PAM type: YTN; PAM sequence: CTG
ggggcacccttggagcagcc

SEQ ID NO: 205433 - DNA, 20 bp, Artificial Sequence
  Description of Artificial Sequence: Synthetic oligonucleotide
  Target: ATXN1; (-) strand; PAM type: YTN; PAM sequence: CTG
gctgggggcacccttggagc

SEQ ID NO: 205434 - DNA, 20 bp, Artificial Sequence
  Description of Artificial Sequence: Synthetic oligonucleotide
  Target: ATXN1; (-) strand; PAM type: YTN; PAM sequence: CTG
gatcacctggctgggggcac

SEQ ID NO: 205435 - DNA, 20 bp, Artificial Sequence
  Description of Artificial Sequence: Synthetic oligonucleotide
  Target: ATXN1; (-) strand; PAM type: YTN; PAM sequence: CTG
tctggatcacctggctgggg

SEQ ID NO: 205436 - DNA, 20 bp, Artificial Sequence
  Description of Artificial Sequence: Synthetic oligonucleotide
  Target: ATXN1; (-) strand; PAM type: YTN; PAM sequence: TTG
aaaccatggctgtctggatc

SEQ ID NO: 205437 - DNA, 20 bp, Artificial Sequence
  Description of Artificial Sequence: Synthetic oligonucleotide
  Target: ATXN1; (-) strand; PAM type: YTN; PAM sequence: TTT
gaaaccatggctgtctggat

SEQ ID NO: 205438 - DNA, 20 bp, Artificial Sequence
  Description of Artificial Sequence: Synthetic oligonucleotide
  Target: ATXN1; (-) strand; PAM type: YTN; PAM sequence: CTT
tgaaaccatggctgtctgga

SEQ ID NO: 205439 - DNA, 20 bp, Artificial Sequence
  Description of Artificial Sequence: Synthetic oligonucleotide
  Target: ATXN1; (-) strand; PAM type: YTN; PAM sequence: TTC
acagagctttgaaaccatgg

SEQ ID NO: 205440 - DNA, 20 bp, Artificial Sequence
  Description of Artificial Sequence: Synthetic oligonucleotide
  Target: ATXN1; (-) strand; PAM type: YTN; PAM sequence: TTT
cacagagctttgaaaccatg

SEQ ID NO: 205441 - DNA, 20 bp, Artificial Sequence
  Description of Artificial Sequence: Synthetic oligonucleotide
  Target: ATXN1; (-) strand; PAM type: YTN; PAM sequence: TTT
tcacagagctttgaaaccat

SEQ ID NO: 205442 - DNA, 20 bp, Artificial Sequence
  Description of Artificial Sequence: Synthetic oligonucleotide
  Target: ATXN1; (-) strand; PAM type: YTN; PAM sequence: TTT
ttcacagagctttgaaacca

SEQ ID NO: 205443 - DNA, 20 bp, Artificial Sequence
  Description of Artificial Sequence: Synthetic oligonucleotide
  Target: ATXN1; (-) strand; PAM type: YTN; PAM sequence: TTC
aagtcagagacccatttttc

SEQ ID NO: 205444 - DNA, 20 bp, Artificial Sequence
  Description of Artificial Sequence: Synthetic oligonucleotide
  Target: ATXN1; (-) strand; PAM type: YTN; PAM sequence: TTT
caagtcagagacccattttt

SEQ ID NO: 205445 - DNA, 20 bp, Artificial Sequence
  Description of Artificial Sequence: Synthetic oligonucleotide
  Target: ATXN1; (-) strand; PAM type: YTN; PAM sequence: TTT
tcaagtcagagacccatttt

SEQ ID NO: 205446 - DNA, 20 bp, Artificial Sequence
  Description of Artificial Sequence: Synthetic oligonucleotide
  Target: ATXN1; (-) strand; PAM type: YTN; PAM sequence: TTC
aagttttcaagtcagagacc

SEQ ID NO: 205447 - DNA, 20 bp, Artificial Sequence
  Description of Artificial Sequence: Synthetic oligonucleotide
  Target: ATXN1; (-) strand; PAM type: YTN; PAM sequence: CTG
attcaagttttcaagtcaga

SEQ ID NO: 205448 - DNA, 20 bp, Artificial Sequence
  Description of Artificial Sequence: Synthetic oligonucleotide
  Target: ATXN1; (-) strand; PAM type: YTN; PAM sequence: TTC
ctgattcaagttttcaagtc

SEQ ID NO: 205449 - DNA, 20 bp, Artificial Sequence
  Description of Artificial Sequence: Synthetic oligonucleotide
  Target: ATXN1; (-) strand; PAM type: YTN; PAM sequence: CTT
cctgattcaagttttcaagt

SEQ ID NO: 205450 - DNA, 20 bp, Artificial Sequence
  Description of Artificial Sequence: Synthetic oligonucleotide
  Target: ATXN1; (-) strand; PAM type: YTN; PAM sequence: CTG
gagagacttcctgattcaag

SEQ ID NO: 205451 - DNA, 20 bp, Artificial Sequence
  Description of Artificial Sequence: Synthetic oligonucleotide
  Target: ATXN1; (-) strand; PAM type: YTN; PAM sequence: TTA
gtggagtaatcccagtcctg

SEQ ID NO: 205452 - DNA, 20 bp, Artificial Sequence
  Description of Artificial Sequence: Synthetic oligonucleotide
  Target: ATXN1; (-) strand; PAM type: YTN; PAM sequence: TTG
tattagtggagtaatcccag

SEQ ID NO: 205453 - DNA, 20 bp, Artificial Sequence
  Description of Artificial Sequence: Synthetic oligonucleotide
  Target: ATXN1; (-) strand; PAM type: YTN; PAM sequence: TTT
gtattagtggagtaatccca

SEQ ID NO: 205454 - DNA, 20 bp, Artificial Sequence
  Description of Artificial Sequence: Synthetic oligonucleotide
  Target: ATXN1; (-) strand; PAM type: YTN; PAM sequence: TTA
atttgtattagtggagtaat

SEQ ID NO: 205455 - DNA, 20 bp, Artificial Sequence
  Description of Artificial Sequence: Synthetic oligonucleotide
  Target: ATXN1; (-) strand; PAM type: YTN; PAM sequence: TTT
aatttgtattagtggagtaa

SEQ ID NO: 205456 - DNA, 20 bp, Artificial Sequence
  Description of Artificial Sequence: Synthetic oligonucleotide
  Target: ATXN1; (-) strand; PAM type: YTN; PAM sequence: CTG
aatggatttaatttgtatta

SEQ ID NO: 205457 - DNA, 20 bp, Artificial Sequence
  Description of Artificial Sequence: Synthetic oligonucleotide
  Target: ATXN1; (-) strand; PAM type: YTN; PAM sequence: TTC
tgaatggatttaatttgtat

SEQ ID NO: 205458 - DNA, 20 bp, Artificial Sequence
  Description of Artificial Sequence: Synthetic oligonucleotide
  Target: ATXN1; (-) strand; PAM type: YTN; PAM sequence: CTT
ctgaatggatttaatttgta

SEQ ID NO: 205459 - DNA, 20 bp, Artificial Sequence
  Description of Artificial Sequence: Synthetic oligonucleotide
  Target: ATXN1; (-) strand; PAM type: YTN; PAM sequence: TTA
gcatacttctgaatggattt

SEQ ID NO: 205460 - DNA, 20 bp, Artificial Sequence
  Description of Artificial Sequence: Synthetic oligonucleotide
  Target: ATXN1; (-) strand; PAM type: YTN; PAM sequence: TTT
agcatacttctgaatggatt

SEQ ID NO: 205461 - DNA, 20 bp, Artificial Sequence
  Description of Artificial Sequence: Synthetic oligonucleotide
  Target: ATXN1; (-) strand; PAM type: YTN; PAM sequence: CTA
caaaaagggtttagcatact

SEQ ID NO: 205462 - DNA, 20 bp, Artificial Sequence
  Description of Artificial Sequence: Synthetic oligonucleotide
  Target: ATXN1; (-) strand; PAM type: YTN; PAM sequence: CTA
gtatctacaaaaagggttta

SEQ ID NO: 205463 - DNA, 20 bp, Artificial Sequence
  Description of Artificial Sequence: Synthetic oligonucleotide
  Target: ATXN1; (-) strand; PAM type: YTN; PAM sequence: CTC
tagtatctacaaaaagggtt

SEQ ID NO: 205464 - DNA, 20 bp, Artificial Sequence
  Description of Artificial Sequence: Synthetic oligonucleotide
  Target: ATXN1; (-) strand; PAM type: YTN; PAM sequence: CTC
ctctagtatctacaaaaagg

SEQ ID NO: 205465 - DNA, 20 bp, Artificial Sequence
  Description of Artificial Sequence: Synthetic oligonucleotide
  Target: ATXN1; (-) strand; PAM type: YTN; PAM sequence: TTC
atcctcctctagtatctaca

SEQ ID NO: 205466 - DNA, 20 bp, Artificial Sequence
  Description of Artificial Sequence: Synthetic oligonucleotide
  Target: ATXN1; (-) strand; PAM type: YTN; PAM sequence: TTT
catcctcctctagtatctac

SEQ ID NO: 205467 - DNA, 20 bp, Artificial Sequence
  Description of Artificial Sequence: Synthetic oligonucleotide
  Target: ATXN1; (-) strand; PAM type: YTN; PAM sequence: TTT
tcatcctcctctagtatcta

SEQ ID NO: 205468 - DNA, 20 bp, Artificial Sequence
  Description of Artificial Sequence: Synthetic oligonucleotide
  Target: ATXN1; (-) strand; PAM type: YTN; PAM sequence: CTT
ttcatcctcctctagtatct

SEQ ID NO: 205469 - DNA, 20 bp, Artificial Sequence
  Description of Artificial Sequence: Synthetic oligonucleotide
  Target: ATXN1; (-) strand; PAM type: YTN; PAM sequence: CTC
ttttcatcctcctctagtat

SEQ ID NO: 205470 - DNA, 20 bp, Artificial Sequence
  Description of Artificial Sequence: Synthetic oligonucleotide
  Target: ATXN1; (-) strand; PAM type: YTN; PAM sequence: CTC
cctcttttcatcctcctcta

SEQ ID NO: 205471 - DNA, 20 bp, Artificial Sequence
  Description of Artificial Sequence: Synthetic oligonucleotide
  Target: ATXN1; (-) strand; PAM type: YTN; PAM sequence: TTC
ctccctcttttcatcctcct

SEQ ID NO: 205472 - DNA, 20 bp, Artificial Sequence
  Description of Artificial Sequence: Synthetic oligonucleotide
  Target: ATXN1; (-) strand; PAM type: YTN; PAM sequence: TTT
cctccctcttttcatcctcc

SEQ ID NO: 205473 - DNA, 20 bp, Artificial Sequence
  Description of Artificial Sequence: Synthetic oligonucleotide
  Target: ATXN1; (-) strand; PAM type: YTN; PAM sequence: CTT
tcctccctcttttcatcctc

SEQ ID NO: 205474 - DNA, 20 bp, Artificial Sequence
  Description of Artificial Sequence: Synthetic oligonucleotide
  Target: ATXN1; (-) strand; PAM type: YTN; PAM sequence: CTC
tttcctccctcttttcatcc

SEQ ID NO: 205475 - DNA, 20 bp, Artificial Sequence
  Description of Artificial Sequence: Synthetic oligonucleotide
  Target: ATXN1; (-) strand; PAM type: YTN; PAM sequence: CTC
tctttcctccctcttttcat

SEQ ID NO: 205476 - DNA, 20 bp, Artificial Sequence
  Description of Artificial Sequence: Synthetic oligonucleotide
  Target: ATXN1; (-) strand; PAM type: YTN; PAM sequence: TTG
cctctctttcctccctcttt

SEQ ID NO: 205477 - DNA, 20 bp, Artificial Sequence
  Description of Artificial Sequence: Synthetic oligonucleotide
  Target: ATXN1; (-) strand; PAM type: YTN; PAM sequence: TTT
gcctctctttcctccctctt

SEQ ID NO: 205478 - DNA, 20 bp, Artificial Sequence
  Description of Artificial Sequence: Synthetic oligonucleotide
  Target: ATXN1; (-) strand; PAM type: YTN; PAM sequence: CTT
tgcctctctttcctccctct

SEQ ID NO: 205479 - DNA, 20 bp, Artificial Sequence
  Description of Artificial Sequence: Synthetic oligonucleotide
  Target: ATXN1; (-) strand; PAM type: YTN; PAM sequence: TTA
ctttgcctctctttcctccc

SEQ ID NO: 205480 - DNA, 20 bp, Artificial Sequence
  Description of Artificial Sequence: Synthetic oligonucleotide
  Target: ATXN1; (-) strand; PAM type: YTN; PAM sequence: TTC
caaaattactttgcctctct

SEQ ID NO: 205481 - DNA, 20 bp, Artificial Sequence
  Description of Artificial Sequence: Synthetic oligonucleotide
  Target: ATXN1; (-) strand; PAM type: YTN; PAM sequence: CTT
ccaaaattactttgcctctc

SEQ ID NO: 205482 - DNA, 20 bp, Artificial Sequence
  Description of Artificial Sequence: Synthetic oligonucleotide
  Target: ATXN1; (-) strand; PAM type: YTN; PAM sequence: CTA
atcttccaaaattactttgc

SEQ ID NO: 205483 - DNA, 20 bp, Artificial Sequence
  Description of Artificial Sequence: Synthetic oligonucleotide
  Target: ATXN1; (-) strand; PAM type: YTN; PAM sequence: TTG
gcatgaaccatagtataatc

SEQ ID NO: 205484 - DNA, 20 bp, Artificial Sequence
  Description of Artificial Sequence: Synthetic oligonucleotide
  Target: ATXN1; (-) strand; PAM type: YTN; PAM sequence: TTG
agaaaatgatcaatatagaa

SEQ ID NO: 205485 - DNA, 20 bp, Artificial Sequence
  Description of Artificial Sequence: Synthetic oligonucleotide
  Target: ATXN1; (-) strand; PAM type: YTN; PAM sequence: TTT
gagaaaatgatcaatataga

SEQ ID NO: 205486 - DNA, 20 bp, Artificial Sequence
  Description of Artificial Sequence: Synthetic oligonucleotide
  Target: ATXN1; (-) strand; PAM type: YTN; PAM sequence: TTA
atcatttgagaaaatgatca

SEQ ID NO: 205487 - DNA, 20 bp, Artificial Sequence
  Description of Artificial Sequence: Synthetic oligonucleotide
  Target: ATXN1; (-) strand; PAM type: YTN; PAM sequence: TTT
aatcatttgagaaaatgatc

SEQ ID NO: 205488 - DNA, 20 bp, Artificial Sequence
  Description of Artificial Sequence: Synthetic oligonucleotide
  Target: ATXN1; (-) strand; PAM type: YTN; PAM sequence: TTC
aggagtatttaatcatttga

SEQ ID NO: 205489 - DNA, 20 bp, Artificial Sequence
  Description of Artificial Sequence: Synthetic oligonucleotide
  Target: ATXN1; (-) strand; PAM type: YTN; PAM sequence: TTT
caggagtatttaatcatttg

SEQ ID NO: 205490 - DNA, 20 bp, Artificial Sequence
  Description of Artificial Sequence: Synthetic oligonucleotide
  Target: ATXN1; (-) strand; PAM type: YTN; PAM sequence: CTA
tttcaggagtatttaatcat

SEQ ID NO: 205491 - DNA, 20 bp, Artificial Sequence
  Description of Artificial Sequence: Synthetic oligonucleotide
  Target: ATXN1; (-) strand; PAM type: YTN; PAM sequence: CTC
ctatttcaggagtatttaat

SEQ ID NO: 205492 - DNA, 20 bp, Artificial Sequence
  Description of Artificial Sequence: Synthetic oligonucleotide
  Target: ATXN1; (-) strand; PAM type: YTN; PAM sequence: TTA
aaactcctatttcaggagta

SEQ ID NO: 205493 - DNA, 20 bp, Artificial Sequence
  Description of Artificial Sequence: Synthetic oligonucleotide
  Target: ATXN1; (-) strand; PAM type: YTN; PAM sequence: TTA
aaatcgttaaaactcctatt

SEQ ID NO: 205494 - DNA, 20 bp, Artificial Sequence
  Description of Artificial Sequence: Synthetic oligonucleotide
  Target: ATXN1; (-) strand; PAM type: YTN; PAM sequence: TTT
aaaatcgttaaaactcctat

SEQ ID NO: 205495 - DNA, 20 bp, Artificial Sequence
  Description of Artificial Sequence: Synthetic oligonucleotide
  Target: ATXN1; (-) strand; PAM type: YTN; PAM sequence: CTG
caaataatatatatgaaatg

SEQ ID NO: 205496 - DNA, 20 bp, Artificial Sequence
  Description of Artificial Sequence: Synthetic oligonucleotide
  Target: ATXN1; (-) strand; PAM type: YTN; PAM sequence: TTG
ctgcaaataatatatatgaa

SEQ ID NO: 205497 - DNA, 20 bp, Artificial Sequence
  Description of Artificial Sequence: Synthetic oligonucleotide
  Target: ATXN1; (-) strand; PAM type: YTN; PAM sequence: TTG
ggtgttgctgcaaataatat

SEQ ID NO: 205498 - DNA, 20 bp, Artificial Sequence
  Description of Artificial Sequence: Synthetic oligonucleotide
  Target: ATXN1; (-) strand; PAM type: YTN; PAM sequence: CTT
gggtgttgctgcaaataata

SEQ ID NO: 205499 - DNA, 20 bp, Artificial Sequence
  Description of Artificial Sequence: Synthetic oligonucleotide
  Target: ATXN1; (-) strand; PAM type: YTN; PAM sequence: CTC
ccttgggtgttgctgcaaat

SEQ ID NO: 205500 - DNA, 20 bp, Artificial Sequence
  Description of Artificial Sequence: Synthetic oligonucleotide
  Target: ATXN1; (-) strand; PAM type: YTN; PAM sequence: TTC
tcccttgggtgttgctgcaa

SEQ ID NO: 205501 - DNA, 20 bp, Artificial Sequence
  Description of Artificial Sequence: Synthetic oligonucleotide
  Target: ATXN1; (-) strand; PAM type: YTN; PAM sequence: CTT
ctcccttgggtgttgctgca

SEQ ID NO: 205502 - DNA, 20 bp, Artificial Sequence
  Description of Artificial Sequence: Synthetic oligonucleotide
  Target: ATXN1; (-) strand; PAM type: YTN; PAM sequence: TTC
ggataataatagtacccttc

SEQ ID NO: 205503 - DNA, 20 bp, Artificial Sequence
  Description of Artificial Sequence: Synthetic oligonucleotide
  Target: ATXN1; (-) strand; PAM type: YTN; PAM sequence: TTG
catgtaaaattcggataata

SEQ ID NO: 205504 - DNA, 20 bp, Artificial Sequence
  Description of Artificial Sequence: Synthetic oligonucleotide
  Target: ATXN1; (-) strand; PAM type: YTN; PAM sequence: TTT
gcatgtaaaattcggataat

SEQ ID NO: 205505 - DNA, 20 bp, Artificial Sequence
  Description of Artificial Sequence: Synthetic oligonucleotide
  Target: ATXN1; (-) strand; PAM type: YTN; PAM sequence: CTT
tgcatgtaaaattcggataa

SEQ ID NO: 205506 - DNA, 20 bp, Artificial Sequence
  Description of Artificial Sequence: Synthetic oligonucleotide
  Target: ATXN1; (-) strand; PAM type: YTN; PAM sequence: TTA
ctttgcatgtaaaattcgga

SEQ ID NO: 205507 - DNA, 20 bp, Artificial Sequence
  Description of Artificial Sequence: Synthetic oligonucleotide
  Target: ATXN1; (-) strand; PAM type: YTN; PAM sequence: TTG
ggcaagttactttgcatgta

SEQ ID NO: 205508 - DNA, 20 bp, Artificial Sequence
  Description of Artificial Sequence: Synthetic oligonucleotide
  Target: ATXN1; (-) strand; PAM type: YTN; PAM sequence: TTG
aagtgtgacattgggcaagt

SEQ ID NO: 205509 - DNA, 20 bp, Artificial Sequence
  Description of Artificial Sequence: Synthetic oligonucleotide
  Target: ATXN1; (-) strand; PAM type: YTN; PAM sequence: CTT
gaagtgtgacattgggcaag

SEQ ID NO: 205510 - DNA, 20 bp, Artificial Sequence
  Description of Artificial Sequence: Synthetic oligonucleotide
  Target: ATXN1; (-) strand; PAM type: YTN; PAM sequence: TTC
ttgaagtgtgacattgggca

SEQ ID NO: 205511 - DNA, 20 bp, Artificial Sequence
  Description of Artificial Sequence: Synthetic oligonucleotide
  Target: ATXN1; (-) strand; PAM type: YTN; PAM sequence: TTT
cttgaagtgtgacattgggc

SEQ ID NO: 205512 - DNA, 20 bp, Artificial Sequence
  Description of Artificial Sequence: Synthetic oligonucleotide
  Target: ATXN1; (-) strand; PAM type: YTN; PAM sequence: TTT
tcttgaagtgtgacattggg

SEQ ID NO: 205513 - DNA, 20 bp, Artificial Sequence
  Description of Artificial Sequence: Synthetic oligonucleotide
  Target: ATXN1; (-) strand; PAM type: YTN; PAM sequence: CTG
ttttcttgaagtgtgacatt

SEQ ID NO: 205514 - DNA, 20 bp, Artificial Sequence
  Description of Artificial Sequence: Synthetic oligonucleotide
  Target: ATXN1; (-) strand; PAM type: YTN; PAM sequence: CTG
ctgttttcttgaagtgtgac

SEQ ID NO: 205515 - DNA, 20 bp, Artificial Sequence
  Description of Artificial Sequence: Synthetic oligonucleotide
  Target: ATXN1; (-) strand; PAM type: YTN; PAM sequence: CTC
tgctgttttcttgaagtgtg

SEQ ID NO: 205516 - DNA, 20 bp, Artificial Sequence
  Description of Artificial Sequence: Synthetic oligonucleotide
  Target: ATXN1; (-) strand; PAM type: YTN; PAM sequence: TTC
cagctctgctgttttcttga

SEQ ID NO: 205517 - DNA, 20 bp, Artificial Sequence
  Description of Artificial Sequence: Synthetic oligonucleotide
  Target: ATXN1; (-) strand; PAM type: YTN; PAM sequence: CTC
aaattccagctctgctgttt

SEQ ID NO: 205518 - DNA, 20 bp, Artificial Sequence
  Description of Artificial Sequence: Synthetic oligonucleotide
  Target: ATXN1; (-) strand; PAM type: YTN; PAM sequence: CTG
ggctcaaattccagctctgc

SEQ ID NO: 205519 - DNA, 20 bp, Artificial Sequence
  Description of Artificial Sequence: Synthetic oligonucleotide
  Target: ATXN1; (-) strand; PAM type: YTN; PAM sequence: CTG
cctgggctcaaattccagct

SEQ ID NO: 205520 - DNA, 20 bp, Artificial Sequence
  Description of Artificial Sequence: Synthetic oligonucleotide
  Target: ATXN1; (-) strand; PAM type: YTN; PAM sequence: TTC
aggctgcctgggctcaaatt

SEQ ID NO: 205521 - DNA, 20 bp, Artificial Sequence
  Description of Artificial Sequence: Synthetic oligonucleotide
  Target: ATXN1; (-) strand; PAM type: YTN; PAM sequence: CTT
caggctgcctgggctcaaat

SEQ ID NO: 205522 - DNA, 20 bp, Artificial Sequence
  Description of Artificial Sequence: Synthetic oligonucleotide
  Target: ATXN1; (-) strand; PAM type: YTN; PAM sequence: TTG
caagcttcaggctgcctggg

SEQ ID NO: 205523 - DNA, 20 bp, Artificial Sequence
  Description of Artificial Sequence: Synthetic oligonucleotide
  Target: ATXN1; (-) strand; PAM type: YTN; PAM sequence: CTG
tagataagattgcaagcttc

SEQ ID NO: 205524 - DNA, 20 bp, Artificial Sequence
  Description of Artificial Sequence: Synthetic oligonucleotide
  Target: ATXN1; (-) strand; PAM type: YTN; PAM sequence: TTA
gtgccatatgatggaaaagc

SEQ ID NO: 205525 - DNA, 20 bp, Artificial Sequence
  Description of Artificial Sequence: Synthetic oligonucleotide
  Target: ATXN1; (-) strand; PAM type: YTN; PAM sequence: CTA
tgttagtgccatatgatgga

SEQ ID NO: 205526 - DNA, 20 bp, Artificial Sequence
  Description of Artificial Sequence: Synthetic oligonucleotide
  Target: ATXN1; (-) strand; PAM type: YTN; PAM sequence: TTA
aatataactatgttagtgcc

SEQ ID NO: 205527 - DNA, 20 bp, Artificial Sequence
  Description of Artificial Sequence: Synthetic oligonucleotide
  Target: ATXN1; (-) strand; PAM type: YTN; PAM sequence: CTA
tatatgtatgtgtgtgtgta

SEQ ID NO: 205528 - DNA, 20 bp, Artificial Sequence
  Description of Artificial Sequence: Synthetic oligonucleotide
  Target: ATXN1; (-) strand; PAM type: YTN; PAM sequence: TTA
aaaatatgtatgtgcctata

SEQ ID NO: 205529 - DNA, 20 bp, Artificial Sequence
  Description of Artificial Sequence: Synthetic oligonucleotide
  Target: ATXN1; (-) strand; PAM type: YTN; PAM sequence: TTT
aaaaatatgtatgtgcctat

SEQ ID NO: 205530 - DNA, 20 bp, Artificial Sequence
  Description of Artificial Sequence: Synthetic oligonucleotide
  Target: ATXN1; (-) strand; PAM type: YTN; PAM sequence: TTA
gtttaaaaatatgtatgtgc

SEQ ID NO: 205531 - DNA, 20 bp, Artificial Sequence
  Description of Artificial Sequence: Synthetic oligonucleotide
  Target: ATXN1; (-) strand; PAM type: YTN; PAM sequence: CTC
attagtttaaaaatatgtat

SEQ ID NO: 205532 - DNA, 20 bp, Artificial Sequence
  Description of Artificial Sequence: Synthetic oligonucleotide
  Target: ATXN1; (-) strand; PAM type: YTN; PAM sequence: CTG
ctcattagtttaaaaatatg

SEQ ID NO: 205533 - DNA, 20 bp, Artificial Sequence
  Description of Artificial Sequence: Synthetic oligonucleotide
  Target: ATXN1; (-) strand; PAM type: YTN; PAM sequence: TTA
tactgctcattagtttaaaa

SEQ ID NO: 205534 - DNA, 20 bp, Artificial Sequence
  Description of Artificial Sequence: Synthetic oligonucleotide
  Target: ATXN1; (-) strand; PAM type: YTN; PAM sequence: CTG
aagttatactgctcattagt

SEQ ID NO: 205535 - DNA, 20 bp, Artificial Sequence
  Description of Artificial Sequence: Synthetic oligonucleotide
  Target: ATXN1; (-) strand; PAM type: YTN; PAM sequence: TTA
gatatgtatctgaagttata

SEQ ID NO: 205536 - DNA, 20 bp, Artificial Sequence
  Description of Artificial Sequence: Synthetic oligonucleotide
  Target: ATXN1; (-) strand; PAM type: YTN; PAM sequence: TTA
ttagatatgtatctgaagtt

SEQ ID NO: 205537 - DNA, 20 bp, Artificial Sequence
  Description of Artificial Sequence: Synthetic oligonucleotide
  Target: ATXN1; (-) strand; PAM type: YTN; PAM sequence: TTT
attagatatgtatctgaagt

SEQ ID NO: 205538 - DNA, 20 bp, Artificial Sequence
  Description of Artificial Sequence: Synthetic oligonucleotide
  Target: ATXN1; (-) strand; PAM type: YTN; PAM sequence: TTT
tattagatatgtatctgaag

SEQ ID NO: 205539 - DNA, 20 bp, Artificial Sequence
  Description of Artificial Sequence: Synthetic oligonucleotide
  Target: ATXN1; (-) strand; PAM type: YTN; PAM sequence: TTA
ataaaaaaattttattagat

SEQ ID NO: 205540 - DNA, 20 bp, Artificial Sequence
  Description of Artificial Sequence: Synthetic oligonucleotide
  Target: ATXN1; (-) strand; PAM type: YTN; PAM sequence: TTT
aataaaaaaattttattaga

SEQ ID NO: 205541 - DNA, 20 bp, Artificial Sequence
  Description of Artificial Sequence: Synthetic oligonucleotide
  Target: ATXN1; (-) strand; PAM type: YTN; PAM sequence: TTA
aaaagagcaaaaaggtattt

SEQ ID NO: 205542 - DNA, 20 bp, Artificial Sequence
  Description of Artificial Sequence: Synthetic oligonucleotide
  Target: ATXN1; (-) strand; PAM type: YTN; PAM sequence: CTT
aaaaagagcaaaaaggtatt

SEQ ID NO: 205543 - DNA, 20 bp, Artificial Sequence
  Description of Artificial Sequence: Synthetic oligonucleotide
  Target: ATXN1; (-) strand; PAM type: YTN; PAM sequence: TTC
ttaaaaagagcaaaaaggta

SEQ ID NO: 205544 - DNA, 20 bp, Artificial Sequence
  Description of Artificial Sequence: Synthetic oligonucleotide
  Target: ATXN1; (-) strand; PAM type: YTN; PAM sequence: TTT
cttaaaaagagcaaaaaggt

SEQ ID NO: 205545 - DNA, 20 bp, Artificial Sequence
  Description of Artificial Sequence: Synthetic oligonucleotide
  Target: ATXN1; (-) strand; PAM type: YTN; PAM sequence: TTC
atttcttaaaaagagcaaaa

SEQ ID NO: 205546 - DNA, 20 bp, Artificial Sequence
  Description of Artificial Sequence: Synthetic oligonucleotide
  Target: ATXN1; (-) strand; PAM type: YTN; PAM sequence: TTT
catttcttaaaaagagcaaa

SEQ ID NO: 205547 - DNA, 20 bp, Artificial Sequence
  Description of Artificial Sequence: Synthetic oligonucleotide
  Target: ATXN1; (-) strand; PAM type: YTN; PAM sequence: TTT
tcatttcttaaaaagagcaa

SEQ ID NO: 205548 - DNA, 20 bp, Artificial Sequence
  Description of Artificial Sequence: Synthetic oligonucleotide
  Target: ATXN1; (-) strand; PAM type: YTN; PAM sequence: TTT
ttcatttcttaaaaagagca

SEQ ID NO: 205549 - DNA, 20 bp, Artificial Sequence
  Description of Artificial Sequence: Synthetic oligonucleotide
  Target: ATXN1; (-) strand; PAM type: YTN; PAM sequence: TTC
agtggaaagcataatttttc

SEQ ID NO: 205550 - DNA, 20 bp, Artificial Sequence
  Description of Artificial Sequence: Synthetic oligonucleotide
  Target: ATXN1; (-) strand; PAM type: YTN; PAM sequence: TTT
cagtggaaagcataattttt

SEQ ID NO: 205551 - DNA, 20 bp, Artificial Sequence
  Description of Artificial Sequence: Synthetic oligonucleotide
  Target: ATXN1; (-) strand; PAM type: YTN; PAM sequence: TTT
tcagtggaaagcataatttt

SEQ ID NO: 205552 - DNA, 20 bp, Artificial Sequence
  Description of Artificial Sequence: Synthetic oligonucleotide
  Target: ATXN1; (-) strand; PAM type: YTN; PAM sequence: TTT
ttcagtggaaagcataattt

SEQ ID NO: 205553 - DNA, 20 bp, Artificial Sequence
  Description of Artificial Sequence: Synthetic oligonucleotide
  Target: ATXN1; (-) strand; PAM type: YTN; PAM sequence: CTA
gatacaatcatttttcagtg

SEQ ID NO: 205554 - DNA, 20 bp, Artificial Sequence
  Description of Artificial Sequence: Synthetic oligonucleotide
  Target: ATXN1; (-) strand; PAM type: YTN; PAM sequence: CTA
tgaaatcactagatacaatc

SEQ ID NO: 205555 - DNA, 20 bp, Artificial Sequence
  Description of Artificial Sequence: Synthetic oligonucleotide
  Target: ATXN1; (-) strand; PAM type: YTN; PAM sequence: TTA
gacaactatgaaatcactag

SEQ ID NO: 205556 - DNA, 20 bp, Artificial Sequence
  Description of Artificial Sequence: Synthetic oligonucleotide
  Target: ATXN1; (-) strand; PAM type: YTN; PAM sequence: TTT
agacaactatgaaatcacta

SEQ ID NO: 205557 - DNA, 20 bp, Artificial Sequence
  Description of Artificial Sequence: Synthetic oligonucleotide
  Target: ATXN1; (-) strand; PAM type: YTN; PAM sequence: TTT
tagacaactatgaaatcact

SEQ ID NO: 205558 - DNA, 20 bp, Artificial Sequence
  Description of Artificial Sequence: Synthetic oligonucleotide
  Target: ATXN1; (-) strand; PAM type: YTN; PAM sequence: TTT
ttagacaactatgaaatcac

SEQ ID NO: 205559 - DNA, 20 bp, Artificial Sequence
  Description of Artificial Sequence: Synthetic oligonucleotide
  Target: ATXN1; (-) strand; PAM type: YTN; PAM sequence: CTG
gccaagtatttttagacaac

SEQ ID NO: 205560 - DNA, 20 bp, Artificial Sequence
  Description of Artificial Sequence: Synthetic oligonucleotide
  Target: ATXN1; (-) strand; PAM type: YTN; PAM sequence: TTC
tggccaagtatttttagaca

SEQ ID NO: 205561 - DNA, 20 bp, Artificial Sequence
  Description of Artificial Sequence: Synthetic oligonucleotide
  Target: ATXN1; (-) strand; PAM type: YTN; PAM sequence: TTT
ctggccaagtatttttagac

SEQ ID NO: 205562 - DNA, 20 bp, Artificial Sequence
  Description of Artificial Sequence: Synthetic oligonucleotide
  Target: ATXN1; (-) strand; PAM type: YTN; PAM sequence: CTT
tctggccaagtatttttaga

SEQ ID NO: 205563 - DNA, 20 bp, Artificial Sequence
  Description of Artificial Sequence: Synthetic oligonucleotide
  Target: ATXN1; (-) strand; PAM type: YTN; PAM sequence: TTC
ctttctggccaagtattttt

SEQ ID NO: 205564 - DNA, 20 bp, Artificial Sequence
  Description of Artificial Sequence: Synthetic oligonucleotide
  Target: ATXN1; (-) strand; PAM type: YTN; PAM sequence: CTT
cctttctggccaagtatttt

SEQ ID NO: 205565 - DNA, 20 bp, Artificial Sequence
  Description of Artificial Sequence: Synthetic oligonucleotide
  Target: ATXN1; (-) strand; PAM type: YTN; PAM sequence: TTC
ttcctttctggccaagtatt

SEQ ID NO: 205566 - DNA, 20 bp, Artificial Sequence
  Description of Artificial Sequence: Synthetic oligonucleotide
  Target: ATXN1; (-) strand; PAM type: YTN; PAM sequence: TTA
agttcttcctttctggccaa

SEQ ID NO: 205567 - DNA, 20 bp, Artificial Sequence
  Description of Artificial Sequence: Synthetic oligonucleotide
  Target: ATXN1; (-) strand; PAM type: YTN; PAM sequence: TTT
aagttcttcctttctggcca

SEQ ID NO: 205568 - DNA, 20 bp, Artificial Sequence
  Description of Artificial Sequence: Synthetic oligonucleotide
  Target: ATXN1; (-) strand; PAM type: YTN; PAM sequence: TTT
taagttcttcctttctggcc

SEQ ID NO: 205569 - DNA, 20 bp, Artificial Sequence
  Description of Artificial Sequence: Synthetic oligonucleotide
  Target: ATXN1; (-) strand; PAM type: YTN; PAM sequence: CTA
gggaattttaagttcttcct

SEQ ID NO: 205570 - DNA, 20 bp, Artificial Sequence
  Description of Artificial Sequence: Synthetic oligonucleotide
  Target: ATXN1; (-) strand; PAM type: YTN; PAM sequence: TTA
aatccagaaggagtagaagg

SEQ ID NO: 205571 - DNA, 20 bp, Artificial Sequence
  Description of Artificial Sequence: Synthetic oligonucleotide
  Target: ATXN1; (-) strand; PAM type: YTN; PAM sequence: TTC
agaaataatattaaatccag

SEQ ID NO: 205572 - DNA, 20 bp, Artificial Sequence
  Description of Artificial Sequence: Synthetic oligonucleotide
  Target: ATXN1; (-) strand; PAM type: YTN; PAM sequence: TTT
cagaaataatattaaatcca

SEQ ID NO: 205573 - DNA, 20 bp, Artificial Sequence
  Description of Artificial Sequence: Synthetic oligonucleotide
  Target: ATXN1; (-) strand; PAM type: YTN; PAM sequence: TTC
gacatttcagaaataatatt

SEQ ID NO: 205574 - DNA, 20 bp, Artificial Sequence
  Description of Artificial Sequence: Synthetic oligonucleotide
  Target: ATXN1; (-) strand; PAM type: YTN; PAM sequence: TTT
cgacatttcagaaataatat

SEQ ID NO: 205575 - DNA, 20 bp, Artificial Sequence
  Description of Artificial Sequence: Synthetic oligonucleotide
  Target: ATXN1; (-) strand; PAM type: YTN; PAM sequence: TTA
ccagatttcgacatttcaga

SEQ ID NO: 205576 - DNA, 20 bp, Artificial Sequence
  Description of Artificial Sequence: Synthetic oligonucleotide
  Target: ATXN1; (-) strand; PAM type: YTN; PAM sequence: CTT
accagatttcgacatttcag

SEQ ID NO: 205577 - DNA, 20 bp, Artificial Sequence
  Description of Artificial Sequence: Synthetic oligonucleotide
  Target: ATXN1; (-) strand; PAM type: YTN; PAM sequence: TTG
aaacttaccagatttcgaca

SEQ ID NO: 205578 - DNA, 20 bp, Artificial Sequence
  Description of Artificial Sequence: Synthetic oligonucleotide
  Target: ATXN1; (-) strand; PAM type: YTN; PAM sequence: CTT
gaaacttaccagatttcgac

SEQ ID NO: 205579 - DNA, 20 bp, Artificial Sequence
  Description of Artificial Sequence: Synthetic oligonucleotide
  Target: ATXN1; (-) strand; PAM type: YTN; PAM sequence: TTA
gacagcagcatccttgaaac

SEQ ID NO: 205580 - DNA, 20 bp, Artificial Sequence
  Description of Artificial Sequence: Synthetic oligonucleotide
  Target: ATXN1; (-) strand; PAM type: YTN; PAM sequence: CTC
cattagacagcagcatcctt

SEQ ID NO: 205581 - DNA, 20 bp, Artificial Sequence
  Description of Artificial Sequence: Synthetic oligonucleotide
  Target: ATXN1; (-) strand; PAM type: YTN; PAM sequence: TTC
ctccattagacagcagcatc

SEQ ID NO: 205582 - DNA, 20 bp, Artificial Sequence
  Description of Artificial Sequence: Synthetic oligonucleotide
  Target: ATXN1; (-) strand; PAM type: YTN; PAM sequence: CTT
cctccattagacagcagcat

SEQ ID NO: 205583 - DNA, 20 bp, Artificial Sequence
  Description of Artificial Sequence: Synthetic oligonucleotide
  Target: ATXN1; (-) strand; PAM type: YTN; PAM sequence: TTG
tagaaccttcctccattaga

SEQ ID NO: 205584 - DNA, 20 bp, Artificial Sequence
  Description of Artificial Sequence: Synthetic oligonucleotide
  Target: ATXN1; (-) strand; PAM type: YTN; PAM sequence: TTT
gtagaaccttcctccattag

SEQ ID NO: 205585 - DNA, 20 bp, Artificial Sequence
  Description of Artificial Sequence: Synthetic oligonucleotide
  Target: ATXN1; (-) strand; PAM type: YTN; PAM sequence: TTT
tgtagaaccttcctccatta

SEQ ID NO: 205586 - DNA, 20 bp, Artificial Sequence
  Description of Artificial Sequence: Synthetic oligonucleotide
  Target: ATXN1; (-) strand; PAM type: YTN; PAM sequence: CTG
ttttgtagaaccttcctcca

SEQ ID NO: 205587 - DNA, 20 bp, Artificial Sequence
  Description of Artificial Sequence: Synthetic oligonucleotide
  Target: ATXN1; (-) strand; PAM type: YTN; PAM sequence: TTG
tactgttttgtagaaccttc

SEQ ID NO: 205588 - DNA, 20 bp, Artificial Sequence
  Description of Artificial Sequence: Synthetic oligonucleotide
  Target: ATXN1; (-) strand; PAM type: YTN; PAM sequence: TTG
taagtcaagtaaattgtact

SEQ ID NO: 205589 - DNA, 20 bp, Artificial Sequence
  Description of Artificial Sequence: Synthetic oligonucleotide
  Target: ATXN1; (-) strand; PAM type: YTN; PAM sequence: TTT
gtaagtcaagtaaattgtac

SEQ ID NO: 205590 - DNA, 20 bp, Artificial Sequence
  Description of Artificial Sequence: Synthetic oligonucleotide
  Target: ATXN1; (-) strand; PAM type: YTN; PAM sequence: TTG
ggggtggggggggtcatttg

SEQ ID NO: 205591 - DNA, 20 bp, Artificial Sequence
  Description of Artificial Sequence: Synthetic oligonucleotide
  Target: ATXN1; (-) strand; PAM type: YTN; PAM sequence: TTT
gggggtggggggggtcattt

SEQ ID NO: 205592 - DNA, 20 bp, Artificial Sequence
  Description of Artificial Sequence: Synthetic oligonucleotide
  Target: ATXN1; (-) strand; PAM type: YTN; PAM sequence: TTT
tgggggtggggggggtcatt

SEQ ID NO: 205593 - DNA, 20 bp, Artificial Sequence
  Description of Artificial Sequence: Synthetic oligonucleotide
  Target: ATXN1; (-) strand; PAM type: YTN; PAM sequence: TTG
ggttttgggggtgggggggg

SEQ ID NO: 205594 - DNA, 20 bp, Artificial Sequence
  Description of Artificial Sequence: Synthetic oligonucleotide
  Target: ATXN1; (-) strand; PAM type: YTN; PAM sequence: TTT
gggttttgggggtggggggg

SEQ ID NO: 205595 - DNA, 20 bp, Artificial Sequence
  Description of Artificial Sequence: Synthetic oligonucleotide
  Target: ATXN1; (-) strand; PAM type: YTN; PAM sequence: TTT
tgggttttgggggtgggggg

SEQ ID NO: 205596 - DNA, 20 bp, Artificial Sequence
  Description of Artificial Sequence: Synthetic oligonucleotide
  Target: ATXN1; (-) strand; PAM type: YTN; PAM sequence: TTC
catgtattttgggttttggg

SEQ ID NO: 205597 - DNA, 20 bp, Artificial Sequence
  Description of Artificial Sequence: Synthetic oligonucleotide
  Target: ATXN1; (-) strand; PAM type: YTN; PAM sequence: TTT
ccatgtattttgggttttgg

SEQ ID NO: 205598 - DNA, 20 bp, Artificial Sequence
  Description of Artificial Sequence: Synthetic oligonucleotide
  Target: ATXN1; (-) strand; PAM type: YTN; PAM sequence: TTA
tgcaaaatggtgtttccatg

SEQ ID NO: 205599 - DNA, 20 bp, Artificial Sequence
  Description of Artificial Sequence: Synthetic oligonucleotide
  Target: ATXN1; (-) strand; PAM type: YTN; PAM sequence: CTG
attatgcaaaatggtgtttc

SEQ ID NO: 205600 - DNA, 20 bp, Artificial Sequence
  Description of Artificial Sequence: Synthetic oligonucleotide
  Target: ATXN1; (-) strand; PAM type: YTN; PAM sequence: CTG
actgattatgcaaaatggtg

SEQ ID NO: 205601 - DNA, 20 bp, Artificial Sequence
  Description of Artificial Sequence: Synthetic oligonucleotide
  Target: ATXN1; (-) strand; PAM type: YTN; PAM sequence: TTG
ctgactgattatgcaaaatg

SEQ ID NO: 205602 - DNA, 20 bp, Artificial Sequence
  Description of Artificial Sequence: Synthetic oligonucleotide
  Target: ATXN1; (-) strand; PAM type: YTN; PAM sequence: TTT
gctgactgattatgcaaaat

SEQ ID NO: 205603 - DNA, 20 bp, Artificial Sequence
  Description of Artificial Sequence: Synthetic oligonucleotide
  Target: ATXN1; (-) strand; PAM type: YTN; PAM sequence: TTT
tgctgactgattatgcaaaa

SEQ ID NO: 205604 - DNA, 20 bp, Artificial Sequence
  Description of Artificial Sequence: Synthetic oligonucleotide
  Target: ATXN1; (-) strand; PAM type: YTN; PAM sequence: TTT
ttgctgactgattatgcaaa

SEQ ID NO: 205605 - DNA, 20 bp, Artificial Sequence
  Description of Artificial Sequence: Synthetic oligonucleotide
  Target: ATXN1; (-) strand; PAM type: YTN; PAM sequence: TTT
tttgctgactgattatgcaa

SEQ ID NO: 205606 - DNA, 20 bp, Artificial Sequence
  Description of Artificial Sequence: Synthetic oligonucleotide
  Target: ATXN1; (-) strand; PAM type: YTN; PAM sequence: TTG
aaaacaaaaagagttttttg

SEQ ID NO: 205607 - DNA, 20 bp, Artificial Sequence
  Description of Artificial Sequence: Synthetic oligonucleotide
  Target: ATXN1; (-) strand; PAM type: YTN; PAM sequence: TTT
gaaaacaaaaagagtttttt

SEQ ID NO: 205608 - DNA, 20 bp, Artificial Sequence
  Description of Artificial Sequence: Synthetic oligonucleotide
  Target: ATXN1; (-) strand; PAM type: YTN; PAM sequence: TTT
tgaaaacaaaaagagttttt

SEQ ID NO: 205609 - DNA, 20 bp, Artificial Sequence
  Description of Artificial Sequence: Synthetic oligonucleotide
  Target: ATXN1; (-) strand; PAM type: YTN; PAM sequence: CTG
agaattttgaaaacaaaaag

SEQ ID NO: 205610 - DNA, 20 bp, Artificial Sequence
  Description of Artificial Sequence: Synthetic oligonucleotide
  Target: ATXN1; (-) strand; PAM type: YTN; PAM sequence: TTC
caatgctgagaattttgaaa

SEQ ID NO: 205611 - DNA, 20 bp, Artificial Sequence
  Description of Artificial Sequence: Synthetic oligonucleotide
  Target: ATXN1; (-) strand; PAM type: YTN; PAM sequence: TTT
ccaatgctgagaattttgaa

SEQ ID NO: 205612 - DNA, 20 bp, Artificial Sequence
  Description of Artificial Sequence: Synthetic oligonucleotide
  Target: ATXN1; (-) strand; PAM type: YTN; PAM sequence: TTT
tccaatgctgagaattttga

SEQ ID NO: 205613 - DNA, 20 bp, Artificial Sequence
  Description of Artificial Sequence: Synthetic oligonucleotide
  Target: ATXN1; (-) strand; PAM type: YTN; PAM sequence: TTA
atacagttttccaatgctga

SEQ ID NO: 205614 - DNA, 20 bp, Artificial Sequence
  Description of Artificial Sequence: Synthetic oligonucleotide
  Target: ATXN1; (-) strand; PAM type: YTN; PAM sequence: CTT
aatacagttttccaatgctg

SEQ ID NO: 205615 - DNA, 20 bp, Artificial Sequence
  Description of Artificial Sequence: Synthetic oligonucleotide
  Target: ATXN1; (-) strand; PAM type: YTN; PAM sequence: CTA
cttaatacagttttccaatg

SEQ ID NO: 205616 - DNA, 20 bp, Artificial Sequence
  Description of Artificial Sequence: Synthetic oligonucleotide
  Target: ATXN1; (-) strand; PAM type: YTN; PAM sequence: TTA
tgagagcgtctacttaatac

SEQ ID NO: 205617 - DNA, 20 bp, Artificial Sequence
  Description of Artificial Sequence: Synthetic oligonucleotide
  Target: ATXN1; (-) strand; PAM type: YTN; PAM sequence: TTT
atgagagcgtctacttaata

SEQ ID NO: 205618 - DNA, 20 bp, Artificial Sequence
  Description of Artificial Sequence: Synthetic oligonucleotide
  Target: ATXN1; (-) strand; PAM type: YTN; PAM sequence: TTC
cagaggcagtttatgagagc

SEQ ID NO: 205619 - DNA, 20 bp, Artificial Sequence
  Description of Artificial Sequence: Synthetic oligonucleotide
  Target: ATXN1; (-) strand; PAM type: YTN; PAM sequence: TTT
ccagaggcagtttatgagag

SEQ ID NO: 205620 - DNA, 20 bp, Artificial Sequence
  Description of Artificial Sequence: Synthetic oligonucleotide
  Target: ATXN1; (-) strand; PAM type: YTN; PAM sequence: TTG
tatttccagaggcagtttat

SEQ ID NO: 205621 - DNA, 20 bp, Artificial Sequence
  Description of Artificial Sequence: Synthetic oligonucleotide
  Target: ATXN1; (-) strand; PAM type: YTN; PAM sequence: TTT
gtatttccagaggcagttta

SEQ ID NO: 205622 - DNA, 20 bp, Artificial Sequence
  Description of Artificial Sequence: Synthetic oligonucleotide
  Target: ATXN1; (-) strand; PAM type: YTN; PAM sequence: TTC
agtaaagtcataccagtttg

SEQ ID NO: 205623 - DNA, 20 bp, Artificial Sequence
  Description of Artificial Sequence: Synthetic oligonucleotide
  Target: ATXN1; (-) strand; PAM type: YTN; PAM sequence: TTT
cagtaaagtcataccagttt

SEQ ID NO: 205624 - DNA, 20 bp, Artificial Sequence
  Description of Artificial Sequence: Synthetic oligonucleotide
  Target: ATXN1; (-) strand; PAM type: YTN; PAM sequence: CTT
tcagtaaagtcataccagtt

SEQ ID NO: 205625 - DNA, 20 bp, Artificial Sequence
  Description of Artificial Sequence: Synthetic oligonucleotide
  Target: ATXN1; (-) strand; PAM type: YTN; PAM sequence: TTA
ctttcagtaaagtcatacca

SEQ ID NO: 205626 - DNA, 20 bp, Artificial Sequence
  Description of Artificial Sequence: Synthetic oligonucleotide
  Target: ATXN1; (-) strand; PAM type: YTN; PAM sequence: TTG
ccaaattactttcagtaaag

SEQ ID NO: 205627 - DNA, 20 bp, Artificial Sequence
  Description of Artificial Sequence: Synthetic oligonucleotide
  Target: ATXN1; (-) strand; PAM type: YTN; PAM sequence: TTG
ttgccaaattactttcagta

SEQ ID NO: 205628 - DNA, 20 bp, Artificial Sequence
  Description of Artificial Sequence: Synthetic oligonucleotide
  Target: ATXN1; (-) strand; PAM type: YTN; PAM sequence: CTT
gttgccaaattactttcagt

SEQ ID NO: 205629 - DNA, 20 bp, Artificial Sequence
  Description of Artificial Sequence: Synthetic oligonucleotide
  Target: ATXN1; (-) strand; PAM type: YTN; PAM sequence: TTG
gtaacttgttgccaaattac

SEQ ID NO: 205630 - DNA, 20 bp, Artificial Sequence
  Description of Artificial Sequence: Synthetic oligonucleotide
  Target: ATXN1; (-) strand; PAM type: YTN; PAM sequence: TTT
ggtaacttgttgccaaatta

SEQ ID NO: 205631 - DNA, 20 bp, Artificial Sequence
  Description of Artificial Sequence: Synthetic oligonucleotide
  Target: ATXN1; (-) strand; PAM type: YTN; PAM sequence: TTT
tggtaacttgttgccaaatt

SEQ ID NO: 205632 - DNA, 20 bp, Artificial Sequence
  Description of Artificial Sequence: Synthetic oligonucleotide
  Target: ATXN1; (-) strand; PAM type: YTN; PAM sequence: CTT
ttggtaacttgttgccaaat

SEQ ID NO: 205633 - DNA, 20 bp, Artificial Sequence
  Description of Artificial Sequence: Synthetic oligonucleotide
  Target: ATXN1; (-) strand; PAM type: YTN; PAM sequence: TTA
cggcttttggtaacttgttg

SEQ ID NO: 205634 - DNA, 20 bp, Artificial Sequence
  Description of Artificial Sequence: Synthetic oligonucleotide
  Target: ATXN1; (-) strand; PAM type: YTN; PAM sequence: TTT
acggcttttggtaacttgtt

SEQ ID NO: 205635 - DNA, 20 bp, Artificial Sequence
  Description of Artificial Sequence: Synthetic oligonucleotide
  Target: ATXN1; (-) strand; PAM type: YTN; PAM sequence: TTT
tacggcttttggtaacttgt

SEQ ID NO: 205636 - DNA, 20 bp, Artificial Sequence
  Description of Artificial Sequence: Synthetic oligonucleotide
  Target: ATXN1; (-) strand; PAM type: YTN; PAM sequence: TTC
aagttttacggcttttggta

SEQ ID NO: 205637 - DNA, 20 bp, Artificial Sequence
  Description of Artificial Sequence: Synthetic oligonucleotide
  Target: ATXN1; (-) strand; PAM type: YTN; PAM sequence: TTT
caagttttacggcttttggt

SEQ ID NO: 205638 - DNA, 20 bp, Artificial Sequence
  Description of Artificial Sequence: Synthetic oligonucleotide
  Target: ATXN1; (-) strand; PAM type: YTN; PAM sequence: TTT
tcaagttttacggcttttgg

SEQ ID NO: 205639 - DNA, 20 bp, Artificial Sequence
  Description of Artificial Sequence: Synthetic oligonucleotide
  Target: ATXN1; (-) strand; PAM type: YTN; PAM sequence: CTG
gtaaatgtaagagttttcaa

SEQ ID NO: 205640 - DNA, 20 bp, Artificial Sequence
  Description of Artificial Sequence: Synthetic oligonucleotide
  Target: ATXN1; (-) strand; PAM type: YTN; PAM sequence: TTA
gcagcatactggtaaatgta

SEQ ID NO: 205641 - DNA, 20 bp, Artificial Sequence
  Description of Artificial Sequence: Synthetic oligonucleotide
  Target: ATXN1; (-) strand; PAM type: YTN; PAM sequence: CTT
agcagcatactggtaaatgt

SEQ ID NO: 205642 - DNA, 20 bp, Artificial Sequence
  Description of Artificial Sequence: Synthetic oligonucleotide
  Target: ATXN1; (-) strand; PAM type: YTN; PAM sequence: TTC
ttagcagcatactggtaaat

SEQ ID NO: 205643 - DNA, 20 bp, Artificial Sequence
  Description of Artificial Sequence: Synthetic oligonucleotide
  Target: ATXN1; (-) strand; PAM type: YTN; PAM sequence: TTT
cttagcagcatactggtaaa

SEQ ID NO: 205644 - DNA, 20 bp, Artificial Sequence
  Description of Artificial Sequence: Synthetic oligonucleotide
  Target: ATXN1; (-) strand; PAM type: YTN; PAM sequence: CTA
atttcttagcagcatactgg

SEQ ID NO: 205645 - DNA, 20 bp, Artificial Sequence
  Description of Artificial Sequence: Synthetic oligonucleotide
  Target: ATXN1; (-) strand; PAM type: YTN; PAM sequence: TTA
ggctaatttcttagcagcat

SEQ ID NO: 205646 - DNA, 20 bp, Artificial Sequence
  Description of Artificial Sequence: Synthetic oligonucleotide
  Target: ATXN1; (-) strand; PAM type: YTN; PAM sequence: CTT
aggctaatttcttagcagca

SEQ ID NO: 205647 - DNA, 20 bp, Artificial Sequence
  Description of Artificial Sequence: Synthetic oligonucleotide
  Target: ATXN1; (-) strand; PAM type: YTN; PAM sequence: TTC
cttaggctaatttcttagca

SEQ ID NO: 205648 - DNA, 20 bp, Artificial Sequence
  Description of Artificial Sequence: Synthetic oligonucleotide
  Target: ATXN1; (-) strand; PAM type: YTN; PAM sequence: TTT
ccttaggctaatttcttagc

SEQ ID NO: 205649 - DNA, 20 bp, Artificial Sequence
  Description of Artificial Sequence: Synthetic oligonucleotide
  Target: ATXN1; (-) strand; PAM type: YTN; PAM sequence: TTA
tttccttaggctaatttctt

SEQ ID NO: 205650 - DNA, 20 bp, Artificial Sequence
  Description of Artificial Sequence: Synthetic oligonucleotide
  Target: ATXN1; (-) strand; PAM type: YTN; PAM sequence: TTA
caaattatttccttaggcta

SEQ ID NO: 205651 - DNA, 20 bp, Artificial Sequence
  Description of Artificial Sequence: Synthetic oligonucleotide
  Target: ATXN1; (-) strand; PAM type: YTN; PAM sequence: TTC
ccattacaaattatttcctt

SEQ ID NO: 205652 - DNA, 20 bp, Artificial Sequence
  Description of Artificial Sequence: Synthetic oligonucleotide
  Target: ATXN1; (-) strand; PAM type: YTN; PAM sequence: TTA
gttcccattacaaattattt

SEQ ID NO: 205653 - DNA, 20 bp, Artificial Sequence
  Description of Artificial Sequence: Synthetic oligonucleotide
  Target: ATXN1; (-) strand; PAM type: YTN; PAM sequence: CTG
tattagttcccattacaaat

SEQ ID NO: 205654 - DNA, 20 bp, Artificial Sequence
  Description of Artificial Sequence: Synthetic oligonucleotide
  Target: ATXN1; (-) strand; PAM type: YTN; PAM sequence: CTC
tgtattagttcccattacaa

SEQ ID NO: 205655 - DNA, 20 bp, Artificial Sequence
  Description of Artificial Sequence: Synthetic oligonucleotide
  Target: ATXN1; (-) strand; PAM type: YTN; PAM sequence: TTA
tagctctgtattagttccca

SEQ ID NO: 205656 - DNA, 20 bp, Artificial Sequence
  Description of Artificial Sequence: Synthetic oligonucleotide
  Target: ATXN1; (-) strand; PAM type: YTN; PAM sequence: CTT
atagctctgtattagttccc

SEQ ID NO: 205657 - DNA, 20 bp, Artificial Sequence
  Description of Artificial Sequence: Synthetic oligonucleotide
  Target: ATXN1; (-) strand; PAM type: YTN; PAM sequence: TTC
ttatagctctgtattagttc

SEQ ID NO: 205658 - DNA, 20 bp, Artificial Sequence
  Description of Artificial Sequence: Synthetic oligonucleotide
  Target: ATXN1; (-) strand; PAM type: YTN; PAM sequence: TTC
atgatgccaaaaatattctt

SEQ ID NO: 205659 - DNA, 20 bp, Artificial Sequence
  Description of Artificial Sequence: Synthetic oligonucleotide
  Target: ATXN1; (-) strand; PAM type: YTN; PAM sequence: TTT
catgatgccaaaaatattct

SEQ ID NO: 205660 - DNA, 20 bp, Artificial Sequence
  Description of Artificial Sequence: Synthetic oligonucleotide
  Target: ATXN1; (-) strand; PAM type: YTN; PAM sequence: CTT
tcatgatgccaaaaatattc

SEQ ID NO: 205661 - DNA, 20 bp, Artificial Sequence
  Description of Artificial Sequence: Synthetic oligonucleotide
  Target: ATXN1; (-) strand; PAM type: YTN; PAM sequence: TTG
ctttcatgatgccaaaaata

SEQ ID NO: 205662 - DNA, 20 bp, Artificial Sequence
  Description of Artificial Sequence: Synthetic oligonucleotide
  Target: ATXN1; (-) strand; PAM type: YTN; PAM sequence: TTA
ttgctttcatgatgccaaaa

SEQ ID NO: 205663 - DNA, 20 bp, Artificial Sequence
  Description of Artificial Sequence: Synthetic oligonucleotide
  Target: ATXN1; (-) strand; PAM type: YTN; PAM sequence: TTT
attgctttcatgatgccaaa

SEQ ID NO: 205664 - DNA, 20 bp, Artificial Sequence
  Description of Artificial Sequence: Synthetic oligonucleotide
  Target: ATXN1; (-) strand; PAM type: YTN; PAM sequence: TTT
tattgctttcatgatgccaa

SEQ ID NO: 205665 - DNA, 20 bp, Artificial Sequence
  Description of Artificial Sequence: Synthetic oligonucleotide
  Target: ATXN1; (-) strand; PAM type: YTN; PAM sequence: TTA
caggcgtgatccaccacacc

SEQ ID NO: 205666 - DNA, 20 bp, Artificial Sequence
  Description of Artificial Sequence: Synthetic oligonucleotide
  Target: ATXN1; (-) strand; PAM type: YTN; PAM sequence: TTG
ggattacaggcgtgatccac

SEQ ID NO: 205667 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgttgggattacag

SEQ ID NO: 205668 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgttggga

SEQ ID NO: 205669 - DNA, 20 bp, Artificial Sequence
  Description of Artificial Sequence: Synthetic oligonucleotide
  Target: ATXN1; (-) strand; PAM type: YTN; PAM sequence: TTC
ccacctcagcctcccaaagt

SEQ ID NO: 205670 - DNA, 20 bp, Artificial Sequence
  Description of Artificial Sequence: Synthetic oligonucleotide
  Target: ATXN1; (-) strand; PAM type: YTN; PAM sequence: CTT
cccacctcagcctcccaaag

SEQ ID NO: 205671 - DNA, 20 bp, Artificial Sequence
  Description of Artificial Sequence: Synthetic oligonucleotide
  Target: ATXN1; (-) strand; PAM type: YTN; PAM sequence: CTC
aagcagtcttcccacctcag

SEQ ID NO: 205672 - DNA, 20 bp, Artificial Sequence
  Description of Artificial Sequence: Synthetic oligonucleotide
  Target: ATXN1; (-) strand; PAM type: YTN; PAM sequence: CTC
gtgacctcaagcagtcttcc

SEQ ID NO: 205673 - DNA, 20 bp, Artificial Sequence
  Description of Artificial Sequence: Synthetic oligonucleotide
  Target: ATXN1; (-) strand; PAM type: YTN; PAM sequence: CTC
aaactcgtgacctcaagcag

SEQ ID NO: 205674 - DNA, 20 bp, Artificial Sequence
  Description of Artificial Sequence: Synthetic oligonucleotide
  Target: ATXN1; (-) strand; PAM type: YTN; PAM sequence: CTG
gtctcaaactcgtgacctca

SEQ ID NO: 205675 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtctcaaactc

SEQ ID NO: 205676 - DNA, 20 bp, Artificial Sequence
  Description of Artificial Sequence: Synthetic oligonucleotide
  Target: ATXN1; (-) strand; PAM type: YTN; PAM sequence: TTG
ccatgttgcccaggctggtc

SEQ ID NO: 205677 - DNA, 20 bp, Artificial Sequence
  Description of Artificial Sequence: Synthetic oligonucleotide
  Target: ATXN1; (-) strand; PAM type: YTN; PAM sequence: TTT
gccatgttgcccaggctggt

SEQ ID NO: 205678 - DNA, 20 bp, Artificial Sequence
  Description of Artificial Sequence: Synthetic oligonucleotide
  Target: ATXN1; (-) strand; PAM type: YTN; PAM sequence: TTT
tgccatgttgcccaggctgg

SEQ ID NO: 205679 - DNA, 20 bp, Artificial Sequence
  Description of Artificial Sequence: Synthetic oligonucleotide
  Target: ATXN1; (-) strand; PAM type: YTN; PAM sequence: TTA
tatagtgatgaggttttgcc

SEQ ID NO: 205680 - DNA, 20 bp, Artificial Sequence
  Description of Artificial Sequence: Synthetic oligonucleotide
  Target: ATXN1; (-) strand; PAM type: YTN; PAM sequence: TTT
atatagtgatgaggttttgc

SEQ ID NO: 205681 - DNA, 20 bp, Artificial Sequence
  Description of Artificial Sequence: Synthetic oligonucleotide
  Target: ATXN1; (-) strand; PAM type: YTN; PAM sequence: TTT
tatatagtgatgaggttttg

SEQ ID NO: 205682 - DNA, 20 bp, Artificial Sequence
  Description of Artificial Sequence: Synthetic oligonucleotide
  Target: ATXN1; (-) strand; PAM type: YTN; PAM sequence: TTT
ttatatagtgatgaggtttt

SEQ ID NO: 205683 - DNA, 20 bp, Artificial Sequence
  Description of Artificial Sequence: Synthetic oligonucleotide
  Target: ATXN1; (-) strand; PAM type: YTN; PAM sequence: TTT
tttatatagtgatgaggttt

SEQ ID NO: 205684 - DNA, 20 bp, Artificial Sequence
  Description of Artificial Sequence: Synthetic oligonucleotide
  Target: ATXN1; (-) strand; PAM type: YTN; PAM sequence: TTT
ttttatatagtgatgaggtt

SEQ ID NO: 205685 - DNA, 20 bp, Artificial Sequence
  Description of Artificial Sequence: Synthetic oligonucleotide
  Target: ATXN1; (-) strand; PAM type: YTN; PAM sequence: TTT
tttttatatagtgatgaggt

SEQ ID NO: 205686 - DNA, 20 bp, Artificial Sequence
  Description of Artificial Sequence: Synthetic oligonucleotide
  Target: ATXN1; (-) strand; PAM type: YTN; PAM sequence: TTT
ttttttatatagtgatgagg

SEQ ID NO: 205687 - DNA, 20 bp, Artificial Sequence
  Description of Artificial Sequence: Synthetic oligonucleotide
  Target: ATXN1; (-) strand; PAM type: YTN; PAM sequence: TTT
tttttttatatagtgatgag

SEQ ID NO: 205688 - DNA, 20 bp, Artificial Sequence
  Description of Artificial Sequence: Synthetic oligonucleotide
  Target: ATXN1; (-) strand; PAM type: YTN; PAM sequence: TTT
ttttttttatatagtgatga

SEQ ID NO: 205689 - DNA, 20 bp, Artificial Sequence
  Description of Artificial Sequence: Synthetic oligonucleotide
  Target: ATXN1; (-) strand; PAM type: YTN; PAM sequence: TTT
tttttttttatatagtgatg

SEQ ID NO: 205690 - DNA, 20 bp, Artificial Sequence
  Description of Artificial Sequence: Synthetic oligonucleotide
  Target: ATXN1; (-) strand; PAM type: YTN; PAM sequence: TTG
tattttttttttttatatag

SEQ ID NO: 205691 - DNA, 20 bp, Artificial Sequence
  Description of Artificial Sequence: Synthetic oligonucleotide
  Target: ATXN1; (-) strand; PAM type: YTN; PAM sequence: TTT
gtattttttttttttatata

SEQ ID NO: 205692 - DNA, 20 bp, Artificial Sequence
  Description of Artificial Sequence: Synthetic oligonucleotide
  Target: ATXN1; (-) strand; PAM type: YTN; PAM sequence: TTT
tgtattttttttttttatat

SEQ ID NO: 205693 - DNA, 20 bp, Artificial Sequence
  Description of Artificial Sequence: Synthetic oligonucleotide
  Target: ATXN1; (-) strand; PAM type: YTN; PAM sequence: CTT
ttgtattttttttttttata

SEQ ID NO: 205694 - DNA, 20 bp, Artificial Sequence
  Description of Artificial Sequence: Synthetic oligonucleotide
  Target: ATXN1; (-) strand; PAM type: YTN; PAM sequence: CTA
acttttgtattttttttttt

SEQ ID NO: 205695 - DNA, 20 bp, Artificial Sequence
  Description of Artificial Sequence: Synthetic oligonucleotide
  Target: ATXN1; (-) strand; PAM type: YTN; PAM sequence: CTG
gctaacttttgtattttttt

SEQ ID NO: 205696 - DNA, 20 bp, Artificial Sequence
  Description of Artificial Sequence: Synthetic oligonucleotide
  Target: ATXN1; (-) strand; PAM type: YTN; PAM sequence: CTA
caggtgcacatcaccatgcc

SEQ ID NO: 205697 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcacatcac

SEQ ID NO: 205698 - DNA, 20 bp, Artificial Sequence
  Description of Artificial Sequence: Synthetic oligonucleotide
  Target: ATXN1; (-) strand; PAM type: YTN; PAM sequence: TTA
atagctgggactacaggtgc

SEQ ID NO: 205699 - DNA, 20 bp, Artificial Sequence
  Description of Artificial Sequence: Synthetic oligonucleotide
  Target: ATXN1; (-) strand; PAM type: YTN; PAM sequence: CTC
ccaagtattaatagctggga

SEQ ID NO: 205700 - DNA, 20 bp, Artificial Sequence
  Description of Artificial Sequence: Synthetic oligonucleotide
  Target: ATXN1; (-) strand; PAM type: YTN; PAM sequence: CTC
agcctcccaagtattaatag

SEQ ID NO: 205701 - DNA, 20 bp, Artificial Sequence
  Description of Artificial Sequence: Synthetic oligonucleotide
  Target: ATXN1; (-) strand; PAM type: YTN; PAM sequence: CTC
ccacctcagcctcccaagta

SEQ ID NO: 205702 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctcccacctcag

SEQ ID NO: 205703 - DNA, 20 bp, Artificial Sequence
  Description of Artificial Sequence: Synthetic oligonucleotide
  Target: ATXN1; (-) strand; PAM type: YTN; PAM sequence: CTC
caaggctcaagtgatcctcc

SEQ ID NO: 205704 - DNA, 20 bp, Artificial Sequence
  Description of Artificial Sequence: Synthetic oligonucleotide
  Target: ATXN1; (-) strand; PAM type: YTN; PAM sequence: TTC
cacctccaaggctcaagtga

SEQ ID NO: 205705 - DNA, 20 bp, Artificial Sequence
  Description of Artificial Sequence: Synthetic oligonucleotide
  Target: ATXN1; (-) strand; PAM type: YTN; PAM sequence: CTT
ccacctccaaggctcaagtg

SEQ ID NO: 205706 - DNA, 20 bp, Artificial Sequence
  Description of Artificial Sequence: Synthetic oligonucleotide
  Target: ATXN1; (-) strand; PAM type: YTN; PAM sequence: TTG
cagcttccacctccaaggct

SEQ ID NO: 205707 - DNA, 20 bp, Artificial Sequence
  Description of Artificial Sequence: Synthetic oligonucleotide
  Target: ATXN1; (-) strand; PAM type: YTN; PAM sequence: CTC
attgcagcttccacctccaa

SEQ ID NO: 205708 - DNA, 20 bp, Artificial Sequence
  Description of Artificial Sequence: Synthetic oligonucleotide
  Target: ATXN1; (-) strand; PAM type: YTN; PAM sequence: TTG
gctcattgcagcttccacct

SEQ ID NO: 205709 - DNA, 20 bp, Artificial Sequence
  Description of Artificial Sequence: Synthetic oligonucleotide
  Target: ATXN1; (-) strand; PAM type: YTN; PAM sequence: TTT
ggctcattgcagcttccacc

SEQ ID NO: 205710 - DNA, 20 bp, Artificial Sequence
  Description of Artificial Sequence: Synthetic oligonucleotide
  Target: ATXN1; (-) strand; PAM type: YTN; PAM sequence: TTT
tggctcattgcagcttccac

SEQ ID NO: 205711 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatttt

SEQ ID NO: 205712 - DNA, 20 bp, Artificial Sequence
  Description of Artificial Sequence: Synthetic oligonucleotide
  Target: ATXN1; (-) strand; PAM type: YTN; PAM sequence: CTG
tcacccaggctggagtgcag

SEQ ID NO: 205713 - DNA, 20 bp, Artificial Sequence
  Description of Artificial Sequence: Synthetic oligonucleotide
  Target: ATXN1; (-) strand; PAM type: YTN; PAM sequence: CTC
tgtcacccaggctggagtgc

SEQ ID NO: 205714 - DNA, 20 bp, Artificial Sequence
  Description of Artificial Sequence: Synthetic oligonucleotide
  Target: ATXN1; (-) strand; PAM type: YTN; PAM sequence: CTC
actctgtcacccaggctgga

SEQ ID NO: 205715 - DNA, 20 bp, Artificial Sequence
  Description of Artificial Sequence: Synthetic oligonucleotide
  Target: ATXN1; (-) strand; PAM type: YTN; PAM sequence: TTG
agatagggtctcactctgtc

SEQ ID NO: 205716 - DNA, 20 bp, Artificial Sequence
  Description of Artificial Sequence: Synthetic oligonucleotide
  Target: ATXN1; (-) strand; PAM type: YTN; PAM sequence: CTT
gagatagggtctcactctgt

SEQ ID NO: 205717 - DNA, 20 bp, Artificial Sequence
  Description of Artificial Sequence: Synthetic oligonucleotide
  Target: ATXN1; (-) strand; PAM type: YTN; PAM sequence: TTC
ttgagatagggtctcactct

SEQ ID NO: 205718 - DNA, 20 bp, Artificial Sequence
  Description of Artificial Sequence: Synthetic oligonucleotide
  Target: ATXN1; (-) strand; PAM type: YTN; PAM sequence: TTT
cttgagatagggtctcactc

SEQ ID NO: 205719 - DNA, 20 bp, Artificial Sequence
  Description of Artificial Sequence: Synthetic oligonucleotide
  Target: ATXN1; (-) strand; PAM type: YTN; PAM sequence: TTT
tcttgagatagggtctcact

SEQ ID NO: 205720 - DNA, 20 bp, Artificial Sequence
  Description of Artificial Sequence: Synthetic oligonucleotide
  Target: ATXN1; (-) strand; PAM type: YTN; PAM sequence: TTA
ttttcttgagatagggtctc

SEQ ID NO: 205721 - DNA, 20 bp, Artificial Sequence
  Description of Artificial Sequence: Synthetic oligonucleotide
  Target: ATXN1; (-) strand; PAM type: YTN; PAM sequence: TTT
attttcttgagatagggtct

SEQ ID NO: 205722 - DNA, 20 bp, Artificial Sequence
  Description of Artificial Sequence: Synthetic oligonucleotide
  Target: ATXN1; (-) strand; PAM type: YTN; PAM sequence: TTT
tattttcttgagatagggtc

SEQ ID NO: 205723 - DNA, 20 bp, Artificial Sequence
  Description of Artificial Sequence: Synthetic oligonucleotide
  Target: ATXN1; (-) strand; PAM type: YTN; PAM sequence: TTT
ttattttcttgagatagggt

SEQ ID NO: 205724 - DNA, 20 bp, Artificial Sequence
  Description of Artificial Sequence: Synthetic oligonucleotide
  Target: ATXN1; (-) strand; PAM type: YTN; PAM sequence: CTT
tttattttcttgagataggg

SEQ ID NO: 205725 - DNA, 20 bp, Artificial Sequence
  Description of Artificial Sequence: Synthetic oligonucleotide
  Target: ATXN1; (-) strand; PAM type: YTN; PAM sequence: TTG
cctttttattttcttgagat

SEQ ID NO: 205726 - DNA, 20 bp, Artificial Sequence
  Description of Artificial Sequence: Synthetic oligonucleotide
  Target: ATXN1; (-) strand; PAM type: YTN; PAM sequence: TTT
gcctttttattttcttgaga

SEQ ID NO: 205727 - DNA, 20 bp, Artificial Sequence
  Description of Artificial Sequence: Synthetic oligonucleotide
  Target: ATXN1; (-) strand; PAM type: YTN; PAM sequence: TTT
tgcctttttattttcttgag

SEQ ID NO: 205728 - DNA, 20 bp, Artificial Sequence
  Description of Artificial Sequence: Synthetic oligonucleotide
  Target: ATXN1; (-) strand; PAM type: YTN; PAM sequence: TTT
ttgcctttttattttcttga

SEQ ID NO: 205729 - DNA, 20 bp, Artificial Sequence
  Description of Artificial Sequence: Synthetic oligonucleotide
  Target: ATXN1; (-) strand; PAM type: YTN; PAM sequence: TTT
tttgcctttttattttcttg

SEQ ID NO: 205730 - DNA, 20 bp, Artificial Sequence
  Description of Artificial Sequence: Synthetic oligonucleotide
  Target: ATXN1; (-) strand; PAM type: YTN; PAM sequence: TTT
ttttgcctttttattttctt

SEQ ID NO: 205731 - DNA, 20 bp, Artificial Sequence
  Description of Artificial Sequence: Synthetic oligonucleotide
  Target: ATXN1; (-) strand; PAM type: YTN; PAM sequence: CTA
atttttttgcctttttattt

SEQ ID NO: 205732 - DNA, 20 bp, Artificial Sequence
  Description of Artificial Sequence: Synthetic oligonucleotide
  Target: ATXN1; (-) strand; PAM type: YTN; PAM sequence: TTC
taatttttttgcctttttat

SEQ ID NO: 205733 - DNA, 20 bp, Artificial Sequence
  Description of Artificial Sequence: Synthetic oligonucleotide
  Target: ATXN1; (-) strand; PAM type: YTN; PAM sequence: TTT
ctaatttttttgccttttta

SEQ ID NO: 205734 - DNA, 20 bp, Artificial Sequence
  Description of Artificial Sequence: Synthetic oligonucleotide
  Target: ATXN1; (-) strand; PAM type: YTN; PAM sequence: TTA
gccgtttctaatttttttgc

SEQ ID NO: 205735 - DNA, 20 bp, Artificial Sequence
  Description of Artificial Sequence: Synthetic oligonucleotide
  Target: ATXN1; (-) strand; PAM type: YTN; PAM sequence: CTG
gacagttagccgtttctaat

SEQ ID NO: 205736 - DNA, 20 bp, Artificial Sequence
  Description of Artificial Sequence: Synthetic oligonucleotide
  Target: ATXN1; (-) strand; PAM type: YTN; PAM sequence: CTA
actggacagttagccgtttc

SEQ ID NO: 205737 - DNA, 20 bp, Artificial Sequence
  Description of Artificial Sequence: Synthetic oligonucleotide
  Target: ATXN1; (-) strand; PAM type: YTN; PAM sequence: TTC
taactggacagttagccgtt

SEQ ID NO: 205738 - DNA, 20 bp, Artificial Sequence
  Description of Artificial Sequence: Synthetic oligonucleotide
  Target: ATXN1; (-) strand; PAM type: YTN; PAM sequence: CTT
ctaactggacagttagccgt

SEQ ID NO: 205739 - DNA, 20 bp, Artificial Sequence
  Description of Artificial Sequence: Synthetic oligonucleotide
  Target: ATXN1; (-) strand; PAM type: YTN; PAM sequence: TTA
tatcccttctaactggacag

SEQ ID NO: 205740 - DNA, 20 bp, Artificial Sequence
  Description of Artificial Sequence: Synthetic oligonucleotide
  Target: ATXN1; (-) strand; PAM type: YTN; PAM sequence: TTT
atatcccttctaactggaca

SEQ ID NO: 205741 - DNA, 20 bp, Artificial Sequence
  Description of Artificial Sequence: Synthetic oligonucleotide
  Target: ATXN1; (-) strand; PAM type: YTN; PAM sequence: TTA
atttatatcccttctaactg

SEQ ID NO: 205742 - DNA, 20 bp, Artificial Sequence
  Description of Artificial Sequence: Synthetic oligonucleotide
  Target: ATXN1; (-) strand; PAM type: YTN; PAM sequence: TTT
aatttatatcccttctaact

SEQ ID NO: 205743 - DNA, 20 bp, Artificial Sequence
  Description of Artificial Sequence: Synthetic oligonucleotide
  Target: ATXN1; (-) strand; PAM type: YTN; PAM sequence: TTA
tttaatttatatcccttcta

SEQ ID NO: 205744 - DNA, 20 bp, Artificial Sequence
  Description of Artificial Sequence: Synthetic oligonucleotide
  Target: ATXN1; (-) strand; PAM type: YTN; PAM sequence: TTT
atttaatttatatcccttct

SEQ ID NO: 205745 - DNA, 20 bp, Artificial Sequence
  Description of Artificial Sequence: Synthetic oligonucleotide
  Target: ATXN1; (-) strand; PAM type: YTN; PAM sequence: CTA
aaatttatttaatttatatc

SEQ ID NO: 205746 - DNA, 20 bp, Artificial Sequence
  Description of Artificial Sequence: Synthetic oligonucleotide
  Target: ATXN1; (-) strand; PAM type: YTN; PAM sequence: TTC
taaaatttatttaatttata

SEQ ID NO: 205747 - DNA, 20 bp, Artificial Sequence
  Description of Artificial Sequence: Synthetic oligonucleotide
  Target: ATXN1; (-) strand; PAM type: YTN; PAM sequence: TTG
agtaaacattctaaaattta

SEQ ID NO: 205748 - DNA, 20 bp, Artificial Sequence
  Description of Artificial Sequence: Synthetic oligonucleotide
  Target: ATXN1; (-) strand; PAM type: YTN; PAM sequence: TTA
gtataccattgagtaaacat

SEQ ID NO: 205749 - DNA, 20 bp, Artificial Sequence
  Description of Artificial Sequence: Synthetic oligonucleotide
  Target: ATXN1; (-) strand; PAM type: YTN; PAM sequence: TTA
atgattagtataccattgag

SEQ ID NO: 205750 - DNA, 20 bp, Artificial Sequence
  Description of Artificial Sequence: Synthetic oligonucleotide
  Target: ATXN1; (-) strand; PAM type: YTN; PAM sequence: TTA
ttaatgattagtataccatt

SEQ ID NO: 205751 - DNA, 20 bp, Artificial Sequence
  Description of Artificial Sequence: Synthetic oligonucleotide
  Target: ATXN1; (-) strand; PAM type: YTN; PAM sequence: CTA
ccgtatagttattaatgatt

SEQ ID NO: 205752 - DNA, 20 bp, Artificial Sequence
  Description of Artificial Sequence: Synthetic oligonucleotide
  Target: ATXN1; (-) strand; PAM type: YTN; PAM sequence: TTC
taccgtatagttattaatga

SEQ ID NO: 205753 - DNA, 20 bp, Artificial Sequence
  Description of Artificial Sequence: Synthetic oligonucleotide
  Target: ATXN1; (-) strand; PAM type: YTN; PAM sequence: TTT
ctaccgtatagttattaatg

SEQ ID NO: 205754 - DNA, 20 bp, Artificial Sequence
  Description of Artificial Sequence: Synthetic oligonucleotide
  Target: ATXN1; (-) strand; PAM type: YTN; PAM sequence: TTT
tctaccgtatagttattaat

SEQ ID NO: 205755 - DNA, 20 bp, Artificial Sequence
  Description of Artificial Sequence: Synthetic oligonucleotide
  Target: ATXN1; (-) strand; PAM type: YTN; PAM sequence: TTT
ttctaccgtatagttattaa

SEQ ID NO: 205756 - DNA, 20 bp, Artificial Sequence
  Description of Artificial Sequence: Synthetic oligonucleotide
  Target: ATXN1; (-) strand; PAM type: YTN; PAM sequence: TTC
atagcaacagatatttttct

SEQ ID NO: 205757 - DNA, 20 bp, Artificial Sequence
  Description of Artificial Sequence: Synthetic oligonucleotide
  Target: ATXN1; (-) strand; PAM type: YTN; PAM sequence: TTT
catagcaacagatatttttc

SEQ ID NO: 205758 - DNA, 20 bp, Artificial Sequence
  Description of Artificial Sequence: Synthetic oligonucleotide
  Target: ATXN1; (-) strand; PAM type: YTN; PAM sequence: CTT
tcatagcaacagatattttt

SEQ ID NO: 205759 - DNA, 20 bp, Artificial Sequence
  Description of Artificial Sequence: Synthetic oligonucleotide
  Target: ATXN1; (-) strand; PAM type: YTN; PAM sequence: CTG
aacatctttcatagcaacag

SEQ ID NO: 205760 - DNA, 20 bp, Artificial Sequence
  Description of Artificial Sequence: Synthetic oligonucleotide
  Target: ATXN1; (-) strand; PAM type: YTN; PAM sequence: TTC
tgaacatctttcatagcaac

SEQ ID NO: 205761 - DNA, 20 bp, Artificial Sequence
  Description of Artificial Sequence: Synthetic oligonucleotide
  Target: ATXN1; (-) strand; PAM type: YTN; PAM sequence: TTA
acaatataattctgaacatc

SEQ ID NO: 205762 - DNA, 20 bp, Artificial Sequence
  Description of Artificial Sequence: Synthetic oligonucleotide
  Target: ATXN1; (-) strand; PAM type: YTN; PAM sequence: CTT
aacaatataattctgaacat

SEQ ID NO: 205763 - DNA, 20 bp, Artificial Sequence
  Description of Artificial Sequence: Synthetic oligonucleotide
  Target: ATXN1; (-) strand; PAM type: YTN; PAM sequence: CTC
ttaacaatataattctgaac

SEQ ID NO: 205764 - DNA, 20 bp, Artificial Sequence
  Description of Artificial Sequence: Synthetic oligonucleotide
  Target: ATXN1; (-) strand; PAM type: YTN; PAM sequence: TTC
ctcttaacaatataattctg

SEQ ID NO: 205765 - DNA, 20 bp, Artificial Sequence
  Description of Artificial Sequence: Synthetic oligonucleotide
  Target: ATXN1; (-) strand; PAM type: YTN; PAM sequence: TTG
ttcctcttaacaatataatt

SEQ ID NO: 205766 - DNA, 20 bp, Artificial Sequence
  Description of Artificial Sequence: Synthetic oligonucleotide
  Target: ATXN1; (-) strand; PAM type: YTN; PAM sequence: TTA
agagtattgttcctcttaac

SEQ ID NO: 205767 - DNA, 20 bp, Artificial Sequence
  Description of Artificial Sequence: Synthetic oligonucleotide
  Target: ATXN1; (-) strand; PAM type: YTN; PAM sequence: TTA
ttaagagtattgttcctctt

SEQ ID NO: 205768 - DNA, 20 bp, Artificial Sequence
  Description of Artificial Sequence: Synthetic oligonucleotide
  Target: ATXN1; (-) strand; PAM type: YTN; PAM sequence: TTG
tagaagtagtagagattatt

SEQ ID NO: 205769 - DNA, 20 bp, Artificial Sequence
  Description of Artificial Sequence: Synthetic oligonucleotide
  Target: ATXN1; (-) strand; PAM type: YTN; PAM sequence: TTA
gagagacaaacatcaaatgg

SEQ ID NO: 205770 - DNA, 20 bp, Artificial Sequence
  Description of Artificial Sequence: Synthetic oligonucleotide
  Target: ATXN1; (-) strand; PAM type: YTN; PAM sequence: CTT
agagagacaaacatcaaatg

SEQ ID NO: 205771 - DNA, 20 bp, Artificial Sequence
  Description of Artificial Sequence: Synthetic oligonucleotide
  Target: ATXN1; (-) strand; PAM type: YTN; PAM sequence: TTC
acttagagagacaaacatca

SEQ ID NO: 205772 - DNA, 20 bp, Artificial Sequence
  Description of Artificial Sequence: Synthetic oligonucleotide
  Target: ATXN1; (-) strand; PAM type: YTN; PAM sequence: TTA
taaattcacttagagagaca

SEQ ID NO: 205773 - DNA, 20 bp, Artificial Sequence
  Description of Artificial Sequence: Synthetic oligonucleotide
  Target: ATXN1; (-) strand; PAM type: YTN; PAM sequence: TTT
ataaattcacttagagagac

SEQ ID NO: 205774 - DNA, 20 bp, Artificial Sequence
  Description of Artificial Sequence: Synthetic oligonucleotide
  Target: ATXN1; (-) strand; PAM type: YTN; PAM sequence: TTA
tagatttataaattcactta

SEQ ID NO: 205775 - DNA, 20 bp, Artificial Sequence
  Description of Artificial Sequence: Synthetic oligonucleotide
  Target: ATXN1; (-) strand; PAM type: YTN; PAM sequence: TTT
atagatttataaattcactt

SEQ ID NO: 205776 - DNA, 20 bp, Artificial Sequence
  Description of Artificial Sequence: Synthetic oligonucleotide
  Target: ATXN1; (-) strand; PAM type: YTN; PAM sequence: TTA
taaatttatagatttataaa

SEQ ID NO: 205777 - DNA, 20 bp, Artificial Sequence
  Description of Artificial Sequence: Synthetic oligonucleotide
  Target: ATXN1; (-) strand; PAM type: YTN; PAM sequence: TTT
ataaatttatagatttataa

SEQ ID NO: 205778 - DNA, 20 bp, Artificial Sequence
  Description of Artificial Sequence: Synthetic oligonucleotide
  Target: ATXN1; (-) strand; PAM type: YTN; PAM sequence: CTG
aaggcatttataaatttata

SEQ ID NO: 205779 - DNA, 20 bp, Artificial Sequence
  Description of Artificial Sequence: Synthetic oligonucleotide
  Target: ATXN1; (-) strand; PAM type: YTN; PAM sequence: TTC
tgaaggcatttataaattta

SEQ ID NO: 205780 - DNA, 20 bp, Artificial Sequence
  Description of Artificial Sequence: Synthetic oligonucleotide
  Target: ATXN1; (-) strand; PAM type: YTN; PAM sequence: CTG
ataattctgaaggcatttat

SEQ ID NO: 205781 - DNA, 20 bp, Artificial Sequence
  Description of Artificial Sequence: Synthetic oligonucleotide
  Target: ATXN1; (-) strand; PAM type: YTN; PAM sequence: TTG
ctgataattctgaaggcatt

SEQ ID NO: 205782 - DNA, 20 bp, Artificial Sequence
  Description of Artificial Sequence: Synthetic oligonucleotide
  Target: ATXN1; (-) strand; PAM type: YTN; PAM sequence: TTA
ggatagatgacaaggcattg

SEQ ID NO: 205783 - DNA, 20 bp, Artificial Sequence
  Description of Artificial Sequence: Synthetic oligonucleotide
  Target: ATXN1; (-) strand; PAM type: YTN; PAM sequence: CTA
gttaggatagatgacaaggc

SEQ ID NO: 205784 - DNA, 20 bp, Artificial Sequence
  Description of Artificial Sequence: Synthetic oligonucleotide
  Target: ATXN1; (-) strand; PAM type: YTN; PAM sequence: TTG
aggtcactagttaggataga

SEQ ID NO: 205785 - DNA, 20 bp, Artificial Sequence
  Description of Artificial Sequence: Synthetic oligonucleotide
  Target: ATXN1; (-) strand; PAM type: YTN; PAM sequence: TTT
gaggtcactagttaggatag

SEQ ID NO: 205786 - DNA, 20 bp, Artificial Sequence
  Description of Artificial Sequence: Synthetic oligonucleotide
  Target: ATXN1; (-) strand; PAM type: YTN; PAM sequence: TTT
tgaggtcactagttaggata

SEQ ID NO: 205787 - DNA, 20 bp, Artificial Sequence
  Description of Artificial Sequence: Synthetic oligonucleotide
  Target: ATXN1; (-) strand; PAM type: YTN; PAM sequence: TTA
ttttgaggtcactagttagg

SEQ ID NO: 205788 - DNA, 20 bp, Artificial Sequence
  Description of Artificial Sequence: Synthetic oligonucleotide
  Target: ATXN1; (-) strand; PAM type: YTN; PAM sequence: CTT
attttgaggtcactagttag

SEQ ID NO: 205789 - DNA, 20 bp, Artificial Sequence
  Description of Artificial Sequence: Synthetic oligonucleotide
  Target: ATXN1; (-) strand; PAM type: YTN; PAM sequence: CTA
cttattttgaggtcactagt

SEQ ID NO: 205790 - DNA, 20 bp, Artificial Sequence
  Description of Artificial Sequence: Synthetic oligonucleotide
  Target: ATXN1; (-) strand; PAM type: YTN; PAM sequence: TTC
tacttattttgaggtcacta

SEQ ID NO: 205791 - DNA, 20 bp, Artificial Sequence
  Description of Artificial Sequence: Synthetic oligonucleotide
  Target: ATXN1; (-) strand; PAM type: YTN; PAM sequence: CTT
ctacttattttgaggtcact

SEQ ID NO: 205792 - DNA, 20 bp, Artificial Sequence
  Description of Artificial Sequence: Synthetic oligonucleotide
  Target: ATXN1; (-) strand; PAM type: YTN; PAM sequence: TTA
tgggaaaggaaataacttct

SEQ ID NO: 205793 - DNA, 20 bp, Artificial Sequence
  Description of Artificial Sequence: Synthetic oligonucleotide
  Target: ATXN1; (-) strand; PAM type: YTN; PAM sequence: TTT
atgggaaaggaaataacttc

SEQ ID NO: 205794 - DNA, 20 bp, Artificial Sequence
  Description of Artificial Sequence: Synthetic oligonucleotide
  Target: ATXN1; (-) strand; PAM type: YTN; PAM sequence: TTT
tatgggaaaggaaataactt

SEQ ID NO: 205795 - DNA, 20 bp, Artificial Sequence
  Description of Artificial Sequence: Synthetic oligonucleotide
  Target: ATXN1; (-) strand; PAM type: YTN; PAM sequence: TTT
ttatgggaaaggaaataact

SEQ ID NO: 205796 - DNA, 20 bp, Artificial Sequence
  Description of Artificial Sequence: Synthetic oligonucleotide
  Target: ATXN1; (-) strand; PAM type: YTN; PAM sequence: TTT
tttatgggaaaggaaataac

SEQ ID NO: 205797 - DNA, 20 bp, Artificial Sequence
  Description of Artificial Sequence: Synthetic oligonucleotide
  Target: ATXN1; (-) strand; PAM type: YTN; PAM sequence: CTT
ttttatgggaaaggaaataa

SEQ ID NO: 205798 - DNA, 20 bp, Artificial Sequence
  Description of Artificial Sequence: Synthetic oligonucleotide
  Target: ATXN1; (-) strand; PAM type: YTN; PAM sequence: TTG
cttttttatgggaaaggaaa

SEQ ID NO: 205799 - DNA, 20 bp, Artificial Sequence
  Description of Artificial Sequence: Synthetic oligonucleotide
  Target: ATXN1; (-) strand; PAM type: YTN; PAM sequence: CTT
gcttttttatgggaaaggaa

SEQ ID NO: 205800 - DNA, 20 bp, Artificial Sequence
  Description of Artificial Sequence: Synthetic oligonucleotide
  Target: ATXN1; (-) strand; PAM type: YTN; PAM sequence: TTA
taaaaatggaacccttgctt

SEQ ID NO: 205801 - DNA, 20 bp, Artificial Sequence
  Description of Artificial Sequence: Synthetic oligonucleotide
  Target: ATXN1; (-) strand; PAM type: YTN; PAM sequence: TTT
ataaaaatggaacccttgct

SEQ ID NO: 205802 - DNA, 20 bp, Artificial Sequence
  Description of Artificial Sequence: Synthetic oligonucleotide
  Target: ATXN1; (-) strand; PAM type: YTN; PAM sequence: TTT
tataaaaatggaacccttgc

SEQ ID NO: 205803 - DNA, 20 bp, Artificial Sequence
  Description of Artificial Sequence: Synthetic oligonucleotide
  Target: ATXN1; (-) strand; PAM type: YTN; PAM sequence: CTT
ttataaaaatggaacccttg

SEQ ID NO: 205804 - DNA, 20 bp, Artificial Sequence
  Description of Artificial Sequence: Synthetic oligonucleotide
  Target: ATXN1; (-) strand; PAM type: YTN; PAM sequence: CTC
ttttataaaaatggaaccct

SEQ ID NO: 205805 - DNA, 20 bp, Artificial Sequence
  Description of Artificial Sequence: Synthetic oligonucleotide
  Target: ATXN1; (-) strand; PAM type: YTN; PAM sequence: CTG
tctcttttataaaaatggaa

SEQ ID NO: 205806 - DNA, 20 bp, Artificial Sequence
  Description of Artificial Sequence: Synthetic oligonucleotide
  Target: ATXN1; (-) strand; PAM type: YTN; PAM sequence: CTA
ctgtctcttttataaaaatg

SEQ ID NO: 205807 - DNA, 20 bp, Artificial Sequence
  Description of Artificial Sequence: Synthetic oligonucleotide
  Target: ATXN1; (-) strand; PAM type: YTN; PAM sequence: TTC
ctactgtctcttttataaaa

SEQ ID NO: 205808 - DNA, 20 bp, Artificial Sequence
  Description of Artificial Sequence: Synthetic oligonucleotide
  Target: ATXN1; (-) strand; PAM type: YTN; PAM sequence: TTT
cctactgtctcttttataaa

SEQ ID NO: 205809 - DNA, 20 bp, Artificial Sequence
  Description of Artificial Sequence: Synthetic oligonucleotide
  Target: ATXN1; (-) strand; PAM type: YTN; PAM sequence: TTT
tcctactgtctcttttataa

SEQ ID NO: 205810 - DNA, 20 bp, Artificial Sequence
  Description of Artificial Sequence: Synthetic oligonucleotide
  Target: ATXN1; (-) strand; PAM type: YTN; PAM sequence: TTT
ttcctactgtctcttttata

SEQ ID NO: 205811 - DNA, 20 bp, Artificial Sequence
  Description of Artificial Sequence: Synthetic oligonucleotide
  Target: ATXN1; (-) strand; PAM type: YTN; PAM sequence: TTT
tttcctactgtctcttttat

SEQ ID NO: 205812 - DNA, 20 bp, Artificial Sequence
  Description of Artificial Sequence: Synthetic oligonucleotide
  Target: ATXN1; (-) strand; PAM type: YTN; PAM sequence: CTC
cattttttcctactgtctct

SEQ ID NO: 205813 - DNA, 20 bp, Artificial Sequence
  Description of Artificial Sequence: Synthetic oligonucleotide
  Target: ATXN1; (-) strand; PAM type: YTN; PAM sequence: TTC
atgtagactccattttttcc

SEQ ID NO: 205814 - DNA, 20 bp, Artificial Sequence
  Description of Artificial Sequence: Synthetic oligonucleotide
  Target: ATXN1; (-) strand; PAM type: YTN; PAM sequence: CTA
ttcatgtagactccattttt

SEQ ID NO: 205815 - DNA, 20 bp, Artificial Sequence
  Description of Artificial Sequence: Synthetic oligonucleotide
  Target: ATXN1; (-) strand; PAM type: YTN; PAM sequence: CTG
gtcacacaaacatacacaca

SEQ ID NO: 205816 - DNA, 20 bp, Artificial Sequence
  Description of Artificial Sequence: Synthetic oligonucleotide
  Target: ATXN1; (-) strand; PAM type: YTN; PAM sequence: TTG
taaagtccccaagatagtgg

SEQ ID NO: 205817 - DNA, 20 bp, Artificial Sequence
  Description of Artificial Sequence: Synthetic oligonucleotide
  Target: ATXN1; (-) strand; PAM type: YTN; PAM sequence: TTG
agttgtaaagtccccaagat

SEQ ID NO: 205818 - DNA, 20 bp, Artificial Sequence
  Description of Artificial Sequence: Synthetic oligonucleotide
  Target: ATXN1; (-) strand; PAM type: YTN; PAM sequence: TTA
tcattgagttgtaaagtccc

SEQ ID NO: 205819 - DNA, 20 bp, Artificial Sequence
  Description of Artificial Sequence: Synthetic oligonucleotide
  Target: ATXN1; (-) strand; PAM type: YTN; PAM sequence: TTA
aaggaaaataattatcattg

SEQ ID NO: 205820 - DNA, 20 bp, Artificial Sequence
  Description of Artificial Sequence: Synthetic oligonucleotide
  Target: ATXN1; (-) strand; PAM type: YTN; PAM sequence: TTT
aaaggaaaataattatcatt

SEQ ID NO: 205821 - DNA, 20 bp, Artificial Sequence
  Description of Artificial Sequence: Synthetic oligonucleotide
  Target: ATXN1; (-) strand; PAM type: YTN; PAM sequence: CTT
taaaggaaaataattatcat

SEQ ID NO: 205822 - DNA, 20 bp, Artificial Sequence
  Description of Artificial Sequence: Synthetic oligonucleotide
  Target: ATXN1; (-) strand; PAM type: YTN; PAM sequence: CTC
caaaagctttaaaggaaaat

SEQ ID NO: 205823 - DNA, 20 bp, Artificial Sequence
  Description of Artificial Sequence: Synthetic oligonucleotide
  Target: ATXN1; (-) strand; PAM type: YTN; PAM sequence: TTG
tgatgaaagcacatggtaca

SEQ ID NO: 205824 - DNA, 20 bp, Artificial Sequence
  Description of Artificial Sequence: Synthetic oligonucleotide
  Target: ATXN1; (-) strand; PAM type: YTN; PAM sequence: CTC
cattgtgatgaaagcacatg

SEQ ID NO: 205825 - DNA, 20 bp, Artificial Sequence
  Description of Artificial Sequence: Synthetic oligonucleotide
  Target: ATXN1; (-) strand; PAM type: YTN; PAM sequence: TTC
tccattgtgatgaaagcaca

SEQ ID NO: 205826 - DNA, 20 bp, Artificial Sequence
  Description of Artificial Sequence: Synthetic oligonucleotide
  Target: ATXN1; (-) strand; PAM type: YTN; PAM sequence: TTA
tggttctccattgtgatgaa

SEQ ID NO: 205827 - DNA, 20 bp, Artificial Sequence
  Description of Artificial Sequence: Synthetic oligonucleotide
  Target: ATXN1; (-) strand; PAM type: YTN; PAM sequence: CTT
atggttctccattgtgatga

SEQ ID NO: 205828 - DNA, 20 bp, Artificial Sequence
  Description of Artificial Sequence: Synthetic oligonucleotide
  Target: ATXN1; (-) strand; PAM type: YTN; PAM sequence: CTG
atagcttatggttctccatt

SEQ ID NO: 205829 - DNA, 20 bp, Artificial Sequence
  Description of Artificial Sequence: Synthetic oligonucleotide
  Target: ATXN1; (-) strand; PAM type: YTN; PAM sequence: CTG
caaggaactgatagcttatg

SEQ ID NO: 205830 - DNA, 20 bp, Artificial Sequence
  Description of Artificial Sequence: Synthetic oligonucleotide
  Target: ATXN1; (-) strand; PAM type: YTN; PAM sequence: CTG
ctgcaaggaactgatagctt

SEQ ID NO: 205831 - DNA, 20 bp, Artificial Sequence
  Description of Artificial Sequence: Synthetic oligonucleotide
  Target: ATXN1; (-) strand; PAM type: YTN; PAM sequence: TTC
gtgaaaagatctgctgcaag

SEQ ID NO: 205832 - DNA, 20 bp, Artificial Sequence
  Description of Artificial Sequence: Synthetic oligonucleotide
  Target: ATXN1; (-) strand; PAM type: YTN; PAM sequence: CTT
cgtgaaaagatctgctgcaa

SEQ ID NO: 205833 - DNA, 20 bp, Artificial Sequence
  Description of Artificial Sequence: Synthetic oligonucleotide
  Target: ATXN1; (-) strand; PAM type: YTN; PAM sequence: CTC
aagcaaaatcttcgtgaaaa

SEQ ID NO: 205834 - DNA, 20 bp, Artificial Sequence
  Description of Artificial Sequence: Synthetic oligonucleotide
  Target: ATXN1; (-) strand; PAM type: YTN; PAM sequence: CTA
ctcaagcaaaatcttcgtga

SEQ ID NO: 205835 - DNA, 20 bp, Artificial Sequence
  Description of Artificial Sequence: Synthetic oligonucleotide
  Target: ATXN1; (-) strand; PAM type: YTN; PAM sequence: TTC
tactcaagcaaaatcttcgt

SEQ ID NO: 205836 - DNA, 20 bp, Artificial Sequence
  Description of Artificial Sequence: Synthetic oligonucleotide
  Target: ATXN1; (-) strand; PAM type: YTN; PAM sequence: TTT
ctactcaagcaaaatcttcg

SEQ ID NO: 205837 - DNA, 20 bp, Artificial Sequence
  Description of Artificial Sequence: Synthetic oligonucleotide
  Target: ATXN1; (-) strand; PAM type: YTN; PAM sequence: CTT
tctactcaagcaaaatcttc

SEQ ID NO: 205838 - DNA, 20 bp, Artificial Sequence
  Description of Artificial Sequence: Synthetic oligonucleotide
  Target: ATXN1; (-) strand; PAM type: YTN; PAM sequence: CTG
ccaccctttctactcaagca

SEQ ID NO: 205839 - DNA, 20 bp, Artificial Sequence
  Description of Artificial Sequence: Synthetic oligonucleotide
  Target: ATXN1; (-) strand; PAM type: YTN; PAM sequence: CTC
cactgccaccctttctactc

SEQ ID NO: 205840 - DNA, 20 bp, Artificial Sequence
  Description of Artificial Sequence: Synthetic oligonucleotide
  Target: ATXN1; (-) strand; PAM type: YTN; PAM sequence: TTC
tccactgccaccctttctac

SEQ ID NO: 205841 - DNA, 20 bp, Artificial Sequence
  Description of Artificial Sequence: Synthetic oligonucleotide
  Target: ATXN1; (-) strand; PAM type: YTN; PAM sequence: CTG
agattctccactgccaccct

SEQ ID NO: 205842 - DNA, 20 bp, Artificial Sequence
  Description of Artificial Sequence: Synthetic oligonucleotide
  Target: ATXN1; (-) strand; PAM type: YTN; PAM sequence: TTA
cactgagattctccactgcc

SEQ ID NO: 205843 - DNA, 20 bp, Artificial Sequence
  Description of Artificial Sequence: Synthetic oligonucleotide
  Target: ATXN1; (-) strand; PAM type: YTN; PAM sequence: TTT
acactgagattctccactgc

SEQ ID NO: 205844 - DNA, 20 bp, Artificial Sequence
  Description of Artificial Sequence: Synthetic oligonucleotide
  Target: ATXN1; (-) strand; PAM type: YTN; PAM sequence: TTT
tacactgagattctccactg

SEQ ID NO: 205845 - DNA, 20 bp, Artificial Sequence
  Description of Artificial Sequence: Synthetic oligonucleotide
  Target: ATXN1; (-) strand; PAM type: YTN; PAM sequence: CTA
ggcgttttacactgagattc

SEQ ID NO: 205846 - DNA, 20 bp, Artificial Sequence
  Description of Artificial Sequence: Synthetic oligonucleotide
  Target: ATXN1; (-) strand; PAM type: YTN; PAM sequence: TTA
caggtctaggcgttttacac

SEQ ID NO: 205847 - DNA, 20 bp, Artificial Sequence
  Description of Artificial Sequence: Synthetic oligonucleotide
  Target: ATXN1; (-) strand; PAM type: YTN; PAM sequence: TTA
taattacaggtctaggcgtt

SEQ ID NO: 205848 - DNA, 20 bp, Artificial Sequence
  Description of Artificial Sequence: Synthetic oligonucleotide
  Target: ATXN1; (-) strand; PAM type: YTN; PAM sequence: TTT
ataattacaggtctaggcgt

SEQ ID NO: 205849 - DNA, 20 bp, Artificial Sequence
  Description of Artificial Sequence: Synthetic oligonucleotide
  Target: ATXN1; (-) strand; PAM type: YTN; PAM sequence: TTT
tataattacaggtctaggcg

SEQ ID NO: 205850 - DNA, 20 bp, Artificial Sequence
  Description of Artificial Sequence: Synthetic oligonucleotide
  Target: ATXN1; (-) strand; PAM type: YTN; PAM sequence: TTT
ttataattacaggtctaggc

SEQ ID NO: 205851 - DNA, 20 bp, Artificial Sequence
  Description of Artificial Sequence: Synthetic oligonucleotide
  Target: ATXN1; (-) strand; PAM type: YTN; PAM sequence: TTG
tttttataattacaggtcta

SEQ ID NO: 205852 - DNA, 20 bp, Artificial Sequence
  Description of Artificial Sequence: Synthetic oligonucleotide
  Target: ATXN1; (-) strand; PAM type: YTN; PAM sequence: CTC
agtgagaatattgtttttat

SEQ ID NO: 205853 - DNA, 20 bp, Artificial Sequence
  Description of Artificial Sequence: Synthetic oligonucleotide
  Target: ATXN1; (-) strand; PAM type: YTN; PAM sequence: CTA
actcagtgagaatattgttt

SEQ ID NO: 205854 - DNA, 20 bp, Artificial Sequence
  Description of Artificial Sequence: Synthetic oligonucleotide
  Target: ATXN1; (-) strand; PAM type: YTN; PAM sequence: TTC
agcgaatgtgaatgaagacc

SEQ ID NO: 205855 - DNA, 20 bp, Artificial Sequence
  Description of Artificial Sequence: Synthetic oligonucleotide
  Target: ATXN1; (-) strand; PAM type: YTN; PAM sequence: CTT
cagcgaatgtgaatgaagac

SEQ ID NO: 205856 - DNA, 20 bp, Artificial Sequence
  Description of Artificial Sequence: Synthetic oligonucleotide
  Target: ATXN1; (-) strand; PAM type: YTN; PAM sequence: CTG
tgacttcagcgaatgtgaat

SEQ ID NO: 205857 - DNA, 20 bp, Artificial Sequence
  Description of Artificial Sequence: Synthetic oligonucleotide
  Target: ATXN1; (-) strand; PAM type: YTN; PAM sequence: TTC
tgtgacttcagcgaatgtga

SEQ ID NO: 205858 - DNA, 20 bp, Artificial Sequence
  Description of Artificial Sequence: Synthetic oligonucleotide
  Target: ATXN1; (-) strand; PAM type: YTN; PAM sequence: TTT
ctgtgacttcagcgaatgtg

SEQ ID NO: 205859 - DNA, 20 bp, Artificial Sequence
  Description of Artificial Sequence: Synthetic oligonucleotide
  Target: ATXN1; (-) strand; PAM type: YTN; PAM sequence: TTC
ccgtttctgtgacttcagcg

SEQ ID NO: 205860 - DNA, 20 bp, Artificial Sequence
  Description of Artificial Sequence: Synthetic oligonucleotide
  Target: ATXN1; (-) strand; PAM type: YTN; PAM sequence: TTT
cccgtttctgtgacttcagc

SEQ ID NO: 205861 - DNA, 20 bp, Artificial Sequence
  Description of Artificial Sequence: Synthetic oligonucleotide
  Target: ATXN1; (-) strand; PAM type: YTN; PAM sequence: TTA
tgcaatatgatgtttcccgt

SEQ ID NO: 205862 - DNA, 20 bp, Artificial Sequence
  Description of Artificial Sequence: Synthetic oligonucleotide
  Target: ATXN1; (-) strand; PAM type: YTN; PAM sequence: TTG
cgtgtgtgcatgtgtgtgtg

SEQ ID NO: 205863 - DNA, 20 bp, Artificial Sequence
  Description of Artificial Sequence: Synthetic oligonucleotide
  Target: ATXN1; (-) strand; PAM type: YTN; PAM sequence: CTT
gcgtgtgtgcatgtgtgtgt

SEQ ID NO: 205864 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgtgtgtgtgtgtg

SEQ ID NO: 205865 - DNA, 20 bp, Artificial Sequence
  Description of Artificial Sequence: Synthetic oligonucleotide
  Target: ATXN1; (-) strand; PAM type: YTN; PAM sequence: CTT
gtgtgtgtgtgtgtgtgtgt

SEQ ID NO: 205866 - DNA, 20 bp, Artificial Sequence
  Description of Artificial Sequence: Synthetic oligonucleotide
  Target: ATXN1; (-) strand; PAM type: YTN; PAM sequence: TTA
aaaaccttgtgtgtgtgtgt

SEQ ID NO: 205867 - DNA, 20 bp, Artificial Sequence
  Description of Artificial Sequence: Synthetic oligonucleotide
  Target: ATXN1; (-) strand; PAM type: YTN; PAM sequence: TTT
aaaaaccttgtgtgtgtgtg

SEQ ID NO: 205868 - DNA, 20 bp, Artificial Sequence
  Description of Artificial Sequence: Synthetic oligonucleotide
  Target: ATXN1; (-) strand; PAM type: YTN; PAM sequence: CTG
atttaaaaaccttgtgtgtg

SEQ ID NO: 205869 - DNA, 20 bp, Artificial Sequence
  Description of Artificial Sequence: Synthetic oligonucleotide
  Target: ATXN1; (-) strand; PAM type: YTN; PAM sequence: TTC
tgatttaaaaaccttgtgtg

SEQ ID NO: 205870 - DNA, 20 bp, Artificial Sequence
  Description of Artificial Sequence: Synthetic oligonucleotide
  Target: ATXN1; (-) strand; PAM type: YTN; PAM sequence: TTG
acattctgatttaaaaacct

SEQ ID NO: 205871 - DNA, 20 bp, Artificial Sequence
  Description of Artificial Sequence: Synthetic oligonucleotide
  Target: ATXN1; (-) strand; PAM type: YTN; PAM sequence: TTT
gacattctgatttaaaaacc

SEQ ID NO: 205872 - DNA, 20 bp, Artificial Sequence
  Description of Artificial Sequence: Synthetic oligonucleotide
  Target: ATXN1; (-) strand; PAM type: YTN; PAM sequence: TTT
tgacattctgatttaaaaac

SEQ ID NO: 205873 - DNA, 20 bp, Artificial Sequence
  Description of Artificial Sequence: Synthetic oligonucleotide
  Target: ATXN1; (-) strand; PAM type: YTN; PAM sequence: TTT
ttgacattctgatttaaaaa

SEQ ID NO: 205874 - DNA, 20 bp, Artificial Sequence
  Description of Artificial Sequence: Synthetic oligonucleotide
  Target: ATXN1; (-) strand; PAM type: YTN; PAM sequence: CTG
agtttttgacattctgattt

SEQ ID NO: 205875 - DNA, 20 bp, Artificial Sequence
  Description of Artificial Sequence: Synthetic oligonucleotide
  Target: ATXN1; (-) strand; PAM type: YTN; PAM sequence: CTG
ctgagtttttgacattctga

SEQ ID NO: 205876 - DNA, 20 bp, Artificial Sequence
  Description of Artificial Sequence: Synthetic oligonucleotide
  Target: ATXN1; (-) strand; PAM type: YTN; PAM sequence: CTG
cctgctgagtttttgacatt

SEQ ID NO: 205877 - DNA, 20 bp, Artificial Sequence
  Description of Artificial Sequence: Synthetic oligonucleotide
  Target: ATXN1; (-) strand; PAM type: YTN; PAM sequence: CTC
tgcctgctgagtttttgaca

SEQ ID NO: 205878 - DNA, 20 bp, Artificial Sequence
  Description of Artificial Sequence: Synthetic oligonucleotide
  Target: ATXN1; (-) strand; PAM type: YTN; PAM sequence: CTG
tgtctctgcctgctgagttt

SEQ ID NO: 205879 - DNA, 20 bp, Artificial Sequence
  Description of Artificial Sequence: Synthetic oligonucleotide
  Target: ATXN1; (-) strand; PAM type: YTN; PAM sequence: CTG
ctgtgtctctgcctgctgag

SEQ ID NO: 205880 - DNA, 20 bp, Artificial Sequence
  Description of Artificial Sequence: Synthetic oligonucleotide
  Target: ATXN1; (-) strand; PAM type: YTN; PAM sequence: CTG
gggatagggacctgctgtgt

SEQ ID NO: 205881 - DNA, 20 bp, Artificial Sequence
  Description of Artificial Sequence: Synthetic oligonucleotide
  Target: ATXN1; (-) strand; PAM type: YTN; PAM sequence: CTC
atccctggggatagggacct

SEQ ID NO: 205882 - DNA, 20 bp, Artificial Sequence
  Description of Artificial Sequence: Synthetic oligonucleotide
  Target: ATXN1; (-) strand; PAM type: YTN; PAM sequence: CTG
gccagaacccactcatccct

SEQ ID NO: 205883 - DNA, 20 bp, Artificial Sequence
  Description of Artificial Sequence: Synthetic oligonucleotide
  Target: ATXN1; (-) strand; PAM type: YTN; PAM sequence: CTC
aaggggaggagatggggtgg

SEQ ID NO: 205884 - DNA, 20 bp, Artificial Sequence
  Description of Artificial Sequence: Synthetic oligonucleotide
  Target: ATXN1; (-) strand; PAM type: YTN; PAM sequence: TTG
atagtggtgtcctcaagggg

SEQ ID NO: 205885 - DNA, 20 bp, Artificial Sequence
  Description of Artificial Sequence: Synthetic oligonucleotide
  Target: ATXN1; (-) strand; PAM type: YTN; PAM sequence: TTT
gatagtggtgtcctcaaggg

SEQ ID NO: 205886 - DNA, 20 bp, Artificial Sequence
  Description of Artificial Sequence: Synthetic oligonucleotide
  Target: ATXN1; (-) strand; PAM type: YTN; PAM sequence: TTT
tgatagtggtgtcctcaagg

SEQ ID NO: 205887 - DNA, 20 bp, Artificial Sequence
  Description of Artificial Sequence: Synthetic oligonucleotide
  Target: ATXN1; (-) strand; PAM type: YTN; PAM sequence: TTA
ttttgatagtggtgtcctca

SEQ ID NO: 205888 - DNA, 20 bp, Artificial Sequence
  Description of Artificial Sequence: Synthetic oligonucleotide
  Target: ATXN1; (-) strand; PAM type: YTN; PAM sequence: TTG
agcagggaaggaggggcagg

SEQ ID NO: 205889 - DNA, 20 bp, Artificial Sequence
  Description of Artificial Sequence: Synthetic oligonucleotide
  Target: ATXN1; (-) strand; PAM type: YTN; PAM sequence: TTA
gaatcattgagcagggaagg

SEQ ID NO: 205890 - DNA, 20 bp, Artificial Sequence
  Description of Artificial Sequence: Synthetic oligonucleotide
  Target: ATXN1; (-) strand; PAM type: YTN; PAM sequence: CTT
agaatcattgagcagggaag

SEQ ID NO: 205891 - DNA, 20 bp, Artificial Sequence
  Description of Artificial Sequence: Synthetic oligonucleotide
  Target: ATXN1; (-) strand; PAM type: YTN; PAM sequence: TTA
gaaatcttagaatcattgag

SEQ ID NO: 205892 - DNA, 20 bp, Artificial Sequence
  Description of Artificial Sequence: Synthetic oligonucleotide
  Target: ATXN1; (-) strand; PAM type: YTN; PAM sequence: CTT
agaaatcttagaatcattga

SEQ ID NO: 205893 - DNA, 20 bp, Artificial Sequence
  Description of Artificial Sequence: Synthetic oligonucleotide
  Target: ATXN1; (-) strand; PAM type: YTN; PAM sequence: TTC
ttagaaatcttagaatcatt

SEQ ID NO: 205894 - DNA, 20 bp, Artificial Sequence
  Description of Artificial Sequence: Synthetic oligonucleotide
  Target: ATXN1; (-) strand; PAM type: YTN; PAM sequence: TTT
cttagaaatcttagaatcat

SEQ ID NO: 205895 - DNA, 20 bp, Artificial Sequence
  Description of Artificial Sequence: Synthetic oligonucleotide
  Target: ATXN1; (-) strand; PAM type: YTN; PAM sequence: TTA
tttcttagaaatcttagaat

SEQ ID NO: 205896 - DNA, 20 bp, Artificial Sequence
  Description of Artificial Sequence: Synthetic oligonucleotide
  Target: ATXN1; (-) strand; PAM type: YTN; PAM sequence: TTG
ttatttcttagaaatcttag

SEQ ID NO: 205897 - DNA, 20 bp, Artificial Sequence
  Description of Artificial Sequence: Synthetic oligonucleotide
  Target: ATXN1; (-) strand; PAM type: YTN; PAM sequence: CTT
gttatttcttagaaatctta

SEQ ID NO: 205898 - DNA, 20 bp, Artificial Sequence
  Description of Artificial Sequence: Synthetic oligonucleotide
  Target: ATXN1; (-) strand; PAM type: YTN; PAM sequence: CTG
cttgttatttcttagaaatc

SEQ ID NO: 205899 - DNA, 20 bp, Artificial Sequence
  Description of Artificial Sequence: Synthetic oligonucleotide
  Target: ATXN1; (-) strand; PAM type: YTN; PAM sequence: CTG
actgcttgttatttcttaga

SEQ ID NO: 205900 - DNA, 20 bp, Artificial Sequence
  Description of Artificial Sequence: Synthetic oligonucleotide
  Target: ATXN1; (-) strand; PAM type: YTN; PAM sequence: CTA
tgaagaactgactgcttgtt

SEQ ID NO: 205901 - DNA, 20 bp, Artificial Sequence
  Description of Artificial Sequence: Synthetic oligonucleotide
  Target: ATXN1; (-) strand; PAM type: YTN; PAM sequence: TTC
tatgaagaactgactgcttg

SEQ ID NO: 205902 - DNA, 20 bp, Artificial Sequence
  Description of Artificial Sequence: Synthetic oligonucleotide
  Target: ATXN1; (-) strand; PAM type: YTN; PAM sequence: TTT
ctatgaagaactgactgctt

SEQ ID NO: 205903 - DNA, 20 bp, Artificial Sequence
  Description of Artificial Sequence: Synthetic oligonucleotide
  Target: ATXN1; (-) strand; PAM type: YTN; PAM sequence: TTT
tctatgaagaactgactgct

SEQ ID NO: 205904 - DNA, 20 bp, Artificial Sequence
  Description of Artificial Sequence: Synthetic oligonucleotide
  Target: ATXN1; (-) strand; PAM type: YTN; PAM sequence: CTG
acattttctatgaagaactg

SEQ ID NO: 205905 - DNA, 20 bp, Artificial Sequence
  Description of Artificial Sequence: Synthetic oligonucleotide
  Target: ATXN1; (-) strand; PAM type: YTN; PAM sequence: TTC
tgacattttctatgaagaac

SEQ ID NO: 205906 - DNA, 20 bp, Artificial Sequence
  Description of Artificial Sequence: Synthetic oligonucleotide
  Target: ATXN1; (-) strand; PAM type: YTN; PAM sequence: TTT
ctgacattttctatgaagaa

SEQ ID NO: 205907 - DNA, 20 bp, Artificial Sequence
  Description of Artificial Sequence: Synthetic oligonucleotide
  Target: ATXN1; (-) strand; PAM type: YTN; PAM sequence: TTC
agcaatgtttctgacatttt

SEQ ID NO: 205908 - DNA, 20 bp, Artificial Sequence
  Description of Artificial Sequence: Synthetic oligonucleotide
  Target: ATXN1; (-) strand; PAM type: YTN; PAM sequence: TTA
gagaaagagagcatcaaatt

SEQ ID NO: 205909 - DNA, 20 bp, Artificial Sequence
  Description of Artificial Sequence: Synthetic oligonucleotide
  Target: ATXN1; (-) strand; PAM type: YTN; PAM sequence: CTT
agagaaagagagcatcaaat

SEQ ID NO: 205910 - DNA, 20 bp, Artificial Sequence
  Description of Artificial Sequence: Synthetic oligonucleotide
  Target: ATXN1; (-) strand; PAM type: YTN; PAM sequence: CTA
gaaggagtcttagagaaaga

SEQ ID NO: 205911 - DNA, 20 bp, Artificial Sequence
  Description of Artificial Sequence: Synthetic oligonucleotide
  Target: ATXN1; (-) strand; PAM type: YTN; PAM sequence: TTG
tggctagaaggagtcttaga

SEQ ID NO: 205912 - DNA, 20 bp, Artificial Sequence
  Description of Artificial Sequence: Synthetic oligonucleotide
  Target: ATXN1; (-) strand; PAM type: YTN; PAM sequence: TTT
gtggctagaaggagtcttag

SEQ ID NO: 205913 - DNA, 20 bp, Artificial Sequence
  Description of Artificial Sequence: Synthetic oligonucleotide
  Target: ATXN1; (-) strand; PAM type: YTN; PAM sequence: TTT
tgtggctagaaggagtctta

SEQ ID NO: 205914 - DNA, 20 bp, Artificial Sequence
  Description of Artificial Sequence: Synthetic oligonucleotide
  Target: ATXN1; (-) strand; PAM type: YTN; PAM sequence: TTG
cataattttgtggctagaag

SEQ ID NO: 205915 - DNA, 20 bp, Artificial Sequence
  Description of Artificial Sequence: Synthetic oligonucleotide
  Target: ATXN1; (-) strand; PAM type: YTN; PAM sequence: TTT
gcataattttgtggctagaa

SEQ ID NO: 205916 - DNA, 20 bp, Artificial Sequence
  Description of Artificial Sequence: Synthetic oligonucleotide
  Target: ATXN1; (-) strand; PAM type: YTN; PAM sequence: CTG
aatttgcataattttgtggc

SEQ ID NO: 205917 - DNA, 20 bp, Artificial Sequence
  Description of Artificial Sequence: Synthetic oligonucleotide
  Target: ATXN1; (-) strand; PAM type: YTN; PAM sequence: TTC
aaaagtgaaagtgaggccgg

SEQ ID NO: 205918 - DNA, 20 bp, Artificial Sequence
  Description of Artificial Sequence: Synthetic oligonucleotide
  Target: ATXN1; (-) strand; PAM type: YTN; PAM sequence: TTT
caaaagtgaaagtgaggccg

SEQ ID NO: 205919 - DNA, 20 bp, Artificial Sequence
  Description of Artificial Sequence: Synthetic oligonucleotide
  Target: ATXN1; (-) strand; PAM type: YTN; PAM sequence: TTA
acaaagaggcatgtgtagtt

SEQ ID NO: 205920 - DNA, 20 bp, Artificial Sequence
  Description of Artificial Sequence: Synthetic oligonucleotide
  Target: ATXN1; (-) strand; PAM type: YTN; PAM sequence: TTA
ttaacaaagaggcatgtgta

SEQ ID NO: 205921 - DNA, 20 bp, Artificial Sequence
  Description of Artificial Sequence: Synthetic oligonucleotide
  Target: ATXN1; (-) strand; PAM type: YTN; PAM sequence: CTG
agttattaacaaagaggcat

SEQ ID NO: 205922 - DNA, 20 bp, Artificial Sequence
  Description of Artificial Sequence: Synthetic oligonucleotide
  Target: ATXN1; (-) strand; PAM type: YTN; PAM sequence: TTA
actgagttattaacaaagag

SEQ ID NO: 205923 - DNA, 20 bp, Artificial Sequence
  Description of Artificial Sequence: Synthetic oligonucleotide
  Target: ATXN1; (-) strand; PAM type: YTN; PAM sequence: CTT
aactgagttattaacaaaga

SEQ ID NO: 205924 - DNA, 20 bp, Artificial Sequence
  Description of Artificial Sequence: Synthetic oligonucleotide
  Target: ATXN1; (-) strand; PAM type: YTN; PAM sequence: CTG
acatcatgtcttaactgagt

SEQ ID NO: 205925 - DNA, 20 bp, Artificial Sequence
  Description of Artificial Sequence: Synthetic oligonucleotide
  Target: ATXN1; (-) strand; PAM type: YTN; PAM sequence: TTG
gccatcactgacatcatgtc

SEQ ID NO: 205926 - DNA, 20 bp, Artificial Sequence
  Description of Artificial Sequence: Synthetic oligonucleotide
  Target: ATXN1; (-) strand; PAM type: YTN; PAM sequence: CTT
ggccatcactgacatcatgt

SEQ ID NO: 205927 - DNA, 20 bp, Artificial Sequence
  Description of Artificial Sequence: Synthetic oligonucleotide
  Target: ATXN1; (-) strand; PAM type: YTN; PAM sequence: TTC
gtgatgaccttggccatcac

SEQ ID NO: 205928 - DNA, 20 bp, Artificial Sequence
  Description of Artificial Sequence: Synthetic oligonucleotide
  Target: ATXN1; (-) strand; PAM type: YTN; PAM sequence: TTA
atcaatgttcgtgatgacct

SEQ ID NO: 205929 - DNA, 20 bp, Artificial Sequence
  Description of Artificial Sequence: Synthetic oligonucleotide
  Target: ATXN1; (-) strand; PAM type: YTN; PAM sequence: TTT
aatcaatgttcgtgatgacc

SEQ ID NO: 205930 - DNA, 20 bp, Artificial Sequence
  Description of Artificial Sequence: Synthetic oligonucleotide
  Target: ATXN1; (-) strand; PAM type: YTN; PAM sequence: TTA
gcacatggcccagaacatag

SEQ ID NO: 205931 - DNA, 20 bp, Artificial Sequence
  Description of Artificial Sequence: Synthetic oligonucleotide
  Target: ATXN1; (-) strand; PAM type: YTN; PAM sequence: CTT
agcacatggcccagaacata

SEQ ID NO: 205932 - DNA, 20 bp, Artificial Sequence
  Description of Artificial Sequence: Synthetic oligonucleotide
  Target: ATXN1; (-) strand; PAM type: YTN; PAM sequence: CTG
cagtggagtggggcaatgtg

SEQ ID NO: 205933 - DNA, 20 bp, Artificial Sequence
  Description of Artificial Sequence: Synthetic oligonucleotide
  Target: ATXN1; (-) strand; PAM type: YTN; PAM sequence: CTC
acagactgcagtggagtggg

SEQ ID NO: 205934 - DNA, 20 bp, Artificial Sequence
  Description of Artificial Sequence: Synthetic oligonucleotide
  Target: ATXN1; (-) strand; PAM type: YTN; PAM sequence: CTG
gccacctcacagactgcagt

SEQ ID NO: 205935 - DNA, 20 bp, Artificial Sequence
  Description of Artificial Sequence: Synthetic oligonucleotide
  Target: ATXN1; (-) strand; PAM type: YTN; PAM sequence: TTC
ctggccacctcacagactgc

SEQ ID NO: 205936 - DNA, 20 bp, Artificial Sequence
  Description of Artificial Sequence: Synthetic oligonucleotide
  Target: ATXN1; (-) strand; PAM type: YTN; PAM sequence: TTG
tcaataatgcagaggtaaac

SEQ ID NO: 205937 - DNA, 20 bp, Artificial Sequence
  Description of Artificial Sequence: Synthetic oligonucleotide
  Target: ATXN1; (-) strand; PAM type: YTN; PAM sequence: CTT
gtcaataatgcagaggtaaa

SEQ ID NO: 205938 - DNA, 20 bp, Artificial Sequence
  Description of Artificial Sequence: Synthetic oligonucleotide
  Target: ATXN1; (-) strand; PAM type: YTN; PAM sequence: TTC
ttgtcaataatgcagaggta

SEQ ID NO: 205939 - DNA, 20 bp, Artificial Sequence
  Description of Artificial Sequence: Synthetic oligonucleotide
  Target: ATXN1; (-) strand; PAM type: YTN; PAM sequence: TTT
cttgtcaataatgcagaggt

SEQ ID NO: 205940 - DNA, 20 bp, Artificial Sequence
  Description of Artificial Sequence: Synthetic oligonucleotide
  Target: ATXN1; (-) strand; PAM type: YTN; PAM sequence: TTT
tcttgtcaataatgcagagg

SEQ ID NO: 205941 - DNA, 20 bp, Artificial Sequence
  Description of Artificial Sequence: Synthetic oligonucleotide
  Target: ATXN1; (-) strand; PAM type: YTN; PAM sequence: CTG
tcagttttcttgtcaataat

SEQ ID NO: 205942 - DNA, 20 bp, Artificial Sequence
  Description of Artificial Sequence: Synthetic oligonucleotide
  Target: ATXN1; (-) strand; PAM type: YTN; PAM sequence: TTA
ctgtcagttttcttgtcaat

SEQ ID NO: 205943 - DNA, 20 bp, Artificial Sequence
  Description of Artificial Sequence: Synthetic oligonucleotide
  Target: ATXN1; (-) strand; PAM type: YTN; PAM sequence: TTT
actgtcagttttcttgtcaa

SEQ ID NO: 205944 - DNA, 20 bp, Artificial Sequence
  Description of Artificial Sequence: Synthetic oligonucleotide
  Target: ATXN1; (-) strand; PAM type: YTN; PAM sequence: CTG
tatttactgtcagttttctt

SEQ ID NO: 205945 - DNA, 20 bp, Artificial Sequence
  Description of Artificial Sequence: Synthetic oligonucleotide
  Target: ATXN1; (-) strand; PAM type: YTN; PAM sequence: TTG
gctgtatttactgtcagttt

SEQ ID NO: 205946 - DNA, 20 bp, Artificial Sequence
  Description of Artificial Sequence: Synthetic oligonucleotide
  Target: ATXN1; (-) strand; PAM type: YTN; PAM sequence: TTA
acatccgttggctgtattta

SEQ ID NO: 205947 - DNA, 20 bp, Artificial Sequence
  Description of Artificial Sequence: Synthetic oligonucleotide
  Target: ATXN1; (-) strand; PAM type: YTN; PAM sequence: TTT
aacatccgttggctgtattt

SEQ ID NO: 205948 - DNA, 20 bp, Artificial Sequence
  Description of Artificial Sequence: Synthetic oligonucleotide
  Target: ATXN1; (-) strand; PAM type: YTN; PAM sequence: CTT
taacatccgttggctgtatt

SEQ ID NO: 205949 - DNA, 20 bp, Artificial Sequence
  Description of Artificial Sequence: Synthetic oligonucleotide
  Target: ATXN1; (-) strand; PAM type: YTN; PAM sequence: CTG
gctttaacatccgttggctg

SEQ ID NO: 205950 - DNA, 20 bp, Artificial Sequence
  Description of Artificial Sequence: Synthetic oligonucleotide
  Target: ATXN1; (-) strand; PAM type: YTN; PAM sequence: TTA
agtactggctttaacatccg

SEQ ID NO: 205951 - DNA, 20 bp, Artificial Sequence
  Description of Artificial Sequence: Synthetic oligonucleotide
  Target: ATXN1; (-) strand; PAM type: YTN; PAM sequence: CTT
aagtactggctttaacatcc

SEQ ID NO: 205952 - DNA, 20 bp, Artificial Sequence
  Description of Artificial Sequence: Synthetic oligonucleotide
  Target: ATXN1; (-) strand; PAM type: YTN; PAM sequence: TTG
gcttaagtactggctttaac

SEQ ID NO: 205953 - DNA, 20 bp, Artificial Sequence
  Description of Artificial Sequence: Synthetic oligonucleotide
  Target: ATXN1; (-) strand; PAM type: YTN; PAM sequence: CTG
ttggcttaagtactggcttt

SEQ ID NO: 205954 - DNA, 20 bp, Artificial Sequence
  Description of Artificial Sequence: Synthetic oligonucleotide
  Target: ATXN1; (-) strand; PAM type: YTN; PAM sequence: CTG
tgaactgttggcttaagtac

SEQ ID NO: 205955 - DNA, 20 bp, Artificial Sequence
  Description of Artificial Sequence: Synthetic oligonucleotide
  Target: ATXN1; (-) strand; PAM type: YTN; PAM sequence: CTC
tgtgaactgttggcttaagt

SEQ ID NO: 205956 - DNA, 20 bp, Artificial Sequence
  Description of Artificial Sequence: Synthetic oligonucleotide
  Target: ATXN1; (-) strand; PAM type: YTN; PAM sequence: CTA
agcatgacctctgtgaactg

SEQ ID NO: 205957 - DNA, 20 bp, Artificial Sequence
  Description of Artificial Sequence: Synthetic oligonucleotide
  Target: ATXN1; (-) strand; PAM type: YTN; PAM sequence: CTA
gaatcctaagcatgacctct

SEQ ID NO: 205958 - DNA, 20 bp, Artificial Sequence
  Description of Artificial Sequence: Synthetic oligonucleotide
  Target: ATXN1; (-) strand; PAM type: YTN; PAM sequence: TTG
aagagatggtatagtactag

SEQ ID NO: 205959 - DNA, 20 bp, Artificial Sequence
  Description of Artificial Sequence: Synthetic oligonucleotide
  Target: ATXN1; (-) strand; PAM type: YTN; PAM sequence: CTT
gaagagatggtatagtacta

SEQ ID NO: 205960 - DNA, 20 bp, Artificial Sequence
  Description of Artificial Sequence: Synthetic oligonucleotide
  Target: ATXN1; (-) strand; PAM type: YTN; PAM sequence: TTG
gtagaaagatcagccttgaa

SEQ ID NO: 205961 - DNA, 20 bp, Artificial Sequence
  Description of Artificial Sequence: Synthetic oligonucleotide
  Target: ATXN1; (-) strand; PAM type: YTN; PAM sequence: CTA
cagaagtgttggtagaaaga

SEQ ID NO: 205962 - DNA, 20 bp, Artificial Sequence
  Description of Artificial Sequence: Synthetic oligonucleotide
  Target: ATXN1; (-) strand; PAM type: YTN; PAM sequence: CTA
actacagaagtgttggtaga

SEQ ID NO: 205963 - DNA, 20 bp, Artificial Sequence
  Description of Artificial Sequence: Synthetic oligonucleotide
  Target: ATXN1; (-) strand; PAM type: YTN; PAM sequence: TTA
atactaactacagaagtgtt

SEQ ID NO: 205964 - DNA, 20 bp, Artificial Sequence
  Description of Artificial Sequence: Synthetic oligonucleotide
  Target: ATXN1; (-) strand; PAM type: YTN; PAM sequence: TTT
aatactaactacagaagtgt

SEQ ID NO: 205965 - DNA, 20 bp, Artificial Sequence
  Description of Artificial Sequence: Synthetic oligonucleotide
  Target: ATXN1; (-) strand; PAM type: YTN; PAM sequence: TTT
taatactaactacagaagtg

SEQ ID NO: 205966 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccaccatgcc

SEQ ID NO: 205967 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcatgagccac

SEQ ID NO: 205968 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattacag

SEQ ID NO: 205969 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 205970 - DNA, 20 bp, Artificial Sequence
  Description of Artificial Sequence: Synthetic oligonucleotide
  Target: ATXN1; (-) strand; PAM type: YTN; PAM sequence: CTC
atgatccgcccacctcagcc

SEQ ID NO: 205971 - DNA, 20 bp, Artificial Sequence
  Description of Artificial Sequence: Synthetic oligonucleotide
  Target: ATXN1; (-) strand; PAM type: YTN; PAM sequence: CTG
acctcatgatccgcccacct

SEQ ID NO: 205972 - DNA, 20 bp, Artificial Sequence
  Description of Artificial Sequence: Synthetic oligonucleotide
  Target: ATXN1; (-) strand; PAM type: YTN; PAM sequence: CTC
ctgacctcatgatccgccca

SEQ ID NO: 205973 - DNA, 20 bp, Artificial Sequence
  Description of Artificial Sequence: Synthetic oligonucleotide
  Target: ATXN1; (-) strand; PAM type: YTN; PAM sequence: CTC
gatctcctgacctcatgatc

SEQ ID NO: 205974 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtctcgatctc

SEQ ID NO: 205975 - DNA, 20 bp, Artificial Sequence
  Description of Artificial Sequence: Synthetic oligonucleotide
  Target: ATXN1; (-) strand; PAM type: YTN; PAM sequence: TTA
caccatgttggccaggatgg

SEQ ID NO: 205976 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggttacacca

SEQ ID NO: 205977 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggttacacc

SEQ ID NO: 205978 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggttacac

SEQ ID NO: 205979 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggttaca

SEQ ID NO: 205980 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagatgggg

SEQ ID NO: 205981 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagatggg

SEQ ID NO: 205982 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagatgg

SEQ ID NO: 205983 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagatg

SEQ ID NO: 205984 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 205985 - DNA, 20 bp, Artificial Sequence
  Description of Artificial Sequence: Synthetic oligonucleotide
  Target: ATXN1; (-) strand; PAM type: YTN; PAM sequence: TTA
cgggcacgcaccaccatgcg

SEQ ID NO: 205986 - DNA, 20 bp, Artificial Sequence
  Description of Artificial Sequence: Synthetic oligonucleotide
  Target: ATXN1; (-) strand; PAM type: YTN; PAM sequence: CTG
ggattacgggcacgcaccac

SEQ ID NO: 205987 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattacgggca

SEQ ID NO: 205988 - DNA, 20 bp, Artificial Sequence
  Description of Artificial Sequence: Synthetic oligonucleotide
  Target: ATXN1; (-) strand; PAM type: YTN; PAM sequence: TTC
ctgagtagctgggattacgg

SEQ ID NO: 205989 - DNA, 20 bp, Artificial Sequence
  Description of Artificial Sequence: Synthetic oligonucleotide
  Target: ATXN1; (-) strand; PAM type: YTN; PAM sequence: CTT
cctgagtagctgggattacg

SEQ ID NO: 205990 - DNA, 20 bp, Artificial Sequence
  Description of Artificial Sequence: Synthetic oligonucleotide
  Target: ATXN1; (-) strand; PAM type: YTN; PAM sequence: CTC
agcttcctgagtagctggga

SEQ ID NO: 205991 - DNA, 20 bp, Artificial Sequence
  Description of Artificial Sequence: Synthetic oligonucleotide
  Target: ATXN1; (-) strand; PAM type: YTN; PAM sequence: CTG
cctcagcttcctgagtagct

SEQ ID NO: 205992 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcttcctgagta

SEQ ID NO: 205993 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcttcctgag

SEQ ID NO: 205994 - DNA, 20 bp, Artificial Sequence
  Description of Artificial Sequence: Synthetic oligonucleotide
  Target: ATXN1; (-) strand; PAM type: YTN; PAM sequence: TTC
aagtgattctcctgcctcag

SEQ ID NO: 205995 - DNA, 20 bp, Artificial Sequence
  Description of Artificial Sequence: Synthetic oligonucleotide
  Target: ATXN1; (-) strand; PAM type: YTN; PAM sequence: TTC
cggttcaagtgattctcctg

SEQ ID NO: 205996 - DNA, 20 bp, Artificial Sequence
  Description of Artificial Sequence: Synthetic oligonucleotide
  Target: ATXN1; (-) strand; PAM type: YTN; PAM sequence: CTT
ccggttcaagtgattctcct

SEQ ID NO: 205997 - DNA, 20 bp, Artificial Sequence
  Description of Artificial Sequence: Synthetic oligonucleotide
  Target: ATXN1; (-) strand; PAM type: YTN; PAM sequence: CTG
ccttccggttcaagtgattc

SEQ ID NO: 205998 - DNA, 20 bp, Artificial Sequence
  Description of Artificial Sequence: Synthetic oligonucleotide
  Target: ATXN1; (-) strand; PAM type: YTN; PAM sequence: CTC
tgccttccggttcaagtgat

SEQ ID NO: 205999 - DNA, 20 bp, Artificial Sequence
  Description of Artificial Sequence: Synthetic oligonucleotide
  Target: ATXN1; (-) strand; PAM type: YTN; PAM sequence: CTG
caaactctgccttccggttc

SEQ ID NO: 206000 - DNA, 20 bp, Artificial Sequence
  Description of Artificial Sequence: Synthetic oligonucleotide
  Target: ATXN1; (-) strand; PAM type: YTN; PAM sequence: CTC
actgcaaactctgccttccg

SEQ ID NO: 206001 - DNA, 20 bp, Artificial Sequence
  Description of Artificial Sequence: Synthetic oligonucleotide
  Target: ATXN1; (-) strand; PAM type: YTN; PAM sequence: CTC
agctcactgcaaactctgcc

SEQ ID NO: 206002 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcatgatctc

SEQ ID NO: 206003 - DNA, 20 bp, Artificial Sequence
  Description of Artificial Sequence: Synthetic oligonucleotide
  Target: ATXN1; (-) strand; PAM type: YTN; PAM sequence: TTG
tcaccaggctggagtgcagt

SEQ ID NO: 206004 - DNA, 20 bp, Artificial Sequence
  Description of Artificial Sequence: Synthetic oligonucleotide
  Target: ATXN1; (-) strand; PAM type: YTN; PAM sequence: TTT
gtcaccaggctggagtgcag

SEQ ID NO: 206005 - DNA, 20 bp, Artificial Sequence
  Description of Artificial Sequence: Synthetic oligonucleotide
  Target: ATXN1; (-) strand; PAM type: YTN; PAM sequence: CTT
tgtcaccaggctggagtgca

SEQ ID NO: 206006 - DNA, 20 bp, Artificial Sequence
  Description of Artificial Sequence: Synthetic oligonucleotide
  Target: ATXN1; (-) strand; PAM type: YTN; PAM sequence: TTG
ctttgtcaccaggctggagt

SEQ ID NO: 206007 - DNA, 20 bp, Artificial Sequence
  Description of Artificial Sequence: Synthetic oligonucleotide
  Target: ATXN1; (-) strand; PAM type: YTN; PAM sequence: CTT
gctttgtcaccaggctggag

SEQ ID NO: 206008 - DNA, 20 bp, Artificial Sequence
  Description of Artificial Sequence: Synthetic oligonucleotide
  Target: ATXN1; (-) strand; PAM type: YTN; PAM sequence: TTG
agacagagtcttgctttgtc

SEQ ID NO: 206009 - DNA, 20 bp, Artificial Sequence
  Description of Artificial Sequence: Synthetic oligonucleotide
  Target: ATXN1; (-) strand; PAM type: YTN; PAM sequence: TTT
gagacagagtcttgctttgt

SEQ ID NO: 206010 - DNA, 20 bp, Artificial Sequence
  Description of Artificial Sequence: Synthetic oligonucleotide
  Target: ATXN1; (-) strand; PAM type: YTN; PAM sequence: TTT
tgagacagagtcttgctttg

SEQ ID NO: 206011 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagtcttgcttt

SEQ ID NO: 206012 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagtcttgctt

SEQ ID NO: 206013 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagtcttgct

SEQ ID NO: 206014 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagtcttgc

SEQ ID NO: 206015 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagtcttg

SEQ ID NO: 206016 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtctt

SEQ ID NO: 206017 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagtct

SEQ ID NO: 206018 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtc

SEQ ID NO: 206019 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 206020 - DNA, 20 bp, Artificial Sequence
  Description of Artificial Sequence: Synthetic oligonucleotide
  Target: ATXN1; (-) strand; PAM type: YTN; PAM sequence: CTT
tttttttttttgagacagag

SEQ ID NO: 206021 - DNA, 20 bp, Artificial Sequence
  Description of Artificial Sequence: Synthetic oligonucleotide
  Target: ATXN1; (-) strand; PAM type: YTN; PAM sequence: TTG
atactttttttttttttgag

SEQ ID NO: 206022 - DNA, 20 bp, Artificial Sequence
  Description of Artificial Sequence: Synthetic oligonucleotide
  Target: ATXN1; (-) strand; PAM type: YTN; PAM sequence: TTT
gatactttttttttttttga

SEQ ID NO: 206023 - DNA, 20 bp, Artificial Sequence
  Description of Artificial Sequence: Synthetic oligonucleotide
  Target: ATXN1; (-) strand; PAM type: YTN; PAM sequence: CTG
ggaaaaatgaggtgatagtg

SEQ ID NO: 206024 - DNA, 20 bp, Artificial Sequence
  Description of Artificial Sequence: Synthetic oligonucleotide
  Target: ATXN1; (-) strand; PAM type: YTN; PAM sequence: CTC
tgggaaaaatgaggtgatag

SEQ ID NO: 206025 - DNA, 20 bp, Artificial Sequence
  Description of Artificial Sequence: Synthetic oligonucleotide
  Target: ATXN1; (-) strand; PAM type: YTN; PAM sequence: CTA
ggtgacataaccctctggga

SEQ ID NO: 206026 - DNA, 20 bp, Artificial Sequence
  Description of Artificial Sequence: Synthetic oligonucleotide
  Target: ATXN1; (-) strand; PAM type: YTN; PAM sequence: TTA
agactaggtgacataaccct

SEQ ID NO: 206027 - DNA, 20 bp, Artificial Sequence
  Description of Artificial Sequence: Synthetic oligonucleotide
  Target: ATXN1; (-) strand; PAM type: YTN; PAM sequence: TTT
aagactaggtgacataaccc

SEQ ID NO: 206028 - DNA, 20 bp, Artificial Sequence
  Description of Artificial Sequence: Synthetic oligonucleotide
  Target: ATXN1; (-) strand; PAM type: YTN; PAM sequence: TTT
taagactaggtgacataacc

SEQ ID NO: 206029 - DNA, 20 bp, Artificial Sequence
  Description of Artificial Sequence: Synthetic oligonucleotide
  Target: ATXN1; (-) strand; PAM type: YTN; PAM sequence: TTA
aaatcaaagtacagtcaaat

SEQ ID NO: 206030 - DNA, 20 bp, Artificial Sequence
  Description of Artificial Sequence: Synthetic oligonucleotide
  Target: ATXN1; (-) strand; PAM type: YTN; PAM sequence: TTG
ggaattaaaatcaaagtaca

SEQ ID NO: 206031 - DNA, 20 bp, Artificial Sequence
  Description of Artificial Sequence: Synthetic oligonucleotide
  Target: ATXN1; (-) strand; PAM type: YTN; PAM sequence: CTT
gggaattaaaatcaaagtac

SEQ ID NO: 206032 - DNA, 20 bp, Artificial Sequence
  Description of Artificial Sequence: Synthetic oligonucleotide
  Target: ATXN1; (-) strand; PAM type: YTN; PAM sequence: TTG
agcttgggaattaaaatcaa

SEQ ID NO: 206033 - DNA, 20 bp, Artificial Sequence
  Description of Artificial Sequence: Synthetic oligonucleotide
  Target: ATXN1; (-) strand; PAM type: YTN; PAM sequence: CTT
gagcttgggaattaaaatca

SEQ ID NO: 206034 - DNA, 20 bp, Artificial Sequence
  Description of Artificial Sequence: Synthetic oligonucleotide
  Target: ATXN1; (-) strand; PAM type: YTN; PAM sequence: TTC
acttgagcttgggaattaaa

SEQ ID NO: 206035 - DNA, 20 bp, Artificial Sequence
  Description of Artificial Sequence: Synthetic oligonucleotide
  Target: ATXN1; (-) strand; PAM type: YTN; PAM sequence: TTT
cacttgagcttgggaattaa

SEQ ID NO: 206036 - DNA, 20 bp, Artificial Sequence
  Description of Artificial Sequence: Synthetic oligonucleotide
  Target: ATXN1; (-) strand; PAM type: YTN; PAM sequence: TTG
aaatatgaacatgtcggttt

SEQ ID NO: 206037 - DNA, 20 bp, Artificial Sequence
  Description of Artificial Sequence: Synthetic oligonucleotide
  Target: ATXN1; (-) strand; PAM type: YTN; PAM sequence: CTC
agttgaaatatgaacatgtc

SEQ ID NO: 206038 - DNA, 20 bp, Artificial Sequence
  Description of Artificial Sequence: Synthetic oligonucleotide
  Target: ATXN1; (-) strand; PAM type: YTN; PAM sequence: TTA
cactcagttgaaatatgaac

SEQ ID NO: 206039 - DNA, 20 bp, Artificial Sequence
  Description of Artificial Sequence: Synthetic oligonucleotide
  Target: ATXN1; (-) strand; PAM type: YTN; PAM sequence: CTT
acactcagttgaaatatgaa

SEQ ID NO: 206040 - DNA, 20 bp, Artificial Sequence
  Description of Artificial Sequence: Synthetic oligonucleotide
  Target: ATXN1; (-) strand; PAM type: YTN; PAM sequence: CTA
aaataaccaccaacttacac

SEQ ID NO: 206041 - DNA, 20 bp, Artificial Sequence
  Description of Artificial Sequence: Synthetic oligonucleotide
  Target: ATXN1; (-) strand; PAM type: YTN; PAM sequence: TTA
ctaaaataaccaccaactta

SEQ ID NO: 206042 - DNA, 20 bp, Artificial Sequence
  Description of Artificial Sequence: Synthetic oligonucleotide
  Target: ATXN1; (-) strand; PAM type: YTN; PAM sequence: TTT
actaaaataaccaccaactt

SEQ ID NO: 206043 - DNA, 20 bp, Artificial Sequence
  Description of Artificial Sequence: Synthetic oligonucleotide
  Target: ATXN1; (-) strand; PAM type: YTN; PAM sequence: TTA
atttactaaaataaccacca

SEQ ID NO: 206044 - DNA, 20 bp, Artificial Sequence
  Description of Artificial Sequence: Synthetic oligonucleotide
  Target: ATXN1; (-) strand; PAM type: YTN; PAM sequence: TTT
aatttactaaaataaccacc

SEQ ID NO: 206045 - DNA, 20 bp, Artificial Sequence
  Description of Artificial Sequence: Synthetic oligonucleotide
  Target: ATXN1; (-) strand; PAM type: YTN; PAM sequence: TTT
taatttactaaaataaccac

SEQ ID NO: 206046 - DNA, 20 bp, Artificial Sequence
  Description of Artificial Sequence: Synthetic oligonucleotide
  Target: ATXN1; (-) strand; PAM type: YTN; PAM sequence: TTT
ttaatttactaaaataacca

SEQ ID NO: 206047 - DNA, 20 bp, Artificial Sequence
  Description of Artificial Sequence: Synthetic oligonucleotide
  Target: ATXN1; (-) strand; PAM type: YTN; PAM sequence: TTA
gcatttttaatttactaaaa

SEQ ID NO: 206048 - DNA, 20 bp, Artificial Sequence
  Description of Artificial Sequence: Synthetic oligonucleotide
  Target: ATXN1; (-) strand; PAM type: YTN; PAM sequence: CTT
agcatttttaatttactaaa

SEQ ID NO: 206049 - DNA, 20 bp, Artificial Sequence
  Description of Artificial Sequence: Synthetic oligonucleotide
  Target: ATXN1; (-) strand; PAM type: YTN; PAM sequence: TTA
cttagcatttttaatttact

SEQ ID NO: 206050 - DNA, 20 bp, Artificial Sequence
  Description of Artificial Sequence: Synthetic oligonucleotide
  Target: ATXN1; (-) strand; PAM type: YTN; PAM sequence: TTG
ggattacttagcatttttaa

SEQ ID NO: 206051 - DNA, 20 bp, Artificial Sequence
  Description of Artificial Sequence: Synthetic oligonucleotide
  Target: ATXN1; (-) strand; PAM type: YTN; PAM sequence: TTT
gggattacttagcattttta

SEQ ID NO: 206052 - DNA, 20 bp, Artificial Sequence
  Description of Artificial Sequence: Synthetic oligonucleotide
  Target: ATXN1; (-) strand; PAM type: YTN; PAM sequence: CTG
gatttgggattacttagcat

SEQ ID NO: 206053 - DNA, 20 bp, Artificial Sequence
  Description of Artificial Sequence: Synthetic oligonucleotide
  Target: ATXN1; (-) strand; PAM type: YTN; PAM sequence: TTG
gcatctggatttgggattac

SEQ ID NO: 206054 - DNA, 20 bp, Artificial Sequence
  Description of Artificial Sequence: Synthetic oligonucleotide
  Target: ATXN1; (-) strand; PAM type: YTN; PAM sequence: TTT
ggcatctggatttgggatta

SEQ ID NO: 206055 - DNA, 20 bp, Artificial Sequence
  Description of Artificial Sequence: Synthetic oligonucleotide
  Target: ATXN1; (-) strand; PAM type: YTN; PAM sequence: TTT
tggcatctggatttgggatt

SEQ ID NO: 206056 - DNA, 20 bp, Artificial Sequence
  Description of Artificial Sequence: Synthetic oligonucleotide
  Target: ATXN1; (-) strand; PAM type: YTN; PAM sequence: TTA
gtgttttggcatctggattt

SEQ ID NO: 206057 - DNA, 20 bp, Artificial Sequence
  Description of Artificial Sequence: Synthetic oligonucleotide
  Target: ATXN1; (-) strand; PAM type: YTN; PAM sequence: CTT
agtgttttggcatctggatt

SEQ ID NO: 206058 - DNA, 20 bp, Artificial Sequence
  Description of Artificial Sequence: Synthetic oligonucleotide
  Target: ATXN1; (-) strand; PAM type: YTN; PAM sequence: CTG
cttagtgttttggcatctgg

SEQ ID NO: 206059 - DNA, 20 bp, Artificial Sequence
  Description of Artificial Sequence: Synthetic oligonucleotide
  Target: ATXN1; (-) strand; PAM type: YTN; PAM sequence: TTC
tgcttagtgttttggcatct

SEQ ID NO: 206060 - DNA, 20 bp, Artificial Sequence
  Description of Artificial Sequence: Synthetic oligonucleotide
  Target: ATXN1; (-) strand; PAM type: YTN; PAM sequence: TTT
ctgcttagtgttttggcatc

SEQ ID NO: 206061 - DNA, 20 bp, Artificial Sequence
  Description of Artificial Sequence: Synthetic oligonucleotide
  Target: ATXN1; (-) strand; PAM type: YTN; PAM sequence: TTA
ggtttctgcttagtgttttg

SEQ ID NO: 206062 - DNA, 20 bp, Artificial Sequence
  Description of Artificial Sequence: Synthetic oligonucleotide
  Target: ATXN1; (-) strand; PAM type: YTN; PAM sequence: TTT
aggtttctgcttagtgtttt

SEQ ID NO: 206063 - DNA, 20 bp, Artificial Sequence
  Description of Artificial Sequence: Synthetic oligonucleotide
  Target: ATXN1; (-) strand; PAM type: YTN; PAM sequence: TTT
taggtttctgcttagtgttt

SEQ ID NO: 206064 - DNA, 20 bp, Artificial Sequence
  Description of Artificial Sequence: Synthetic oligonucleotide
  Target: ATXN1; (-) strand; PAM type: YTN; PAM sequence: TTA
ggcaggacgtggattttagg

SEQ ID NO: 206065 - DNA, 20 bp, Artificial Sequence
  Description of Artificial Sequence: Synthetic oligonucleotide
  Target: ATXN1; (-) strand; PAM type: YTN; PAM sequence: CTT
aggcaggacgtggattttag

SEQ ID NO: 206066 - DNA, 20 bp, Artificial Sequence
  Description of Artificial Sequence: Synthetic oligonucleotide
  Target: ATXN1; (-) strand; PAM type: YTN; PAM sequence: TTA
gccgcttaggcaggacgtgg

SEQ ID NO: 206067 - DNA, 20 bp, Artificial Sequence
  Description of Artificial Sequence: Synthetic oligonucleotide
  Target: ATXN1; (-) strand; PAM type: YTN; PAM sequence: TTT
agccgcttaggcaggacgtg

SEQ ID NO: 206068 - DNA, 20 bp, Artificial Sequence
  Description of Artificial Sequence: Synthetic oligonucleotide
  Target: ATXN1; (-) strand; PAM type: YTN; PAM sequence: CTA
atgaaatttagccgcttagg

SEQ ID NO: 206069 - DNA, 20 bp, Artificial Sequence
  Description of Artificial Sequence: Synthetic oligonucleotide
  Target: ATXN1; (-) strand; PAM type: YTN; PAM sequence: TTC
taatgaaatttagccgctta

SEQ ID NO: 206070 - DNA, 20 bp, Artificial Sequence
  Description of Artificial Sequence: Synthetic oligonucleotide
  Target: ATXN1; (-) strand; PAM type: YTN; PAM sequence: TTT
ctaatgaaatttagccgctt

SEQ ID NO: 206071 - DNA, 20 bp, Artificial Sequence
  Description of Artificial Sequence: Synthetic oligonucleotide
  Target: ATXN1; (-) strand; PAM type: YTN; PAM sequence: TTG
tttctaatgaaatttagccg

SEQ ID NO: 206072 - DNA, 20 bp, Artificial Sequence
  Description of Artificial Sequence: Synthetic oligonucleotide
  Target: ATXN1; (-) strand; PAM type: YTN; PAM sequence: CTT
gtttctaatgaaatttagcc

SEQ ID NO: 206073 - DNA, 20 bp, Artificial Sequence
  Description of Artificial Sequence: Synthetic oligonucleotide
  Target: ATXN1; (-) strand; PAM type: YTN; PAM sequence: CTG
acttgtttctaatgaaattt

SEQ ID NO: 206074 - DNA, 20 bp, Artificial Sequence
  Description of Artificial Sequence: Synthetic oligonucleotide
  Target: ATXN1; (-) strand; PAM type: YTN; PAM sequence: TTA
tcatctgacttgtttctaat

SEQ ID NO: 206075 - DNA, 20 bp, Artificial Sequence
  Description of Artificial Sequence: Synthetic oligonucleotide
  Target: ATXN1; (-) strand; PAM type: YTN; PAM sequence: TTG
atgttatcatctgacttgtt

SEQ ID NO: 206076 - DNA, 20 bp, Artificial Sequence
  Description of Artificial Sequence: Synthetic oligonucleotide
  Target: ATXN1; (-) strand; PAM type: YTN; PAM sequence: TTT
gatgttatcatctgacttgt

SEQ ID NO: 206077 - DNA, 20 bp, Artificial Sequence
  Description of Artificial Sequence: Synthetic oligonucleotide
  Target: ATXN1; (-) strand; PAM type: YTN; PAM sequence: TTT
tgatgttatcatctgacttg

SEQ ID NO: 206078 - DNA, 20 bp, Artificial Sequence
  Description of Artificial Sequence: Synthetic oligonucleotide
  Target: ATXN1; (-) strand; PAM type: YTN; PAM sequence: CTT
ttgatgttatcatctgactt

SEQ ID NO: 206079 - DNA, 20 bp, Artificial Sequence
  Description of Artificial Sequence: Synthetic oligonucleotide
  Target: ATXN1; (-) strand; PAM type: YTN; PAM sequence: TTC
atatatgccttttgatgtta

SEQ ID NO: 206080 - DNA, 20 bp, Artificial Sequence
  Description of Artificial Sequence: Synthetic oligonucleotide
  Target: ATXN1; (-) strand; PAM type: YTN; PAM sequence: TTG
gaattcatatatgccttttg

SEQ ID NO: 206081 - DNA, 20 bp, Artificial Sequence
  Description of Artificial Sequence: Synthetic oligonucleotide
  Target: ATXN1; (-) strand; PAM type: YTN; PAM sequence: TTT
ggaattcatatatgcctttt

SEQ ID NO: 206082 - DNA, 20 bp, Artificial Sequence
  Description of Artificial Sequence: Synthetic oligonucleotide
  Target: ATXN1; (-) strand; PAM type: YTN; PAM sequence: CTT
tggaattcatatatgccttt

SEQ ID NO: 206083 - DNA, 20 bp, Artificial Sequence
  Description of Artificial Sequence: Synthetic oligonucleotide
  Target: ATXN1; (-) strand; PAM type: YTN; PAM sequence: TTA
ctttggaattcatatatgcc

SEQ ID NO: 206084 - DNA, 20 bp, Artificial Sequence
  Description of Artificial Sequence: Synthetic oligonucleotide
  Target: ATXN1; (-) strand; PAM type: YTN; PAM sequence: TTT
actttggaattcatatatgc

SEQ ID NO: 206085 - DNA, 20 bp, Artificial Sequence
  Description of Artificial Sequence: Synthetic oligonucleotide
  Target: ATXN1; (-) strand; PAM type: YTN; PAM sequence: CTT
tactttggaattcatatatg

SEQ ID NO: 206086 - DNA, 20 bp, Artificial Sequence
  Description of Artificial Sequence: Synthetic oligonucleotide
  Target: ATXN1; (-) strand; PAM type: YTN; PAM sequence: TTC
atatctttactttggaattc

SEQ ID NO: 206087 - DNA, 20 bp, Artificial Sequence
  Description of Artificial Sequence: Synthetic oligonucleotide
  Target: ATXN1; (-) strand; PAM type: YTN; PAM sequence: TTT
catatctttactttggaatt

SEQ ID NO: 206088 - DNA, 20 bp, Artificial Sequence
  Description of Artificial Sequence: Synthetic oligonucleotide
  Target: ATXN1; (-) strand; PAM type: YTN; PAM sequence: TTT
tcatatctttactttggaat

SEQ ID NO: 206089 - DNA, 20 bp, Artificial Sequence
  Description of Artificial Sequence: Synthetic oligonucleotide
  Target: ATXN1; (-) strand; PAM type: YTN; PAM sequence: TTC
attttcatatctttactttg

SEQ ID NO: 206090 - DNA, 20 bp, Artificial Sequence
  Description of Artificial Sequence: Synthetic oligonucleotide
  Target: ATXN1; (-) strand; PAM type: YTN; PAM sequence: CTT
cattttcatatctttacttt

SEQ ID NO: 206091 - DNA, 20 bp, Artificial Sequence
  Description of Artificial Sequence: Synthetic oligonucleotide
  Target: ATXN1; (-) strand; PAM type: YTN; PAM sequence: CTC
ttcattttcatatctttact

SEQ ID NO: 206092 - DNA, 20 bp, Artificial Sequence
  Description of Artificial Sequence: Synthetic oligonucleotide
  Target: ATXN1; (-) strand; PAM type: YTN; PAM sequence: CTC
tcttcattttcatatcttta

SEQ ID NO: 206093 - DNA, 20 bp, Artificial Sequence
  Description of Artificial Sequence: Synthetic oligonucleotide
  Target: ATXN1; (-) strand; PAM type: YTN; PAM sequence: TTC
ctctcttcattttcatatct

SEQ ID NO: 206094 - DNA, 20 bp, Artificial Sequence
  Description of Artificial Sequence: Synthetic oligonucleotide
  Target: ATXN1; (-) strand; PAM type: YTN; PAM sequence: TTA
gatatcgaaattcctctctt

SEQ ID NO: 206095 - DNA, 20 bp, Artificial Sequence
  Description of Artificial Sequence: Synthetic oligonucleotide
  Target: ATXN1; (-) strand; PAM type: YTN; PAM sequence: CTG
tattagatatcgaaattcct

SEQ ID NO: 206096 - DNA, 20 bp, Artificial Sequence
  Description of Artificial Sequence: Synthetic oligonucleotide
  Target: ATXN1; (-) strand; PAM type: YTN; PAM sequence: TTA
agacatggctgtattagata

SEQ ID NO: 206097 - DNA, 20 bp, Artificial Sequence
  Description of Artificial Sequence: Synthetic oligonucleotide
  Target: ATXN1; (-) strand; PAM type: YTN; PAM sequence: TTT
aagacatggctgtattagat

SEQ ID NO: 206098 - DNA, 20 bp, Artificial Sequence
  Description of Artificial Sequence: Synthetic oligonucleotide
  Target: ATXN1; (-) strand; PAM type: YTN; PAM sequence: TTT
taagacatggctgtattaga

SEQ ID NO: 206099 - DNA, 20 bp, Artificial Sequence
  Description of Artificial Sequence: Synthetic oligonucleotide
  Target: ATXN1; (-) strand; PAM type: YTN; PAM sequence: TTT
ttaagacatggctgtattag

SEQ ID NO: 206100 - DNA, 20 bp, Artificial Sequence
  Description of Artificial Sequence: Synthetic oligonucleotide
  Target: ATXN1; (-) strand; PAM type: YTN; PAM sequence: TTT
tttaagacatggctgtatta

SEQ ID NO: 206101 - DNA, 20 bp, Artificial Sequence
  Description of Artificial Sequence: Synthetic oligonucleotide
  Target: ATXN1; (-) strand; PAM type: YTN; PAM sequence: TTA
agaattttttaagacatggc

SEQ ID NO: 206102 - DNA, 20 bp, Artificial Sequence
  Description of Artificial Sequence: Synthetic oligonucleotide
  Target: ATXN1; (-) strand; PAM type: YTN; PAM sequence: TTT
aagaattttttaagacatgg

SEQ ID NO: 206103 - DNA, 20 bp, Artificial Sequence
  Description of Artificial Sequence: Synthetic oligonucleotide
  Target: ATXN1; (-) strand; PAM type: YTN; PAM sequence: TTG
tgaacaggtaaacatgttta

SEQ ID NO: 206104 - DNA, 20 bp, Artificial Sequence
  Description of Artificial Sequence: Synthetic oligonucleotide
  Target: ATXN1; (-) strand; PAM type: YTN; PAM sequence: TTT
gtgaacaggtaaacatgttt

SEQ ID NO: 206105 - DNA, 20 bp, Artificial Sequence
  Description of Artificial Sequence: Synthetic oligonucleotide
  Target: ATXN1; (-) strand; PAM type: YTN; PAM sequence: CTT
tgtgaacaggtaaacatgtt

SEQ ID NO: 206106 - DNA, 20 bp, Artificial Sequence
  Description of Artificial Sequence: Synthetic oligonucleotide
  Target: ATXN1; (-) strand; PAM type: YTN; PAM sequence: TTA
gtatgtagactttgtgaaca

SEQ ID NO: 206107 - DNA, 20 bp, Artificial Sequence
  Description of Artificial Sequence: Synthetic oligonucleotide
  Target: ATXN1; (-) strand; PAM type: YTN; PAM sequence: CTG
tattagtatgtagactttgt

SEQ ID NO: 206108 - DNA, 20 bp, Artificial Sequence
  Description of Artificial Sequence: Synthetic oligonucleotide
  Target: ATXN1; (-) strand; PAM type: YTN; PAM sequence: CTA
agatctgtattagtatgtag

SEQ ID NO: 206109 - DNA, 20 bp, Artificial Sequence
  Description of Artificial Sequence: Synthetic oligonucleotide
  Target: ATXN1; (-) strand; PAM type: YTN; PAM sequence: TTC
taagatctgtattagtatgt

SEQ ID NO: 206110 - DNA, 20 bp, Artificial Sequence
  Description of Artificial Sequence: Synthetic oligonucleotide
  Target: ATXN1; (-) strand; PAM type: YTN; PAM sequence: TTG
cagtgattctaagatctgta

SEQ ID NO: 206111 - DNA, 20 bp, Artificial Sequence
  Description of Artificial Sequence: Synthetic oligonucleotide
  Target: ATXN1; (-) strand; PAM type: YTN; PAM sequence: TTG
tgttgcagtgattctaagat

SEQ ID NO: 206112 - DNA, 20 bp, Artificial Sequence
  Description of Artificial Sequence: Synthetic oligonucleotide
  Target: ATXN1; (-) strand; PAM type: YTN; PAM sequence: TTT
gtgttgcagtgattctaaga

SEQ ID NO: 206113 - DNA, 20 bp, Artificial Sequence
  Description of Artificial Sequence: Synthetic oligonucleotide
  Target: ATXN1; (-) strand; PAM type: YTN; PAM sequence: TTT
tgtgttgcagtgattctaag

SEQ ID NO: 206114 - DNA, 20 bp, Artificial Sequence
  Description of Artificial Sequence: Synthetic oligonucleotide
  Target: ATXN1; (-) strand; PAM type: YTN; PAM sequence: CTC
atatccattttgtgttgcag

SEQ ID NO: 206115 - DNA, 20 bp, Artificial Sequence
  Description of Artificial Sequence: Synthetic oligonucleotide
  Target: ATXN1; (-) strand; PAM type: YTN; PAM sequence: TTG
atatgctcatatccattttg

SEQ ID NO: 206116 - DNA, 20 bp, Artificial Sequence
  Description of Artificial Sequence: Synthetic oligonucleotide
  Target: ATXN1; (-) strand; PAM type: YTN; PAM sequence: CTT
gatatgctcatatccatttt

SEQ ID NO: 206117 - DNA, 20 bp, Artificial Sequence
  Description of Artificial Sequence: Synthetic oligonucleotide
  Target: ATXN1; (-) strand; PAM type: YTN; PAM sequence: TTC
ttgatatgctcatatccatt

SEQ ID NO: 206118 - DNA, 20 bp, Artificial Sequence
  Description of Artificial Sequence: Synthetic oligonucleotide
  Target: ATXN1; (-) strand; PAM type: YTN; PAM sequence: TTT
cttgatatgctcatatccat

SEQ ID NO: 206119 - DNA, 20 bp, Artificial Sequence
  Description of Artificial Sequence: Synthetic oligonucleotide
  Target: ATXN1; (-) strand; PAM type: YTN; PAM sequence: TTG
atttcttgatatgctcatat

SEQ ID NO: 206120 - DNA, 20 bp, Artificial Sequence
  Description of Artificial Sequence: Synthetic oligonucleotide
  Target: ATXN1; (-) strand; PAM type: YTN; PAM sequence: TTG
ttgatttcttgatatgctca

SEQ ID NO: 206121 - DNA, 20 bp, Artificial Sequence
  Description of Artificial Sequence: Synthetic oligonucleotide
  Target: ATXN1; (-) strand; PAM type: YTN; PAM sequence: TTT
gttgatttcttgatatgctc

SEQ ID NO: 206122 - DNA, 20 bp, Artificial Sequence
  Description of Artificial Sequence: Synthetic oligonucleotide
  Target: ATXN1; (-) strand; PAM type: YTN; PAM sequence: TTT
tgttgatttcttgatatgct

SEQ ID NO: 206123 - DNA, 20 bp, Artificial Sequence
  Description of Artificial Sequence: Synthetic oligonucleotide
  Target: ATXN1; (-) strand; PAM type: YTN; PAM sequence: TTG
tgggacccatacataatttt

SEQ ID NO: 206124 - DNA, 20 bp, Artificial Sequence
  Description of Artificial Sequence: Synthetic oligonucleotide
  Target: ATXN1; (-) strand; PAM type: YTN; PAM sequence: TTA
ttgtgggacccatacataat

SEQ ID NO: 206125 - DNA, 20 bp, Artificial Sequence
  Description of Artificial Sequence: Synthetic oligonucleotide
  Target: ATXN1; (-) strand; PAM type: YTN; PAM sequence: CTA
cacatatacaaaaggagagt

SEQ ID NO: 206126 - DNA, 20 bp, Artificial Sequence
  Description of Artificial Sequence: Synthetic oligonucleotide
  Target: ATXN1; (-) strand; PAM type: YTN; PAM sequence: TTA
atcaaagggagtgtcatatg

SEQ ID NO: 206127 - DNA, 20 bp, Artificial Sequence
  Description of Artificial Sequence: Synthetic oligonucleotide
  Target: ATXN1; (-) strand; PAM type: YTN; PAM sequence: CTA
aatggcaaggagaggcaaag

SEQ ID NO: 206128 - DNA, 20 bp, Artificial Sequence
  Description of Artificial Sequence: Synthetic oligonucleotide
  Target: ATXN1; (-) strand; PAM type: YTN; PAM sequence: TTC
taaatggcaaggagaggcaa

SEQ ID NO: 206129 - DNA, 20 bp, Artificial Sequence
  Description of Artificial Sequence: Synthetic oligonucleotide
  Target: ATXN1; (-) strand; PAM type: YTN; PAM sequence: TTT
ctaaatggcaaggagaggca

SEQ ID NO: 206130 - DNA, 20 bp, Artificial Sequence
  Description of Artificial Sequence: Synthetic oligonucleotide
  Target: ATXN1; (-) strand; PAM type: YTN; PAM sequence: TTT
tctaaatggcaaggagaggc

SEQ ID NO: 206131 - DNA, 20 bp, Artificial Sequence
  Description of Artificial Sequence: Synthetic oligonucleotide
  Target: ATXN1; (-) strand; PAM type: YTN; PAM sequence: CTG
aaaaatgagtaggaattttc

SEQ ID NO: 206132 - DNA, 20 bp, Artificial Sequence
  Description of Artificial Sequence: Synthetic oligonucleotide
  Target: ATXN1; (-) strand; PAM type: YTN; PAM sequence: CTG
tgtccagctgaaaaatgagt

SEQ ID NO: 206133 - DNA, 20 bp, Artificial Sequence
  Description of Artificial Sequence: Synthetic oligonucleotide
  Target: ATXN1; (-) strand; PAM type: YTN; PAM sequence: TTA
caggcatgagccactgtgtc

SEQ ID NO: 206134 - DNA, 20 bp, Artificial Sequence
  Description of Artificial Sequence: Synthetic oligonucleotide
  Target: ATXN1; (-) strand; PAM type: YTN; PAM sequence: TTT
acaggcatgagccactgtgt

SEQ ID NO: 206135 - DNA, 20 bp, Artificial Sequence
  Description of Artificial Sequence: Synthetic oligonucleotide
  Target: ATXN1; (-) strand; PAM type: YTN; PAM sequence: CTG
gatttacaggcatgagccac

SEQ ID NO: 206136 - DNA, 20 bp, Artificial Sequence
  Description of Artificial Sequence: Synthetic oligonucleotide
  Target: ATXN1; (-) strand; PAM type: YTN; PAM sequence: TTG
gccccccaaagtgctggatt

SEQ ID NO: 206137 - DNA, 20 bp, Artificial Sequence
  Description of Artificial Sequence: Synthetic oligonucleotide
  Target: ATXN1; (-) strand; PAM type: YTN; PAM sequence: CTT
ggccccccaaagtgctggat

SEQ ID NO: 206138 - DNA, 20 bp, Artificial Sequence
  Description of Artificial Sequence: Synthetic oligonucleotide
  Target: ATXN1; (-) strand; PAM type: YTN; PAM sequence: CTC
ccgccttggccccccaaagt

SEQ ID NO: 206139 - DNA, 20 bp, Artificial Sequence
  Description of Artificial Sequence: Synthetic oligonucleotide
  Target: ATXN1; (-) strand; PAM type: YTN; PAM sequence: CTC
aggtgatcctcccgccttgg

SEQ ID NO: 206140 - DNA, 20 bp, Artificial Sequence
  Description of Artificial Sequence: Synthetic oligonucleotide
  Target: ATXN1; (-) strand; PAM type: YTN; PAM sequence: CTG
acctcaggtgatcctcccgc

SEQ ID NO: 206141 - DNA, 20 bp, Artificial Sequence
  Description of Artificial Sequence: Synthetic oligonucleotide
  Target: ATXN1; (-) strand; PAM type: YTN; PAM sequence: CTC
ctgacctcaggtgatcctcc

SEQ ID NO: 206142 - DNA, 20 bp, Artificial Sequence
  Description of Artificial Sequence: Synthetic oligonucleotide
  Target: ATXN1; (-) strand; PAM type: YTN; PAM sequence: CTC
gaactcctgacctcaggtga

SEQ ID NO: 206143 - DNA, 20 bp, Artificial Sequence
  Description of Artificial Sequence: Synthetic oligonucleotide
  Target: ATXN1; (-) strand; PAM type: YTN; PAM sequence: CTG
gtctcgaactcctgacctca

SEQ ID NO: 206144 - DNA, 20 bp, Artificial Sequence
  Description of Artificial Sequence: Synthetic oligonucleotide
  Target: ATXN1; (-) strand; PAM type: YTN; PAM sequence: TTG
gccaggctggtctcgaactc

SEQ ID NO: 206145 - DNA, 20 bp, Artificial Sequence
  Description of Artificial Sequence: Synthetic oligonucleotide
  Target: ATXN1; (-) strand; PAM type: YTN; PAM sequence: TTC
accatgttggccaggctggt

SEQ ID NO: 206146 - DNA, 20 bp, Artificial Sequence
  Description of Artificial Sequence: Synthetic oligonucleotide
  Target: ATXN1; (-) strand; PAM type: YTN; PAM sequence: TTT
caccatgttggccaggctgg

SEQ ID NO: 206147 - DNA, 20 bp, Artificial Sequence
  Description of Artificial Sequence: Synthetic oligonucleotide
  Target: ATXN1; (-) strand; PAM type: YTN; PAM sequence: TTA
gtatagatggggtttcacca

SEQ ID NO: 206148 - DNA, 20 bp, Artificial Sequence
  Description of Artificial Sequence: Synthetic oligonucleotide
  Target: ATXN1; (-) strand; PAM type: YTN; PAM sequence: TTT
agtatagatggggtttcacc

SEQ ID NO: 206149 - DNA, 20 bp, Artificial Sequence
  Description of Artificial Sequence: Synthetic oligonucleotide
  Target: ATXN1; (-) strand; PAM type: YTN; PAM sequence: TTT
tagtatagatggggtttcac

SEQ ID NO: 206150 - DNA, 20 bp, Artificial Sequence
  Description of Artificial Sequence: Synthetic oligonucleotide
  Target: ATXN1; (-) strand; PAM type: YTN; PAM sequence: TTT
ttagtatagatggggtttca

SEQ ID NO: 206151 - DNA, 20 bp, Artificial Sequence
  Description of Artificial Sequence: Synthetic oligonucleotide
  Target: ATXN1; (-) strand; PAM type: YTN; PAM sequence: TTT
tttagtatagatggggtttc

SEQ ID NO: 206152 - DNA, 20 bp, Artificial Sequence
  Description of Artificial Sequence: Synthetic oligonucleotide
  Target: ATXN1; (-) strand; PAM type: YTN; PAM sequence: TTT
ttttagtatagatggggttt

SEQ ID NO: 206153 - DNA, 20 bp, Artificial Sequence
  Description of Artificial Sequence: Synthetic oligonucleotide
  Target: ATXN1; (-) strand; PAM type: YTN; PAM sequence: TTT
tttttagtatagatggggtt

SEQ ID NO: 206154 - DNA, 20 bp, Artificial Sequence
  Description of Artificial Sequence: Synthetic oligonucleotide
  Target: ATXN1; (-) strand; PAM type: YTN; PAM sequence: TTT
ttttttagtatagatggggt

SEQ ID NO: 206155 - DNA, 20 bp, Artificial Sequence
  Description of Artificial Sequence: Synthetic oligonucleotide
  Target: ATXN1; (-) strand; PAM type: YTN; PAM sequence: TTT
tttttttagtatagatgggg

SEQ ID NO: 206156 - DNA, 20 bp, Artificial Sequence
  Description of Artificial Sequence: Synthetic oligonucleotide
  Target: ATXN1; (-) strand; PAM type: YTN; PAM sequence: TTT
ttttttttagtatagatggg

SEQ ID NO: 206157 - DNA, 20 bp, Artificial Sequence
  Description of Artificial Sequence: Synthetic oligonucleotide
  Target: ATXN1; (-) strand; PAM type: YTN; PAM sequence: CTA
gtttttttttttagtataga

SEQ ID NO: 206158 - DNA, 20 bp, Artificial Sequence
  Description of Artificial Sequence: Synthetic oligonucleotide
  Target: ATXN1; (-) strand; PAM type: YTN; PAM sequence: CTG
gctagtttttttttttagta

SEQ ID NO: 206159 - DNA, 20 bp, Artificial Sequence
  Description of Artificial Sequence: Synthetic oligonucleotide
  Target: ATXN1; (-) strand; PAM type: YTN; PAM sequence: TTA
caggcgcccaccaccatgcc

SEQ ID NO: 206160 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgcccaccac

SEQ ID NO: 206161 - DNA, 20 bp, Artificial Sequence
  Description of Artificial Sequence: Synthetic oligonucleotide
  Target: ATXN1; (-) strand; PAM type: YTN; PAM sequence: CTC
ccgggtcactgggattacag

SEQ ID NO: 206162 - DNA, 20 bp, Artificial Sequence
  Description of Artificial Sequence: Synthetic oligonucleotide
  Target: ATXN1; (-) strand; PAM type: YTN; PAM sequence: CTC
agcctcccgggtcactggga

SEQ ID NO: 206163 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgggtcact

SEQ ID NO: 206164 - DNA, 20 bp, Artificial Sequence
  Description of Artificial Sequence: Synthetic oligonucleotide
  Target: ATXN1; (-) strand; PAM type: YTN; PAM sequence: CTC
ctgcctcagcctcccgggtc

SEQ ID NO: 206165 - DNA, 20 bp, Artificial Sequence
  Description of Artificial Sequence: Synthetic oligonucleotide
  Target: ATXN1; (-) strand; PAM type: YTN; PAM sequence: TTC
tcctgcctcagcctcccggg

SEQ ID NO: 206166 - DNA, 20 bp, Artificial Sequence
  Description of Artificial Sequence: Synthetic oligonucleotide
  Target: ATXN1; (-) strand; PAM type: YTN; PAM sequence: TTC
aagcgattctcctgcctcag

SEQ ID NO: 206167 - DNA, 20 bp, Artificial Sequence
  Description of Artificial Sequence: Synthetic oligonucleotide
  Target: ATXN1; (-) strand; PAM type: YTN; PAM sequence: CTC
ccaggttcaagcgattctcc

SEQ ID NO: 206168 - DNA, 20 bp, Artificial Sequence
  Description of Artificial Sequence: Synthetic oligonucleotide
  Target: ATXN1; (-) strand; PAM type: YTN; PAM sequence: CTG
cctcccaggttcaagcgatt

SEQ ID NO: 206169 - DNA, 20 bp, Artificial Sequence
  Description of Artificial Sequence: Synthetic oligonucleotide
  Target: ATXN1; (-) strand; PAM type: YTN; PAM sequence: CTC
tgcctcccaggttcaagcga

SEQ ID NO: 206170 - DNA, 20 bp, Artificial Sequence
  Description of Artificial Sequence: Synthetic oligonucleotide
  Target: ATXN1; (-) strand; PAM type: YTN; PAM sequence: CTG
caacctctgcctcccaggtt

SEQ ID NO: 206171 - DNA, 20 bp, Artificial Sequence
  Description of Artificial Sequence: Synthetic oligonucleotide
  Target: ATXN1; (-) strand; PAM type: YTN; PAM sequence: TTA
ctgcaacctctgcctcccag

SEQ ID NO: 206172 - DNA, 20 bp, Artificial Sequence
  Description of Artificial Sequence: Synthetic oligonucleotide
  Target: ATXN1; (-) strand; PAM type: YTN; PAM sequence: CTT
actgcaacctctgcctccca

SEQ ID NO: 206173 - DNA, 20 bp, Artificial Sequence
  Description of Artificial Sequence: Synthetic oligonucleotide
  Target: ATXN1; (-) strand; PAM type: YTN; PAM sequence: CTC
agcttactgcaacctctgcc

SEQ ID NO: 206174 - DNA, 20 bp, Artificial Sequence
  Description of Artificial Sequence: Synthetic oligonucleotide
  Target: ATXN1; (-) strand; PAM type: YTN; PAM sequence: CTG
tagtgcaatggcacgatctc

SEQ ID NO: 206175 - DNA, 20 bp, Artificial Sequence
  Description of Artificial Sequence: Synthetic oligonucleotide
  Target: ATXN1; (-) strand; PAM type: YTN; PAM sequence: TTG
atgcccaggctgtagtgcaa

SEQ ID NO: 206176 - DNA, 20 bp, Artificial Sequence
  Description of Artificial Sequence: Synthetic oligonucleotide
  Target: ATXN1; (-) strand; PAM type: YTN; PAM sequence: CTG
ttgatgcccaggctgtagtg

SEQ ID NO: 206177 - DNA, 20 bp, Artificial Sequence
  Description of Artificial Sequence: Synthetic oligonucleotide
  Target: ATXN1; (-) strand; PAM type: YTN; PAM sequence: TTC
cgctgttgatgcccaggctg

SEQ ID NO: 206178 - DNA, 20 bp, Artificial Sequence
  Description of Artificial Sequence: Synthetic oligonucleotide
  Target: ATXN1; (-) strand; PAM type: YTN; PAM sequence: TTA
gacagagttccgctgttgat

SEQ ID NO: 206179 - DNA, 20 bp, Artificial Sequence
  Description of Artificial Sequence: Synthetic oligonucleotide
  Target: ATXN1; (-) strand; PAM type: YTN; PAM sequence: TTT
agacagagttccgctgttga

SEQ ID NO: 206180 - DNA, 20 bp, Artificial Sequence
  Description of Artificial Sequence: Synthetic oligonucleotide
  Target: ATXN1; (-) strand; PAM type: YTN; PAM sequence: TTT
tagacagagttccgctgttg

SEQ ID NO: 206181 - DNA, 20 bp, Artificial Sequence
  Description of Artificial Sequence: Synthetic oligonucleotide
  Target: ATXN1; (-) strand; PAM type: YTN; PAM sequence: TTT
ttagacagagttccgctgtt

SEQ ID NO: 206182 - DNA, 20 bp, Artificial Sequence
  Description of Artificial Sequence: Synthetic oligonucleotide
  Target: ATXN1; (-) strand; PAM type: YTN; PAM sequence: TTT
tttagacagagttccgctgt

SEQ ID NO: 206183 - DNA, 20 bp, Artificial Sequence
  Description of Artificial Sequence: Synthetic oligonucleotide
  Target: ATXN1; (-) strand; PAM type: YTN; PAM sequence: TTT
ttttagacagagttccgctg

SEQ ID NO: 206184 - DNA, 20 bp, Artificial Sequence
  Description of Artificial Sequence: Synthetic oligonucleotide
  Target: ATXN1; (-) strand; PAM type: YTN; PAM sequence: TTT
tttttagacagagttccgct

SEQ ID NO: 206185 - DNA, 20 bp, Artificial Sequence
  Description of Artificial Sequence: Synthetic oligonucleotide
  Target: ATXN1; (-) strand; PAM type: YTN; PAM sequence: TTT
ttttttagacagagttccgc

SEQ ID NO: 206186 - DNA, 20 bp, Artificial Sequence
  Description of Artificial Sequence: Synthetic oligonucleotide
  Target: ATXN1; (-) strand; PAM type: YTN; PAM sequence: TTT
tttttttagacagagttccg

SEQ ID NO: 206187 - DNA, 20 bp, Artificial Sequence
  Description of Artificial Sequence: Synthetic oligonucleotide
  Target: ATXN1; (-) strand; PAM type: YTN; PAM sequence: TTT
ttttttttagacagagttcc

SEQ ID NO: 206188 - DNA, 20 bp, Artificial Sequence
  Description of Artificial Sequence: Synthetic oligonucleotide
  Target: ATXN1; (-) strand; PAM type: YTN; PAM sequence: TTT
tttttttttagacagagttc

SEQ ID NO: 206189 - DNA, 20 bp, Artificial Sequence
  Description of Artificial Sequence: Synthetic oligonucleotide
  Target: ATXN1; (-) strand; PAM type: YTN; PAM sequence: TTT
ttttttttttagacagagtt

SEQ ID NO: 206190 - DNA, 20 bp, Artificial Sequence
  Description of Artificial Sequence: Synthetic oligonucleotide
  Target: ATXN1; (-) strand; PAM type: YTN; PAM sequence: TTT
tttttttttttagacagagt

SEQ ID NO: 206191 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttagacagag

SEQ ID NO: 206192 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttagacaga

SEQ ID NO: 206193 - DNA, 20 bp, Artificial Sequence
  Description of Artificial Sequence: Synthetic oligonucleotide
  Target: ATXN1; (-) strand; PAM type: YTN; PAM sequence: TTC
tttttttttttttttagaca

SEQ ID NO: 206194 - DNA, 20 bp, Artificial Sequence
  Description of Artificial Sequence: Synthetic oligonucleotide
  Target: ATXN1; (-) strand; PAM type: YTN; PAM sequence: TTT
ctttttttttttttttagac

SEQ ID NO: 206195 - DNA, 20 bp, Artificial Sequence
  Description of Artificial Sequence: Synthetic oligonucleotide
  Target: ATXN1; (-) strand; PAM type: YTN; PAM sequence: TTT
tctttttttttttttttaga

SEQ ID NO: 206196 - DNA, 20 bp, Artificial Sequence
  Description of Artificial Sequence: Synthetic oligonucleotide
  Target: ATXN1; (-) strand; PAM type: YTN; PAM sequence: TTG
aaaaatgagtaggaattttc

SEQ ID NO: 206197 - DNA, 20 bp, Artificial Sequence
  Description of Artificial Sequence: Synthetic oligonucleotide
  Target: ATXN1; (-) strand; PAM type: YTN; PAM sequence: CTT
gaaaaatgagtaggaatttt

SEQ ID NO: 206198 - DNA, 20 bp, Artificial Sequence
  Description of Artificial Sequence: Synthetic oligonucleotide
  Target: ATXN1; (-) strand; PAM type: YTN; PAM sequence: TTG
gccttgaaaaatgagtagga

SEQ ID NO: 206199 - DNA, 20 bp, Artificial Sequence
  Description of Artificial Sequence: Synthetic oligonucleotide
  Target: ATXN1; (-) strand; PAM type: YTN; PAM sequence: CTC
aaggttggccttgaaaaatg

SEQ ID NO: 206200 - DNA, 20 bp, Artificial Sequence
  Description of Artificial Sequence: Synthetic oligonucleotide
  Target: ATXN1; (-) strand; PAM type: YTN; PAM sequence: TTA
agctcaaggttggccttgaa

SEQ ID NO: 206201 - DNA, 20 bp, Artificial Sequence
  Description of Artificial Sequence: Synthetic oligonucleotide
  Target: ATXN1; (-) strand; PAM type: YTN; PAM sequence: TTT
aagctcaaggttggccttga

SEQ ID NO: 206202 - DNA, 20 bp, Artificial Sequence
  Description of Artificial Sequence: Synthetic oligonucleotide
  Target: ATXN1; (-) strand; PAM type: YTN; PAM sequence: CTA
tttaagctcaaggttggcct

SEQ ID NO: 206203 - DNA, 20 bp, Artificial Sequence
  Description of Artificial Sequence: Synthetic oligonucleotide
  Target: ATXN1; (-) strand; PAM type: YTN; PAM sequence: TTA
agctatttaagctcaaggtt

SEQ ID NO: 206204 - DNA, 20 bp, Artificial Sequence
  Description of Artificial Sequence: Synthetic oligonucleotide
  Target: ATXN1; (-) strand; PAM type: YTN; PAM sequence: TTT
aagctatttaagctcaaggt

SEQ ID NO: 206205 - DNA, 20 bp, Artificial Sequence
  Description of Artificial Sequence: Synthetic oligonucleotide
  Target: ATXN1; (-) strand; PAM type: YTN; PAM sequence: TTA
ggggatagatgaggatgaca

SEQ ID NO: 206206 - DNA, 20 bp, Artificial Sequence
  Description of Artificial Sequence: Synthetic oligonucleotide
  Target: ATXN1; (-) strand; PAM type: YTN; PAM sequence: TTC
cagaaaacattaggggatag

SEQ ID NO: 206207 - DNA, 20 bp, Artificial Sequence
  Description of Artificial Sequence: Synthetic oligonucleotide
  Target: ATXN1; (-) strand; PAM type: YTN; PAM sequence: TTT
ccagaaaacattaggggata

SEQ ID NO: 206208 - DNA, 20 bp, Artificial Sequence
  Description of Artificial Sequence: Synthetic oligonucleotide
  Target: ATXN1; (-) strand; PAM type: YTN; PAM sequence: TTA
gatttccagaaaacattagg

SEQ ID NO: 206209 - DNA, 20 bp, Artificial Sequence
  Description of Artificial Sequence: Synthetic oligonucleotide
  Target: ATXN1; (-) strand; PAM type: YTN; PAM sequence: CTT
agatttccagaaaacattag

SEQ ID NO: 206210 - DNA, 20 bp, Artificial Sequence
  Description of Artificial Sequence: Synthetic oligonucleotide
  Target: ATXN1; (-) strand; PAM type: YTN; PAM sequence: CTG
cttagatttccagaaaacat

SEQ ID NO: 206211 - DNA, 20 bp, Artificial Sequence
  Description of Artificial Sequence: Synthetic oligonucleotide
  Target: ATXN1; (-) strand; PAM type: YTN; PAM sequence: TTC
tgcttagatttccagaaaac

SEQ ID NO: 206212 - DNA, 20 bp, Artificial Sequence
  Description of Artificial Sequence: Synthetic oligonucleotide
  Target: ATXN1; (-) strand; PAM type: YTN; PAM sequence: CTA
ttctgcttagatttccagaa

SEQ ID NO: 206213 - DNA, 20 bp, Artificial Sequence
  Description of Artificial Sequence: Synthetic oligonucleotide
  Target: ATXN1; (-) strand; PAM type: YTN; PAM sequence: CTA
ggaaacgtaggtgaggcaga

SEQ ID NO: 206214 - DNA, 20 bp, Artificial Sequence
  Description of Artificial Sequence: Synthetic oligonucleotide
  Target: ATXN1; (-) strand; PAM type: YTN; PAM sequence: CTG
agctaggaaacgtaggtgag

SEQ ID NO: 206215 - DNA, 20 bp, Artificial Sequence
  Description of Artificial Sequence: Synthetic oligonucleotide
  Target: ATXN1; (-) strand; PAM type: YTN; PAM sequence: TTG
atgccatcactgagctagga

SEQ ID NO: 206216 - DNA, 20 bp, Artificial Sequence
  Description of Artificial Sequence: Synthetic oligonucleotide
  Target: ATXN1; (-) strand; PAM type: YTN; PAM sequence: TTG
ggagaggaagacgtcagagt

SEQ ID NO: 206217 - DNA, 20 bp, Artificial Sequence
  Description of Artificial Sequence: Synthetic oligonucleotide
  Target: ATXN1; (-) strand; PAM type: YTN; PAM sequence: TTT
gggagaggaagacgtcagag

SEQ ID NO: 206218 - DNA, 20 bp, Artificial Sequence
  Description of Artificial Sequence: Synthetic oligonucleotide
  Target: ATXN1; (-) strand; PAM type: YTN; PAM sequence: TTG
aatatggggcataatttggg

SEQ ID NO: 206219 - DNA, 20 bp, Artificial Sequence
  Description of Artificial Sequence: Synthetic oligonucleotide
  Target: ATXN1; (-) strand; PAM type: YTN; PAM sequence: CTG
catggttgaatatggggcat

SEQ ID NO: 206220 - DNA, 20 bp, Artificial Sequence
  Description of Artificial Sequence: Synthetic oligonucleotide
  Target: ATXN1; (-) strand; PAM type: YTN; PAM sequence: TTG
aggagtatggctgcatggtt

SEQ ID NO: 206221 - DNA, 20 bp, Artificial Sequence
  Description of Artificial Sequence: Synthetic oligonucleotide
  Target: ATXN1; (-) strand; PAM type: YTN; PAM sequence: TTA
gggggccagggaaagagtcc

SEQ ID NO: 206222 - DNA, 20 bp, Artificial Sequence
  Description of Artificial Sequence: Synthetic oligonucleotide
  Target: ATXN1; (-) strand; PAM type: YTN; PAM sequence: TTA
ggcaggagccaaggaaggta

SEQ ID NO: 206223 - DNA, 20 bp, Artificial Sequence
  Description of Artificial Sequence: Synthetic oligonucleotide
  Target: ATXN1; (-) strand; PAM type: YTN; PAM sequence: CTT
aggcaggagccaaggaaggt

SEQ ID NO: 206224 - DNA, 20 bp, Artificial Sequence
  Description of Artificial Sequence: Synthetic oligonucleotide
  Target: ATXN1; (-) strand; PAM type: YTN; PAM sequence: CTG
caatgccttaggcaggagcc

SEQ ID NO: 206225 - DNA, 20 bp, Artificial Sequence
  Description of Artificial Sequence: Synthetic oligonucleotide
  Target: ATXN1; (-) strand; PAM type: YTN; PAM sequence: TTA
gaaatggaaagccactgcaa

SEQ ID NO: 206226 - DNA, 20 bp, Artificial Sequence
  Description of Artificial Sequence: Synthetic oligonucleotide
  Target: ATXN1; (-) strand; PAM type: YTN; PAM sequence: TTT
agaaatggaaagccactgca

SEQ ID NO: 206227 - DNA, 20 bp, Artificial Sequence
  Description of Artificial Sequence: Synthetic oligonucleotide
  Target: ATXN1; (-) strand; PAM type: YTN; PAM sequence: TTG
ggggccatgtttagaaatgg

SEQ ID NO: 206228 - DNA, 20 bp, Artificial Sequence
  Description of Artificial Sequence: Synthetic oligonucleotide
  Target: ATXN1; (-) strand; PAM type: YTN; PAM sequence: TTT
gggggccatgtttagaaatg

SEQ ID NO: 206229 - DNA, 20 bp, Artificial Sequence
  Description of Artificial Sequence: Synthetic oligonucleotide
  Target: ATXN1; (-) strand; PAM type: YTN; PAM sequence: TTT
tgggggccatgtttagaaat

SEQ ID NO: 206230 - DNA, 20 bp, Artificial Sequence
  Description of Artificial Sequence: Synthetic oligonucleotide
  Target: ATXN1; (-) strand; PAM type: YTN; PAM sequence: TTG
gaagagaatgcaggttttgg

SEQ ID NO: 206231 - DNA, 20 bp, Artificial Sequence
  Description of Artificial Sequence: Synthetic oligonucleotide
  Target: ATXN1; (-) strand; PAM type: YTN; PAM sequence: CTG
tagtgcaagttggaagagaa

SEQ ID NO: 206232 - DNA, 20 bp, Artificial Sequence
  Description of Artificial Sequence: Synthetic oligonucleotide
  Target: ATXN1; (-) strand; PAM type: YTN; PAM sequence: TTG
aaagtaagccagccatgctg

SEQ ID NO: 206233 - DNA, 20 bp, Artificial Sequence
  Description of Artificial Sequence: Synthetic oligonucleotide
  Target: ATXN1; (-) strand; PAM type: YTN; PAM sequence: TTA
aggaattgaaagtaagccag

SEQ ID NO: 206234 - DNA, 20 bp, Artificial Sequence
  Description of Artificial Sequence: Synthetic oligonucleotide
  Target: ATXN1; (-) strand; PAM type: YTN; PAM sequence: TTT
aaggaattgaaagtaagcca

SEQ ID NO: 206235 - DNA, 20 bp, Artificial Sequence
  Description of Artificial Sequence: Synthetic oligonucleotide
  Target: ATXN1; (-) strand; PAM type: YTN; PAM sequence: TTT
taaggaattgaaagtaagcc

SEQ ID NO: 206236 - DNA, 20 bp, Artificial Sequence
  Description of Artificial Sequence: Synthetic oligonucleotide
  Target: ATXN1; (-) strand; PAM type: YTN; PAM sequence: CTT
ttaaggaattgaaagtaagc

SEQ ID NO: 206237 - DNA, 20 bp, Artificial Sequence
  Description of Artificial Sequence: Synthetic oligonucleotide
  Target: ATXN1; (-) strand; PAM type: YTN; PAM sequence: CTG
ggaaagcaaggtccttttaa

SEQ ID NO: 206238 - DNA, 20 bp, Artificial Sequence
  Description of Artificial Sequence: Synthetic oligonucleotide
  Target: ATXN1; (-) strand; PAM type: YTN; PAM sequence: TTA
aggcctgggaaagcaaggtc

SEQ ID NO: 206239 - DNA, 20 bp, Artificial Sequence
  Description of Artificial Sequence: Synthetic oligonucleotide
  Target: ATXN1; (-) strand; PAM type: YTN; PAM sequence: TTT
aaggcctgggaaagcaaggt

SEQ ID NO: 206240 - DNA, 20 bp, Artificial Sequence
  Description of Artificial Sequence: Synthetic oligonucleotide
  Target: ATXN1; (-) strand; PAM type: YTN; PAM sequence: CTT
taaggcctgggaaagcaagg

SEQ ID NO: 206241 - DNA, 20 bp, Artificial Sequence
  Description of Artificial Sequence: Synthetic oligonucleotide
  Target: ATXN1; (-) strand; PAM type: YTN; PAM sequence: TTA
gcaaggaggaagtcatgtgc

SEQ ID NO: 206242 - DNA, 20 bp, Artificial Sequence
  Description of Artificial Sequence: Synthetic oligonucleotide
  Target: ATXN1; (-) strand; PAM type: YTN; PAM sequence: CTT
agcaaggaggaagtcatgtg

SEQ ID NO: 206243 - DNA, 20 bp, Artificial Sequence
  Description of Artificial Sequence: Synthetic oligonucleotide
  Target: ATXN1; (-) strand; PAM type: YTN; PAM sequence: TTG
aggagaagtcttagcaagga

SEQ ID NO: 206244 - DNA, 20 bp, Artificial Sequence
  Description of Artificial Sequence: Synthetic oligonucleotide
  Target: ATXN1; (-) strand; PAM type: YTN; PAM sequence: TTT
gaggagaagtcttagcaagg

SEQ ID NO: 206245 - DNA, 20 bp, Artificial Sequence
  Description of Artificial Sequence: Synthetic oligonucleotide
  Target: ATXN1; (-) strand; PAM type: YTN; PAM sequence: TTG
atagaaggggtgggtgattt

SEQ ID NO: 206246 - DNA, 20 bp, Artificial Sequence
  Description of Artificial Sequence: Synthetic oligonucleotide
  Target: ATXN1; (-) strand; PAM type: YTN; PAM sequence: TTT
gatagaaggggtgggtgatt

SEQ ID NO: 206247 - DNA, 20 bp, Artificial Sequence
  Description of Artificial Sequence: Synthetic oligonucleotide
  Target: ATXN1; (-) strand; PAM type: YTN; PAM sequence: CTG
aaggagaaaagaatacaagg

SEQ ID NO: 206248 - DNA, 20 bp, Artificial Sequence
  Description of Artificial Sequence: Synthetic oligonucleotide
  Target: ATXN1; (-) strand; PAM type: YTN; PAM sequence: CTG
agagctgaaggagaaaagaa

SEQ ID NO: 206249 - DNA, 20 bp, Artificial Sequence
  Description of Artificial Sequence: Synthetic oligonucleotide
  Target: ATXN1; (-) strand; PAM type: YTN; PAM sequence: CTG
agctgagagctgaaggagaa

SEQ ID NO: 206250 - DNA, 20 bp, Artificial Sequence
  Description of Artificial Sequence: Synthetic oligonucleotide
  Target: ATXN1; (-) strand; PAM type: YTN; PAM sequence: TTG
agaagaggactgagctgaga

SEQ ID NO: 206251 - DNA, 20 bp, Artificial Sequence
  Description of Artificial Sequence: Synthetic oligonucleotide
  Target: ATXN1; (-) strand; PAM type: YTN; PAM sequence: CTT
gagaagaggactgagctgag

SEQ ID NO: 206252 - DNA, 20 bp, Artificial Sequence
  Description of Artificial Sequence: Synthetic oligonucleotide
  Target: ATXN1; (-) strand; PAM type: YTN; PAM sequence: CTC
ccttgagaagaggactgagc

SEQ ID NO: 206253 - DNA, 20 bp, Artificial Sequence
  Description of Artificial Sequence: Synthetic oligonucleotide
  Target: ATXN1; (-) strand; PAM type: YTN; PAM sequence: CTG
aggaagtctcccttgagaag

SEQ ID NO: 206254 - DNA, 20 bp, Artificial Sequence
  Description of Artificial Sequence: Synthetic oligonucleotide
  Target: ATXN1; (-) strand; PAM type: YTN; PAM sequence: CTG
gctgaggaagtctcccttga

SEQ ID NO: 206255 - DNA, 20 bp, Artificial Sequence
  Description of Artificial Sequence: Synthetic oligonucleotide
  Target: ATXN1; (-) strand; PAM type: YTN; PAM sequence: CTA
ggaggtggtgacctggctga

SEQ ID NO: 206256 - DNA, 20 bp, Artificial Sequence
  Description of Artificial Sequence: Synthetic oligonucleotide
  Target: ATXN1; (-) strand; PAM type: YTN; PAM sequence: CTA
tacaagtgtgtcctaggagg

SEQ ID NO: 206257 - DNA, 20 bp, Artificial Sequence
  Description of Artificial Sequence: Synthetic oligonucleotide
  Target: ATXN1; (-) strand; PAM type: YTN; PAM sequence: TTC
tatacaagtgtgtcctagga

SEQ ID NO: 206258 - DNA, 20 bp, Artificial Sequence
  Description of Artificial Sequence: Synthetic oligonucleotide
  Target: ATXN1; (-) strand; PAM type: YTN; PAM sequence: CTA
taaccagggagggtcattct

SEQ ID NO: 206259 - DNA, 20 bp, Artificial Sequence
  Description of Artificial Sequence: Synthetic oligonucleotide
  Target: ATXN1; (-) strand; PAM type: YTN; PAM sequence: CTA
ctataaccagggagggtcat

SEQ ID NO: 206260 - DNA, 20 bp, Artificial Sequence
  Description of Artificial Sequence: Synthetic oligonucleotide
  Target: ATXN1; (-) strand; PAM type: YTN; PAM sequence: TTA
caaaatgactactataacca

SEQ ID NO: 206261 - DNA, 20 bp, Artificial Sequence
  Description of Artificial Sequence: Synthetic oligonucleotide
  Target: ATXN1; (-) strand; PAM type: YTN; PAM sequence: TTA
atcaatgaatcaaccaaaaa

SEQ ID NO: 206262 - DNA, 20 bp, Artificial Sequence
  Description of Artificial Sequence: Synthetic oligonucleotide
  Target: ATXN1; (-) strand; PAM type: YTN; PAM sequence: TTC
gtgggggaaaacaagcatta

SEQ ID NO: 206263 - DNA, 20 bp, Artificial Sequence
  Description of Artificial Sequence: Synthetic oligonucleotide
  Target: ATXN1; (-) strand; PAM type: YTN; PAM sequence: TTG
attcgtgggggaaaacaagc

SEQ ID NO: 206264 - DNA, 20 bp, Artificial Sequence
  Description of Artificial Sequence: Synthetic oligonucleotide
  Target: ATXN1; (-) strand; PAM type: YTN; PAM sequence: TTA
ttgattcgtgggggaaaaca

SEQ ID NO: 206265 - DNA, 20 bp, Artificial Sequence
  Description of Artificial Sequence: Synthetic oligonucleotide
  Target: ATXN1; (-) strand; PAM type: YTN; PAM sequence: TTT
attgattcgtgggggaaaac

SEQ ID NO: 206266 - DNA, 20 bp, Artificial Sequence
  Description of Artificial Sequence: Synthetic oligonucleotide
  Target: ATXN1; (-) strand; PAM type: YTN; PAM sequence: CTG
gagtttattgattcgtgggg

SEQ ID NO: 206267 - DNA, 20 bp, Artificial Sequence
  Description of Artificial Sequence: Synthetic oligonucleotide
  Target: ATXN1; (-) strand; PAM type: YTN; PAM sequence: TTC
tggagtttattgattcgtgg

SEQ ID NO: 206268 - DNA, 20 bp, Artificial Sequence
  Description of Artificial Sequence: Synthetic oligonucleotide
  Target: ATXN1; (-) strand; PAM type: YTN; PAM sequence: TTT
ctggagtttattgattcgtg

SEQ ID NO: 206269 - DNA, 20 bp, Artificial Sequence
  Description of Artificial Sequence: Synthetic oligonucleotide
  Target: ATXN1; (-) strand; PAM type: YTN; PAM sequence: CTT
tctggagtttattgattcgt

SEQ ID NO: 206270 - DNA, 20 bp, Artificial Sequence
  Description of Artificial Sequence: Synthetic oligonucleotide
  Target: ATXN1; (-) strand; PAM type: YTN; PAM sequence: CTC
cctttctggagtttattgat

SEQ ID NO: 206271 - DNA, 20 bp, Artificial Sequence
  Description of Artificial Sequence: Synthetic oligonucleotide
  Target: ATXN1; (-) strand; PAM type: YTN; PAM sequence: TTC
tccctttctggagtttattg

SEQ ID NO: 206272 - DNA, 20 bp, Artificial Sequence
  Description of Artificial Sequence: Synthetic oligonucleotide
  Target: ATXN1; (-) strand; PAM type: YTN; PAM sequence: TTG
aatcccaaagatgaaaggag

SEQ ID NO: 206273 - DNA, 20 bp, Artificial Sequence
  Description of Artificial Sequence: Synthetic oligonucleotide
  Target: ATXN1; (-) strand; PAM type: YTN; PAM sequence: TTC
cattgaatcccaaagatgaa

SEQ ID NO: 206274 - DNA, 20 bp, Artificial Sequence
  Description of Artificial Sequence: Synthetic oligonucleotide
  Target: ATXN1; (-) strand; PAM type: YTN; PAM sequence: TTT
ccattgaatcccaaagatga

SEQ ID NO: 206275 - DNA, 20 bp, Artificial Sequence
  Description of Artificial Sequence: Synthetic oligonucleotide
  Target: ATXN1; (-) strand; PAM type: YTN; PAM sequence: CTT
tccattgaatcccaaagatg

SEQ ID NO: 206276 - DNA, 20 bp, Artificial Sequence
  Description of Artificial Sequence: Synthetic oligonucleotide
  Target: ATXN1; (-) strand; PAM type: YTN; PAM sequence: TTG
agtgcccataatgtgcaaag

SEQ ID NO: 206277 - DNA, 20 bp, Artificial Sequence
  Description of Artificial Sequence: Synthetic oligonucleotide
  Target: ATXN1; (-) strand; PAM type: YTN; PAM sequence: TTA
ttgagtgcccataatgtgca

SEQ ID NO: 206278 - DNA, 20 bp, Artificial Sequence
  Description of Artificial Sequence: Synthetic oligonucleotide
  Target: ATXN1; (-) strand; PAM type: YTN; PAM sequence: TTT
attgagtgcccataatgtgc

SEQ ID NO: 206279 - DNA, 20 bp, Artificial Sequence
  Description of Artificial Sequence: Synthetic oligonucleotide
  Target: ATXN1; (-) strand; PAM type: YTN; PAM sequence: TTT
tattgagtgcccataatgtg

SEQ ID NO: 206280 - DNA, 20 bp, Artificial Sequence
  Description of Artificial Sequence: Synthetic oligonucleotide
  Target: ATXN1; (-) strand; PAM type: YTN; PAM sequence: CTC
agaagattttattgagtgcc

SEQ ID NO: 206281 - DNA, 20 bp, Artificial Sequence
  Description of Artificial Sequence: Synthetic oligonucleotide
  Target: ATXN1; (-) strand; PAM type: YTN; PAM sequence: TTC
actcagaagattttattgag

SEQ ID NO: 206282 - DNA, 20 bp, Artificial Sequence
  Description of Artificial Sequence: Synthetic oligonucleotide
  Target: ATXN1; (-) strand; PAM type: YTN; PAM sequence: TTA
ttcactcagaagattttatt

SEQ ID NO: 206283 - DNA, 20 bp, Artificial Sequence
  Description of Artificial Sequence: Synthetic oligonucleotide
  Target: ATXN1; (-) strand; PAM type: YTN; PAM sequence: TTT
attcactcagaagattttat

SEQ ID NO: 206284 - DNA, 20 bp, Artificial Sequence
  Description of Artificial Sequence: Synthetic oligonucleotide
  Target: ATXN1; (-) strand; PAM type: YTN; PAM sequence: CTC
atttattcactcagaagatt

SEQ ID NO: 206285 - DNA, 20 bp, Artificial Sequence
  Description of Artificial Sequence: Synthetic oligonucleotide
  Target: ATXN1; (-) strand; PAM type: YTN; PAM sequence: TTG
gctcatttattcactcagaa

SEQ ID NO: 206286 - DNA, 20 bp, Artificial Sequence
  Description of Artificial Sequence: Synthetic oligonucleotide
  Target: ATXN1; (-) strand; PAM type: YTN; PAM sequence: TTT
ggctcatttattcactcaga

SEQ ID NO: 206287 - DNA, 20 bp, Artificial Sequence
  Description of Artificial Sequence: Synthetic oligonucleotide
  Target: ATXN1; (-) strand; PAM type: YTN; PAM sequence: CTT
tggctcatttattcactcag

SEQ ID NO: 206288 - DNA, 20 bp, Artificial Sequence
  Description of Artificial Sequence: Synthetic oligonucleotide
  Target: ATXN1; (-) strand; PAM type: YTN; PAM sequence: TTC
tttggctcatttattcactc

SEQ ID NO: 206289 - DNA, 20 bp, Artificial Sequence
  Description of Artificial Sequence: Synthetic oligonucleotide
  Target: ATXN1; (-) strand; PAM type: YTN; PAM sequence: CTT
ctttggctcatttattcact

SEQ ID NO: 206290 - DNA, 20 bp, Artificial Sequence
  Description of Artificial Sequence: Synthetic oligonucleotide
  Target: ATXN1; (-) strand; PAM type: YTN; PAM sequence: CTC
cttctttggctcatttattc

SEQ ID NO: 206291 - DNA, 20 bp, Artificial Sequence
  Description of Artificial Sequence: Synthetic oligonucleotide
  Target: ATXN1; (-) strand; PAM type: YTN; PAM sequence: TTC
cctccttctttggctcattt

SEQ ID NO: 206292 - DNA, 20 bp, Artificial Sequence
  Description of Artificial Sequence: Synthetic oligonucleotide
  Target: ATXN1; (-) strand; PAM type: YTN; PAM sequence: CTT
ccctccttctttggctcatt

SEQ ID NO: 206293 - DNA, 20 bp, Artificial Sequence
  Description of Artificial Sequence: Synthetic oligonucleotide
  Target: ATXN1; (-) strand; PAM type: YTN; PAM sequence: CTC
cttccctccttctttggctc

SEQ ID NO: 206294 - DNA, 20 bp, Artificial Sequence
  Description of Artificial Sequence: Synthetic oligonucleotide
  Target: ATXN1; (-) strand; PAM type: YTN; PAM sequence: TTC
ctccttccctccttctttgg

SEQ ID NO: 206295 - DNA, 20 bp, Artificial Sequence
  Description of Artificial Sequence: Synthetic oligonucleotide
  Target: ATXN1; (-) strand; PAM type: YTN; PAM sequence: CTT
cctccttccctccttctttg

SEQ ID NO: 206296 - DNA, 20 bp, Artificial Sequence
  Description of Artificial Sequence: Synthetic oligonucleotide
  Target: ATXN1; (-) strand; PAM type: YTN; PAM sequence: CTC
ccttcctccttccctccttc

SEQ ID NO: 206297 - DNA, 20 bp, Artificial Sequence
  Description of Artificial Sequence: Synthetic oligonucleotide
  Target: ATXN1; (-) strand; PAM type: YTN; PAM sequence: CTC
cctcccttcctccttccctc

SEQ ID NO: 206298 - DNA, 20 bp, Artificial Sequence
  Description of Artificial Sequence: Synthetic oligonucleotide
  Target: ATXN1; (-) strand; PAM type: YTN; PAM sequence: TTC
ctccctcccttcctccttcc

SEQ ID NO: 206299 - DNA, 20 bp, Artificial Sequence
  Description of Artificial Sequence: Synthetic oligonucleotide
  Target: ATXN1; (-) strand; PAM type: YTN; PAM sequence: CTT
cctccctcccttcctccttc

SEQ ID NO: 206300 - DNA, 20 bp, Artificial Sequence
  Description of Artificial Sequence: Synthetic oligonucleotide
  Target: ATXN1; (-) strand; PAM type: YTN; PAM sequence: CTA
ccttcctccctcccttcctc

SEQ ID NO: 206301 - DNA, 20 bp, Artificial Sequence
  Description of Artificial Sequence: Synthetic oligonucleotide
  Target: ATXN1; (-) strand; PAM type: YTN; PAM sequence: TTC
ctaccttcctccctcccttc

SEQ ID NO: 206302 - DNA, 20 bp, Artificial Sequence
  Description of Artificial Sequence: Synthetic oligonucleotide
  Target: ATXN1; (-) strand; PAM type: YTN; PAM sequence: CTT
cctaccttcctccctccctt

SEQ ID NO: 206303 - DNA, 20 bp, Artificial Sequence
  Description of Artificial Sequence: Synthetic oligonucleotide
  Target: ATXN1; (-) strand; PAM type: YTN; PAM sequence: TTC
ttcctaccttcctccctccc

SEQ ID NO: 206304 - DNA, 20 bp, Artificial Sequence
  Description of Artificial Sequence: Synthetic oligonucleotide
  Target: ATXN1; (-) strand; PAM type: YTN; PAM sequence: TTT
cttcctaccttcctccctcc

SEQ ID NO: 206305 - DNA, 20 bp, Artificial Sequence
  Description of Artificial Sequence: Synthetic oligonucleotide
  Target: ATXN1; (-) strand; PAM type: YTN; PAM sequence: CTT
tcttcctaccttcctccctc

SEQ ID NO: 206306 - DNA, 20 bp, Artificial Sequence
  Description of Artificial Sequence: Synthetic oligonucleotide
  Target: ATXN1; (-) strand; PAM type: YTN; PAM sequence: TTC
ctttcttcctaccttcctcc

SEQ ID NO: 206307 - DNA, 20 bp, Artificial Sequence
  Description of Artificial Sequence: Synthetic oligonucleotide
  Target: ATXN1; (-) strand; PAM type: YTN; PAM sequence: CTT
cctttcttcctaccttcctc

SEQ ID NO: 206308 - DNA, 20 bp, Artificial Sequence
  Description of Artificial Sequence: Synthetic oligonucleotide
  Target: ATXN1; (-) strand; PAM type: YTN; PAM sequence: TTA
agggatgaccttcctttctt

SEQ ID NO: 206309 - DNA, 20 bp, Artificial Sequence
  Description of Artificial Sequence: Synthetic oligonucleotide
  Target: ATXN1; (-) strand; PAM type: YTN; PAM sequence: TTA
aatcagtatgattaagggat

SEQ ID NO: 206310 - DNA, 20 bp, Artificial Sequence
  Description of Artificial Sequence: Synthetic oligonucleotide
  Target: ATXN1; (-) strand; PAM type: YTN; PAM sequence: CTA
attaaatcagtatgattaag

SEQ ID NO: 206311 - DNA, 20 bp, Artificial Sequence
  Description of Artificial Sequence: Synthetic oligonucleotide
  Target: ATXN1; (-) strand; PAM type: YTN; PAM sequence: TTA
cagatgaatccaatcaacac

SEQ ID NO: 206312 - DNA, 20 bp, Artificial Sequence
  Description of Artificial Sequence: Synthetic oligonucleotide
  Target: ATXN1; (-) strand; PAM type: YTN; PAM sequence: TTT
acagatgaatccaatcaaca

SEQ ID NO: 206313 - DNA, 20 bp, Artificial Sequence
  Description of Artificial Sequence: Synthetic oligonucleotide
  Target: ATXN1; (-) strand; PAM type: YTN; PAM sequence: CTG
gaaaacgatttacagatgaa

SEQ ID NO: 206314 - DNA, 20 bp, Artificial Sequence
  Description of Artificial Sequence: Synthetic oligonucleotide
  Target: ATXN1; (-) strand; PAM type: YTN; PAM sequence: CTG
tgtgctggaaaacgatttac

SEQ ID NO: 206315 - DNA, 20 bp, Artificial Sequence
  Description of Artificial Sequence: Synthetic oligonucleotide
  Target: ATXN1; (-) strand; PAM type: YTN; PAM sequence: CTC
tgtgtgctggaaaacgattt

SEQ ID NO: 206316 - DNA, 20 bp, Artificial Sequence
  Description of Artificial Sequence: Synthetic oligonucleotide
  Target: ATXN1; (-) strand; PAM type: YTN; PAM sequence: TTA
cccaaaggaatgtagatgtc

SEQ ID NO: 206317 - DNA, 20 bp, Artificial Sequence
  Description of Artificial Sequence: Synthetic oligonucleotide
  Target: ATXN1; (-) strand; PAM type: YTN; PAM sequence: TTG
catgttacccaaaggaatgt

SEQ ID NO: 206318 - DNA, 20 bp, Artificial Sequence
  Description of Artificial Sequence: Synthetic oligonucleotide
  Target: ATXN1; (-) strand; PAM type: YTN; PAM sequence: CTT
gcatgttacccaaaggaatg

SEQ ID NO: 206319 - DNA, 20 bp, Artificial Sequence
  Description of Artificial Sequence: Synthetic oligonucleotide
  Target: ATXN1; (-) strand; PAM type: YTN; PAM sequence: CTC
aaggagccttgcatgttacc

SEQ ID NO: 206320 - DNA, 20 bp, Artificial Sequence
  Description of Artificial Sequence: Synthetic oligonucleotide
  Target: ATXN1; (-) strand; PAM type: YTN; PAM sequence: CTG
gggtcagagctcaaggagcc

SEQ ID NO: 206321 - DNA, 20 bp, Artificial Sequence
  Description of Artificial Sequence: Synthetic oligonucleotide
  Target: ATXN1; (-) strand; PAM type: YTN; PAM sequence: CTG
gctggggtcagagctcaagg

SEQ ID NO: 206322 - DNA, 20 bp, Artificial Sequence
  Description of Artificial Sequence: Synthetic oligonucleotide
  Target: ATXN1; (-) strand; PAM type: YTN; PAM sequence: CTG
agggtcaagtgcagcaggag

SEQ ID NO: 206323 - DNA, 20 bp, Artificial Sequence
  Description of Artificial Sequence: Synthetic oligonucleotide
  Target: ATXN1; (-) strand; PAM type: YTN; PAM sequence: TTG
gaggtgctgagggtcaagtg

SEQ ID NO: 206324 - DNA, 20 bp, Artificial Sequence
  Description of Artificial Sequence: Synthetic oligonucleotide
  Target: ATXN1; (-) strand; PAM type: YTN; PAM sequence: CTT
ggaggtgctgagggtcaagt

SEQ ID NO: 206325 - DNA, 20 bp, Artificial Sequence
  Description of Artificial Sequence: Synthetic oligonucleotide
  Target: ATXN1; (-) strand; PAM type: YTN; PAM sequence: CTA
cagggagggacttggaggtg

SEQ ID NO: 206326 - DNA, 20 bp, Artificial Sequence
  Description of Artificial Sequence: Synthetic oligonucleotide
  Target: ATXN1; (-) strand; PAM type: YTN; PAM sequence: TTG
aaaagatgatgtgtgggggg

SEQ ID NO: 206327 - DNA, 20 bp, Artificial Sequence
  Description of Artificial Sequence: Synthetic oligonucleotide
  Target: ATXN1; (-) strand; PAM type: YTN; PAM sequence: TTT
gaaaagatgatgtgtggggg

SEQ ID NO: 206328 - DNA, 20 bp, Artificial Sequence
  Description of Artificial Sequence: Synthetic oligonucleotide
  Target: ATXN1; (-) strand; PAM type: YTN; PAM sequence: CTG
agtgagtttgaaaagatgat

SEQ ID NO: 206329 - DNA, 20 bp, Artificial Sequence
  Description of Artificial Sequence: Synthetic oligonucleotide
  Target: ATXN1; (-) strand; PAM type: YTN; PAM sequence: TTG
aagactgagtgagtttgaaa

SEQ ID NO: 206330 - DNA, 20 bp, Artificial Sequence
  Description of Artificial Sequence: Synthetic oligonucleotide
  Target: ATXN1; (-) strand; PAM type: YTN; PAM sequence: CTT
gaagactgagtgagtttgaa

SEQ ID NO: 206331 - DNA, 20 bp, Artificial Sequence
  Description of Artificial Sequence: Synthetic oligonucleotide
  Target: ATXN1; (-) strand; PAM type: YTN; PAM sequence: CTG
agacttgaagactgagtgag

SEQ ID NO: 206332 - DNA, 20 bp, Artificial Sequence
  Description of Artificial Sequence: Synthetic oligonucleotide
  Target: ATXN1; (-) strand; PAM type: YTN; PAM sequence: TTC
acagagaagcgtccccagcc

SEQ ID NO: 206333 - DNA, 20 bp, Artificial Sequence
  Description of Artificial Sequence: Synthetic oligonucleotide
  Target: ATXN1; (-) strand; PAM type: YTN; PAM sequence: TTT
cacagagaagcgtccccagc

SEQ ID NO: 206334 - DNA, 20 bp, Artificial Sequence
  Description of Artificial Sequence: Synthetic oligonucleotide
  Target: ATXN1; (-) strand; PAM type: YTN; PAM sequence: TTT
tcacagagaagcgtccccag

SEQ ID NO: 206335 - DNA, 20 bp, Artificial Sequence
  Description of Artificial Sequence: Synthetic oligonucleotide
  Target: ATXN1; (-) strand; PAM type: YTN; PAM sequence: TTT
ttcacagagaagcgtcccca

SEQ ID NO: 206336 - DNA, 20 bp, Artificial Sequence
  Description of Artificial Sequence: Synthetic oligonucleotide
  Target: ATXN1; (-) strand; PAM type: YTN; PAM sequence: TTC
ccagaaggtgtcagggagtt

SEQ ID NO: 206337 - DNA, 20 bp, Artificial Sequence
  Description of Artificial Sequence: Synthetic oligonucleotide
  Target: ATXN1; (-) strand; PAM type: YTN; PAM sequence: CTT
cccagaaggtgtcagggagt

SEQ ID NO: 206338 - DNA, 20 bp, Artificial Sequence
  Description of Artificial Sequence: Synthetic oligonucleotide
  Target: ATXN1; (-) strand; PAM type: YTN; PAM sequence: TTG
tagaaaaatgagagaaaagg

SEQ ID NO: 206339 - DNA, 20 bp, Artificial Sequence
  Description of Artificial Sequence: Synthetic oligonucleotide
  Target: ATXN1; (-) strand; PAM type: YTN; PAM sequence: TTA
atagggataggtacaggggt

SEQ ID NO: 206340 - DNA, 20 bp, Artificial Sequence
  Description of Artificial Sequence: Synthetic oligonucleotide
  Target: ATXN1; (-) strand; PAM type: YTN; PAM sequence: TTT
aatagggataggtacagggg

SEQ ID NO: 206341 - DNA, 20 bp, Artificial Sequence
  Description of Artificial Sequence: Synthetic oligonucleotide
  Target: ATXN1; (-) strand; PAM type: YTN; PAM sequence: CTT
taatagggataggtacaggg

SEQ ID NO: 206342 - DNA, 20 bp, Artificial Sequence
  Description of Artificial Sequence: Synthetic oligonucleotide
  Target: ATXN1; (-) strand; PAM type: YTN; PAM sequence: TTG
ctttaatagggataggtaca

SEQ ID NO: 206343 - DNA, 20 bp, Artificial Sequence
  Description of Artificial Sequence: Synthetic oligonucleotide
  Target: ATXN1; (-) strand; PAM type: YTN; PAM sequence: TTA
aggaacaagtacaggaaaat

SEQ ID NO: 206344 - DNA, 20 bp, Artificial Sequence
  Description of Artificial Sequence: Synthetic oligonucleotide
  Target: ATXN1; (-) strand; PAM type: YTN; PAM sequence: TTG
gttaaggaacaagtacagga

SEQ ID NO: 206345 - DNA, 20 bp, Artificial Sequence
  Description of Artificial Sequence: Synthetic oligonucleotide
  Target: ATXN1; (-) strand; PAM type: YTN; PAM sequence: CTT
ggttaaggaacaagtacagg

SEQ ID NO: 206346 - DNA, 20 bp, Artificial Sequence
  Description of Artificial Sequence: Synthetic oligonucleotide
  Target: ATXN1; (-) strand; PAM type: YTN; PAM sequence: TTG
tggtgggagagatggacttg

SEQ ID NO: 206347 - DNA, 20 bp, Artificial Sequence
  Description of Artificial Sequence: Synthetic oligonucleotide
  Target: ATXN1; (-) strand; PAM type: YTN; PAM sequence: TTA
ggttgtggtgggagagatgg

SEQ ID NO: 206348 - DNA, 20 bp, Artificial Sequence
  Description of Artificial Sequence: Synthetic oligonucleotide
  Target: ATXN1; (-) strand; PAM type: YTN; PAM sequence: CTT
aggttgtggtgggagagatg

SEQ ID NO: 206349 - DNA, 20 bp, Artificial Sequence
  Description of Artificial Sequence: Synthetic oligonucleotide
  Target: ATXN1; (-) strand; PAM type: YTN; PAM sequence: TTA
agggacttaggttgtggtgg

SEQ ID NO: 206350 - DNA, 20 bp, Artificial Sequence
  Description of Artificial Sequence: Synthetic oligonucleotide
  Target: ATXN1; (-) strand; PAM type: YTN; PAM sequence: TTT
aagggacttaggttgtggtg

SEQ ID NO: 206351 - DNA, 20 bp, Artificial Sequence
  Description of Artificial Sequence: Synthetic oligonucleotide
  Target: ATXN1; (-) strand; PAM type: YTN; PAM sequence: CTT
taagggacttaggttgtggt

SEQ ID NO: 206352 - DNA, 20 bp, Artificial Sequence
  Description of Artificial Sequence: Synthetic oligonucleotide
  Target: ATXN1; (-) strand; PAM type: YTN; PAM sequence: TTG
cctttaagggacttaggttg

SEQ ID NO: 206353 - DNA, 20 bp, Artificial Sequence
  Description of Artificial Sequence: Synthetic oligonucleotide
  Target: ATXN1; (-) strand; PAM type: YTN; PAM sequence: CTT
gcctttaagggacttaggtt

SEQ ID NO: 206354 - DNA, 20 bp, Artificial Sequence
  Description of Artificial Sequence: Synthetic oligonucleotide
  Target: ATXN1; (-) strand; PAM type: YTN; PAM sequence: TTC
ttgcctttaagggacttagg

SEQ ID NO: 206355 - DNA, 20 bp, Artificial Sequence
  Description of Artificial Sequence: Synthetic oligonucleotide
  Target: ATXN1; (-) strand; PAM type: YTN; PAM sequence: TTT
cttgcctttaagggacttag

SEQ ID NO: 206356 - DNA, 20 bp, Artificial Sequence
  Description of Artificial Sequence: Synthetic oligonucleotide
  Target: ATXN1; (-) strand; PAM type: YTN; PAM sequence: CTT
tcttgcctttaagggactta

SEQ ID NO: 206357 - DNA, 20 bp, Artificial Sequence
  Description of Artificial Sequence: Synthetic oligonucleotide
  Target: ATXN1; (-) strand; PAM type: YTN; PAM sequence: CTC
tttcttgcctttaagggact

SEQ ID NO: 206358 - DNA, 20 bp, Artificial Sequence
  Description of Artificial Sequence: Synthetic oligonucleotide
  Target: ATXN1; (-) strand; PAM type: YTN; PAM sequence: CTA
tgatgaggggatacctcttt

SEQ ID NO: 206359 - DNA, 20 bp, Artificial Sequence
  Description of Artificial Sequence: Synthetic oligonucleotide
  Target: ATXN1; (-) strand; PAM type: YTN; PAM sequence: CTG
gggtactatgatgaggggat

SEQ ID NO: 206360 - DNA, 20 bp, Artificial Sequence
  Description of Artificial Sequence: Synthetic oligonucleotide
  Target: ATXN1; (-) strand; PAM type: YTN; PAM sequence: CTC
tggggtactatgatgagggg

SEQ ID NO: 206361 - DNA, 20 bp, Artificial Sequence
  Description of Artificial Sequence: Synthetic oligonucleotide
  Target: ATXN1; (-) strand; PAM type: YTN; PAM sequence: CTG
tacgaaactctggggtacta

SEQ ID NO: 206362 - DNA, 20 bp, Artificial Sequence
  Description of Artificial Sequence: Synthetic oligonucleotide
  Target: ATXN1; (-) strand; PAM type: YTN; PAM sequence: CTG
ctgtacgaaactctggggta

SEQ ID NO: 206363 - DNA, 20 bp, Artificial Sequence
  Description of Artificial Sequence: Synthetic oligonucleotide
  Target: ATXN1; (-) strand; PAM type: YTN; PAM sequence: TTA
tgtgccacgctgctgtacga

SEQ ID NO: 206364 - DNA, 20 bp, Artificial Sequence
  Description of Artificial Sequence: Synthetic oligonucleotide
  Target: ATXN1; (-) strand; PAM type: YTN; PAM sequence: TTT
atgtgccacgctgctgtacg

SEQ ID NO: 206365 - DNA, 20 bp, Artificial Sequence
  Description of Artificial Sequence: Synthetic oligonucleotide
  Target: ATXN1; (-) strand; PAM type: YTN; PAM sequence: TTA
atttatgtgccacgctgctg

SEQ ID NO: 206366 - DNA, 20 bp, Artificial Sequence
  Description of Artificial Sequence: Synthetic oligonucleotide
  Target: ATXN1; (-) strand; PAM type: YTN; PAM sequence: TTG
ttaatttatgtgccacgctg

SEQ ID NO: 206367 - DNA, 20 bp, Artificial Sequence
  Description of Artificial Sequence: Synthetic oligonucleotide
  Target: ATXN1; (-) strand; PAM type: YTN; PAM sequence: TTG
ttgttaatttatgtgccacg

SEQ ID NO: 206368 - DNA, 20 bp, Artificial Sequence
  Description of Artificial Sequence: Synthetic oligonucleotide
  Target: ATXN1; (-) strand; PAM type: YTN; PAM sequence: TTG
ttgttgttaatttatgtgcc

SEQ ID NO: 206369 - DNA, 20 bp, Artificial Sequence
  Description of Artificial Sequence: Synthetic oligonucleotide
  Target: ATXN1; (-) strand; PAM type: YTN; PAM sequence: TTT
gttgttgttaatttatgtgc

SEQ ID NO: 206370 - DNA, 20 bp, Artificial Sequence
  Description of Artificial Sequence: Synthetic oligonucleotide
  Target: ATXN1; (-) strand; PAM type: YTN; PAM sequence: TTT
tgttgttgttaatttatgtg

SEQ ID NO: 206371 - DNA, 20 bp, Artificial Sequence
  Description of Artificial Sequence: Synthetic oligonucleotide
  Target: ATXN1; (-) strand; PAM type: YTN; PAM sequence: TTT
ttgttgttgttaatttatgt

SEQ ID NO: 206372 - DNA, 20 bp, Artificial Sequence
  Description of Artificial Sequence: Synthetic oligonucleotide
  Target: ATXN1; (-) strand; PAM type: YTN; PAM sequence: TTT
tttgttgttgttaatttatg

SEQ ID NO: 206373 - DNA, 20 bp, Artificial Sequence
  Description of Artificial Sequence: Synthetic oligonucleotide
  Target: ATXN1; (-) strand; PAM type: YTN; PAM sequence: TTT
ttttgttgttgttaatttat

SEQ ID NO: 206374 - DNA, 20 bp, Artificial Sequence
  Description of Artificial Sequence: Synthetic oligonucleotide
  Target: ATXN1; (-) strand; PAM type: YTN; PAM sequence: TTT
tttttgttgttgttaattta

SEQ ID NO: 206375 - DNA, 20 bp, Artificial Sequence
  Description of Artificial Sequence: Synthetic oligonucleotide
  Target: ATXN1; (-) strand; PAM type: YTN; PAM sequence: CTT
ttttttgttgttgttaattt

SEQ ID NO: 206376 - DNA, 20 bp, Artificial Sequence
  Description of Artificial Sequence: Synthetic oligonucleotide
  Target: ATXN1; (-) strand; PAM type: YTN; PAM sequence: TTC
ttttttttgttgttgttaat

SEQ ID NO: 206377 - DNA, 20 bp, Artificial Sequence
  Description of Artificial Sequence: Synthetic oligonucleotide
  Target: ATXN1; (-) strand; PAM type: YTN; PAM sequence: TTT
cttttttttgttgttgttaa

SEQ ID NO: 206378 - DNA, 20 bp, Artificial Sequence
  Description of Artificial Sequence: Synthetic oligonucleotide
  Target: ATXN1; (-) strand; PAM type: YTN; PAM sequence: TTA
tataatatatatgtgtgcgt

SEQ ID NO: 206379 - DNA, 20 bp, Artificial Sequence
  Description of Artificial Sequence: Synthetic oligonucleotide
  Target: ATXN1; (-) strand; PAM type: YTN; PAM sequence: TTG
cagtatgaaacgtgtgtgta

SEQ ID NO: 206380 - DNA, 20 bp, Artificial Sequence
  Description of Artificial Sequence: Synthetic oligonucleotide
  Target: ATXN1; (-) strand; PAM type: YTN; PAM sequence: TTT
gcagtatgaaacgtgtgtgt

SEQ ID NO: 206381 - DNA, 20 bp, Artificial Sequence
  Description of Artificial Sequence: Synthetic oligonucleotide
  Target: ATXN1; (-) strand; PAM type: YTN; PAM sequence: CTT
tgcagtatgaaacgtgtgtg

SEQ ID NO: 206382 - DNA, 20 bp, Artificial Sequence
  Description of Artificial Sequence: Synthetic oligonucleotide
  Target: ATXN1; (-) strand; PAM type: YTN; PAM sequence: CTG
gaactttgcagtatgaaacg

SEQ ID NO: 206383 - DNA, 20 bp, Artificial Sequence
  Description of Artificial Sequence: Synthetic oligonucleotide
  Target: ATXN1; (-) strand; PAM type: YTN; PAM sequence: CTC
tggaactttgcagtatgaaa

SEQ ID NO: 206384 - DNA, 20 bp, Artificial Sequence
  Description of Artificial Sequence: Synthetic oligonucleotide
  Target: ATXN1; (-) strand; PAM type: YTN; PAM sequence: TTC
agatgcccagctctggaact

SEQ ID NO: 206385 - DNA, 20 bp, Artificial Sequence
  Description of Artificial Sequence: Synthetic oligonucleotide
  Target: ATXN1; (-) strand; PAM type: YTN; PAM sequence: TTT
cagatgcccagctctggaac

SEQ ID NO: 206386 - DNA, 20 bp, Artificial Sequence
  Description of Artificial Sequence: Synthetic oligonucleotide
  Target: ATXN1; (-) strand; PAM type: YTN; PAM sequence: TTA
atcgtatatttcagatgccc

SEQ ID NO: 206387 - DNA, 20 bp, Artificial Sequence
  Description of Artificial Sequence: Synthetic oligonucleotide
  Target: ATXN1; (-) strand; PAM type: YTN; PAM sequence: CTA
ttaatcgtatatttcagatg

SEQ ID NO: 206388 - DNA, 20 bp, Artificial Sequence
  Description of Artificial Sequence: Synthetic oligonucleotide
  Target: ATXN1; (-) strand; PAM type: YTN; PAM sequence: CTC
tattaatcgtatatttcaga

SEQ ID NO: 206389 - DNA, 20 bp, Artificial Sequence
  Description of Artificial Sequence: Synthetic oligonucleotide
  Target: ATXN1; (-) strand; PAM type: YTN; PAM sequence: TTC
tctattaatcgtatatttca

SEQ ID NO: 206390 - DNA, 20 bp, Artificial Sequence
  Description of Artificial Sequence: Synthetic oligonucleotide
  Target: ATXN1; (-) strand; PAM type: YTN; PAM sequence: TTA
ataataacattctctattaa

SEQ ID NO: 206391 - DNA, 20 bp, Artificial Sequence
  Description of Artificial Sequence: Synthetic oligonucleotide
  Target: ATXN1; (-) strand; PAM type: YTN; PAM sequence: TTT
aataataacattctctatta

SEQ ID NO: 206392 - DNA, 20 bp, Artificial Sequence
  Description of Artificial Sequence: Synthetic oligonucleotide
  Target: ATXN1; (-) strand; PAM type: YTN; PAM sequence: TTA
ccacatttaataataacatt

SEQ ID NO: 206393 - DNA, 20 bp, Artificial Sequence
  Description of Artificial Sequence: Synthetic oligonucleotide
  Target: ATXN1; (-) strand; PAM type: YTN; PAM sequence: CTT
accacatttaataataacat

SEQ ID NO: 206394 - DNA, 20 bp, Artificial Sequence
  Description of Artificial Sequence: Synthetic oligonucleotide
  Target: ATXN1; (-) strand; PAM type: YTN; PAM sequence: TTA
tgccttaccacatttaataa

SEQ ID NO: 206395 - DNA, 20 bp, Artificial Sequence
  Description of Artificial Sequence: Synthetic oligonucleotide
  Target: ATXN1; (-) strand; PAM type: YTN; PAM sequence: TTG
taatcattatgccttaccac

SEQ ID NO: 206396 - DNA, 20 bp, Artificial Sequence
  Description of Artificial Sequence: Synthetic oligonucleotide
  Target: ATXN1; (-) strand; PAM type: YTN; PAM sequence: TTT
gtaatcattatgccttacca

SEQ ID NO: 206397 - DNA, 20 bp, Artificial Sequence
  Description of Artificial Sequence: Synthetic oligonucleotide
  Target: ATXN1; (-) strand; PAM type: YTN; PAM sequence: TTC
acagatgaatttgtaatcat

SEQ ID NO: 206398 - DNA, 20 bp, Artificial Sequence
  Description of Artificial Sequence: Synthetic oligonucleotide
  Target: ATXN1; (-) strand; PAM type: YTN; PAM sequence: TTT
cacagatgaatttgtaatca

SEQ ID NO: 206399 - DNA, 20 bp, Artificial Sequence
  Description of Artificial Sequence: Synthetic oligonucleotide
  Target: ATXN1; (-) strand; PAM type: YTN; PAM sequence: TTA
gcccgtttcacagatgaatt

SEQ ID NO: 206400 - DNA, 20 bp, Artificial Sequence
  Description of Artificial Sequence: Synthetic oligonucleotide
  Target: ATXN1; (-) strand; PAM type: YTN; PAM sequence: TTA
ttagcccgtttcacagatga

SEQ ID NO: 206401 - DNA, 20 bp, Artificial Sequence
  Description of Artificial Sequence: Synthetic oligonucleotide
  Target: ATXN1; (-) strand; PAM type: YTN; PAM sequence: CTG
tgaggtaggtgttattagcc

SEQ ID NO: 206402 - DNA, 20 bp, Artificial Sequence
  Description of Artificial Sequence: Synthetic oligonucleotide
  Target: ATXN1; (-) strand; PAM type: YTN; PAM sequence: CTC
gtaacaaccctgtgaggtag

SEQ ID NO: 206403 - DNA, 20 bp, Artificial Sequence
  Description of Artificial Sequence: Synthetic oligonucleotide
  Target: ATXN1; (-) strand; PAM type: YTN; PAM sequence: CTC
tcgtaacaaccctgtgaggt

SEQ ID NO: 206404 - DNA, 20 bp, Artificial Sequence
  Description of Artificial Sequence: Synthetic oligonucleotide
  Target: ATXN1; (-) strand; PAM type: YTN; PAM sequence: TTA
actctcgtaacaaccctgtg

SEQ ID NO: 206405 - DNA, 20 bp, Artificial Sequence
  Description of Artificial Sequence: Synthetic oligonucleotide
  Target: ATXN1; (-) strand; PAM type: YTN; PAM sequence: TTA
gttaactctcgtaacaaccc

SEQ ID NO: 206406 - DNA, 20 bp, Artificial Sequence
  Description of Artificial Sequence: Synthetic oligonucleotide
  Target: ATXN1; (-) strand; PAM type: YTN; PAM sequence: CTT
agttaactctcgtaacaacc

SEQ ID NO: 206407 - DNA, 20 bp, Artificial Sequence
  Description of Artificial Sequence: Synthetic oligonucleotide
  Target: ATXN1; (-) strand; PAM type: YTN; PAM sequence: TTA
tgtagcttagttaactctcg

SEQ ID NO: 206408 - DNA, 20 bp, Artificial Sequence
  Description of Artificial Sequence: Synthetic oligonucleotide
  Target: ATXN1; (-) strand; PAM type: YTN; PAM sequence: CTT
atgtagcttagttaactctc

SEQ ID NO: 206409 - DNA, 20 bp, Artificial Sequence
  Description of Artificial Sequence: Synthetic oligonucleotide
  Target: ATXN1; (-) strand; PAM type: YTN; PAM sequence: TTA
cttatgtagcttagttaact

SEQ ID NO: 206410 - DNA, 20 bp, Artificial Sequence
  Description of Artificial Sequence: Synthetic oligonucleotide
  Target: ATXN1; (-) strand; PAM type: YTN; PAM sequence: TTT
acttatgtagcttagttaac

SEQ ID NO: 206411 - DNA, 20 bp, Artificial Sequence
  Description of Artificial Sequence: Synthetic oligonucleotide
  Target: ATXN1; (-) strand; PAM type: YTN; PAM sequence: TTT
tacttatgtagcttagttaa

SEQ ID NO: 206412 - DNA, 20 bp, Artificial Sequence
  Description of Artificial Sequence: Synthetic oligonucleotide
  Target: ATXN1; (-) strand; PAM type: YTN; PAM sequence: CTA
aacattttacttatgtagct

SEQ ID NO: 206413 - DNA, 20 bp, Artificial Sequence
  Description of Artificial Sequence: Synthetic oligonucleotide
  Target: ATXN1; (-) strand; PAM type: YTN; PAM sequence: CTG
tgctaaacattttacttatg

SEQ ID NO: 206414 - DNA, 20 bp, Artificial Sequence
  Description of Artificial Sequence: Synthetic oligonucleotide
  Target: ATXN1; (-) strand; PAM type: YTN; PAM sequence: CTC
tgtgctaaacattttactta

SEQ ID NO: 206415 - DNA, 20 bp, Artificial Sequence
  Description of Artificial Sequence: Synthetic oligonucleotide
  Target: ATXN1; (-) strand; PAM type: YTN; PAM sequence: CTG
agctctgtgctaaacatttt

SEQ ID NO: 206416 - DNA, 20 bp, Artificial Sequence
  Description of Artificial Sequence: Synthetic oligonucleotide
  Target: ATXN1; (-) strand; PAM type: YTN; PAM sequence: TTC
cagtatactgagctctgtgc

SEQ ID NO: 206417 - DNA, 20 bp, Artificial Sequence
  Description of Artificial Sequence: Synthetic oligonucleotide
  Target: ATXN1; (-) strand; PAM type: YTN; PAM sequence: CTT
ccagtatactgagctctgtg

SEQ ID NO: 206418 - DNA, 20 bp, Artificial Sequence
  Description of Artificial Sequence: Synthetic oligonucleotide
  Target: ATXN1; (-) strand; PAM type: YTN; PAM sequence: TTA
tggagtgcttccagtatact

SEQ ID NO: 206419 - DNA, 20 bp, Artificial Sequence
  Description of Artificial Sequence: Synthetic oligonucleotide
  Target: ATXN1; (-) strand; PAM type: YTN; PAM sequence: TTT
atggagtgcttccagtatac

SEQ ID NO: 206420 - DNA, 20 bp, Artificial Sequence
  Description of Artificial Sequence: Synthetic oligonucleotide
  Target: ATXN1; (-) strand; PAM type: YTN; PAM sequence: TTA
atatttatggagtgcttcca

SEQ ID NO: 206421 - DNA, 20 bp, Artificial Sequence
  Description of Artificial Sequence: Synthetic oligonucleotide
  Target: ATXN1; (-) strand; PAM type: YTN; PAM sequence: CTG
tacaattaatatttatggag

SEQ ID NO: 206422 - DNA, 20 bp, Artificial Sequence
  Description of Artificial Sequence: Synthetic oligonucleotide
  Target: ATXN1; (-) strand; PAM type: YTN; PAM sequence: CTG
atagtgataatggctgtaca

SEQ ID NO: 206423 - DNA, 20 bp, Artificial Sequence
  Description of Artificial Sequence: Synthetic oligonucleotide
  Target: ATXN1; (-) strand; PAM type: YTN; PAM sequence: CTA
acaatactgatagtgataat

SEQ ID NO: 206424 - DNA, 20 bp, Artificial Sequence
  Description of Artificial Sequence: Synthetic oligonucleotide
  Target: ATXN1; (-) strand; PAM type: YTN; PAM sequence: TTG
ccctaacaatactgatagtg

SEQ ID NO: 206425 - DNA, 20 bp, Artificial Sequence
  Description of Artificial Sequence: Synthetic oligonucleotide
  Target: ATXN1; (-) strand; PAM type: YTN; PAM sequence: TTA
gttgccctaacaatactgat

SEQ ID NO: 206426 - DNA, 20 bp, Artificial Sequence
  Description of Artificial Sequence: Synthetic oligonucleotide
  Target: ATXN1; (-) strand; PAM type: YTN; PAM sequence: CTT
agttgccctaacaatactga

SEQ ID NO: 206427 - DNA, 20 bp, Artificial Sequence
  Description of Artificial Sequence: Synthetic oligonucleotide
  Target: ATXN1; (-) strand; PAM type: YTN; PAM sequence: TTC
agcttagttgccctaacaat

SEQ ID NO: 206428 - DNA, 20 bp, Artificial Sequence
  Description of Artificial Sequence: Synthetic oligonucleotide
  Target: ATXN1; (-) strand; PAM type: YTN; PAM sequence: TTG
taaattcagcttagttgccc

SEQ ID NO: 206429 - DNA, 20 bp, Artificial Sequence
  Description of Artificial Sequence: Synthetic oligonucleotide
  Target: ATXN1; (-) strand; PAM type: YTN; PAM sequence: TTA
cccataagttgtaaattcag

SEQ ID NO: 206430 - DNA, 20 bp, Artificial Sequence
  Description of Artificial Sequence: Synthetic oligonucleotide
  Target: ATXN1; (-) strand; PAM type: YTN; PAM sequence: TTT
acccataagttgtaaattca

SEQ ID NO: 206431 - DNA, 20 bp, Artificial Sequence
  Description of Artificial Sequence: Synthetic oligonucleotide
  Target: ATXN1; (-) strand; PAM type: YTN; PAM sequence: TTT
tacccataagttgtaaattc

SEQ ID NO: 206432 - DNA, 20 bp, Artificial Sequence
  Description of Artificial Sequence: Synthetic oligonucleotide
  Target: ATXN1; (-) strand; PAM type: YTN; PAM sequence: TTA
cattttacccataagttgta

SEQ ID NO: 206433 - DNA, 20 bp, Artificial Sequence
  Description of Artificial Sequence: Synthetic oligonucleotide
  Target: ATXN1; (-) strand; PAM type: YTN; PAM sequence: CTG
ttacattttacccataagtt

SEQ ID NO: 206434 - DNA, 20 bp, Artificial Sequence
  Description of Artificial Sequence: Synthetic oligonucleotide
  Target: ATXN1; (-) strand; PAM type: YTN; PAM sequence: CTG
gcaaataaaactgttacatt

SEQ ID NO: 206435 - DNA, 20 bp, Artificial Sequence
  Description of Artificial Sequence: Synthetic oligonucleotide
  Target: ATXN1; (-) strand; PAM type: YTN; PAM sequence: TTA
atatgaaagatactggcaaa

SEQ ID NO: 206436 - DNA, 20 bp, Artificial Sequence
  Description of Artificial Sequence: Synthetic oligonucleotide
  Target: ATXN1; (-) strand; PAM type: YTN; PAM sequence: TTT
aatatgaaagatactggcaa

SEQ ID NO: 206437 - DNA, 20 bp, Artificial Sequence
  Description of Artificial Sequence: Synthetic oligonucleotide
  Target: ATXN1; (-) strand; PAM type: YTN; PAM sequence: CTT
taatatgaaagatactggca

SEQ ID NO: 206438 - DNA, 20 bp, Artificial Sequence
  Description of Artificial Sequence: Synthetic oligonucleotide
  Target: ATXN1; (-) strand; PAM type: YTN; PAM sequence: TTA
atgctttaatatgaaagata

SEQ ID NO: 206439 - DNA, 20 bp, Artificial Sequence
  Description of Artificial Sequence: Synthetic oligonucleotide
  Target: ATXN1; (-) strand; PAM type: YTN; PAM sequence: CTA
attaatgctttaatatgaaa

SEQ ID NO: 206440 - DNA, 20 bp, Artificial Sequence
  Description of Artificial Sequence: Synthetic oligonucleotide
  Target: ATXN1; (-) strand; PAM type: YTN; PAM sequence: CTA
atgctaattaatgctttaat

SEQ ID NO: 206441 - DNA, 20 bp, Artificial Sequence
  Description of Artificial Sequence: Synthetic oligonucleotide
  Target: ATXN1; (-) strand; PAM type: YTN; PAM sequence: TTA
cacagatgctaatgctaatt

SEQ ID NO: 206442 - DNA, 20 bp, Artificial Sequence
  Description of Artificial Sequence: Synthetic oligonucleotide
  Target: ATXN1; (-) strand; PAM type: YTN; PAM sequence: CTT
acacagatgctaatgctaat

SEQ ID NO: 206443 - DNA, 20 bp, Artificial Sequence
  Description of Artificial Sequence: Synthetic oligonucleotide
  Target: ATXN1; (-) strand; PAM type: YTN; PAM sequence: TTC
ttacacagatgctaatgcta

SEQ ID NO: 206444 - DNA, 20 bp, Artificial Sequence
  Description of Artificial Sequence: Synthetic oligonucleotide
  Target: ATXN1; (-) strand; PAM type: YTN; PAM sequence: TTA
tgttcttacacagatgctaa

SEQ ID NO: 206445 - DNA, 20 bp, Artificial Sequence
  Description of Artificial Sequence: Synthetic oligonucleotide
  Target: ATXN1; (-) strand; PAM type: YTN; PAM sequence: TTT
atgttcttacacagatgcta

SEQ ID NO: 206446 - DNA, 20 bp, Artificial Sequence
  Description of Artificial Sequence: Synthetic oligonucleotide
  Target: ATXN1; (-) strand; PAM type: YTN; PAM sequence: TTT
tatgttcttacacagatgct

SEQ ID NO: 206447 - DNA, 20 bp, Artificial Sequence
  Description of Artificial Sequence: Synthetic oligonucleotide
  Target: ATXN1; (-) strand; PAM type: YTN; PAM sequence: CTA
ggcattttatgttcttacac

SEQ ID NO: 206448 - DNA, 20 bp, Artificial Sequence
  Description of Artificial Sequence: Synthetic oligonucleotide
  Target: ATXN1; (-) strand; PAM type: YTN; PAM sequence: TTC
taggcattttatgttcttac

SEQ ID NO: 206449 - DNA, 20 bp, Artificial Sequence
  Description of Artificial Sequence: Synthetic oligonucleotide
  Target: ATXN1; (-) strand; PAM type: YTN; PAM sequence: TTT
ctaggcattttatgttctta

SEQ ID NO: 206450 - DNA, 20 bp, Artificial Sequence
  Description of Artificial Sequence: Synthetic oligonucleotide
  Target: ATXN1; (-) strand; PAM type: YTN; PAM sequence: CTT
tctaggcattttatgttctt

SEQ ID NO: 206451 - DNA, 20 bp, Artificial Sequence
  Description of Artificial Sequence: Synthetic oligonucleotide
  Target: ATXN1; (-) strand; PAM type: YTN; PAM sequence: CTC
ctttctaggcattttatgtt

SEQ ID NO: 206452 - DNA, 20 bp, Artificial Sequence
  Description of Artificial Sequence: Synthetic oligonucleotide
  Target: ATXN1; (-) strand; PAM type: YTN; PAM sequence: CTG
agctcctttctaggcatttt

SEQ ID NO: 206453 - DNA, 20 bp, Artificial Sequence
  Description of Artificial Sequence: Synthetic oligonucleotide
  Target: ATXN1; (-) strand; PAM type: YTN; PAM sequence: TTC
tgagctcctttctaggcatt

SEQ ID NO: 206454 - DNA, 20 bp, Artificial Sequence
  Description of Artificial Sequence: Synthetic oligonucleotide
  Target: ATXN1; (-) strand; PAM type: YTN; PAM sequence: TTT
ctgagctcctttctaggcat

SEQ ID NO: 206455 - DNA, 20 bp, Artificial Sequence
  Description of Artificial Sequence: Synthetic oligonucleotide
  Target: ATXN1; (-) strand; PAM type: YTN; PAM sequence: TTT
tctgagctcctttctaggca

SEQ ID NO: 206456 - DNA, 20 bp, Artificial Sequence
  Description of Artificial Sequence: Synthetic oligonucleotide
  Target: ATXN1; (-) strand; PAM type: YTN; PAM sequence: TTA
attttctgagctcctttcta

SEQ ID NO: 206457 - DNA, 20 bp, Artificial Sequence
  Description of Artificial Sequence: Synthetic oligonucleotide
  Target: ATXN1; (-) strand; PAM type: YTN; PAM sequence: CTT
aattttctgagctcctttct

SEQ ID NO: 206458 - DNA, 20 bp, Artificial Sequence
  Description of Artificial Sequence: Synthetic oligonucleotide
  Target: ATXN1; (-) strand; PAM type: YTN; PAM sequence: TTA
tccttaattttctgagctcc

SEQ ID NO: 206459 - DNA, 20 bp, Artificial Sequence
  Description of Artificial Sequence: Synthetic oligonucleotide
  Target: ATXN1; (-) strand; PAM type: YTN; PAM sequence: TTT
atccttaattttctgagctc

SEQ ID NO: 206460 - DNA, 20 bp, Artificial Sequence
  Description of Artificial Sequence: Synthetic oligonucleotide
  Target: ATXN1; (-) strand; PAM type: YTN; PAM sequence: CTT
tatccttaattttctgagct

SEQ ID NO: 206461 - DNA, 20 bp, Artificial Sequence
  Description of Artificial Sequence: Synthetic oligonucleotide
  Target: ATXN1; (-) strand; PAM type: YTN; PAM sequence: TTC
tttatccttaattttctgag

SEQ ID NO: 206462 - DNA, 20 bp, Artificial Sequence
  Description of Artificial Sequence: Synthetic oligonucleotide
  Target: ATXN1; (-) strand; PAM type: YTN; PAM sequence: CTT
ctttatccttaattttctga

SEQ ID NO: 206463 - DNA, 20 bp, Artificial Sequence
  Description of Artificial Sequence: Synthetic oligonucleotide
  Target: ATXN1; (-) strand; PAM type: YTN; PAM sequence: CTC
ttctttatccttaattttct

SEQ ID NO: 206464 - DNA, 20 bp, Artificial Sequence
  Description of Artificial Sequence: Synthetic oligonucleotide
  Target: ATXN1; (-) strand; PAM type: YTN; PAM sequence: TTG
caacggataagactcttctt

SEQ ID NO: 206465 - DNA, 20 bp, Artificial Sequence
  Description of Artificial Sequence: Synthetic oligonucleotide
  Target: ATXN1; (-) strand; PAM type: YTN; PAM sequence: TTC
agttgcaacggataagactc

SEQ ID NO: 206466 - DNA, 20 bp, Artificial Sequence
  Description of Artificial Sequence: Synthetic oligonucleotide
  Target: ATXN1; (-) strand; PAM type: YTN; PAM sequence: CTT
cagttgcaacggataagact

SEQ ID NO: 206467 - DNA, 20 bp, Artificial Sequence
  Description of Artificial Sequence: Synthetic oligonucleotide
  Target: ATXN1; (-) strand; PAM type: YTN; PAM sequence: TTA
gtccttcagttgcaacggat

SEQ ID NO: 206468 - DNA, 20 bp, Artificial Sequence
  Description of Artificial Sequence: Synthetic oligonucleotide
  Target: ATXN1; (-) strand; PAM type: YTN; PAM sequence: TTA
ccgaaacaatcattagtcct

SEQ ID NO: 206469 - DNA, 20 bp, Artificial Sequence
  Description of Artificial Sequence: Synthetic oligonucleotide
  Target: ATXN1; (-) strand; PAM type: YTN; PAM sequence: TTC
acacatatatcacagattac

SEQ ID NO: 206470 - DNA, 20 bp, Artificial Sequence
  Description of Artificial Sequence: Synthetic oligonucleotide
  Target: ATXN1; (-) strand; PAM type: YTN; PAM sequence: CTT
cacacatatatcacagatta

SEQ ID NO: 206471 - DNA, 20 bp, Artificial Sequence
  Description of Artificial Sequence: Synthetic oligonucleotide
  Target: ATXN1; (-) strand; PAM type: YTN; PAM sequence: TTC
cttcacacatatatcacaga

SEQ ID NO: 206472 - DNA, 20 bp, Artificial Sequence
  Description of Artificial Sequence: Synthetic oligonucleotide
  Target: ATXN1; (-) strand; PAM type: YTN; PAM sequence: CTT
ccttcacacatatatcacag

SEQ ID NO: 206473 - DNA, 20 bp, Artificial Sequence
  Description of Artificial Sequence: Synthetic oligonucleotide
  Target: ATXN1; (-) strand; PAM type: YTN; PAM sequence: TTG
cttccttcacacatatatca

SEQ ID NO: 206474 - DNA, 20 bp, Artificial Sequence
  Description of Artificial Sequence: Synthetic oligonucleotide
  Target: ATXN1; (-) strand; PAM type: YTN; PAM sequence: TTT
gcttccttcacacatatatc

SEQ ID NO: 206475 - DNA, 20 bp, Artificial Sequence
  Description of Artificial Sequence: Synthetic oligonucleotide
  Target: ATXN1; (-) strand; PAM type: YTN; PAM sequence: CTT
tgcttccttcacacatatat

SEQ ID NO: 206476 - DNA, 20 bp, Artificial Sequence
  Description of Artificial Sequence: Synthetic oligonucleotide
  Target: ATXN1; (-) strand; PAM type: YTN; PAM sequence: TTG
atgctttgcttccttcacac

SEQ ID NO: 206477 - DNA, 20 bp, Artificial Sequence
  Description of Artificial Sequence: Synthetic oligonucleotide
  Target: ATXN1; (-) strand; PAM type: YTN; PAM sequence: TTG
ttgatgctttgcttccttca

SEQ ID NO: 206478 - DNA, 20 bp, Artificial Sequence
  Description of Artificial Sequence: Synthetic oligonucleotide
  Target: ATXN1; (-) strand; PAM type: YTN; PAM sequence: TTG
ttgttgatgctttgcttcct

SEQ ID NO: 206479 - DNA, 20 bp, Artificial Sequence
  Description of Artificial Sequence: Synthetic oligonucleotide
  Target: ATXN1; (-) strand; PAM type: YTN; PAM sequence: TTT
gttgttgatgctttgcttcc

SEQ ID NO: 206480 - DNA, 20 bp, Artificial Sequence
  Description of Artificial Sequence: Synthetic oligonucleotide
  Target: ATXN1; (-) strand; PAM type: YTN; PAM sequence: CTT
tgttgttgatgctttgcttc

SEQ ID NO: 206481 - DNA, 20 bp, Artificial Sequence
  Description of Artificial Sequence: Synthetic oligonucleotide
  Target: ATXN1; (-) strand; PAM type: YTN; PAM sequence: TTG
tacagaaatgctttgttgtt

SEQ ID NO: 206482 - DNA, 20 bp, Artificial Sequence
  Description of Artificial Sequence: Synthetic oligonucleotide
  Target: ATXN1; (-) strand; PAM type: YTN; PAM sequence: TTT
gtacagaaatgctttgttgt

SEQ ID NO: 206483 - DNA, 20 bp, Artificial Sequence
  Description of Artificial Sequence: Synthetic oligonucleotide
  Target: ATXN1; (-) strand; PAM type: YTN; PAM sequence: TTT
tgtacagaaatgctttgttg

SEQ ID NO: 206484 - DNA, 20 bp, Artificial Sequence
  Description of Artificial Sequence: Synthetic oligonucleotide
  Target: ATXN1; (-) strand; PAM type: YTN; PAM sequence: TTT
ttgtacagaaatgctttgtt

SEQ ID NO: 206485 - DNA, 20 bp, Artificial Sequence
  Description of Artificial Sequence: Synthetic oligonucleotide
  Target: ATXN1; (-) strand; PAM type: YTN; PAM sequence: TTC
atagataatttttgtacaga

SEQ ID NO: 206486 - DNA, 20 bp, Artificial Sequence
  Description of Artificial Sequence: Synthetic oligonucleotide
  Target: ATXN1; (-) strand; PAM type: YTN; PAM sequence: CTT
catagataatttttgtacag

SEQ ID NO: 206487 - DNA, 20 bp, Artificial Sequence
  Description of Artificial Sequence: Synthetic oligonucleotide
  Target: ATXN1; (-) strand; PAM type: YTN; PAM sequence: TTA
gacttcatagataatttttg

SEQ ID NO: 206488 - DNA, 20 bp, Artificial Sequence
  Description of Artificial Sequence: Synthetic oligonucleotide
  Target: ATXN1; (-) strand; PAM type: YTN; PAM sequence: TTT
agacttcatagataattttt

SEQ ID NO: 206489 - DNA, 20 bp, Artificial Sequence
  Description of Artificial Sequence: Synthetic oligonucleotide
  Target: ATXN1; (-) strand; PAM type: YTN; PAM sequence: CTG
tcatttagacttcatagata

SEQ ID NO: 206490 - DNA, 20 bp, Artificial Sequence
  Description of Artificial Sequence: Synthetic oligonucleotide
  Target: ATXN1; (-) strand; PAM type: YTN; PAM sequence: TTC
tgtcatttagacttcataga

SEQ ID NO: 206491 - DNA, 20 bp, Artificial Sequence
  Description of Artificial Sequence: Synthetic oligonucleotide
  Target: ATXN1; (-) strand; PAM type: YTN; PAM sequence: TTT
ctgtcatttagacttcatag

SEQ ID NO: 206492 - DNA, 20 bp, Artificial Sequence
  Description of Artificial Sequence: Synthetic oligonucleotide
  Target: ATXN1; (-) strand; PAM type: YTN; PAM sequence: TTG
aatggcgatatgtgtagttt

SEQ ID NO: 206493 - DNA, 20 bp, Artificial Sequence
  Description of Artificial Sequence: Synthetic oligonucleotide
  Target: ATXN1; (-) strand; PAM type: YTN; PAM sequence: CTT
gaatggcgatatgtgtagtt

SEQ ID NO: 206494 - DNA, 20 bp, Artificial Sequence
  Description of Artificial Sequence: Synthetic oligonucleotide
  Target: ATXN1; (-) strand; PAM type: YTN; PAM sequence: TTA
cagcacttgaatggcgatat

SEQ ID NO: 206495 - DNA, 20 bp, Artificial Sequence
  Description of Artificial Sequence: Synthetic oligonucleotide
  Target: ATXN1; (-) strand; PAM type: YTN; PAM sequence: TTT
acagcacttgaatggcgata

SEQ ID NO: 206496 - DNA, 20 bp, Artificial Sequence
  Description of Artificial Sequence: Synthetic oligonucleotide
  Target: ATXN1; (-) strand; PAM type: YTN; PAM sequence: CTC
aatgtttacagcacttgaat

SEQ ID NO: 206497 - DNA, 20 bp, Artificial Sequence
  Description of Artificial Sequence: Synthetic oligonucleotide
  Target: ATXN1; (-) strand; PAM type: YTN; PAM sequence: TTA
cgtcagctcaatgtttacag

SEQ ID NO: 206498 - DNA, 20 bp, Artificial Sequence
  Description of Artificial Sequence: Synthetic oligonucleotide
  Target: ATXN1; (-) strand; PAM type: YTN; PAM sequence: TTA
taattacgtcagctcaatgt

SEQ ID NO: 206499 - DNA, 20 bp, Artificial Sequence
  Description of Artificial Sequence: Synthetic oligonucleotide
  Target: ATXN1; (-) strand; PAM type: YTN; PAM sequence: TTT
ataattacgtcagctcaatg

SEQ ID NO: 206500 - DNA, 20 bp, Artificial Sequence
  Description of Artificial Sequence: Synthetic oligonucleotide
  Target: ATXN1; (-) strand; PAM type: YTN; PAM sequence: TTA
cagtaagtatttataattac

SEQ ID NO: 206501 - DNA, 20 bp, Artificial Sequence
  Description of Artificial Sequence: Synthetic oligonucleotide
  Target: ATXN1; (-) strand; PAM type: YTN; PAM sequence: CTT
acagtaagtatttataatta

SEQ ID NO: 206502 - DNA, 20 bp, Artificial Sequence
  Description of Artificial Sequence: Synthetic oligonucleotide
  Target: ATXN1; (-) strand; PAM type: YTN; PAM sequence: TTA
gcaaaagaaatagcttacag

SEQ ID NO: 206503 - DNA, 20 bp, Artificial Sequence
  Description of Artificial Sequence: Synthetic oligonucleotide
  Target: ATXN1; (-) strand; PAM type: YTN; PAM sequence: TTT
agcaaaagaaatagcttaca

SEQ ID NO: 206504 - DNA, 20 bp, Artificial Sequence
  Description of Artificial Sequence: Synthetic oligonucleotide
  Target: ATXN1; (-) strand; PAM type: YTN; PAM sequence: TTT
tagcaaaagaaatagcttac

SEQ ID NO: 206505 - DNA, 20 bp, Artificial Sequence
  Description of Artificial Sequence: Synthetic oligonucleotide
  Target: ATXN1; (-) strand; PAM type: YTN; PAM sequence: TTT
ttagcaaaagaaatagctta

SEQ ID NO: 206506 - DNA, 20 bp, Artificial Sequence
  Description of Artificial Sequence: Synthetic oligonucleotide
  Target: ATXN1; (-) strand; PAM type: YTN; PAM sequence: TTT
tttagcaaaagaaatagctt

SEQ ID NO: 206507 - DNA, 20 bp, Artificial Sequence
  Description of Artificial Sequence: Synthetic oligonucleotide
  Target: ATXN1; (-) strand; PAM type: YTN; PAM sequence: TTT
ttttagcaaaagaaatagct

SEQ ID NO: 206508 - DNA, 20 bp, Artificial Sequence
  Description of Artificial Sequence: Synthetic oligonucleotide
  Target: ATXN1; (-) strand; PAM type: YTN; PAM sequence: TTT
tttttagcaaaagaaatagc

SEQ ID NO: 206509 - DNA, 20 bp, Artificial Sequence
  Description of Artificial Sequence: Synthetic oligonucleotide
  Target: ATXN1; (-) strand; PAM type: YTN; PAM sequence: TTT
ttttttagcaaaagaaatag

SEQ ID NO: 206510 - DNA, 20 bp, Artificial Sequence
  Description of Artificial Sequence: Synthetic oligonucleotide
  Target: ATXN1; (-) strand; PAM type: YTN; PAM sequence: TTT
tttttttagcaaaagaaata

SEQ ID NO: 206511 - DNA, 20 bp, Artificial Sequence
  Description of Artificial Sequence: Synthetic oligonucleotide
  Target: ATXN1; (-) strand; PAM type: YTN; PAM sequence: CTA
attttttttttagcaaaaga

SEQ ID NO: 206512 - DNA, 20 bp, Artificial Sequence
  Description of Artificial Sequence: Synthetic oligonucleotide
  Target: ATXN1; (-) strand; PAM type: YTN; PAM sequence: CTC
taattttttttttagcaaaa

SEQ ID NO: 206513 - DNA, 20 bp, Artificial Sequence
  Description of Artificial Sequence: Synthetic oligonucleotide
  Target: ATXN1; (-) strand; PAM type: YTN; PAM sequence: TTA
acagaagtggatgaatatgc

SEQ ID NO: 206514 - DNA, 20 bp, Artificial Sequence
  Description of Artificial Sequence: Synthetic oligonucleotide
  Target: ATXN1; (-) strand; PAM type: YTN; PAM sequence: CTG
tccagtaattaacagaagtg

SEQ ID NO: 206515 - DNA, 20 bp, Artificial Sequence
  Description of Artificial Sequence: Synthetic oligonucleotide
  Target: ATXN1; (-) strand; PAM type: YTN; PAM sequence: CTC
tgtccagtaattaacagaag

SEQ ID NO: 206516 - DNA, 20 bp, Artificial Sequence
  Description of Artificial Sequence: Synthetic oligonucleotide
  Target: ATXN1; (-) strand; PAM type: YTN; PAM sequence: TTA
ctctgtccagtaattaacag

SEQ ID NO: 206517 - DNA, 20 bp, Artificial Sequence
  Description of Artificial Sequence: Synthetic oligonucleotide
  Target: ATXN1; (-) strand; PAM type: YTN; PAM sequence: TTA
tgaagtcacattactctgtc

SEQ ID NO: 206518 - DNA, 20 bp, Artificial Sequence
  Description of Artificial Sequence: Synthetic oligonucleotide
  Target: ATXN1; (-) strand; PAM type: YTN; PAM sequence: TTT
atgaagtcacattactctgt

SEQ ID NO: 206519 - DNA, 20 bp, Artificial Sequence
  Description of Artificial Sequence: Synthetic oligonucleotide
  Target: ATXN1; (-) strand; PAM type: YTN; PAM sequence: TTA
tttatgaagtcacattactc

SEQ ID NO: 206520 - DNA, 20 bp, Artificial Sequence
  Description of Artificial Sequence: Synthetic oligonucleotide
  Target: ATXN1; (-) strand; PAM type: YTN; PAM sequence: TTT
atttatgaagtcacattact

SEQ ID NO: 206521 - DNA, 20 bp, Artificial Sequence
  Description of Artificial Sequence: Synthetic oligonucleotide
  Target: ATXN1; (-) strand; PAM type: YTN; PAM sequence: TTA
gtatttatttatgaagtcac

SEQ ID NO: 206522 - DNA, 20 bp, Artificial Sequence
  Description of Artificial Sequence: Synthetic oligonucleotide
  Target: ATXN1; (-) strand; PAM type: YTN; PAM sequence: CTT
agtatttatttatgaagtca

SEQ ID NO: 206523 - DNA, 20 bp, Artificial Sequence
  Description of Artificial Sequence: Synthetic oligonucleotide
  Target: ATXN1; (-) strand; PAM type: YTN; PAM sequence: TTA
gtcaaatccttagtatttat

SEQ ID NO: 206524 - DNA, 20 bp, Artificial Sequence
  Description of Artificial Sequence: Synthetic oligonucleotide
  Target: ATXN1; (-) strand; PAM type: YTN; PAM sequence: TTC
attagtcaaatccttagtat

SEQ ID NO: 206525 - DNA, 20 bp, Artificial Sequence
  Description of Artificial Sequence: Synthetic oligonucleotide
  Target: ATXN1; (-) strand; PAM type: YTN; PAM sequence: TTA
tggcatattcattagtcaaa

SEQ ID NO: 206526 - DNA, 20 bp, Artificial Sequence
  Description of Artificial Sequence: Synthetic oligonucleotide
  Target: ATXN1; (-) strand; PAM type: YTN; PAM sequence: TTT
atggcatattcattagtcaa

SEQ ID NO: 206527 - DNA, 20 bp, Artificial Sequence
  Description of Artificial Sequence: Synthetic oligonucleotide
  Target: ATXN1; (-) strand; PAM type: YTN; PAM sequence: TTT
tatggcatattcattagtca

SEQ ID NO: 206528 - DNA, 20 bp, Artificial Sequence
  Description of Artificial Sequence: Synthetic oligonucleotide
  Target: ATXN1; (-) strand; PAM type: YTN; PAM sequence: TTC
agacattttatggcatattc

SEQ ID NO: 206529 - DNA, 20 bp, Artificial Sequence
  Description of Artificial Sequence: Synthetic oligonucleotide
  Target: ATXN1; (-) strand; PAM type: YTN; PAM sequence: TTA
attcagacattttatggcat

SEQ ID NO: 206530 - DNA, 20 bp, Artificial Sequence
  Description of Artificial Sequence: Synthetic oligonucleotide
  Target: ATXN1; (-) strand; PAM type: YTN; PAM sequence: CTA
ttaattcagacattttatgg

SEQ ID NO: 206531 - DNA, 20 bp, Artificial Sequence
  Description of Artificial Sequence: Synthetic oligonucleotide
  Target: ATXN1; (-) strand; PAM type: YTN; PAM sequence: TTG
ctattaattcagacatttta

SEQ ID NO: 206532 - DNA, 20 bp, Artificial Sequence
  Description of Artificial Sequence: Synthetic oligonucleotide
  Target: ATXN1; (-) strand; PAM type: YTN; PAM sequence: CTT
gctattaattcagacatttt

SEQ ID NO: 206533 - DNA, 20 bp, Artificial Sequence
  Description of Artificial Sequence: Synthetic oligonucleotide
  Target: ATXN1; (-) strand; PAM type: YTN; PAM sequence: CTA
atagaccacatatgaaatgt

SEQ ID NO: 206534 - DNA, 20 bp, Artificial Sequence
  Description of Artificial Sequence: Synthetic oligonucleotide
  Target: ATXN1; (-) strand; PAM type: YTN; PAM sequence: TTA
gaatagcatctaatagacca

SEQ ID NO: 206535 - DNA, 20 bp, Artificial Sequence
  Description of Artificial Sequence: Synthetic oligonucleotide
  Target: ATXN1; (-) strand; PAM type: YTN; PAM sequence: CTA
aattagaatagcatctaata

SEQ ID NO: 206536 - DNA, 20 bp, Artificial Sequence
  Description of Artificial Sequence: Synthetic oligonucleotide
  Target: ATXN1; (-) strand; PAM type: YTN; PAM sequence: TTC
taaattagaatagcatctaa

SEQ ID NO: 206537 - DNA, 20 bp, Artificial Sequence
  Description of Artificial Sequence: Synthetic oligonucleotide
  Target: ATXN1; (-) strand; PAM type: YTN; PAM sequence: CTG
caattctaaattagaatagc

SEQ ID NO: 206538 - DNA, 20 bp, Artificial Sequence
  Description of Artificial Sequence: Synthetic oligonucleotide
  Target: ATXN1; (-) strand; PAM type: YTN; PAM sequence: TTC
tgcaattctaaattagaata

SEQ ID NO: 206539 - DNA, 20 bp, Artificial Sequence
  Description of Artificial Sequence: Synthetic oligonucleotide
  Target: ATXN1; (-) strand; PAM type: YTN; PAM sequence: TTT
ctgcaattctaaattagaat

SEQ ID NO: 206540 - DNA, 20 bp, Artificial Sequence
  Description of Artificial Sequence: Synthetic oligonucleotide
  Target: ATXN1; (-) strand; PAM type: YTN; PAM sequence: TTA
aatttctgcaattctaaatt

SEQ ID NO: 206541 - DNA, 20 bp, Artificial Sequence
  Description of Artificial Sequence: Synthetic oligonucleotide
  Target: ATXN1; (-) strand; PAM type: YTN; PAM sequence: TTC
attaaatttctgcaattcta

SEQ ID NO: 206542 - DNA, 20 bp, Artificial Sequence
  Description of Artificial Sequence: Synthetic oligonucleotide
  Target: ATXN1; (-) strand; PAM type: YTN; PAM sequence: TTT
cattaaatttctgcaattct

SEQ ID NO: 206543 - DNA, 20 bp, Artificial Sequence
  Description of Artificial Sequence: Synthetic oligonucleotide
  Target: ATXN1; (-) strand; PAM type: YTN; PAM sequence: CTA
tttcattaaatttctgcaat

SEQ ID NO: 206544 - DNA, 20 bp, Artificial Sequence
  Description of Artificial Sequence: Synthetic oligonucleotide
  Target: ATXN1; (-) strand; PAM type: YTN; PAM sequence: TTG
cagtctatttcattaaattt

SEQ ID NO: 206545 - DNA, 20 bp, Artificial Sequence
  Description of Artificial Sequence: Synthetic oligonucleotide
  Target: ATXN1; (-) strand; PAM type: YTN; PAM sequence: TTT
gcagtctatttcattaaatt

SEQ ID NO: 206546 - DNA, 20 bp, Artificial Sequence
  Description of Artificial Sequence: Synthetic oligonucleotide
  Target: ATXN1; (-) strand; PAM type: YTN; PAM sequence: CTG
tttgcagtctatttcattaa

SEQ ID NO: 206547 - DNA, 20 bp, Artificial Sequence
  Description of Artificial Sequence: Synthetic oligonucleotide
  Target: ATXN1; (-) strand; PAM type: YTN; PAM sequence: TTC
ctgtttgcagtctatttcat

SEQ ID NO: 206548 - DNA, 20 bp, Artificial Sequence
  Description of Artificial Sequence: Synthetic oligonucleotide
  Target: ATXN1; (-) strand; PAM type: YTN; PAM sequence: TTT
cctgtttgcagtctatttca

SEQ ID NO: 206549 - DNA, 20 bp, Artificial Sequence
  Description of Artificial Sequence: Synthetic oligonucleotide
  Target: ATXN1; (-) strand; PAM type: YTN; PAM sequence: TTT
tcctgtttgcagtctatttc

SEQ ID NO: 206550 - DNA, 20 bp, Artificial Sequence
  Description of Artificial Sequence: Synthetic oligonucleotide
  Target: ATXN1; (-) strand; PAM type: YTN; PAM sequence: CTG
tattttcctgtttgcagtct

SEQ ID NO: 206551 - DNA, 20 bp, Artificial Sequence
  Description of Artificial Sequence: Synthetic oligonucleotide
  Target: ATXN1; (-) strand; PAM type: YTN; PAM sequence: TTG
cctgtattttcctgtttgca

SEQ ID NO: 206552 - DNA, 20 bp, Artificial Sequence
  Description of Artificial Sequence: Synthetic oligonucleotide
  Target: ATXN1; (-) strand; PAM type: YTN; PAM sequence: CTT
gcctgtattttcctgtttgc

SEQ ID NO: 206553 - DNA, 20 bp, Artificial Sequence
  Description of Artificial Sequence: Synthetic oligonucleotide
  Target: ATXN1; (-) strand; PAM type: YTN; PAM sequence: TTG
caaaatagtcttgcctgtat

SEQ ID NO: 206554 - DNA, 20 bp, Artificial Sequence
  Description of Artificial Sequence: Synthetic oligonucleotide
  Target: ATXN1; (-) strand; PAM type: YTN; PAM sequence: TTC
caaagtgcattgcaaaatag

SEQ ID NO: 206555 - DNA, 20 bp, Artificial Sequence
  Description of Artificial Sequence: Synthetic oligonucleotide
  Target: ATXN1; (-) strand; PAM type: YTN; PAM sequence: TTT
ccaaagtgcattgcaaaata

SEQ ID NO: 206556 - DNA, 20 bp, Artificial Sequence
  Description of Artificial Sequence: Synthetic oligonucleotide
  Target: ATXN1; (-) strand; PAM type: YTN; PAM sequence: TTT
tccaaagtgcattgcaaaat

SEQ ID NO: 206557 - DNA, 20 bp, Artificial Sequence
  Description of Artificial Sequence: Synthetic oligonucleotide
  Target: ATXN1; (-) strand; PAM type: YTN; PAM sequence: TTT
ttccaaagtgcattgcaaaa

SEQ ID NO: 206558 - DNA, 20 bp, Artificial Sequence
  Description of Artificial Sequence: Synthetic oligonucleotide
  Target: ATXN1; (-) strand; PAM type: YTN; PAM sequence: TTT
tttccaaagtgcattgcaaa

SEQ ID NO: 206559 - DNA, 20 bp, Artificial Sequence
  Description of Artificial Sequence: Synthetic oligonucleotide
  Target: ATXN1; (-) strand; PAM type: YTN; PAM sequence: TTT
ttttccaaagtgcattgcaa

SEQ ID NO: 206560 - DNA, 20 bp, Artificial Sequence
  Description of Artificial Sequence: Synthetic oligonucleotide
  Target: ATXN1; (-) strand; PAM type: YTN; PAM sequence: TTT
tttttccaaagtgcattgca

SEQ ID NO: 206561 - DNA, 20 bp, Artificial Sequence
  Description of Artificial Sequence: Synthetic oligonucleotide
  Target: ATXN1; (-) strand; PAM type: YTN; PAM sequence: TTA
ttttttttccaaagtgcatt

SEQ ID NO: 206562 - DNA, 20 bp, Artificial Sequence
  Description of Artificial Sequence: Synthetic oligonucleotide
  Target: ATXN1; (-) strand; PAM type: YTN; PAM sequence: CTT
attttttttccaaagtgcat

SEQ ID NO: 206563 - DNA, 20 bp, Artificial Sequence
  Description of Artificial Sequence: Synthetic oligonucleotide
  Target: ATXN1; (-) strand; PAM type: YTN; PAM sequence: TTC
ttattttttttccaaagtgc

SEQ ID NO: 206564 - DNA, 20 bp, Artificial Sequence
  Description of Artificial Sequence: Synthetic oligonucleotide
  Target: ATXN1; (-) strand; PAM type: YTN; PAM sequence: TTC
attcttattttttttccaaa

SEQ ID NO: 206565 - DNA, 20 bp, Artificial Sequence
  Description of Artificial Sequence: Synthetic oligonucleotide
  Target: ATXN1; (-) strand; PAM type: YTN; PAM sequence: TTG
taaacaattcattcttattt

SEQ ID NO: 206566 - DNA, 20 bp, Artificial Sequence
  Description of Artificial Sequence: Synthetic oligonucleotide
  Target: ATXN1; (-) strand; PAM type: YTN; PAM sequence: TTT
gtaaacaattcattcttatt

SEQ ID NO: 206567 - DNA, 20 bp, Artificial Sequence
  Description of Artificial Sequence: Synthetic oligonucleotide
  Target: ATXN1; (-) strand; PAM type: YTN; PAM sequence: CTG
gtagcatttgtaaacaattc

SEQ ID NO: 206568 - DNA, 20 bp, Artificial Sequence
  Description of Artificial Sequence: Synthetic oligonucleotide
  Target: ATXN1; (-) strand; PAM type: YTN; PAM sequence: CTA
tgtactggtagcatttgtaa

SEQ ID NO: 206569 - DNA, 20 bp, Artificial Sequence
  Description of Artificial Sequence: Synthetic oligonucleotide
  Target: ATXN1; (-) strand; PAM type: YTN; PAM sequence: TTC
aactatgtactggtagcatt

SEQ ID NO: 206570 - DNA, 20 bp, Artificial Sequence
  Description of Artificial Sequence: Synthetic oligonucleotide
  Target: ATXN1; (-) strand; PAM type: YTN; PAM sequence: CTG
ttcaactatgtactggtagc

SEQ ID NO: 206571 - DNA, 20 bp, Artificial Sequence
  Description of Artificial Sequence: Synthetic oligonucleotide
  Target: ATXN1; (-) strand; PAM type: YTN; PAM sequence: TTC
tgttcaactatgtactggta

SEQ ID NO: 206572 - DNA, 20 bp, Artificial Sequence
  Description of Artificial Sequence: Synthetic oligonucleotide
  Target: ATXN1; (-) strand; PAM type: YTN; PAM sequence: TTC
attctgttcaactatgtact

SEQ ID NO: 206573 - DNA, 20 bp, Artificial Sequence
  Description of Artificial Sequence: Synthetic oligonucleotide
  Target: ATXN1; (-) strand; PAM type: YTN; PAM sequence: TTA
ccagttcattctgttcaact

SEQ ID NO: 206574 - DNA, 20 bp, Artificial Sequence
  Description of Artificial Sequence: Synthetic oligonucleotide
  Target: ATXN1; (-) strand; PAM type: YTN; PAM sequence: CTA
ttaccagttcattctgttca

SEQ ID NO: 206575 - DNA, 20 bp, Artificial Sequence
  Description of Artificial Sequence: Synthetic oligonucleotide
  Target: ATXN1; (-) strand; PAM type: YTN; PAM sequence: TTC
gtaaaataactattaccagt

SEQ ID NO: 206576 - DNA, 20 bp, Artificial Sequence
  Description of Artificial Sequence: Synthetic oligonucleotide
  Target: ATXN1; (-) strand; PAM type: YTN; PAM sequence: CTT
cgtaaaataactattaccag

SEQ ID NO: 206577 - DNA, 20 bp, Artificial Sequence
  Description of Artificial Sequence: Synthetic oligonucleotide
  Target: ATXN1; (-) strand; PAM type: YTN; PAM sequence: TTG
cttcgtaaaataactattac

SEQ ID NO: 206578 - DNA, 20 bp, Artificial Sequence
  Description of Artificial Sequence: Synthetic oligonucleotide
  Target: ATXN1; (-) strand; PAM type: YTN; PAM sequence: TTT
gcttcgtaaaataactatta

SEQ ID NO: 206579 - DNA, 20 bp, Artificial Sequence
  Description of Artificial Sequence: Synthetic oligonucleotide
  Target: ATXN1; (-) strand; PAM type: YTN; PAM sequence: TTA
tgagtttgcttcgtaaaata

SEQ ID NO: 206580 - DNA, 20 bp, Artificial Sequence
  Description of Artificial Sequence: Synthetic oligonucleotide
  Target: ATXN1; (-) strand; PAM type: YTN; PAM sequence: TTG
gccaatatgcaagagaaaag

SEQ ID NO: 206581 - DNA, 20 bp, Artificial Sequence
  Description of Artificial Sequence: Synthetic oligonucleotide
  Target: ATXN1; (-) strand; PAM type: YTN; PAM sequence: TTT
ggccaatatgcaagagaaaa

SEQ ID NO: 206582 - DNA, 20 bp, Artificial Sequence
  Description of Artificial Sequence: Synthetic oligonucleotide
  Target: ATXN1; (-) strand; PAM type: YTN; PAM sequence: TTA
aatttggccaatatgcaaga

SEQ ID NO: 206583 - DNA, 20 bp, Artificial Sequence
  Description of Artificial Sequence: Synthetic oligonucleotide
  Target: ATXN1; (-) strand; PAM type: YTN; PAM sequence: TTT
aaatttggccaatatgcaag

SEQ ID NO: 206584 - DNA, 20 bp, Artificial Sequence
  Description of Artificial Sequence: Synthetic oligonucleotide
  Target: ATXN1; (-) strand; PAM type: YTN; PAM sequence: TTA
tttaaatttggccaatatgc

SEQ ID NO: 206585 - DNA, 20 bp, Artificial Sequence
  Description of Artificial Sequence: Synthetic oligonucleotide
  Target: ATXN1; (-) strand; PAM type: YTN; PAM sequence: CTA
atatgcattatttaaatttg

SEQ ID NO: 206586 - DNA, 20 bp, Artificial Sequence
  Description of Artificial Sequence: Synthetic oligonucleotide
  Target: ATXN1; (-) strand; PAM type: YTN; PAM sequence: CTC
taatatgcattatttaaatt

SEQ ID NO: 206587 - DNA, 20 bp, Artificial Sequence
  Description of Artificial Sequence: Synthetic oligonucleotide
  Target: ATXN1; (-) strand; PAM type: YTN; PAM sequence: TTA
atatataaaactctaatatg

SEQ ID NO: 206588 - DNA, 20 bp, Artificial Sequence
  Description of Artificial Sequence: Synthetic oligonucleotide
  Target: ATXN1; (-) strand; PAM type: YTN; PAM sequence: CTT
aatatataaaactctaatat

SEQ ID NO: 206589 - DNA, 20 bp, Artificial Sequence
  Description of Artificial Sequence: Synthetic oligonucleotide
  Target: ATXN1; (-) strand; PAM type: YTN; PAM sequence: TTC
agtaggacttaatatataaa

SEQ ID NO: 206590 - DNA, 20 bp, Artificial Sequence
  Description of Artificial Sequence: Synthetic oligonucleotide
  Target: ATXN1; (-) strand; PAM type: YTN; PAM sequence: TTT
cagtaggacttaatatataa

SEQ ID NO: 206591 - DNA, 20 bp, Artificial Sequence
  Description of Artificial Sequence: Synthetic oligonucleotide
  Target: ATXN1; (-) strand; PAM type: YTN; PAM sequence: TTA
tatttcagtaggacttaata

SEQ ID NO: 206592 - DNA, 20 bp, Artificial Sequence
  Description of Artificial Sequence: Synthetic oligonucleotide
  Target: ATXN1; (-) strand; PAM type: YTN; PAM sequence: TTT
atatttcagtaggacttaat

SEQ ID NO: 206593 - DNA, 20 bp, Artificial Sequence
  Description of Artificial Sequence: Synthetic oligonucleotide
  Target: ATXN1; (-) strand; PAM type: YTN; PAM sequence: CTT
tatatttcagtaggacttaa

SEQ ID NO: 206594 - DNA, 20 bp, Artificial Sequence
  Description of Artificial Sequence: Synthetic oligonucleotide
  Target: ATXN1; (-) strand; PAM type: YTN; PAM sequence: CTC
aaaatgcaataatgatagta

SEQ ID NO: 206595 - DNA, 20 bp, Artificial Sequence
  Description of Artificial Sequence: Synthetic oligonucleotide
  Target: ATXN1; (-) strand; PAM type: YTN; PAM sequence: TTG
agaatagaaatctcaaaatg

SEQ ID NO: 206596 - DNA, 20 bp, Artificial Sequence
  Description of Artificial Sequence: Synthetic oligonucleotide
  Target: ATXN1; (-) strand; PAM type: YTN; PAM sequence: TTA
tcagtgataaatgtgaattg

SEQ ID NO: 206597 - DNA, 20 bp, Artificial Sequence
  Description of Artificial Sequence: Synthetic oligonucleotide
  Target: ATXN1; (-) strand; PAM type: YTN; PAM sequence: TTT
atcagtgataaatgtgaatt

SEQ ID NO: 206598 - DNA, 20 bp, Artificial Sequence
  Description of Artificial Sequence: Synthetic oligonucleotide
  Target: ATXN1; (-) strand; PAM type: YTN; PAM sequence: TTT
tatcagtgataaatgtgaat

SEQ ID NO: 206599 - DNA, 20 bp, Artificial Sequence
  Description of Artificial Sequence: Synthetic oligonucleotide
  Target: ATXN1; (-) strand; PAM type: YTN; PAM sequence: CTT
ttatcagtgataaatgtgaa

SEQ ID NO: 206600 - DNA, 20 bp, Artificial Sequence
  Description of Artificial Sequence: Synthetic oligonucleotide
  Target: ATXN1; (-) strand; PAM type: YTN; PAM sequence: TTA
tcttttatcagtgataaatg

SEQ ID NO: 206601 - DNA, 20 bp, Artificial Sequence
  Description of Artificial Sequence: Synthetic oligonucleotide
  Target: ATXN1; (-) strand; PAM type: YTN; PAM sequence: TTT
atcttttatcagtgataaat

SEQ ID NO: 206602 - DNA, 20 bp, Artificial Sequence
  Description of Artificial Sequence: Synthetic oligonucleotide
  Target: ATXN1; (-) strand; PAM type: YTN; PAM sequence: TTT
tatcttttatcagtgataaa

SEQ ID NO: 206603 - DNA, 20 bp, Artificial Sequence
  Description of Artificial Sequence: Synthetic oligonucleotide
  Target: ATXN1; (-) strand; PAM type: YTN; PAM sequence: TTG
gggttttatcttttatcagt

SEQ ID NO: 206604 - DNA, 20 bp, Artificial Sequence
  Description of Artificial Sequence: Synthetic oligonucleotide
  Target: ATXN1; (-) strand; PAM type: YTN; PAM sequence: TTT
ggggttttatcttttatcag

SEQ ID NO: 206605 - DNA, 20 bp, Artificial Sequence
  Description of Artificial Sequence: Synthetic oligonucleotide
  Target: ATXN1; (-) strand; PAM type: YTN; PAM sequence: CTT
tggggttttatcttttatca

SEQ ID NO: 206606 - DNA, 20 bp, Artificial Sequence
  Description of Artificial Sequence: Synthetic oligonucleotide
  Target: ATXN1; (-) strand; PAM type: YTN; PAM sequence: TTG
ctttggggttttatctttta

SEQ ID NO: 206607 - DNA, 20 bp, Artificial Sequence
  Description of Artificial Sequence: Synthetic oligonucleotide
  Target: ATXN1; (-) strand; PAM type: YTN; PAM sequence: TTT
gctttggggttttatctttt

SEQ ID NO: 206608 - DNA, 20 bp, Artificial Sequence
  Description of Artificial Sequence: Synthetic oligonucleotide
  Target: ATXN1; (-) strand; PAM type: YTN; PAM sequence: CTC
aatcagaaaaatgatttgct

SEQ ID NO: 206609 - DNA, 20 bp, Artificial Sequence
  Description of Artificial Sequence: Synthetic oligonucleotide
  Target: ATXN1; (-) strand; PAM type: YTN; PAM sequence: CTG
aggaaaagcctcaatcagaa

SEQ ID NO: 206610 - DNA, 20 bp, Artificial Sequence
  Description of Artificial Sequence: Synthetic oligonucleotide
  Target: ATXN1; (-) strand; PAM type: YTN; PAM sequence: CTC
tgaggaaaagcctcaatcag

SEQ ID NO: 206611 - DNA, 20 bp, Artificial Sequence
  Description of Artificial Sequence: Synthetic oligonucleotide
  Target: ATXN1; (-) strand; PAM type: YTN; PAM sequence: CTA
gtatctctgaggaaaagcct

SEQ ID NO: 206612 - DNA, 20 bp, Artificial Sequence
  Description of Artificial Sequence: Synthetic oligonucleotide
  Target: ATXN1; (-) strand; PAM type: YTN; PAM sequence: CTC
tagtatctctgaggaaaagc

SEQ ID NO: 206613 - DNA, 20 bp, Artificial Sequence
  Description of Artificial Sequence: Synthetic oligonucleotide
  Target: ATXN1; (-) strand; PAM type: YTN; PAM sequence: CTA
caactctagtatctctgagg

SEQ ID NO: 206614 - DNA, 20 bp, Artificial Sequence
  Description of Artificial Sequence: Synthetic oligonucleotide
  Target: ATXN1; (-) strand; PAM type: YTN; PAM sequence: TTC
ccctacaactctagtatctc

SEQ ID NO: 206615 - DNA, 20 bp, Artificial Sequence
  Description of Artificial Sequence: Synthetic oligonucleotide
  Target: ATXN1; (-) strand; PAM type: YTN; PAM sequence: CTT
cccctacaactctagtatct

SEQ ID NO: 206616 - DNA, 20 bp, Artificial Sequence
  Description of Artificial Sequence: Synthetic oligonucleotide
  Target: ATXN1; (-) strand; PAM type: YTN; PAM sequence: TTA
tacttcccctacaactctag

SEQ ID NO: 206617 - DNA, 20 bp, Artificial Sequence
  Description of Artificial Sequence: Synthetic oligonucleotide
  Target: ATXN1; (-) strand; PAM type: YTN; PAM sequence: TTT
atacttcccctacaactcta

SEQ ID NO: 206618 - DNA, 20 bp, Artificial Sequence
  Description of Artificial Sequence: Synthetic oligonucleotide
  Target: ATXN1; (-) strand; PAM type: YTN; PAM sequence: TTT
tatacttcccctacaactct

SEQ ID NO: 206619 - DNA, 20 bp, Artificial Sequence
  Description of Artificial Sequence: Synthetic oligonucleotide
  Target: ATXN1; (-) strand; PAM type: YTN; PAM sequence: TTT
ttatacttcccctacaactc

SEQ ID NO: 206620 - DNA, 20 bp, Artificial Sequence
  Description of Artificial Sequence: Synthetic oligonucleotide
  Target: ATXN1; (-) strand; PAM type: YTN; PAM sequence: TTA
gtatttttatacttccccta

SEQ ID NO: 206621 - DNA, 20 bp, Artificial Sequence
  Description of Artificial Sequence: Synthetic oligonucleotide
  Target: ATXN1; (-) strand; PAM type: YTN; PAM sequence: TTT
agtatttttatacttcccct

SEQ ID NO: 206622 - DNA, 20 bp, Artificial Sequence
  Description of Artificial Sequence: Synthetic oligonucleotide
  Target: ATXN1; (-) strand; PAM type: YTN; PAM sequence: TTA
tgaatttagtatttttatac

SEQ ID NO: 206623 - DNA, 20 bp, Artificial Sequence
  Description of Artificial Sequence: Synthetic oligonucleotide
  Target: ATXN1; (-) strand; PAM type: YTN; PAM sequence: CTC
aaagaaaaaaaaaaaagaat

SEQ ID NO: 206624 - DNA, 20 bp, Artificial Sequence
  Description of Artificial Sequence: Synthetic oligonucleotide
  Target: ATXN1; (-) strand; PAM type: YTN; PAM sequence: TTG
tctcaaagaaaaaaaaaaaa

SEQ ID NO: 206625 - DNA, 20 bp, Artificial Sequence
  Description of Artificial Sequence: Synthetic oligonucleotide
  Target: ATXN1; (-) strand; PAM type: YTN; PAM sequence: CTT
gtctcaaagaaaaaaaaaaa

SEQ ID NO: 206626 - DNA, 20 bp, Artificial Sequence
  Description of Artificial Sequence: Synthetic oligonucleotide
  Target: ATXN1; (-) strand; PAM type: YTN; PAM sequence: CTG
ggaaacagagtgagaacttg

SEQ ID NO: 206627 - DNA, 20 bp, Artificial Sequence
  Description of Artificial Sequence: Synthetic oligonucleotide
  Target: ATXN1; (-) strand; PAM type: YTN; PAM sequence: CTC
caacctgggaaacagagtga

SEQ ID NO: 206628 - DNA, 20 bp, Artificial Sequence
  Description of Artificial Sequence: Synthetic oligonucleotide
  Target: ATXN1; (-) strand; PAM type: YTN; PAM sequence: CTG
cactccaacctgggaaacag

SEQ ID NO: 206629 - DNA, 20 bp, Artificial Sequence
  Description of Artificial Sequence: Synthetic oligonucleotide
  Target: ATXN1; (-) strand; PAM type: YTN; PAM sequence: CTG
tcatcacaccactgcactcc

SEQ ID NO: 206630 - DNA, 20 bp, Artificial Sequence
  Description of Artificial Sequence: Synthetic oligonucleotide
  Target: ATXN1; (-) strand; PAM type: YTN; PAM sequence: CTG
aagtgagctgtcatcacacc

SEQ ID NO: 206631 - DNA, 20 bp, Artificial Sequence
  Description of Artificial Sequence: Synthetic oligonucleotide
  Target: ATXN1; (-) strand; PAM type: YTN; PAM sequence: TTG
aggctgaagtgagctgtcat

SEQ ID NO: 206632 - DNA, 20 bp, Artificial Sequence
  Description of Artificial Sequence: Synthetic oligonucleotide
  Target: ATXN1; (-) strand; PAM type: YTN; PAM sequence: CTG
agcccgagaggttgaggctg

SEQ ID NO: 206633 - DNA, 20 bp, Artificial Sequence
  Description of Artificial Sequence: Synthetic oligonucleotide
  Target: ATXN1; (-) strand; PAM type: YTN; PAM sequence: CTG
aggtgagaggaccacctgag

SEQ ID NO: 206634 - DNA, 20 bp, Artificial Sequence
  Description of Artificial Sequence: Synthetic oligonucleotide
  Target: ATXN1; (-) strand; PAM type: YTN; PAM sequence: CTA
cccaggaggctgaggtgaga

SEQ ID NO: 206635 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacccaggag

SEQ ID NO: 206636 - DNA, 20 bp, Artificial Sequence
  Description of Artificial Sequence: Synthetic oligonucleotide
  Target: ATXN1; (-) strand; PAM type: YTN; PAM sequence: TTA
gccaggcatggtggcgtgtg

SEQ ID NO: 206637 - DNA, 20 bp, Artificial Sequence
  Description of Artificial Sequence: Synthetic oligonucleotide
  Target: ATXN1; (-) strand; PAM type: YTN; PAM sequence: TTA
aaaaattagccaggcatggt

SEQ ID NO: 206638 - DNA, 20 bp, Artificial Sequence
  Description of Artificial Sequence: Synthetic oligonucleotide
  Target: ATXN1; (-) strand; PAM type: YTN; PAM sequence: TTC
aaaaaaaaaaaaaaattaaa

SEQ ID NO: 206639 - DNA, 20 bp, Artificial Sequence
  Description of Artificial Sequence: Synthetic oligonucleotide
  Target: ATXN1; (-) strand; PAM type: YTN; PAM sequence: TTT
caaaaaaaaaaaaaaattaa

SEQ ID NO: 206640 - DNA, 20 bp, Artificial Sequence
  Description of Artificial Sequence: Synthetic oligonucleotide
  Target: ATXN1; (-) strand; PAM type: YTN; PAM sequence: CTA
tgtttcaaaaaaaaaaaaaa

SEQ ID NO: 206641 - DNA, 20 bp, Artificial Sequence
  Description of Artificial Sequence: Synthetic oligonucleotide
  Target: ATXN1; (-) strand; PAM type: YTN; PAM sequence: CTG
ggcaacaggagtgaaactat

SEQ ID NO: 206642 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcaacaggagtg

SEQ ID NO: 206643 - DNA, 20 bp, Artificial Sequence
  Description of Artificial Sequence: Synthetic oligonucleotide
  Target: ATXN1; (-) strand; PAM type: YTN; PAM sequence: TTG
cactccagcctgggcaacag

SEQ ID NO: 206644 - DNA, 20 bp, Artificial Sequence
  Description of Artificial Sequence: Synthetic oligonucleotide
  Target: ATXN1; (-) strand; PAM type: YTN; PAM sequence: TTG
cgccattgcactccagcctg

SEQ ID NO: 206645 - DNA, 20 bp, Artificial Sequence
  Description of Artificial Sequence: Synthetic oligonucleotide
  Target: ATXN1; (-) strand; PAM type: YTN; PAM sequence: TTA
tggtgagtggagattgcgcc

SEQ ID NO: 206646 - DNA, 20 bp, Artificial Sequence
  Description of Artificial Sequence: Synthetic oligonucleotide
  Target: ATXN1; (-) strand; PAM type: YTN; PAM sequence: CTG
gaaggcggaggttatggtga

SEQ ID NO: 206647 - DNA, 20 bp, Artificial Sequence
  Description of Artificial Sequence: Synthetic oligonucleotide
  Target: ATXN1; (-) strand; PAM type: YTN; PAM sequence: TTG
aacctggaaggcggaggtta

SEQ ID NO: 206648 - DNA, 20 bp, Artificial Sequence
  Description of Artificial Sequence: Synthetic oligonucleotide
  Target: ATXN1; (-) strand; PAM type: YTN; PAM sequence: CTT
gaacctggaaggcggaggtt

SEQ ID NO: 206649 - DNA, 20 bp, Artificial Sequence
  Description of Artificial Sequence: Synthetic oligonucleotide
  Target: ATXN1; (-) strand; PAM type: YTN; PAM sequence: TTG
cttgaacctggaaggcggag

SEQ ID NO: 206650 - DNA, 20 bp, Artificial Sequence
  Description of Artificial Sequence: Synthetic oligonucleotide
  Target: ATXN1; (-) strand; PAM type: YTN; PAM sequence: CTG
aggcaggataattgcttgaa

SEQ ID NO: 206651 - DNA, 20 bp, Artificial Sequence
  Description of Artificial Sequence: Synthetic oligonucleotide
  Target: ATXN1; (-) strand; PAM type: YTN; PAM sequence: CTC
aggaggctgaggcaggataa

SEQ ID NO: 206652 - DNA, 20 bp, Artificial Sequence
  Description of Artificial Sequence: Synthetic oligonucleotide
  Target: ATXN1; (-) strand; PAM type: YTN; PAM sequence: CTA
ctcaggaggctgaggcagga

SEQ ID NO: 206653 - DNA, 20 bp, Artificial Sequence
  Description of Artificial Sequence: Synthetic oligonucleotide
  Target: ATXN1; (-) strand; PAM type: YTN; PAM sequence: CTG
taatcccagctactcaggag

SEQ ID NO: 206654 - DNA, 20 bp, Artificial Sequence
  Description of Artificial Sequence: Synthetic oligonucleotide
  Target: ATXN1; (-) strand; PAM type: YTN; PAM sequence: CTG
gacgtggtggtgcatgcctg

SEQ ID NO: 206655 - DNA, 20 bp, Artificial Sequence
  Description of Artificial Sequence: Synthetic oligonucleotide
  Target: ATXN1; (-) strand; PAM type: YTN; PAM sequence: TTA
gctggacgtggtggtgcatg

SEQ ID NO: 206656 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaattagctgga

SEQ ID NO: 206657 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaattagct

SEQ ID NO: 206658 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaattag

SEQ ID NO: 206659 - DNA, 20 bp, Artificial Sequence
  Description of Artificial Sequence: Synthetic oligonucleotide
  Target: ATXN1; (-) strand; PAM type: YTN; PAM sequence: CTG
gccaacatggagaaacccca

SEQ ID NO: 206660 - DNA, 20 bp, Artificial Sequence
  Description of Artificial Sequence: Synthetic oligonucleotide
  Target: ATXN1; (-) strand; PAM type: YTN; PAM sequence: CTG
gtcgagaccatcctggccaa

SEQ ID NO: 206661 - DNA, 20 bp, Artificial Sequence
  Description of Artificial Sequence: Synthetic oligonucleotide
  Target: ATXN1; (-) strand; PAM type: YTN; PAM sequence: TTG
ggagaccacatgctggtcga

SEQ ID NO: 206662 - DNA, 20 bp, Artificial Sequence
  Description of Artificial Sequence: Synthetic oligonucleotide
  Target: ATXN1; (-) strand; PAM type: YTN; PAM sequence: TTT
gggagaccacatgctggtcg

SEQ ID NO: 206663 - DNA, 20 bp, Artificial Sequence
  Description of Artificial Sequence: Synthetic oligonucleotide
  Target: ATXN1; (-) strand; PAM type: YTN; PAM sequence: CTT
tgggagaccacatgctggtc

SEQ ID NO: 206664 - DNA, 20 bp, Artificial Sequence
  Description of Artificial Sequence: Synthetic oligonucleotide
  Target: ATXN1; (-) strand; PAM type: YTN; PAM sequence: CTG
taatcacagcactttgggag

SEQ ID NO: 206665 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcacagcact

SEQ ID NO: 206666 - DNA, 20 bp, Artificial Sequence
  Description of Artificial Sequence: Synthetic oligonucleotide
  Target: ATXN1; (-) strand; PAM type: YTN; PAM sequence: TTG
ggcgcagtggctcacgcctg

SEQ ID NO: 206667 - DNA, 20 bp, Artificial Sequence
  Description of Artificial Sequence: Synthetic oligonucleotide
  Target: ATXN1; (-) strand; PAM type: YTN; PAM sequence: TTA
aaaaaatagttgggcgcagt

SEQ ID NO: 206668 - DNA, 20 bp, Artificial Sequence
  Description of Artificial Sequence: Synthetic oligonucleotide
  Target: ATXN1; (-) strand; PAM type: YTN; PAM sequence: CTA
aaaaattaaaaaaatagttg

SEQ ID NO: 206669 - DNA, 20 bp, Artificial Sequence
  Description of Artificial Sequence: Synthetic oligonucleotide
  Target: ATXN1; (-) strand; PAM type: YTN; PAM sequence: CTA
ctaaaaaattaaaaaaatag

SEQ ID NO: 206670 - DNA, 20 bp, Artificial Sequence
  Description of Artificial Sequence: Synthetic oligonucleotide
  Target: ATXN1; (-) strand; PAM type: YTN; PAM sequence: CTC
tactaaaaaattaaaaaaat

SEQ ID NO: 206671 - DNA, 20 bp, Artificial Sequence
  Description of Artificial Sequence: Synthetic oligonucleotide
  Target: ATXN1; (-) strand; PAM type: YTN; PAM sequence: CTG
tctctactaaaaaattaaaa

SEQ ID NO: 206672 - DNA, 20 bp, Artificial Sequence
  Description of Artificial Sequence: Synthetic oligonucleotide
  Target: ATXN1; (-) strand; PAM type: YTN; PAM sequence: CTG
ggcgacatagcaagaccctg

SEQ ID NO: 206673 - DNA, 20 bp, Artificial Sequence
  Description of Artificial Sequence: Synthetic oligonucleotide
  Target: ATXN1; (-) strand; PAM type: YTN; PAM sequence: TTG
agtccagcctgggcgacata

SEQ ID NO: 206674 - DNA, 20 bp, Artificial Sequence
  Description of Artificial Sequence: Synthetic oligonucleotide
  Target: ATXN1; (-) strand; PAM type: YTN; PAM sequence: TTT
gagtccagcctgggcgacat

SEQ ID NO: 206675 - DNA, 20 bp, Artificial Sequence
  Description of Artificial Sequence: Synthetic oligonucleotide
  Target: ATXN1; (-) strand; PAM type: YTN; PAM sequence: CTG
gagaccagtagtttgagtcc

SEQ ID NO: 206676 - DNA, 20 bp, Artificial Sequence
  Description of Artificial Sequence: Synthetic oligonucleotide
  Target: ATXN1; (-) strand; PAM type: YTN; PAM sequence: TTG
ctggagaccagtagtttgag

SEQ ID NO: 206677 - DNA, 20 bp, Artificial Sequence
  Description of Artificial Sequence: Synthetic oligonucleotide
  Target: ATXN1; (-) strand; PAM type: YTN; PAM sequence: CTA
ggtgggaagattgctggaga

SEQ ID NO: 206678 - DNA, 20 bp, Artificial Sequence
  Description of Artificial Sequence: Synthetic oligonucleotide
  Target: ATXN1; (-) strand; PAM type: YTN; PAM sequence: TTG
ggaggcctaggtgggaagat

SEQ ID NO: 206679 - DNA, 20 bp, Artificial Sequence
  Description of Artificial Sequence: Synthetic oligonucleotide
  Target: ATXN1; (-) strand; PAM type: YTN; PAM sequence: TTT
gggaggcctaggtgggaaga

SEQ ID NO: 206680 - DNA, 20 bp, Artificial Sequence
  Description of Artificial Sequence: Synthetic oligonucleotide
  Target: ATXN1; (-) strand; PAM type: YTN; PAM sequence: CTT
tgggaggcctaggtgggaag

SEQ ID NO: 206681 - DNA, 20 bp, Artificial Sequence
  Description of Artificial Sequence: Synthetic oligonucleotide
  Target: ATXN1; (-) strand; PAM type: YTN; PAM sequence: TTC
tttgggaggcctaggtggga

SEQ ID NO: 206682 - DNA, 20 bp, Artificial Sequence
  Description of Artificial Sequence: Synthetic oligonucleotide
  Target: ATXN1; (-) strand; PAM type: YTN; PAM sequence: CTG
tagtcccagttctttgggag

SEQ ID NO: 206683 - DNA, 20 bp, Artificial Sequence
  Description of Artificial Sequence: Synthetic oligonucleotide
  Target: ATXN1; (-) strand; PAM type: YTN; PAM sequence: CTC
acacctgtagtcccagttct

SEQ ID NO: 206684 - DNA, 20 bp, Artificial Sequence
  Description of Artificial Sequence: Synthetic oligonucleotide
  Target: ATXN1; (-) strand; PAM type: YTN; PAM sequence: CTG
tggctcacacctgtagtccc

SEQ ID NO: 206685 - DNA, 20 bp, Artificial Sequence
  Description of Artificial Sequence: Synthetic oligonucleotide
  Target: ATXN1; (-) strand; PAM type: YTN; PAM sequence: CTG
ggcactgtggctcacacctg

SEQ ID NO: 206686 - DNA, 20 bp, Artificial Sequence
  Description of Artificial Sequence: Synthetic oligonucleotide
  Target: ATXN1; (-) strand; PAM type: YTN; PAM sequence: TTA
cagctgggcactgtggctca

SEQ ID NO: 206687 - DNA, 20 bp, Artificial Sequence
  Description of Artificial Sequence: Synthetic oligonucleotide
  Target: ATXN1; (-) strand; PAM type: YTN; PAM sequence: CTC
atggtaaatgaataggttac

SEQ ID NO: 206688 - DNA, 20 bp, Artificial Sequence
  Description of Artificial Sequence: Synthetic oligonucleotide
  Target: ATXN1; (-) strand; PAM type: YTN; PAM sequence: TTA
atagtctcatggtaaatgaa

SEQ ID NO: 206689 - DNA, 20 bp, Artificial Sequence
  Description of Artificial Sequence: Synthetic oligonucleotide
  Target: ATXN1; (-) strand; PAM type: YTN; PAM sequence: TTT
aatagtctcatggtaaatga

SEQ ID NO: 206690 - DNA, 20 bp, Artificial Sequence
  Description of Artificial Sequence: Synthetic oligonucleotide
  Target: ATXN1; (-) strand; PAM type: YTN; PAM sequence: TTA
aaaggagtttaatagtctca

SEQ ID NO: 206691 - DNA, 20 bp, Artificial Sequence
  Description of Artificial Sequence: Synthetic oligonucleotide
  Target: ATXN1; (-) strand; PAM type: YTN; PAM sequence: TTT
aaaaggagtttaatagtctc

SEQ ID NO: 206692 - DNA, 20 bp, Artificial Sequence
  Description of Artificial Sequence: Synthetic oligonucleotide
  Target: ATXN1; (-) strand; PAM type: YTN; PAM sequence: TTC
aatttaaaaggagtttaata

SEQ ID NO: 206693 - DNA, 20 bp, Artificial Sequence
  Description of Artificial Sequence: Synthetic oligonucleotide
  Target: ATXN1; (-) strand; PAM type: YTN; PAM sequence: TTA
taattcaatttaaaaggagt

SEQ ID NO: 206694 - DNA, 20 bp, Artificial Sequence
  Description of Artificial Sequence: Synthetic oligonucleotide
  Target: ATXN1; (-) strand; PAM type: YTN; PAM sequence: CTG
tggccatggaatagaattat

SEQ ID NO: 206695 - DNA, 20 bp, Artificial Sequence
  Description of Artificial Sequence: Synthetic oligonucleotide
  Target: ATXN1; (-) strand; PAM type: YTN; PAM sequence: CTG
gtcaatagctgtggccatgg

SEQ ID NO: 206696 - DNA, 20 bp, Artificial Sequence
  Description of Artificial Sequence: Synthetic oligonucleotide
  Target: ATXN1; (-) strand; PAM type: YTN; PAM sequence: TTA
gggtaaactggtcaatagct

SEQ ID NO: 206697 - DNA, 20 bp, Artificial Sequence
  Description of Artificial Sequence: Synthetic oligonucleotide
  Target: ATXN1; (-) strand; PAM type: YTN; PAM sequence: CTT
agggtaaactggtcaatagc

SEQ ID NO: 206698 - DNA, 20 bp, Artificial Sequence
  Description of Artificial Sequence: Synthetic oligonucleotide
  Target: ATXN1; (-) strand; PAM type: YTN; PAM sequence: TTG
caaagaaccatatacttagg

SEQ ID NO: 206699 - DNA, 20 bp, Artificial Sequence
  Description of Artificial Sequence: Synthetic oligonucleotide
  Target: ATXN1; (-) strand; PAM type: YTN; PAM sequence: TTA
tgttgcaaagaaccatatac

SEQ ID NO: 206700 - DNA, 20 bp, Artificial Sequence
  Description of Artificial Sequence: Synthetic oligonucleotide
  Target: ATXN1; (-) strand; PAM type: YTN; PAM sequence: TTA
attatgttgcaaagaaccat

SEQ ID NO: 206701 - DNA, 20 bp, Artificial Sequence
  Description of Artificial Sequence: Synthetic oligonucleotide
  Target: ATXN1; (-) strand; PAM type: YTN; PAM sequence: TTT
aattatgttgcaaagaacca

SEQ ID NO: 206702 - DNA, 20 bp, Artificial Sequence
  Description of Artificial Sequence: Synthetic oligonucleotide
  Target: ATXN1; (-) strand; PAM type: YTN; PAM sequence: TTT
taattatgttgcaaagaacc

SEQ ID NO: 206703 - DNA, 20 bp, Artificial Sequence
  Description of Artificial Sequence: Synthetic oligonucleotide
  Target: ATXN1; (-) strand; PAM type: YTN; PAM sequence: CTC
attttaattatgttgcaaag

SEQ ID NO: 206704 - DNA, 20 bp, Artificial Sequence
  Description of Artificial Sequence: Synthetic oligonucleotide
  Target: ATXN1; (-) strand; PAM type: YTN; PAM sequence: TTC
tcattttaattatgttgcaa

SEQ ID NO: 206705 - DNA, 20 bp, Artificial Sequence
  Description of Artificial Sequence: Synthetic oligonucleotide
  Target: ATXN1; (-) strand; PAM type: YTN; PAM sequence: CTT
ctcattttaattatgttgca

SEQ ID NO: 206706 - DNA, 20 bp, Artificial Sequence
  Description of Artificial Sequence: Synthetic oligonucleotide
  Target: ATXN1; (-) strand; PAM type: YTN; PAM sequence: CTA
ccttctcattttaattatgt

SEQ ID NO: 206707 - DNA, 20 bp, Artificial Sequence
  Description of Artificial Sequence: Synthetic oligonucleotide
  Target: ATXN1; (-) strand; PAM type: YTN; PAM sequence: TTC
taccttctcattttaattat

SEQ ID NO: 206708 - DNA, 20 bp, Artificial Sequence
  Description of Artificial Sequence: Synthetic oligonucleotide
  Target: ATXN1; (-) strand; PAM type: YTN; PAM sequence: CTA
ttctaccttctcattttaat

SEQ ID NO: 206709 - DNA, 20 bp, Artificial Sequence
  Description of Artificial Sequence: Synthetic oligonucleotide
  Target: ATXN1; (-) strand; PAM type: YTN; PAM sequence: TTG
tctattctaccttctcattt

SEQ ID NO: 206710 - DNA, 20 bp, Artificial Sequence
  Description of Artificial Sequence: Synthetic oligonucleotide
  Target: ATXN1; (-) strand; PAM type: YTN; PAM sequence: TTT
gtctattctaccttctcatt

SEQ ID NO: 206711 - DNA, 20 bp, Artificial Sequence
  Description of Artificial Sequence: Synthetic oligonucleotide
  Target: ATXN1; (-) strand; PAM type: YTN; PAM sequence: TTT
tgtctattctaccttctcat

SEQ ID NO: 206712 - DNA, 20 bp, Artificial Sequence
  Description of Artificial Sequence: Synthetic oligonucleotide
  Target: ATXN1; (-) strand; PAM type: YTN; PAM sequence: TTG
gttttgtctattctaccttc

SEQ ID NO: 206713 - DNA, 20 bp, Artificial Sequence
  Description of Artificial Sequence: Synthetic oligonucleotide
  Target: ATXN1; (-) strand; PAM type: YTN; PAM sequence: TTT
ggttttgtctattctacctt

SEQ ID NO: 206714 - DNA, 20 bp, Artificial Sequence
  Description of Artificial Sequence: Synthetic oligonucleotide
  Target: ATXN1; (-) strand; PAM type: YTN; PAM sequence: TTT
tggttttgtctattctacct

SEQ ID NO: 206715 - DNA, 20 bp, Artificial Sequence
  Description of Artificial Sequence: Synthetic oligonucleotide
  Target: ATXN1; (-) strand; PAM type: YTN; PAM sequence: TTT
ttggttttgtctattctacc

SEQ ID NO: 206716 - DNA, 20 bp, Artificial Sequence
  Description of Artificial Sequence: Synthetic oligonucleotide
  Target: ATXN1; (-) strand; PAM type: YTN; PAM sequence: TTT
tttggttttgtctattctac

SEQ ID NO: 206717 - DNA, 20 bp, Artificial Sequence
  Description of Artificial Sequence: Synthetic oligonucleotide
  Target: ATXN1; (-) strand; PAM type: YTN; PAM sequence: CTT
ttttggttttgtctattcta

SEQ ID NO: 206718 - DNA, 20 bp, Artificial Sequence
  Description of Artificial Sequence: Synthetic oligonucleotide
  Target: ATXN1; (-) strand; PAM type: YTN; PAM sequence: TTA
agacttttttggttttgtct

SEQ ID NO: 206719 - DNA, 20 bp, Artificial Sequence
  Description of Artificial Sequence: Synthetic oligonucleotide
  Target: ATXN1; (-) strand; PAM type: YTN; PAM sequence: TTA
aataaaaatgatcaaattaa

SEQ ID NO: 206720 - DNA, 20 bp, Artificial Sequence
  Description of Artificial Sequence: Synthetic oligonucleotide
  Target: ATXN1; (-) strand; PAM type: YTN; PAM sequence: TTT
aaataaaaatgatcaaatta

SEQ ID NO: 206721 - DNA, 20 bp, Artificial Sequence
  Description of Artificial Sequence: Synthetic oligonucleotide
  Target: ATXN1; (-) strand; PAM type: YTN; PAM sequence: TTA
atagtaaatttaaataaaaa

SEQ ID NO: 206722 - DNA, 20 bp, Artificial Sequence
  Description of Artificial Sequence: Synthetic oligonucleotide
  Target: ATXN1; (-) strand; PAM type: YTN; PAM sequence: TTA
tgacgcaaacataagcatca

SEQ ID NO: 206723 - DNA, 20 bp, Artificial Sequence
  Description of Artificial Sequence: Synthetic oligonucleotide
  Target: ATXN1; (-) strand; PAM type: YTN; PAM sequence: TTC
catcagatgttatgacgcaa

SEQ ID NO: 206724 - DNA, 20 bp, Artificial Sequence
  Description of Artificial Sequence: Synthetic oligonucleotide
  Target: ATXN1; (-) strand; PAM type: YTN; PAM sequence: CTA
agattccatcagatgttatg

SEQ ID NO: 206725 - DNA, 20 bp, Artificial Sequence
  Description of Artificial Sequence: Synthetic oligonucleotide
  Target: ATXN1; (-) strand; PAM type: YTN; PAM sequence: TTA
ctaagattccatcagatgtt

SEQ ID NO: 206726 - DNA, 20 bp, Artificial Sequence
  Description of Artificial Sequence: Synthetic oligonucleotide
  Target: ATXN1; (-) strand; PAM type: YTN; PAM sequence: TTA
tattactaagattccatcag

SEQ ID NO: 206727 - DNA, 20 bp, Artificial Sequence
  Description of Artificial Sequence: Synthetic oligonucleotide
  Target: ATXN1; (-) strand; PAM type: YTN; PAM sequence: CTT
atattactaagattccatca

SEQ ID NO: 206728 - DNA, 20 bp, Artificial Sequence
  Description of Artificial Sequence: Synthetic oligonucleotide
  Target: ATXN1; (-) strand; PAM type: YTN; PAM sequence: TTG
ccttatattactaagattcc

SEQ ID NO: 206729 - DNA, 20 bp, Artificial Sequence
  Description of Artificial Sequence: Synthetic oligonucleotide
  Target: ATXN1; (-) strand; PAM type: YTN; PAM sequence: TTT
gccttatattactaagattc

SEQ ID NO: 206730 - DNA, 20 bp, Artificial Sequence
  Description of Artificial Sequence: Synthetic oligonucleotide
  Target: ATXN1; (-) strand; PAM type: YTN; PAM sequence: TTT
tgccttatattactaagatt

SEQ ID NO: 206731 - DNA, 20 bp, Artificial Sequence
  Description of Artificial Sequence: Synthetic oligonucleotide
  Target: ATXN1; (-) strand; PAM type: YTN; PAM sequence: TTG
aaggaccagcataatgaaca

SEQ ID NO: 206732 - DNA, 20 bp, Artificial Sequence
  Description of Artificial Sequence: Synthetic oligonucleotide
  Target: ATXN1; (-) strand; PAM type: YTN; PAM sequence: CTG
attgaaggaccagcataatg

SEQ ID NO: 206733 - DNA, 20 bp, Artificial Sequence
  Description of Artificial Sequence: Synthetic oligonucleotide
  Target: ATXN1; (-) strand; PAM type: YTN; PAM sequence: TTG
aatgaatgaggacatccctg

SEQ ID NO: 206734 - DNA, 20 bp, Artificial Sequence
  Description of Artificial Sequence: Synthetic oligonucleotide
  Target: ATXN1; (-) strand; PAM type: YTN; PAM sequence: CTT
gaatgaatgaggacatccct

SEQ ID NO: 206735 - DNA, 20 bp, Artificial Sequence
  Description of Artificial Sequence: Synthetic oligonucleotide
  Target: ATXN1; (-) strand; PAM type: YTN; PAM sequence: TTA
aaggaagagcaatgcttgaa

SEQ ID NO: 206736 - DNA, 20 bp, Artificial Sequence
  Description of Artificial Sequence: Synthetic oligonucleotide
  Target: ATXN1; (-) strand; PAM type: YTN; PAM sequence: CTT
aaaggaagagcaatgcttga

SEQ ID NO: 206737 - DNA, 20 bp, Artificial Sequence
  Description of Artificial Sequence: Synthetic oligonucleotide
  Target: ATXN1; (-) strand; PAM type: YTN; PAM sequence: CTG
aatcttaaaggaagagcaat

SEQ ID NO: 206738 - DNA, 20 bp, Artificial Sequence
  Description of Artificial Sequence: Synthetic oligonucleotide
  Target: ATXN1; (-) strand; PAM type: YTN; PAM sequence: TTA
cacggcagggaaaatacaat

SEQ ID NO: 206739 - DNA, 20 bp, Artificial Sequence
  Description of Artificial Sequence: Synthetic oligonucleotide
  Target: ATXN1; (-) strand; PAM type: YTN; PAM sequence: CTA
gaaagggagacagatcatta

SEQ ID NO: 206740 - DNA, 20 bp, Artificial Sequence
  Description of Artificial Sequence: Synthetic oligonucleotide
  Target: ATXN1; (-) strand; PAM type: YTN; PAM sequence: CTC
atagtctagaaagggagaca

SEQ ID NO: 206741 - DNA, 20 bp, Artificial Sequence
  Description of Artificial Sequence: Synthetic oligonucleotide
  Target: ATXN1; (-) strand; PAM type: YTN; PAM sequence: CTA
aggagctcatagtctagaaa

SEQ ID NO: 206742 - DNA, 20 bp, Artificial Sequence
  Description of Artificial Sequence: Synthetic oligonucleotide
  Target: ATXN1; (-) strand; PAM type: YTN; PAM sequence: CTG
gggcccctaaggagctcata

SEQ ID NO: 206743 - DNA, 20 bp, Artificial Sequence
  Description of Artificial Sequence: Synthetic oligonucleotide
  Target: ATXN1; (-) strand; PAM type: YTN; PAM sequence: CTC
gctggggcccctaaggagct

SEQ ID NO: 206744 - DNA, 20 bp, Artificial Sequence
  Description of Artificial Sequence: Synthetic oligonucleotide
  Target: ATXN1; (-) strand; PAM type: YTN; PAM sequence: TTA
tgaaaaatacagagacctcg

SEQ ID NO: 206745 - DNA, 20 bp, Artificial Sequence
  Description of Artificial Sequence: Synthetic oligonucleotide
  Target: ATXN1; (-) strand; PAM type: YTN; PAM sequence: TTG
ttatgaaaaatacagagacc

SEQ ID NO: 206746 - DNA, 20 bp, Artificial Sequence
  Description of Artificial Sequence: Synthetic oligonucleotide
  Target: ATXN1; (-) strand; PAM type: YTN; PAM sequence: TTT
gttatgaaaaatacagagac

SEQ ID NO: 206747 - DNA, 20 bp, Artificial Sequence
  Description of Artificial Sequence: Synthetic oligonucleotide
  Target: ATXN1; (-) strand; PAM type: YTN; PAM sequence: TTG
tgcagtttgttatgaaaaat

SEQ ID NO: 206748 - DNA, 20 bp, Artificial Sequence
  Description of Artificial Sequence: Synthetic oligonucleotide
  Target: ATXN1; (-) strand; PAM type: YTN; PAM sequence: CTG
tgcaaagaattgtgcagttt

SEQ ID NO: 206749 - DNA, 20 bp, Artificial Sequence
  Description of Artificial Sequence: Synthetic oligonucleotide
  Target: ATXN1; (-) strand; PAM type: YTN; PAM sequence: TTC
tgtgcaaagaattgtgcagt

SEQ ID NO: 206750 - DNA, 20 bp, Artificial Sequence
  Description of Artificial Sequence: Synthetic oligonucleotide
  Target: ATXN1; (-) strand; PAM type: YTN; PAM sequence: CTG
agagtatattctgtgcaaag

SEQ ID NO: 206751 - DNA, 20 bp, Artificial Sequence
  Description of Artificial Sequence: Synthetic oligonucleotide
  Target: ATXN1; (-) strand; PAM type: YTN; PAM sequence: TTA
ctgagagtatattctgtgca

SEQ ID NO: 206752 - DNA, 20 bp, Artificial Sequence
  Description of Artificial Sequence: Synthetic oligonucleotide
  Target: ATXN1; (-) strand; PAM type: YTN; PAM sequence: TTT
actgagagtatattctgtgc

SEQ ID NO: 206753 - DNA, 20 bp, Artificial Sequence
  Description of Artificial Sequence: Synthetic oligonucleotide
  Target: ATXN1; (-) strand; PAM type: YTN; PAM sequence: TTC
acccacacatcaaaccagtg

SEQ ID NO: 206754 - DNA, 20 bp, Artificial Sequence
  Description of Artificial Sequence: Synthetic oligonucleotide
  Target: ATXN1; (-) strand; PAM type: YTN; PAM sequence: TTC
accatagtcataagagtatc

SEQ ID NO: 206755 - DNA, 20 bp, Artificial Sequence
  Description of Artificial Sequence: Synthetic oligonucleotide
  Target: ATXN1; (-) strand; PAM type: YTN; PAM sequence: TTT
caccatagtcataagagtat

SEQ ID NO: 206756 - DNA, 20 bp, Artificial Sequence
  Description of Artificial Sequence: Synthetic oligonucleotide
  Target: ATXN1; (-) strand; PAM type: YTN; PAM sequence: TTT
tcaccatagtcataagagta

SEQ ID NO: 206757 - DNA, 20 bp, Artificial Sequence
  Description of Artificial Sequence: Synthetic oligonucleotide
  Target: ATXN1; (-) strand; PAM type: YTN; PAM sequence: CTT
ttcaccatagtcataagagt

SEQ ID NO: 206758 - DNA, 20 bp, Artificial Sequence
  Description of Artificial Sequence: Synthetic oligonucleotide
  Target: ATXN1; (-) strand; PAM type: YTN; PAM sequence: TTA
gtggccttttcaccatagtc

SEQ ID NO: 206759 - DNA, 20 bp, Artificial Sequence
  Description of Artificial Sequence: Synthetic oligonucleotide
  Target: ATXN1; (-) strand; PAM type: YTN; PAM sequence: TTG
aaatcacaattagtggcctt

SEQ ID NO: 206760 - DNA, 20 bp, Artificial Sequence
  Description of Artificial Sequence: Synthetic oligonucleotide
  Target: ATXN1; (-) strand; PAM type: YTN; PAM sequence: TTA
agttgaaatcacaattagtg

SEQ ID NO: 206761 - DNA, 20 bp, Artificial Sequence
  Description of Artificial Sequence: Synthetic oligonucleotide
  Target: ATXN1; (-) strand; PAM type: YTN; PAM sequence: TTT
aagttgaaatcacaattagt

SEQ ID NO: 206762 - DNA, 20 bp, Artificial Sequence
  Description of Artificial Sequence: Synthetic oligonucleotide
  Target: ATXN1; (-) strand; PAM type: YTN; PAM sequence: CTT
taagttgaaatcacaattag

SEQ ID NO: 206763 - DNA, 20 bp, Artificial Sequence
  Description of Artificial Sequence: Synthetic oligonucleotide
  Target: ATXN1; (-) strand; PAM type: YTN; PAM sequence: TTA
acctttaagttgaaatcaca

SEQ ID NO: 206764 - DNA, 20 bp, Artificial Sequence
  Description of Artificial Sequence: Synthetic oligonucleotide
  Target: ATXN1; (-) strand; PAM type: YTN; PAM sequence: TTT
aacctttaagttgaaatcac

SEQ ID NO: 206765 - DNA, 20 bp, Artificial Sequence
  Description of Artificial Sequence: Synthetic oligonucleotide
  Target: ATXN1; (-) strand; PAM type: YTN; PAM sequence: CTT
taacctttaagttgaaatca

SEQ ID NO: 206766 - DNA, 20 bp, Artificial Sequence
  Description of Artificial Sequence: Synthetic oligonucleotide
  Target: ATXN1; (-) strand; PAM type: YTN; PAM sequence: TTG
gctttaacctttaagttgaa

SEQ ID NO: 206767 - DNA, 20 bp, Artificial Sequence
  Description of Artificial Sequence: Synthetic oligonucleotide
  Target: ATXN1; (-) strand; PAM type: YTN; PAM sequence: TTT
ggctttaacctttaagttga

SEQ ID NO: 206768 - DNA, 20 bp, Artificial Sequence
  Description of Artificial Sequence: Synthetic oligonucleotide
  Target: ATXN1; (-) strand; PAM type: YTN; PAM sequence: TTT
tggctttaacctttaagttg

SEQ ID NO: 206769 - DNA, 20 bp, Artificial Sequence
  Description of Artificial Sequence: Synthetic oligonucleotide
  Target: ATXN1; (-) strand; PAM type: YTN; PAM sequence: TTT
ttggctttaacctttaagtt

SEQ ID NO: 206770 - DNA, 20 bp, Artificial Sequence
  Description of Artificial Sequence: Synthetic oligonucleotide
  Target: ATXN1; (-) strand; PAM type: YTN; PAM sequence: TTT
tttggctttaacctttaagt

SEQ ID NO: 206771 - DNA, 20 bp, Artificial Sequence
  Description of Artificial Sequence: Synthetic oligonucleotide
  Target: ATXN1; (-) strand; PAM type: YTN; PAM sequence: TTT
ttttggctttaacctttaag

SEQ ID NO: 206772 - DNA, 20 bp, Artificial Sequence
  Description of Artificial Sequence: Synthetic oligonucleotide
  Target: ATXN1; (-) strand; PAM type: YTN; PAM sequence: TTT
tttttggctttaacctttaa

SEQ ID NO: 206773 - DNA, 20 bp, Artificial Sequence
  Description of Artificial Sequence: Synthetic oligonucleotide
  Target: ATXN1; (-) strand; PAM type: YTN; PAM sequence: CTA
aaaaatggattttttttggc

SEQ ID NO: 206774 - DNA, 20 bp, Artificial Sequence
  Description of Artificial Sequence: Synthetic oligonucleotide
  Target: ATXN1; (-) strand; PAM type: YTN; PAM sequence: TTC
actaaaaaatggattttttt

SEQ ID NO: 206775 - DNA, 20 bp, Artificial Sequence
  Description of Artificial Sequence: Synthetic oligonucleotide
  Target: ATXN1; (-) strand; PAM type: YTN; PAM sequence: TTT
cactaaaaaatggatttttt

SEQ ID NO: 206776 - DNA, 20 bp, Artificial Sequence
  Description of Artificial Sequence: Synthetic oligonucleotide
  Target: ATXN1; (-) strand; PAM type: YTN; PAM sequence: TTC
atttcactaaaaaatggatt

SEQ ID NO: 206777 - DNA, 20 bp, Artificial Sequence
  Description of Artificial Sequence: Synthetic oligonucleotide
  Target: ATXN1; (-) strand; PAM type: YTN; PAM sequence: TTT
catttcactaaaaaatggat

SEQ ID NO: 206778 - DNA, 20 bp, Artificial Sequence
  Description of Artificial Sequence: Synthetic oligonucleotide
  Target: ATXN1; (-) strand; PAM type: YTN; PAM sequence: CTA
agagtttcatttcactaaaa

SEQ ID NO: 206779 - DNA, 20 bp, Artificial Sequence
  Description of Artificial Sequence: Synthetic oligonucleotide
  Target: ATXN1; (-) strand; PAM type: YTN; PAM sequence: CTG
gaagtgaaaacgctaagagt

SEQ ID NO: 206780 - DNA, 20 bp, Artificial Sequence
  Description of Artificial Sequence: Synthetic oligonucleotide
  Target: ATXN1; (-) strand; PAM type: YTN; PAM sequence: CTG
atgcatctggaagtgaaaac

SEQ ID NO: 206781 - DNA, 20 bp, Artificial Sequence
  Description of Artificial Sequence: Synthetic oligonucleotide
  Target: ATXN1; (-) strand; PAM type: YTN; PAM sequence: TTA
tgtaatgctgatgcatctgg

SEQ ID NO: 206782 - DNA, 20 bp, Artificial Sequence
  Description of Artificial Sequence: Synthetic oligonucleotide
  Target: ATXN1; (-) strand; PAM type: YTN; PAM sequence: TTT
atgtaatgctgatgcatctg

SEQ ID NO: 206783 - DNA, 20 bp, Artificial Sequence
  Description of Artificial Sequence: Synthetic oligonucleotide
  Target: ATXN1; (-) strand; PAM type: YTN; PAM sequence: TTT
tatgtaatgctgatgcatct

SEQ ID NO: 206784 - DNA, 20 bp, Artificial Sequence
  Description of Artificial Sequence: Synthetic oligonucleotide
  Target: ATXN1; (-) strand; PAM type: YTN; PAM sequence: CTT
ttatgtaatgctgatgcatc

SEQ ID NO: 206785 - DNA, 20 bp, Artificial Sequence
  Description of Artificial Sequence: Synthetic oligonucleotide
  Target: ATXN1; (-) strand; PAM type: YTN; PAM sequence: TTC
aacatcttttatgtaatgct

SEQ ID NO: 206786 - DNA, 20 bp, Artificial Sequence
  Description of Artificial Sequence: Synthetic oligonucleotide
  Target: ATXN1; (-) strand; PAM type: YTN; PAM sequence: TTT
caacatcttttatgtaatgc

SEQ ID NO: 206787 - DNA, 20 bp, Artificial Sequence
  Description of Artificial Sequence: Synthetic oligonucleotide
  Target: ATXN1; (-) strand; PAM type: YTN; PAM sequence: TTA
aaatagtttcaacatctttt

SEQ ID NO: 206788 - DNA, 20 bp, Artificial Sequence
  Description of Artificial Sequence: Synthetic oligonucleotide
  Target: ATXN1; (-) strand; PAM type: YTN; PAM sequence: TTT
aaaatagtttcaacatcttt

SEQ ID NO: 206789 - DNA, 20 bp, Artificial Sequence
  Description of Artificial Sequence: Synthetic oligonucleotide
  Target: ATXN1; (-) strand; PAM type: YTN; PAM sequence: TTT
taaaatagtttcaacatctt

SEQ ID NO: 206790 - DNA, 20 bp, Artificial Sequence
  Description of Artificial Sequence: Synthetic oligonucleotide
  Target: ATXN1; (-) strand; PAM type: YTN; PAM sequence: TTT
ttaaaatagtttcaacatct

SEQ ID NO: 206791 - DNA, 20 bp, Artificial Sequence
  Description of Artificial Sequence: Synthetic oligonucleotide
  Target: ATXN1; (-) strand; PAM type: YTN; PAM sequence: TTT
tttaaaatagtttcaacatc

SEQ ID NO: 206792 - DNA, 20 bp, Artificial Sequence
  Description of Artificial Sequence: Synthetic oligonucleotide
  Target: ATXN1; (-) strand; PAM type: YTN; PAM sequence: CTA
ttttttaaaatagtttcaac

SEQ ID NO: 206793 - DNA, 20 bp, Artificial Sequence
  Description of Artificial Sequence: Synthetic oligonucleotide
  Target: ATXN1; (-) strand; PAM type: YTN; PAM sequence: CTC
agacaggaaaatgcgcagca

SEQ ID NO: 206794 - DNA, 20 bp, Artificial Sequence
  Description of Artificial Sequence: Synthetic oligonucleotide
  Target: ATXN1; (-) strand; PAM type: YTN; PAM sequence: TTC
tcagacaggaaaatgcgcag

SEQ ID NO: 206795 - DNA, 20 bp, Artificial Sequence
  Description of Artificial Sequence: Synthetic oligonucleotide
  Target: ATXN1; (-) strand; PAM type: YTN; PAM sequence: CTA
attctcagacaggaaaatgc

SEQ ID NO: 206796 - DNA, 20 bp, Artificial Sequence
  Description of Artificial Sequence: Synthetic oligonucleotide
  Target: ATXN1; (-) strand; PAM type: YTN; PAM sequence: TTC
agtctaattctcagacagga

SEQ ID NO: 206797 - DNA, 20 bp, Artificial Sequence
  Description of Artificial Sequence: Synthetic oligonucleotide
  Target: ATXN1; (-) strand; PAM type: YTN; PAM sequence: TTT
cagtctaattctcagacagg

SEQ ID NO: 206798 - DNA, 20 bp, Artificial Sequence
  Description of Artificial Sequence: Synthetic oligonucleotide
  Target: ATXN1; (-) strand; PAM type: YTN; PAM sequence: TTT
tcagtctaattctcagacag

SEQ ID NO: 206799 - DNA, 20 bp, Artificial Sequence
  Description of Artificial Sequence: Synthetic oligonucleotide
  Target: ATXN1; (-) strand; PAM type: YTN; PAM sequence: TTG
gtattttcagtctaattctc

SEQ ID NO: 206800 - DNA, 20 bp, Artificial Sequence
  Description of Artificial Sequence: Synthetic oligonucleotide
  Target: ATXN1; (-) strand; PAM type: YTN; PAM sequence: TTT
ggtattttcagtctaattct

SEQ ID NO: 206801 - DNA, 20 bp, Artificial Sequence
  Description of Artificial Sequence: Synthetic oligonucleotide
  Target: ATXN1; (-) strand; PAM type: YTN; PAM sequence: CTG
gggaatttggtattttcagt

SEQ ID NO: 206802 - DNA, 20 bp, Artificial Sequence
  Description of Artificial Sequence: Synthetic oligonucleotide
  Target: ATXN1; (-) strand; PAM type: YTN; PAM sequence: TTA
gaacacccaggggcccctgg

SEQ ID NO: 206803 - DNA, 20 bp, Artificial Sequence
  Description of Artificial Sequence: Synthetic oligonucleotide
  Target: ATXN1; (-) strand; PAM type: YTN; PAM sequence: TTT
agaacacccaggggcccctg

SEQ ID NO: 206804 - DNA, 20 bp, Artificial Sequence
  Description of Artificial Sequence: Synthetic oligonucleotide
  Target: ATXN1; (-) strand; PAM type: YTN; PAM sequence: CTT
tagaacacccaggggcccct

SEQ ID NO: 206805 - DNA, 20 bp, Artificial Sequence
  Description of Artificial Sequence: Synthetic oligonucleotide
  Target: ATXN1; (-) strand; PAM type: YTN; PAM sequence: TTG
tctttagaacacccaggggc

SEQ ID NO: 206806 - DNA, 20 bp, Artificial Sequence
  Description of Artificial Sequence: Synthetic oligonucleotide
  Target: ATXN1; (-) strand; PAM type: YTN; PAM sequence: TTT
gtctttagaacacccagggg

SEQ ID NO: 206807 - DNA, 20 bp, Artificial Sequence
  Description of Artificial Sequence: Synthetic oligonucleotide
  Target: ATXN1; (-) strand; PAM type: YTN; PAM sequence: CTG
aacatttgtctttagaacac

SEQ ID NO: 206808 - DNA, 20 bp, Artificial Sequence
  Description of Artificial Sequence: Synthetic oligonucleotide
  Target: ATXN1; (-) strand; PAM type: YTN; PAM sequence: CTA
actgaacatttgtctttaga

SEQ ID NO: 206809 - DNA, 20 bp, Artificial Sequence
  Description of Artificial Sequence: Synthetic oligonucleotide
  Target: ATXN1; (-) strand; PAM type: YTN; PAM sequence: TTA
aatgagtgcatggaatcaat

SEQ ID NO: 206810 - DNA, 20 bp, Artificial Sequence
  Description of Artificial Sequence: Synthetic oligonucleotide
  Target: ATXN1; (-) strand; PAM type: YTN; PAM sequence: TTC
cattaaatgagtgcatggaa

SEQ ID NO: 206811 - DNA, 20 bp, Artificial Sequence
  Description of Artificial Sequence: Synthetic oligonucleotide
  Target: ATXN1; (-) strand; PAM type: YTN; PAM sequence: TTT
ccattaaatgagtgcatgga

SEQ ID NO: 206812 - DNA, 20 bp, Artificial Sequence
  Description of Artificial Sequence: Synthetic oligonucleotide
  Target: ATXN1; (-) strand; PAM type: YTN; PAM sequence: CTC
cggatttccattaaatgagt

SEQ ID NO: 206813 - DNA, 20 bp, Artificial Sequence
  Description of Artificial Sequence: Synthetic oligonucleotide
  Target: ATXN1; (-) strand; PAM type: YTN; PAM sequence: TTA
ctccggatttccattaaatg

SEQ ID NO: 206814 - DNA, 20 bp, Artificial Sequence
  Description of Artificial Sequence: Synthetic oligonucleotide
  Target: ATXN1; (-) strand; PAM type: YTN; PAM sequence: CTT
actccggatttccattaaat

SEQ ID NO: 206815 - DNA, 20 bp, Artificial Sequence
  Description of Artificial Sequence: Synthetic oligonucleotide
  Target: ATXN1; (-) strand; PAM type: YTN; PAM sequence: TTG
agtcttactccggatttcca

SEQ ID NO: 206816 - DNA, 20 bp, Artificial Sequence
  Description of Artificial Sequence: Synthetic oligonucleotide
  Target: ATXN1; (-) strand; PAM type: YTN; PAM sequence: CTG
gtggtggggaggttgagtct

SEQ ID NO: 206817 - DNA, 20 bp, Artificial Sequence
  Description of Artificial Sequence: Synthetic oligonucleotide
  Target: ATXN1; (-) strand; PAM type: YTN; PAM sequence: CTG
agcagaataatgagtgacag

SEQ ID NO: 206818 - DNA, 20 bp, Artificial Sequence
  Description of Artificial Sequence: Synthetic oligonucleotide
  Target: ATXN1; (-) strand; PAM type: YTN; PAM sequence: CTG
aaacagctgagcagaataat

SEQ ID NO: 206819 - DNA, 20 bp, Artificial Sequence
  Description of Artificial Sequence: Synthetic oligonucleotide
  Target: ATXN1; (-) strand; PAM type: YTN; PAM sequence: TTC
tgaaacagctgagcagaata

SEQ ID NO: 206820 - DNA, 20 bp, Artificial Sequence
  Description of Artificial Sequence: Synthetic oligonucleotide
  Target: ATXN1; (-) strand; PAM type: YTN; PAM sequence: TTA
ttctgaaacagctgagcaga

SEQ ID NO: 206821 - DNA, 20 bp, Artificial Sequence
  Description of Artificial Sequence: Synthetic oligonucleotide
  Target: ATXN1; (-) strand; PAM type: YTN; PAM sequence: CTT
attctgaaacagctgagcag

SEQ ID NO: 206822 - DNA, 20 bp, Artificial Sequence
  Description of Artificial Sequence: Synthetic oligonucleotide
  Target: ATXN1; (-) strand; PAM type: YTN; PAM sequence: CTC
ccgggagtcgtcgcttattc

SEQ ID NO: 206823 - DNA, 20 bp, Artificial Sequence
  Description of Artificial Sequence: Synthetic oligonucleotide
  Target: ATXN1; (-) strand; PAM type: YTN; PAM sequence: CTC
tcccgggagtcgtcgcttat

SEQ ID NO: 206824 - DNA, 20 bp, Artificial Sequence
  Description of Artificial Sequence: Synthetic oligonucleotide
  Target: ATXN1; (-) strand; PAM type: YTN; PAM sequence: CTG
ggaggggggcagagctctcc

SEQ ID NO: 206825 - DNA, 20 bp, Artificial Sequence
  Description of Artificial Sequence: Synthetic oligonucleotide
  Target: ATXN1; (-) strand; PAM type: YTN; PAM sequence: CTG
gccagtactgggaggggggc

SEQ ID NO: 206826 - DNA, 20 bp, Artificial Sequence
  Description of Artificial Sequence: Synthetic oligonucleotide
  Target: ATXN1; (-) strand; PAM type: YTN; PAM sequence: CTG
aagtgctggccagtactggg

SEQ ID NO: 206827 - DNA, 20 bp, Artificial Sequence
  Description of Artificial Sequence: Synthetic oligonucleotide
  Target: ATXN1; (-) strand; PAM type: YTN; PAM sequence: TTC
atcatcactgaagtgctggc

SEQ ID NO: 206828 - DNA, 20 bp, Artificial Sequence
  Description of Artificial Sequence: Synthetic oligonucleotide
  Target: ATXN1; (-) strand; PAM type: YTN; PAM sequence: CTC
ggattcatcatcactgaagt

SEQ ID NO: 206829 - DNA, 20 bp, Artificial Sequence
  Description of Artificial Sequence: Synthetic oligonucleotide
  Target: ATXN1; (-) strand; PAM type: YTN; PAM sequence: CTG
ctcggattcatcatcactga

SEQ ID NO: 206830 - DNA, 20 bp, Artificial Sequence
  Description of Artificial Sequence: Synthetic oligonucleotide
  Target: ATXN1; (-) strand; PAM type: YTN; PAM sequence: CTG
ctgctcggattcatcatcac

SEQ ID NO: 206831 - DNA, 20 bp, Artificial Sequence
  Description of Artificial Sequence: Synthetic oligonucleotide
  Target: ATXN1; (-) strand; PAM type: YTN; PAM sequence: CTC
tgctgctcggattcatcatc

SEQ ID NO: 206832 - DNA, 20 bp, Artificial Sequence
  Description of Artificial Sequence: Synthetic oligonucleotide
  Target: ATXN1; (-) strand; PAM type: YTN; PAM sequence: TTC
tctgctgctcggattcatca

SEQ ID NO: 206833 - DNA, 20 bp, Artificial Sequence
  Description of Artificial Sequence: Synthetic oligonucleotide
  Target: ATXN1; (-) strand; PAM type: YTN; PAM sequence: CTG
aaattctctgctgctcggat

SEQ ID NO: 206834 - DNA, 20 bp, Artificial Sequence
  Description of Artificial Sequence: Synthetic oligonucleotide
  Target: ATXN1; (-) strand; PAM type: YTN; PAM sequence: TTG
agtactgaaattctctgctg

SEQ ID NO: 206835 - DNA, 20 bp, Artificial Sequence
  Description of Artificial Sequence: Synthetic oligonucleotide
  Target: ATXN1; (-) strand; PAM type: YTN; PAM sequence: TTT
gagtactgaaattctctgct

SEQ ID NO: 206836 - DNA, 20 bp, Artificial Sequence
  Description of Artificial Sequence: Synthetic oligonucleotide
  Target: ATXN1; (-) strand; PAM type: YTN; PAM sequence: CTT
tgagtactgaaattctctgc

SEQ ID NO: 206837 - DNA, 20 bp, Artificial Sequence
  Description of Artificial Sequence: Synthetic oligonucleotide
  Target: ATXN1; (-) strand; PAM type: YTN; PAM sequence: CTG
ctttgagtactgaaattctc

SEQ ID NO: 206838 - DNA, 20 bp, Artificial Sequence
  Description of Artificial Sequence: Synthetic oligonucleotide
  Target: ATXN1; (-) strand; PAM type: YTN; PAM sequence: CTG
ctgctttgagtactgaaatt

SEQ ID NO: 206839 - DNA, 20 bp, Artificial Sequence
  Description of Artificial Sequence: Synthetic oligonucleotide
  Target: ATXN1; (-) strand; PAM type: YTN; PAM sequence: TTC
tgctgctttgagtactgaaa

SEQ ID NO: 206840 - DNA, 20 bp, Artificial Sequence
  Description of Artificial Sequence: Synthetic oligonucleotide
  Target: ATXN1; (-) strand; PAM type: YTN; PAM sequence: CTG
atgttctgctgctttgagta

SEQ ID NO: 206841 - DNA, 20 bp, Artificial Sequence
  Description of Artificial Sequence: Synthetic oligonucleotide
  Target: ATXN1; (-) strand; PAM type: YTN; PAM sequence: TTG
ggactgatgttctgctgctt

SEQ ID NO: 206842 - DNA, 20 bp, Artificial Sequence
  Description of Artificial Sequence: Synthetic oligonucleotide
  Target: ATXN1; (-) strand; PAM type: YTN; PAM sequence: TTG
aaaaatcaaaggtggatatg

SEQ ID NO: 206843 - DNA, 20 bp, Artificial Sequence
  Description of Artificial Sequence: Synthetic oligonucleotide
  Target: ATXN1; (-) strand; PAM type: YTN; PAM sequence: CTT
gaaaaatcaaaggtggatat

SEQ ID NO: 206844 - DNA, 20 bp, Artificial Sequence
  Description of Artificial Sequence: Synthetic oligonucleotide
  Target: ATXN1; (-) strand; PAM type: YTN; PAM sequence: TTC
gatcttgaaaaatcaaaggt

SEQ ID NO: 206845 - DNA, 20 bp, Artificial Sequence
  Description of Artificial Sequence: Synthetic oligonucleotide
  Target: ATXN1; (-) strand; PAM type: YTN; PAM sequence: TTC
aaaggttcgatcttgaaaaa

SEQ ID NO: 206846 - DNA, 20 bp, Artificial Sequence
  Description of Artificial Sequence: Synthetic oligonucleotide
  Target: ATXN1; (-) strand; PAM type: YTN; PAM sequence: TTT
caaaggttcgatcttgaaaa

SEQ ID NO: 206847 - DNA, 20 bp, Artificial Sequence
  Description of Artificial Sequence: Synthetic oligonucleotide
  Target: ATXN1; (-) strand; PAM type: YTN; PAM sequence: TTT
tcaaaggttcgatcttgaaa

SEQ ID NO: 206848 - DNA, 20 bp, Artificial Sequence
  Description of Artificial Sequence: Synthetic oligonucleotide
  Target: ATXN1; (-) strand; PAM type: YTN; PAM sequence: CTT
ttcaaaggttcgatcttgaa

SEQ ID NO: 206849 - DNA, 20 bp, Artificial Sequence
  Description of Artificial Sequence: Synthetic oligonucleotide
  Target: ATXN1; (-) strand; PAM type: YTN; PAM sequence: CTC
accttttcaaaggttcgatc

SEQ ID NO: 206850 - DNA, 20 bp, Artificial Sequence
  Description of Artificial Sequence: Synthetic oligonucleotide
  Target: ATXN1; (-) strand; PAM type: YTN; PAM sequence: TTA
ggcagccaggccctcacctt

SEQ ID NO: 206851 - DNA, 20 bp, Artificial Sequence
  Description of Artificial Sequence: Synthetic oligonucleotide
  Target: ATXN1; (-) strand; PAM type: YTN; PAM sequence: CTG
agtgaggcaggagtccggca

SEQ ID NO: 206852 - DNA, 20 bp, Artificial Sequence
  Description of Artificial Sequence: Synthetic oligonucleotide
  Target: ATXN1; (-) strand; PAM type: YTN; PAM sequence: TTC
tgagtgaggcaggagtccgg

SEQ ID NO: 206853 - DNA, 20 bp, Artificial Sequence
  Description of Artificial Sequence: Synthetic oligonucleotide
  Target: ATXN1; (-) strand; PAM type: YTN; PAM sequence: CTT
ctgagtgaggcaggagtccg

SEQ ID NO: 206854 - DNA, 20 bp, Artificial Sequence
  Description of Artificial Sequence: Synthetic oligonucleotide
  Target: ATXN1; (-) strand; PAM type: YTN; PAM sequence: CTG
agcaacacgtggtcttctga

SEQ ID NO: 206855 - DNA, 20 bp, Artificial Sequence
  Description of Artificial Sequence: Synthetic oligonucleotide
  Target: ATXN1; (-) strand; PAM type: YTN; PAM sequence: TTC
tgagcaacacgtggtcttct

SEQ ID NO: 206856 - DNA, 20 bp, Artificial Sequence
  Description of Artificial Sequence: Synthetic oligonucleotide
  Target: ATXN1; (-) strand; PAM type: YTN; PAM sequence: TTT
ctgagcaacacgtggtcttc

SEQ ID NO: 206857 - DNA, 20 bp, Artificial Sequence
  Description of Artificial Sequence: Synthetic oligonucleotide
  Target: ATXN1; (-) strand; PAM type: YTN; PAM sequence: TTT
tctgagcaacacgtggtctt

SEQ ID NO: 206858 - DNA, 20 bp, Artificial Sequence
  Description of Artificial Sequence: Synthetic oligonucleotide
  Target: ATXN1; (-) strand; PAM type: YTN; PAM sequence: CTT
ttctgagcaacacgtggtct

SEQ ID NO: 206859 - DNA, 20 bp, Artificial Sequence
  Description of Artificial Sequence: Synthetic oligonucleotide
  Target: ATXN1; (-) strand; PAM type: YTN; PAM sequence: TTC
ttttctgagcaacacgtggt

SEQ ID NO: 206860 - DNA, 20 bp, Artificial Sequence
  Description of Artificial Sequence: Synthetic oligonucleotide
  Target: ATXN1; (-) strand; PAM type: YTN; PAM sequence: TTT
cttttctgagcaacacgtgg

SEQ ID NO: 206861 - DNA, 20 bp, Artificial Sequence
  Description of Artificial Sequence: Synthetic oligonucleotide
  Target: ATXN1; (-) strand; PAM type: YTN; PAM sequence: CTT
tcttttctgagcaacacgtg

SEQ ID NO: 206862 - DNA, 20 bp, Artificial Sequence
  Description of Artificial Sequence: Synthetic oligonucleotide
  Target: ATXN1; (-) strand; PAM type: YTN; PAM sequence: TTG
gtgcccacctttcttttctg

SEQ ID NO: 206863 - DNA, 20 bp, Artificial Sequence
  Description of Artificial Sequence: Synthetic oligonucleotide
  Target: ATXN1; (-) strand; PAM type: YTN; PAM sequence: TTT
ggtgcccacctttcttttct

SEQ ID NO: 206864 - DNA, 20 bp, Artificial Sequence
  Description of Artificial Sequence: Synthetic oligonucleotide
  Target: ATXN1; (-) strand; PAM type: YTN; PAM sequence: TTT
tggtgcccacctttcttttc

SEQ ID NO: 206865 - DNA, 20 bp, Artificial Sequence
  Description of Artificial Sequence: Synthetic oligonucleotide
  Target: ATXN1; (-) strand; PAM type: YTN; PAM sequence: CTT
ttggtgcccacctttctttt

SEQ ID NO: 206866 - DNA, 20 bp, Artificial Sequence
  Description of Artificial Sequence: Synthetic oligonucleotide
  Target: ATXN1; (-) strand; PAM type: YTN; PAM sequence: TTC
ttttggtgcccacctttctt

SEQ ID NO: 206867 - DNA, 20 bp, Artificial Sequence
  Description of Artificial Sequence: Synthetic oligonucleotide
  Target: ATXN1; (-) strand; PAM type: YTN; PAM sequence: CTG
ttcttttggtgcccaccttt

SEQ ID NO: 206868 - DNA, 20 bp, Artificial Sequence
  Description of Artificial Sequence: Synthetic oligonucleotide
  Target: ATXN1; (-) strand; PAM type: YTN; PAM sequence: TTA
tgagaaacctgttcttttgg

SEQ ID NO: 206869 - DNA, 20 bp, Artificial Sequence
  Description of Artificial Sequence: Synthetic oligonucleotide
  Target: ATXN1; (-) strand; PAM type: YTN; PAM sequence: CTG
ggtaggatattatgagaaac

SEQ ID NO: 206870 - DNA, 20 bp, Artificial Sequence
  Description of Artificial Sequence: Synthetic oligonucleotide
  Target: ATXN1; (-) strand; PAM type: YTN; PAM sequence: CTG
tgggcctgggtaggatatta

SEQ ID NO: 206871 - DNA, 20 bp, Artificial Sequence
  Description of Artificial Sequence: Synthetic oligonucleotide
  Target: ATXN1; (-) strand; PAM type: YTN; PAM sequence: CTA
actgtgggcctgggtaggat

SEQ ID NO: 206872 - DNA, 20 bp, Artificial Sequence
  Description of Artificial Sequence: Synthetic oligonucleotide
  Target: ATXN1; (-) strand; PAM type: YTN; PAM sequence: CTA
atacgtctaactgtgggcct

SEQ ID NO: 206873 - DNA, 20 bp, Artificial Sequence
  Description of Artificial Sequence: Synthetic oligonucleotide
  Target: ATXN1; (-) strand; PAM type: YTN; PAM sequence: TTG
tcccaacagtgactaatacg

SEQ ID NO: 206874 - DNA, 20 bp, Artificial Sequence
  Description of Artificial Sequence: Synthetic oligonucleotide
  Target: ATXN1; (-) strand; PAM type: YTN; PAM sequence: TTC
attgtcccaacagtgactaa

SEQ ID NO: 206875 - DNA, 20 bp, Artificial Sequence
  Description of Artificial Sequence: Synthetic oligonucleotide
  Target: ATXN1; (-) strand; PAM type: YTN; PAM sequence: TTG
gaaaacccatattcattgtc

SEQ ID NO: 206876 - DNA, 20 bp, Artificial Sequence
  Description of Artificial Sequence: Synthetic oligonucleotide
  Target: ATXN1; (-) strand; PAM type: YTN; PAM sequence: CTT
ggaaaacccatattcattgt

SEQ ID NO: 206877 - DNA, 20 bp, Artificial Sequence
  Description of Artificial Sequence: Synthetic oligonucleotide
  Target: ATXN1; (-) strand; PAM type: YTN; PAM sequence: CTC
ttggaaaacccatattcatt

SEQ ID NO: 206878 - DNA, 20 bp, Artificial Sequence
  Description of Artificial Sequence: Synthetic oligonucleotide
  Target: ATXN1; (-) strand; PAM type: YTN; PAM sequence: TTG
atcacctcttggaaaaccca

SEQ ID NO: 206879 - DNA, 20 bp, Artificial Sequence
  Description of Artificial Sequence: Synthetic oligonucleotide
  Target: ATXN1; (-) strand; PAM type: YTN; PAM sequence: CTT
gatcacctcttggaaaaccc

SEQ ID NO: 206880 - DNA, 20 bp, Artificial Sequence
  Description of Artificial Sequence: Synthetic oligonucleotide
  Target: ATXN1; (-) strand; PAM type: YTN; PAM sequence: TTG
gggcgtggagaaaagaaaat

SEQ ID NO: 206881 - DNA, 20 bp, Artificial Sequence
  Description of Artificial Sequence: Synthetic oligonucleotide
  Target: ATXN1; (-) strand; PAM type: YTN; PAM sequence: CTT
ggggcgtggagaaaagaaaa

SEQ ID NO: 206882 - DNA, 20 bp, Artificial Sequence
  Description of Artificial Sequence: Synthetic oligonucleotide
  Target: ATXN1; (-) strand; PAM type: YTN; PAM sequence: CTA
gaaaatcttggggcgtggag

SEQ ID NO: 206883 - DNA, 20 bp, Artificial Sequence
  Description of Artificial Sequence: Synthetic oligonucleotide
  Target: ATXN1; (-) strand; PAM type: YTN; PAM sequence: CTA
ccaaaagcctagaaaatctt

SEQ ID NO: 206884 - DNA, 20 bp, Artificial Sequence
  Description of Artificial Sequence: Synthetic oligonucleotide
  Target: ATXN1; (-) strand; PAM type: YTN; PAM sequence: TTC
ctaccaaaagcctagaaaat

SEQ ID NO: 206885 - DNA, 20 bp, Artificial Sequence
  Description of Artificial Sequence: Synthetic oligonucleotide
  Target: ATXN1; (-) strand; PAM type: YTN; PAM sequence: CTT
cctaccaaaagcctagaaaa

SEQ ID NO: 206886 - DNA, 20 bp, Artificial Sequence
  Description of Artificial Sequence: Synthetic oligonucleotide
  Target: ATXN1; (-) strand; PAM type: YTN; PAM sequence: CTG
tatagtgcttcctaccaaaa

SEQ ID NO: 206887 - DNA, 20 bp, Artificial Sequence
  Description of Artificial Sequence: Synthetic oligonucleotide
  Target: ATXN1; (-) strand; PAM type: YTN; PAM sequence: TTC
tgtatagtgcttcctaccaa

SEQ ID NO: 206888 - DNA, 20 bp, Artificial Sequence
  Description of Artificial Sequence: Synthetic oligonucleotide
  Target: ATXN1; (-) strand; PAM type: YTN; PAM sequence: TTT
ctgtatagtgcttcctacca

SEQ ID NO: 206889 - DNA, 20 bp, Artificial Sequence
  Description of Artificial Sequence: Synthetic oligonucleotide
  Target: ATXN1; (-) strand; PAM type: YTN; PAM sequence: CTT
tctgtatagtgcttcctacc

SEQ ID NO: 206890 - DNA, 20 bp, Artificial Sequence
  Description of Artificial Sequence: Synthetic oligonucleotide
  Target: ATXN1; (-) strand; PAM type: YTN; PAM sequence: CTA
ggagacgtgggtgctttctg

SEQ ID NO: 206891 - DNA, 20 bp, Artificial Sequence
  Description of Artificial Sequence: Synthetic oligonucleotide
  Target: ATXN1; (-) strand; PAM type: YTN; PAM sequence: CTC
cagacacagaatcagctagg

SEQ ID NO: 206892 - DNA, 20 bp, Artificial Sequence
  Description of Artificial Sequence: Synthetic oligonucleotide
  Target: ATXN1; (-) strand; PAM type: YTN; PAM sequence: TTG
aagtcagcgagaccacgaac

SEQ ID NO: 206893 - DNA, 20 bp, Artificial Sequence
  Description of Artificial Sequence: Synthetic oligonucleotide
  Target: ATXN1; (-) strand; PAM type: YTN; PAM sequence: CTT
gaagtcagcgagaccacgaa

SEQ ID NO: 206894 - DNA, 20 bp, Artificial Sequence
  Description of Artificial Sequence: Synthetic oligonucleotide
  Target: ATXN1; (-) strand; PAM type: YTN; PAM sequence: TTC
ttgaagtcagcgagaccacg

SEQ ID NO: 206895 - DNA, 20 bp, Artificial Sequence
  Description of Artificial Sequence: Synthetic oligonucleotide
  Target: ATXN1; (-) strand; PAM type: YTN; PAM sequence: CTC
cattcttgaagtcagcgaga

SEQ ID NO: 206896 - DNA, 20 bp, Artificial Sequence
  Description of Artificial Sequence: Synthetic oligonucleotide
  Target: ATXN1; (-) strand; PAM type: YTN; PAM sequence: TTA
gcggctccattcttgaagtc

SEQ ID NO: 206897 - DNA, 20 bp, Artificial Sequence
  Description of Artificial Sequence: Synthetic oligonucleotide
  Target: ATXN1; (-) strand; PAM type: YTN; PAM sequence: CTG
taacagtcaccgcaaaggtt

SEQ ID NO: 206898 - DNA, 20 bp, Artificial Sequence
  Description of Artificial Sequence: Synthetic oligonucleotide
  Target: ATXN1; (-) strand; PAM type: YTN; PAM sequence: TTA
agagctgtaacagtcaccgc

SEQ ID NO: 206899 - DNA, 20 bp, Artificial Sequence
  Description of Artificial Sequence: Synthetic oligonucleotide
  Target: ATXN1; (-) strand; PAM type: YTN; PAM sequence: TTT
aagagctgtaacagtcaccg

SEQ ID NO: 206900 - DNA, 20 bp, Artificial Sequence
  Description of Artificial Sequence: Synthetic oligonucleotide
  Target: ATXN1; (-) strand; PAM type: YTN; PAM sequence: CTT
taagagctgtaacagtcacc

SEQ ID NO: 206901 - DNA, 20 bp, Artificial Sequence
  Description of Artificial Sequence: Synthetic oligonucleotide
  Target: ATXN1; (-) strand; PAM type: YTN; PAM sequence: CTG
tgccatctttaagagctgta

SEQ ID NO: 206902 - DNA, 20 bp, Artificial Sequence
  Description of Artificial Sequence: Synthetic oligonucleotide
  Target: ATXN1; (-) strand; PAM type: YTN; PAM sequence: TTG
ggtctgtgccatctttaaga

SEQ ID NO: 206903 - DNA, 20 bp, Artificial Sequence
  Description of Artificial Sequence: Synthetic oligonucleotide
  Target: ATXN1; (-) strand; PAM type: YTN; PAM sequence: TTT
gggtctgtgccatctttaag

SEQ ID NO: 206904 - DNA, 20 bp, Artificial Sequence
  Description of Artificial Sequence: Synthetic oligonucleotide
  Target: ATXN1; (-) strand; PAM type: YTN; PAM sequence: TTT
tgggtctgtgccatctttaa

SEQ ID NO: 206905 - DNA, 20 bp, Artificial Sequence
  Description of Artificial Sequence: Synthetic oligonucleotide
  Target: ATXN1; (-) strand; PAM type: YTN; PAM sequence: CTT
ttgggtctgtgccatcttta

SEQ ID NO: 206906 - DNA, 20 bp, Artificial Sequence
  Description of Artificial Sequence: Synthetic oligonucleotide
  Target: ATXN1; (-) strand; PAM type: YTN; PAM sequence: TTC
agtcttttgggtctgtgcca

SEQ ID NO: 206907 - DNA, 20 bp, Artificial Sequence
  Description of Artificial Sequence: Synthetic oligonucleotide
  Target: ATXN1; (-) strand; PAM type: YTN; PAM sequence: CTG
ttcagtcttttgggtctgtg

SEQ ID NO: 206908 - DNA, 20 bp, Artificial Sequence
  Description of Artificial Sequence: Synthetic oligonucleotide
  Target: ATXN1; (-) strand; PAM type: YTN; PAM sequence: CTG
ctgttcagtcttttgggtct

SEQ ID NO: 206909 - DNA, 20 bp, Artificial Sequence
  Description of Artificial Sequence: Synthetic oligonucleotide
  Target: ATXN1; (-) strand; PAM type: YTN; PAM sequence: TTG
ctgctgttcagtcttttggg

SEQ ID NO: 206910 - DNA, 20 bp, Artificial Sequence
  Description of Artificial Sequence: Synthetic oligonucleotide
  Target: ATXN1; (-) strand; PAM type: YTN; PAM sequence: CTT
gctgctgttcagtcttttgg

SEQ ID NO: 206911 - DNA, 20 bp, Artificial Sequence
  Description of Artificial Sequence: Synthetic oligonucleotide
  Target: ATXN1; (-) strand; PAM type: YTN; PAM sequence: TTA
tgataaatcttgctgctgtt

SEQ ID NO: 206912 - DNA, 20 bp, Artificial Sequence
  Description of Artificial Sequence: Synthetic oligonucleotide
  Target: ATXN1; (-) strand; PAM type: YTN; PAM sequence: TTT
atgataaatcttgctgctgt

SEQ ID NO: 206913 - DNA, 20 bp, Artificial Sequence
  Description of Artificial Sequence: Synthetic oligonucleotide
  Target: ATXN1; (-) strand; PAM type: YTN; PAM sequence: CTT
tatgataaatcttgctgctg

SEQ ID NO: 206914 - DNA, 20 bp, Artificial Sequence
  Description of Artificial Sequence: Synthetic oligonucleotide
  Target: ATXN1; (-) strand; PAM type: YTN; PAM sequence: CTC
tttatgataaatcttgctgc

SEQ ID NO: 206915 - DNA, 20 bp, Artificial Sequence
  Description of Artificial Sequence: Synthetic oligonucleotide
  Target: ATXN1; (-) strand; PAM type: YTN; PAM sequence: TTC
actctttatgataaatcttg

SEQ ID NO: 206916 - DNA, 20 bp, Artificial Sequence
  Description of Artificial Sequence: Synthetic oligonucleotide
  Target: ATXN1; (-) strand; PAM type: YTN; PAM sequence: TTT
cactctttatgataaatctt

SEQ ID NO: 206917 - DNA, 20 bp, Artificial Sequence
  Description of Artificial Sequence: Synthetic oligonucleotide
  Target: ATXN1; (-) strand; PAM type: YTN; PAM sequence: CTT
tcactctttatgataaatct

SEQ ID NO: 206918 - DNA, 20 bp, Artificial Sequence
  Description of Artificial Sequence: Synthetic oligonucleotide
  Target: ATXN1; (-) strand; PAM type: YTN; PAM sequence: TTC
tttcactctttatgataaat

SEQ ID NO: 206919 - DNA, 20 bp, Artificial Sequence
  Description of Artificial Sequence: Synthetic oligonucleotide
  Target: ATXN1; (-) strand; PAM type: YTN; PAM sequence: TTG
ttctttcactctttatgata

SEQ ID NO: 206920 - DNA, 20 bp, Artificial Sequence
  Description of Artificial Sequence: Synthetic oligonucleotide
  Target: ATXN1; (-) strand; PAM type: YTN; PAM sequence: TTT
gttctttcactctttatgat

SEQ ID NO: 206921 - DNA, 20 bp, Artificial Sequence
  Description of Artificial Sequence: Synthetic oligonucleotide
  Target: ATXN1; (-) strand; PAM type: YTN; PAM sequence: CTT
tgttctttcactctttatga

SEQ ID NO: 206922 - DNA, 20 bp, Artificial Sequence
  Description of Artificial Sequence: Synthetic oligonucleotide
  Target: ATXN1; (-) strand; PAM type: YTN; PAM sequence: CTG
tggaagctttgttctttcac

SEQ ID NO: 206923 - DNA, 20 bp, Artificial Sequence
  Description of Artificial Sequence: Synthetic oligonucleotide
  Target: ATXN1; (-) strand; PAM type: YTN; PAM sequence: TTC
cagctgtggaagctttgttc

SEQ ID NO: 206924 - DNA, 20 bp, Artificial Sequence
  Description of Artificial Sequence: Synthetic oligonucleotide
  Target: ATXN1; (-) strand; PAM type: YTN; PAM sequence: TTT
ccagctgtggaagctttgtt

SEQ ID NO: 206925 - DNA, 20 bp, Artificial Sequence
  Description of Artificial Sequence: Synthetic oligonucleotide
  Target: ATXN1; (-) strand; PAM type: YTN; PAM sequence: TTT
tccagctgtggaagctttgt

SEQ ID NO: 206926 - DNA, 20 bp, Artificial Sequence
  Description of Artificial Sequence: Synthetic oligonucleotide
  Target: ATXN1; (-) strand; PAM type: YTN; PAM sequence: CTT
ttccagctgtggaagctttg

SEQ ID NO: 206927 - DNA, 20 bp, Artificial Sequence
  Description of Artificial Sequence: Synthetic oligonucleotide
  Target: ATXN1; (-) strand; PAM type: YTN; PAM sequence: TTC
ttttccagctgtggaagctt

SEQ ID NO: 206928 - DNA, 20 bp, Artificial Sequence
  Description of Artificial Sequence: Synthetic oligonucleotide
  Target: ATXN1; (-) strand; PAM type: YTN; PAM sequence: CTC
agattcttttccagctgtgg

SEQ ID NO: 206929 - DNA, 20 bp, Artificial Sequence
  Description of Artificial Sequence: Synthetic oligonucleotide
  Target: ATXN1; (-) strand; PAM type: YTN; PAM sequence: CTG
ctcagattcttttccagctg

SEQ ID NO: 206930 - DNA, 20 bp, Artificial Sequence
  Description of Artificial Sequence: Synthetic oligonucleotide
  Target: ATXN1; (-) strand; PAM type: YTN; PAM sequence: CTG
ccccccccaaccccccaccc

SEQ ID NO: 206931 - DNA, 20 bp, Artificial Sequence
  Description of Artificial Sequence: Synthetic oligonucleotide
  Target: ATXN1; (-) strand; PAM type: YTN; PAM sequence: CTG
ataggacagaaacaggacat

SEQ ID NO: 206932 - DNA, 20 bp, Artificial Sequence
  Description of Artificial Sequence: Synthetic oligonucleotide
  Target: ATXN1; (-) strand; PAM type: YTN; PAM sequence: TTC
tgataggacagaaacaggac

SEQ ID NO: 206933 - DNA, 20 bp, Artificial Sequence
  Description of Artificial Sequence: Synthetic oligonucleotide
  Target: ATXN1; (-) strand; PAM type: YTN; PAM sequence: TTG
agaaaagggcgttctgatag

SEQ ID NO: 206934 - DNA, 20 bp, Artificial Sequence
  Description of Artificial Sequence: Synthetic oligonucleotide
  Target: ATXN1; (-) strand; PAM type: YTN; PAM sequence: CTA
aaagtaaccaatcatgggga

SEQ ID NO: 206935 - DNA, 20 bp, Artificial Sequence
  Description of Artificial Sequence: Synthetic oligonucleotide
  Target: ATXN1; (-) strand; PAM type: YTN; PAM sequence: TTC
taaaagtaaccaatcatggg

SEQ ID NO: 206936 - DNA, 20 bp, Artificial Sequence
  Description of Artificial Sequence: Synthetic oligonucleotide
  Target: ATXN1; (-) strand; PAM type: YTN; PAM sequence: TTG
taaaatggaccaatcagcag

SEQ ID NO: 206937 - DNA, 20 bp, Artificial Sequence
  Description of Artificial Sequence: Synthetic oligonucleotide
  Target: ATXN1; (-) strand; PAM type: YTN; PAM sequence: TTT
gtaaaatggaccaatcagca

SEQ ID NO: 206938 - DNA, 20 bp, Artificial Sequence
  Description of Artificial Sequence: Synthetic oligonucleotide
  Target: ATXN1; (-) strand; PAM type: YTN; PAM sequence: CTT
tgtaaaatggaccaatcagc

SEQ ID NO: 206939 - DNA, 20 bp, Artificial Sequence
  Description of Artificial Sequence: Synthetic oligonucleotide
  Target: ATXN1; (-) strand; PAM type: YTN; PAM sequence: TTG
taaaatgcaccaatcagtac

SEQ ID NO: 206940 - DNA, 20 bp, Artificial Sequence
  Description of Artificial Sequence: Synthetic oligonucleotide
  Target: ATXN1; (-) strand; PAM type: YTN; PAM sequence: TTT
gtaaaatgcaccaatcagta

SEQ ID NO: 206941 - DNA, 20 bp, Artificial Sequence
  Description of Artificial Sequence: Synthetic oligonucleotide
  Target: ATXN1; (-) strand; PAM type: YTN; PAM sequence: CTA
gcaagagatttgtaaaatgc

SEQ ID NO: 206942 - DNA, 20 bp, Artificial Sequence
  Description of Artificial Sequence: Synthetic oligonucleotide
  Target: ATXN1; (-) strand; PAM type: YTN; PAM sequence: CTG
tagctagcaagagatttgta

SEQ ID NO: 206943 - DNA, 20 bp, Artificial Sequence
  Description of Artificial Sequence: Synthetic oligonucleotide
  Target: ATXN1; (-) strand; PAM type: YTN; PAM sequence: CTC
tgtagctagcaagagatttg

SEQ ID NO: 206944 - DNA, 20 bp, Artificial Sequence
  Description of Artificial Sequence: Synthetic oligonucleotide
  Target: ATXN1; (-) strand; PAM type: YTN; PAM sequence: CTG
taaaaatgcaccagtcagtg

SEQ ID NO: 206945 - DNA, 20 bp, Artificial Sequence
  Description of Artificial Sequence: Synthetic oligonucleotide
  Target: ATXN1; (-) strand; PAM type: YTN; PAM sequence: CTC
tgtaaaaatgcaccagtcag

SEQ ID NO: 206946 - DNA, 20 bp, Artificial Sequence
  Description of Artificial Sequence: Synthetic oligonucleotide
  Target: ATXN1; (-) strand; PAM type: YTN; PAM sequence: TTG
taaaatgcaccaatcagtgc

SEQ ID NO: 206947 - DNA, 20 bp, Artificial Sequence
  Description of Artificial Sequence: Synthetic oligonucleotide
  Target: ATXN1; (-) strand; PAM type: YTN; PAM sequence: TTT
gtaaaatgcaccaatcagtg

SEQ ID NO: 206948 - DNA, 20 bp, Artificial Sequence
  Description of Artificial Sequence: Synthetic oligonucleotide
  Target: ATXN1; (-) strand; PAM type: YTN; PAM sequence: CTA
gcaagaggtttgtaaaatgc

SEQ ID NO: 206949 - DNA, 20 bp, Artificial Sequence
  Description of Artificial Sequence: Synthetic oligonucleotide
  Target: ATXN1; (-) strand; PAM type: YTN; PAM sequence: CTG
tagctagcaagaggtttgta

SEQ ID NO: 206950 - DNA, 20 bp, Artificial Sequence
  Description of Artificial Sequence: Synthetic oligonucleotide
  Target: ATXN1; (-) strand; PAM type: YTN; PAM sequence: CTC
tgtagctagcaagaggtttg

SEQ ID NO: 206951 - DNA, 20 bp, Artificial Sequence
  Description of Artificial Sequence: Synthetic oligonucleotide
  Target: ATXN1; (-) strand; PAM type: YTN; PAM sequence: TTA
taaaatgcagcagtcagtgc

SEQ ID NO: 206952 - DNA, 20 bp, Artificial Sequence
  Description of Artificial Sequence: Synthetic oligonucleotide
  Target: ATXN1; (-) strand; PAM type: YTN; PAM sequence: TTC
caagggtattataaaatgca

SEQ ID NO: 206953 - DNA, 20 bp, Artificial Sequence
  Description of Artificial Sequence: Synthetic oligonucleotide
  Target: ATXN1; (-) strand; PAM type: YTN; PAM sequence: CTT
ccaagggtattataaaatgc

SEQ ID NO: 206954 - DNA, 20 bp, Artificial Sequence
  Description of Artificial Sequence: Synthetic oligonucleotide
  Target: ATXN1; (-) strand; PAM type: YTN; PAM sequence: CTG
tcttccaagggtattataaa

SEQ ID NO: 206955 - DNA, 20 bp, Artificial Sequence
  Description of Artificial Sequence: Synthetic oligonucleotide
  Target: ATXN1; (-) strand; PAM type: YTN; PAM sequence: TTC
tgtcttccaagggtattata

SEQ ID NO: 206956 - DNA, 20 bp, Artificial Sequence
  Description of Artificial Sequence: Synthetic oligonucleotide
  Target: ATXN1; (-) strand; PAM type: YTN; PAM sequence: TTT
ctgtcttccaagggtattat

SEQ ID NO: 206957 - DNA, 20 bp, Artificial Sequence
  Description of Artificial Sequence: Synthetic oligonucleotide
  Target: ATXN1; (-) strand; PAM type: YTN; PAM sequence: TTT
tctgtcttccaagggtatta

SEQ ID NO: 206958 - DNA, 20 bp, Artificial Sequence
  Description of Artificial Sequence: Synthetic oligonucleotide
  Target: ATXN1; (-) strand; PAM type: YTN; PAM sequence: CTT
ttctgtcttccaagggtatt

SEQ ID NO: 206959 - DNA, 20 bp, Artificial Sequence
  Description of Artificial Sequence: Synthetic oligonucleotide
  Target: ATXN1; (-) strand; PAM type: YTN; PAM sequence: TTG
gagaacttttctgtcttcca

SEQ ID NO: 206960 - DNA, 20 bp, Artificial Sequence
  Description of Artificial Sequence: Synthetic oligonucleotide
  Target: ATXN1; (-) strand; PAM type: YTN; PAM sequence: CTT
ggagaacttttctgtcttcc

SEQ ID NO: 206961 - DNA, 20 bp, Artificial Sequence
  Description of Artificial Sequence: Synthetic oligonucleotide
  Target: ATXN1; (-) strand; PAM type: YTN; PAM sequence: CTG
ggtcgagtggggacttggag

SEQ ID NO: 206962 - DNA, 20 bp, Artificial Sequence
  Description of Artificial Sequence: Synthetic oligonucleotide
  Target: ATXN1; (-) strand; PAM type: YTN; PAM sequence: TTC
ctgggtcgagtggggacttg

SEQ ID NO: 206963 - DNA, 20 bp, Artificial Sequence
  Description of Artificial Sequence: Synthetic oligonucleotide
  Target: ATXN1; (-) strand; PAM type: YTN; PAM sequence: CTT
cctgggtcgagtggggactt

SEQ ID NO: 206964 - DNA, 20 bp, Artificial Sequence
  Description of Artificial Sequence: Synthetic oligonucleotide
  Target: ATXN1; (-) strand; PAM type: YTN; PAM sequence: CTG
gacttcctgggtcgagtggg

SEQ ID NO: 206965 - DNA, 20 bp, Artificial Sequence
  Description of Artificial Sequence: Synthetic oligonucleotide
  Target: ATXN1; (-) strand; PAM type: YTN; PAM sequence: TTG
agaggtgaagccagctggac

SEQ ID NO: 206966 - DNA, 20 bp, Artificial Sequence
  Description of Artificial Sequence: Synthetic oligonucleotide
  Target: ATXN1; (-) strand; PAM type: YTN; PAM sequence: CTG
agtggaattgagaggtgaag

SEQ ID NO: 206967 - DNA, 20 bp, Artificial Sequence
  Description of Artificial Sequence: Synthetic oligonucleotide
  Target: ATXN1; (-) strand; PAM type: YTN; PAM sequence: CTA
ctgagtggaattgagaggtg

SEQ ID NO: 206968 - DNA, 20 bp, Artificial Sequence
  Description of Artificial Sequence: Synthetic oligonucleotide
  Target: ATXN1; (-) strand; PAM type: YTN; PAM sequence: CTG
acagtaactactgagtggaa

SEQ ID NO: 206969 - DNA, 20 bp, Artificial Sequence
  Description of Artificial Sequence: Synthetic oligonucleotide
  Target: ATXN1; (-) strand; PAM type: YTN; PAM sequence: TTA
gggggaggctgacagtaact

SEQ ID NO: 206970 - DNA, 20 bp, Artificial Sequence
  Description of Artificial Sequence: Synthetic oligonucleotide
  Target: ATXN1; (-) strand; PAM type: YTN; PAM sequence: TTT
agggggaggctgacagtaac

SEQ ID NO: 206971 - DNA, 20 bp, Artificial Sequence
  Description of Artificial Sequence: Synthetic oligonucleotide
  Target: ATXN1; (-) strand; PAM type: YTN; PAM sequence: TTT
tagggggaggctgacagtaa

SEQ ID NO: 206972 - DNA, 20 bp, Artificial Sequence
  Description of Artificial Sequence: Synthetic oligonucleotide
  Target: ATXN1; (-) strand; PAM type: YTN; PAM sequence: TTG
agtggtggaggttttagggg

SEQ ID NO: 206973 - DNA, 20 bp, Artificial Sequence
  Description of Artificial Sequence: Synthetic oligonucleotide
  Target: ATXN1; (-) strand; PAM type: YTN; PAM sequence: CTT
gagtggtggaggttttaggg

SEQ ID NO: 206974 - DNA, 20 bp, Artificial Sequence
  Description of Artificial Sequence: Synthetic oligonucleotide
  Target: ATXN1; (-) strand; PAM type: YTN; PAM sequence: CTC
cttgagtggtggaggtttta

SEQ ID NO: 206975 - DNA, 20 bp, Artificial Sequence
  Description of Artificial Sequence: Synthetic oligonucleotide
  Target: ATXN1; (-) strand; PAM type: YTN; PAM sequence: CTG
acagtgtcgctccttgagtg

SEQ ID NO: 206976 - DNA, 20 bp, Artificial Sequence
  Description of Artificial Sequence: Synthetic oligonucleotide
  Target: ATXN1; (-) strand; PAM type: YTN; PAM sequence: TTC
tgacagtgtcgctccttgag

SEQ ID NO: 206977 - DNA, 20 bp, Artificial Sequence
  Description of Artificial Sequence: Synthetic oligonucleotide
  Target: ATXN1; (-) strand; PAM type: YTN; PAM sequence: CTT
ctgacagtgtcgctccttga

SEQ ID NO: 206978 - DNA, 20 bp, Artificial Sequence
  Description of Artificial Sequence: Synthetic oligonucleotide
  Target: ATXN1; (-) strand; PAM type: YTN; PAM sequence: CTG
cttctgacagtgtcgctcct

SEQ ID NO: 206979 - DNA, 20 bp, Artificial Sequence
  Description of Artificial Sequence: Synthetic oligonucleotide
  Target: ATXN1; (-) strand; PAM type: YTN; PAM sequence: TTA
gaaggtctgcttctgacagt

SEQ ID NO: 206980 - DNA, 20 bp, Artificial Sequence
  Description of Artificial Sequence: Synthetic oligonucleotide
  Target: ATXN1; (-) strand; PAM type: YTN; PAM sequence: TTG
agatcacacaggagtaatta

SEQ ID NO: 206981 - DNA, 20 bp, Artificial Sequence
  Description of Artificial Sequence: Synthetic oligonucleotide
  Target: ATXN1; (-) strand; PAM type: YTN; PAM sequence: CTT
gagatcacacaggagtaatt

SEQ ID NO: 206982 - DNA, 20 bp, Artificial Sequence
  Description of Artificial Sequence: Synthetic oligonucleotide
  Target: ATXN1; (-) strand; PAM type: YTN; PAM sequence: TTC
catagtccccagggaggggg

SEQ ID NO: 206983 - DNA, 20 bp, Artificial Sequence
  Description of Artificial Sequence: Synthetic oligonucleotide
  Target: ATXN1; (-) strand; PAM type: YTN; PAM sequence: TTT
ccatagtccccagggagggg

SEQ ID NO: 206984 - DNA, 20 bp, Artificial Sequence
  Description of Artificial Sequence: Synthetic oligonucleotide
  Target: ATXN1; (-) strand; PAM type: YTN; PAM sequence: CTT
tccatagtccccagggaggg

SEQ ID NO: 206985 - DNA, 20 bp, Artificial Sequence
  Description of Artificial Sequence: Synthetic oligonucleotide
  Target: ATXN1; (-) strand; PAM type: YTN; PAM sequence: CTC
tttccatagtccccagggag

SEQ ID NO: 206986 - DNA, 20 bp, Artificial Sequence
  Description of Artificial Sequence: Synthetic oligonucleotide
  Target: ATXN1; (-) strand; PAM type: YTN; PAM sequence: TTC
tctttccatagtccccaggg

SEQ ID NO: 206987 - DNA, 20 bp, Artificial Sequence
  Description of Artificial Sequence: Synthetic oligonucleotide
  Target: ATXN1; (-) strand; PAM type: YTN; PAM sequence: CTA
acattctctttccatagtcc

SEQ ID NO: 206988 - DNA, 20 bp, Artificial Sequence
  Description of Artificial Sequence: Synthetic oligonucleotide
  Target: ATXN1; (-) strand; PAM type: YTN; PAM sequence: TTC
ctaacattctctttccatag

SEQ ID NO: 206989 - DNA, 20 bp, Artificial Sequence
  Description of Artificial Sequence: Synthetic oligonucleotide
  Target: ATXN1; (-) strand; PAM type: YTN; PAM sequence: TTT
cctaacattctctttccata

SEQ ID NO: 206990 - DNA, 20 bp, Artificial Sequence
  Description of Artificial Sequence: Synthetic oligonucleotide
  Target: ATXN1; (-) strand; PAM type: YTN; PAM sequence: CTA
tttcctaacattctctttcc

SEQ ID NO: 206991 - DNA, 20 bp, Artificial Sequence
  Description of Artificial Sequence: Synthetic oligonucleotide
  Target: ATXN1; (-) strand; PAM type: YTN; PAM sequence: CTC
tatttcctaacattctcttt

SEQ ID NO: 206992 - DNA, 20 bp, Artificial Sequence
  Description of Artificial Sequence: Synthetic oligonucleotide
  Target: ATXN1; (-) strand; PAM type: YTN; PAM sequence: TTC
catctctatttcctaacatt

SEQ ID NO: 206993 - DNA, 20 bp, Artificial Sequence
  Description of Artificial Sequence: Synthetic oligonucleotide
  Target: ATXN1; (-) strand; PAM type: YTN; PAM sequence: TTT
ccatctctatttcctaacat

SEQ ID NO: 206994 - DNA, 20 bp, Artificial Sequence
  Description of Artificial Sequence: Synthetic oligonucleotide
  Target: ATXN1; (-) strand; PAM type: YTN; PAM sequence: TTT
tccatctctatttcctaaca

SEQ ID NO: 206995 - DNA, 20 bp, Artificial Sequence
  Description of Artificial Sequence: Synthetic oligonucleotide
  Target: ATXN1; (-) strand; PAM type: YTN; PAM sequence: TTT
ttccatctctatttcctaac

SEQ ID NO: 206996 - DNA, 20 bp, Artificial Sequence
  Description of Artificial Sequence: Synthetic oligonucleotide
  Target: ATXN1; (-) strand; PAM type: YTN; PAM sequence: TTT
tttccatctctatttcctaa

SEQ ID NO: 206997 - DNA, 20 bp, Artificial Sequence
  Description of Artificial Sequence: Synthetic oligonucleotide
  Target: ATXN1; (-) strand; PAM type: YTN; PAM sequence: TTG
ttttttccatctctatttcc

SEQ ID NO: 206998 - DNA, 20 bp, Artificial Sequence
  Description of Artificial Sequence: Synthetic oligonucleotide
  Target: ATXN1; (-) strand; PAM type: YTN; PAM sequence: CTT
gttttttccatctctatttc

SEQ ID NO: 206999 - DNA, 20 bp, Artificial Sequence
  Description of Artificial Sequence: Synthetic oligonucleotide
  Target: ATXN1; (-) strand; PAM type: YTN; PAM sequence: TTA
tggcttgttttttccatctc

SEQ ID NO: 207000 - DNA, 20 bp, Artificial Sequence
  Description of Artificial Sequence: Synthetic oligonucleotide
  Target: ATXN1; (-) strand; PAM type: YTN; PAM sequence: TTA
aagtgatagcatgtcagaat

SEQ ID NO: 207001 - DNA, 20 bp, Artificial Sequence
  Description of Artificial Sequence: Synthetic oligonucleotide
  Target: ATXN1; (-) strand; PAM type: YTN; PAM sequence: TTT
aaagtgatagcatgtcagaa

SEQ ID NO: 207002 - DNA, 20 bp, Artificial Sequence
  Description of Artificial Sequence: Synthetic oligonucleotide
  Target: ATXN1; (-) strand; PAM type: YTN; PAM sequence: TTT
taaagtgatagcatgtcaga

SEQ ID NO: 207003 - DNA, 20 bp, Artificial Sequence
  Description of Artificial Sequence: Synthetic oligonucleotide
  Target: ATXN1; (-) strand; PAM type: YTN; PAM sequence: TTT
ttaaagtgatagcatgtcag

SEQ ID NO: 207004 - DNA, 20 bp, Artificial Sequence
  Description of Artificial Sequence: Synthetic oligonucleotide
  Target: ATXN1; (-) strand; PAM type: YTN; PAM sequence: TTG
catgatagaaatatttttaa

SEQ ID NO: 207005 - DNA, 20 bp, Artificial Sequence
  Description of Artificial Sequence: Synthetic oligonucleotide
  Target: ATXN1; (-) strand; PAM type: YTN; PAM sequence: TTA
caaacattgcatgatagaaa

SEQ ID NO: 207006 - DNA, 20 bp, Artificial Sequence
  Description of Artificial Sequence: Synthetic oligonucleotide
  Target: ATXN1; (-) strand; PAM type: YTN; PAM sequence: TTG
tgggttacaaacattgcatg

SEQ ID NO: 207007 - DNA, 20 bp, Artificial Sequence
  Description of Artificial Sequence: Synthetic oligonucleotide
  Target: ATXN1; (-) strand; PAM type: YTN; PAM sequence: TTT
gtgggttacaaacattgcat

SEQ ID NO: 207008 - DNA, 20 bp, Artificial Sequence
  Description of Artificial Sequence: Synthetic oligonucleotide
  Target: ATXN1; (-) strand; PAM type: YTN; PAM sequence: TTT
tgtgggttacaaacattgca

SEQ ID NO: 207009 - DNA, 20 bp, Artificial Sequence
  Description of Artificial Sequence: Synthetic oligonucleotide
  Target: ATXN1; (-) strand; PAM type: YTN; PAM sequence: CTT
ttgtgggttacaaacattgc

SEQ ID NO: 207010 - DNA, 20 bp, Artificial Sequence
  Description of Artificial Sequence: Synthetic oligonucleotide
  Target: ATXN1; (-) strand; PAM type: YTN; PAM sequence: TTC
ttttgtgggttacaaacatt

SEQ ID NO: 207011 - DNA, 20 bp, Artificial Sequence
  Description of Artificial Sequence: Synthetic oligonucleotide
  Target: ATXN1; (-) strand; PAM type: YTN; PAM sequence: TTA
gtgcattcttttgtgggtta

SEQ ID NO: 207012 - DNA, 20 bp, Artificial Sequence
  Description of Artificial Sequence: Synthetic oligonucleotide
  Target: ATXN1; (-) strand; PAM type: YTN; PAM sequence: TTA
cgtacatgttagtgcattct

SEQ ID NO: 207013 - DNA, 20 bp, Artificial Sequence
  Description of Artificial Sequence: Synthetic oligonucleotide
  Target: ATXN1; (-) strand; PAM type: YTN; PAM sequence: TTC
acaggttacgtacatgttag

SEQ ID NO: 207014 - DNA, 20 bp, Artificial Sequence
  Description of Artificial Sequence: Synthetic oligonucleotide
  Target: ATXN1; (-) strand; PAM type: YTN; PAM sequence: CTT
cacaggttacgtacatgtta

SEQ ID NO: 207015 - DNA, 20 bp, Artificial Sequence
  Description of Artificial Sequence: Synthetic oligonucleotide
  Target: ATXN1; (-) strand; PAM type: YTN; PAM sequence: TTA
tgcttcacaggttacgtaca

SEQ ID NO: 207016 - DNA, 20 bp, Artificial Sequence
  Description of Artificial Sequence: Synthetic oligonucleotide
  Target: ATXN1; (-) strand; PAM type: YTN; PAM sequence: CTT
atgcttcacaggttacgtac

SEQ ID NO: 207017 - DNA, 20 bp, Artificial Sequence
  Description of Artificial Sequence: Synthetic oligonucleotide
  Target: ATXN1; (-) strand; PAM type: YTN; PAM sequence: TTC
ttatgcttcacaggttacgt

SEQ ID NO: 207018 - DNA, 20 bp, Artificial Sequence
  Description of Artificial Sequence: Synthetic oligonucleotide
  Target: ATXN1; (-) strand; PAM type: YTN; PAM sequence: TTA
ttcttatgcttcacaggtta

SEQ ID NO: 207019 - DNA, 20 bp, Artificial Sequence
  Description of Artificial Sequence: Synthetic oligonucleotide
  Target: ATXN1; (-) strand; PAM type: YTN; PAM sequence: TTT
attcttatgcttcacaggtt

SEQ ID NO: 207020 - DNA, 20 bp, Artificial Sequence
  Description of Artificial Sequence: Synthetic oligonucleotide
  Target: ATXN1; (-) strand; PAM type: YTN; PAM sequence: TTT
tattcttatgcttcacaggt

SEQ ID NO: 207021 - DNA, 20 bp, Artificial Sequence
  Description of Artificial Sequence: Synthetic oligonucleotide
  Target: ATXN1; (-) strand; PAM type: YTN; PAM sequence: TTC
attttattcttatgcttcac

SEQ ID NO: 207022 - DNA, 20 bp, Artificial Sequence
  Description of Artificial Sequence: Synthetic oligonucleotide
  Target: ATXN1; (-) strand; PAM type: YTN; PAM sequence: CTG
ttcattttattcttatgctt

SEQ ID NO: 207023 - DNA, 20 bp, Artificial Sequence
  Description of Artificial Sequence: Synthetic oligonucleotide
  Target: ATXN1; (-) strand; PAM type: YTN; PAM sequence: CTC
aaatagggtggtcggtgtat

SEQ ID NO: 207024 - DNA, 20 bp, Artificial Sequence
  Description of Artificial Sequence: Synthetic oligonucleotide
  Target: ATXN1; (-) strand; PAM type: YTN; PAM sequence: TTC
tcaaatagggtggtcggtgt

SEQ ID NO: 207025 - DNA, 20 bp, Artificial Sequence
  Description of Artificial Sequence: Synthetic oligonucleotide
  Target: ATXN1; (-) strand; PAM type: YTN; PAM sequence: CTA
gttctcaaatagggtggtcg

SEQ ID NO: 207026 - DNA, 20 bp, Artificial Sequence
  Description of Artificial Sequence: Synthetic oligonucleotide
  Target: ATXN1; (-) strand; PAM type: YTN; PAM sequence: CTA
aatgtctagttctcaaatag

SEQ ID NO: 207027 - DNA, 20 bp, Artificial Sequence
  Description of Artificial Sequence: Synthetic oligonucleotide
  Target: ATXN1; (-) strand; PAM type: YTN; PAM sequence: TTA
gggaaatagcaaataggtag

SEQ ID NO: 207028 - DNA, 20 bp, Artificial Sequence
  Description of Artificial Sequence: Synthetic oligonucleotide
  Target: ATXN1; (-) strand; PAM type: YTN; PAM sequence: CTT
agggaaatagcaaataggta

SEQ ID NO: 207029 - DNA, 20 bp, Artificial Sequence
  Description of Artificial Sequence: Synthetic oligonucleotide
  Target: ATXN1; (-) strand; PAM type: YTN; PAM sequence: CTG
gagagaaggcaggaggatgg

SEQ ID NO: 207030 - DNA, 20 bp, Artificial Sequence
  Description of Artificial Sequence: Synthetic oligonucleotide
  Target: ATXN1; (-) strand; PAM type: YTN; PAM sequence: TTA
cccctggagagaaggcagga

SEQ ID NO: 207031 - DNA, 20 bp, Artificial Sequence
  Description of Artificial Sequence: Synthetic oligonucleotide
  Target: ATXN1; (-) strand; PAM type: YTN; PAM sequence: TTA
agatagtggttacccctgga

SEQ ID NO: 207032 - DNA, 20 bp, Artificial Sequence
  Description of Artificial Sequence: Synthetic oligonucleotide
  Target: ATXN1; (-) strand; PAM type: YTN; PAM sequence: TTT
aagatagtggttacccctgg

SEQ ID NO: 207033 - DNA, 20 bp, Artificial Sequence
  Description of Artificial Sequence: Synthetic oligonucleotide
  Target: ATXN1; (-) strand; PAM type: YTN; PAM sequence: TTA
gagagtgatagatagaaaat

SEQ ID NO: 207034 - DNA, 20 bp, Artificial Sequence
  Description of Artificial Sequence: Synthetic oligonucleotide
  Target: ATXN1; (-) strand; PAM type: YTN; PAM sequence: TTT
agagagtgatagatagaaaa

SEQ ID NO: 207035 - DNA, 20 bp, Artificial Sequence
  Description of Artificial Sequence: Synthetic oligonucleotide
  Target: ATXN1; (-) strand; PAM type: YTN; PAM sequence: TTT
tagagagtgatagatagaaa

SEQ ID NO: 207036 - DNA, 20 bp, Artificial Sequence
  Description of Artificial Sequence: Synthetic oligonucleotide
  Target: ATXN1; (-) strand; PAM type: YTN; PAM sequence: CTA
tgtattttagagagtgatag

SEQ ID NO: 207037 - DNA, 20 bp, Artificial Sequence
  Description of Artificial Sequence: Synthetic oligonucleotide
  Target: ATXN1; (-) strand; PAM type: YTN; PAM sequence: TTA
aactatgtattttagagagt

SEQ ID NO: 207038 - DNA, 20 bp, Artificial Sequence
  Description of Artificial Sequence: Synthetic oligonucleotide
  Target: ATXN1; (-) strand; PAM type: YTN; PAM sequence: TTA
aaatcaagcacaattaaact

SEQ ID NO: 207039 - DNA, 20 bp, Artificial Sequence
  Description of Artificial Sequence: Synthetic oligonucleotide
  Target: ATXN1; (-) strand; PAM type: YTN; PAM sequence: TTT
aaaatcaagcacaattaaac

SEQ ID NO: 207040 - DNA, 20 bp, Artificial Sequence
  Description of Artificial Sequence: Synthetic oligonucleotide
  Target: ATXN1; (-) strand; PAM type: YTN; PAM sequence: TTA
taaagtttaaaatcaagcac

SEQ ID NO: 207041 - DNA, 20 bp, Artificial Sequence
  Description of Artificial Sequence: Synthetic oligonucleotide
  Target: ATXN1; (-) strand; PAM type: YTN; PAM sequence: CTA
tatacagtatgatagtatta

SEQ ID NO: 207042 - DNA, 20 bp, Artificial Sequence
  Description of Artificial Sequence: Synthetic oligonucleotide
  Target: ATXN1; (-) strand; PAM type: YTN; PAM sequence: CTA
gtcacaaaagactatataca

SEQ ID NO: 207043 - DNA, 20 bp, Artificial Sequence
  Description of Artificial Sequence: Synthetic oligonucleotide
  Target: ATXN1; (-) strand; PAM type: YTN; PAM sequence: TTG
tgtgaaaaaaactagtcaca

SEQ ID NO: 207044 - DNA, 20 bp, Artificial Sequence
  Description of Artificial Sequence: Synthetic oligonucleotide
  Target: ATXN1; (-) strand; PAM type: YTN; PAM sequence: TTA
gaaacaatattgtgtgaaaa

SEQ ID NO: 207045 - DNA, 20 bp, Artificial Sequence
  Description of Artificial Sequence: Synthetic oligonucleotide
  Target: ATXN1; (-) strand; PAM type: YTN; PAM sequence: CTT
agaaacaatattgtgtgaaa

SEQ ID NO: 207046 - DNA, 20 bp, Artificial Sequence
  Description of Artificial Sequence: Synthetic oligonucleotide
  Target: ATXN1; (-) strand; PAM type: YTN; PAM sequence: CTA
aatcttagaaacaatattgt

SEQ ID NO: 207047 - DNA, 20 bp, Artificial Sequence
  Description of Artificial Sequence: Synthetic oligonucleotide
  Target: ATXN1; (-) strand; PAM type: YTN; PAM sequence: CTG
taacaacatggctaaatctt

SEQ ID NO: 207048 - DNA, 20 bp, Artificial Sequence
  Description of Artificial Sequence: Synthetic oligonucleotide
  Target: ATXN1; (-) strand; PAM type: YTN; PAM sequence: CTA
cctgtaacaacatggctaaa

SEQ ID NO: 207049 - DNA, 20 bp, Artificial Sequence
  Description of Artificial Sequence: Synthetic oligonucleotide
  Target: ATXN1; (-) strand; PAM type: YTN; PAM sequence: CTA
tagtagctacctgtaacaac

SEQ ID NO: 207050 - DNA, 20 bp, Artificial Sequence
  Description of Artificial Sequence: Synthetic oligonucleotide
  Target: ATXN1; (-) strand; PAM type: YTN; PAM sequence: TTA
tacagcagtgaatatgaagg

SEQ ID NO: 207051 - DNA, 20 bp, Artificial Sequence
  Description of Artificial Sequence: Synthetic oligonucleotide
  Target: ATXN1; (-) strand; PAM type: YTN; PAM sequence: TTC
acagaatggaatattataca

SEQ ID NO: 207052 - DNA, 20 bp, Artificial Sequence
  Description of Artificial Sequence: Synthetic oligonucleotide
  Target: ATXN1; (-) strand; PAM type: YTN; PAM sequence: CTT
cacagaatggaatattatac

SEQ ID NO: 207053 - DNA, 20 bp, Artificial Sequence
  Description of Artificial Sequence: Synthetic oligonucleotide
  Target: ATXN1; (-) strand; PAM type: YTN; PAM sequence: TTG
cttcacagaatggaatatta

SEQ ID NO: 207054 - DNA, 20 bp, Artificial Sequence
  Description of Artificial Sequence: Synthetic oligonucleotide
  Target: ATXN1; (-) strand; PAM type: YTN; PAM sequence: TTT
gcttcacagaatggaatatt

SEQ ID NO: 207055 - DNA, 20 bp, Artificial Sequence
  Description of Artificial Sequence: Synthetic oligonucleotide
  Target: ATXN1; (-) strand; PAM type: YTN; PAM sequence: TTT
tgcttcacagaatggaatat

SEQ ID NO: 207056 - DNA, 20 bp, Artificial Sequence
  Description of Artificial Sequence: Synthetic oligonucleotide
  Target: ATXN1; (-) strand; PAM type: YTN; PAM sequence: TTT
ttgcttcacagaatggaata

SEQ ID NO: 207057 - DNA, 20 bp, Artificial Sequence
  Description of Artificial Sequence: Synthetic oligonucleotide
  Target: ATXN1; (-) strand; PAM type: YTN; PAM sequence: TTT
tttgcttcacagaatggaat

SEQ ID NO: 207058 - DNA, 20 bp, Artificial Sequence
  Description of Artificial Sequence: Synthetic oligonucleotide
  Target: ATXN1; (-) strand; PAM type: YTN; PAM sequence: TTA
tatatatatatatatatata

SEQ ID NO: 207059 - DNA, 20 bp, Artificial Sequence
  Description of Artificial Sequence: Synthetic oligonucleotide
  Target: ATXN1; (-) strand; PAM type: YTN; PAM sequence: TTT
atatatatatatatatatat

SEQ ID NO: 207060 - DNA, 20 bp, Artificial Sequence
  Description of Artificial Sequence: Synthetic oligonucleotide
  Target: ATXN1; (-) strand; PAM type: YTN; PAM sequence: CTT
tatatatatatatatatata

SEQ ID NO: 207061 - DNA, 20 bp, Artificial Sequence
  Description of Artificial Sequence: Synthetic oligonucleotide
  Target: ATXN1; (-) strand; PAM type: YTN; PAM sequence: TTG
agaacctttatatatatata

SEQ ID NO: 207062 - DNA, 20 bp, Artificial Sequence
  Description of Artificial Sequence: Synthetic oligonucleotide
  Target: ATXN1; (-) strand; PAM type: YTN; PAM sequence: CTA
ttgagaacctttatatatat

SEQ ID NO: 207063 - DNA, 20 bp, Artificial Sequence
  Description of Artificial Sequence: Synthetic oligonucleotide
  Target: ATXN1; (-) strand; PAM type: YTN; PAM sequence: TTA
gtctattgagaacctttata

SEQ ID NO: 207064 - DNA, 20 bp, Artificial Sequence
  Description of Artificial Sequence: Synthetic oligonucleotide
  Target: ATXN1; (-) strand; PAM type: YTN; PAM sequence: CTA
atatatatatatattagtct

SEQ ID NO: 207065 - DNA, 20 bp, Artificial Sequence
  Description of Artificial Sequence: Synthetic oligonucleotide
  Target: ATXN1; (-) strand; PAM type: YTN; PAM sequence: CTC
cagactaatatatatatata

SEQ ID NO: 207066 - DNA, 20 bp, Artificial Sequence
  Description of Artificial Sequence: Synthetic oligonucleotide
  Target: ATXN1; (-) strand; PAM type: YTN; PAM sequence: CTC
tccagactaatatatatata

SEQ ID NO: 207067 - DNA, 20 bp, Artificial Sequence
  Description of Artificial Sequence: Synthetic oligonucleotide
  Target: ATXN1; (-) strand; PAM type: YTN; PAM sequence: CTA
tctctccagactaatatata

SEQ ID NO: 207068 - DNA, 20 bp, Artificial Sequence
  Description of Artificial Sequence: Synthetic oligonucleotide
  Target: ATXN1; (-) strand; PAM type: YTN; PAM sequence: TTC
tatctctccagactaatata

SEQ ID NO: 207069 - DNA, 20 bp, Artificial Sequence
  Description of Artificial Sequence: Synthetic oligonucleotide
  Target: ATXN1; (-) strand; PAM type: YTN; PAM sequence: CTT
ctatctctccagactaatat

SEQ ID NO: 207070 - DNA, 20 bp, Artificial Sequence
  Description of Artificial Sequence: Synthetic oligonucleotide
  Target: ATXN1; (-) strand; PAM type: YTN; PAM sequence: TTA
gcttctatctctccagacta

SEQ ID NO: 207071 - DNA, 20 bp, Artificial Sequence
  Description of Artificial Sequence: Synthetic oligonucleotide
  Target: ATXN1; (-) strand; PAM type: YTN; PAM sequence: CTA
atatatgtattagcttctat

SEQ ID NO: 207072 - DNA, 20 bp, Artificial Sequence
  Description of Artificial Sequence: Synthetic oligonucleotide
  Target: ATXN1; (-) strand; PAM type: YTN; PAM sequence: TTG
gactaatatatgtattagct

SEQ ID NO: 207073 - DNA, 20 bp, Artificial Sequence
  Description of Artificial Sequence: Synthetic oligonucleotide
  Target: ATXN1; (-) strand; PAM type: YTN; PAM sequence: CTA
atatgtataataattggact

SEQ ID NO: 207074 - DNA, 20 bp, Artificial Sequence
  Description of Artificial Sequence: Synthetic oligonucleotide
  Target: ATXN1; (-) strand; PAM type: YTN; PAM sequence: TTA
gactaatatgtataataatt

SEQ ID NO: 207075 - DNA, 20 bp, Artificial Sequence
  Description of Artificial Sequence: Synthetic oligonucleotide
  Target: ATXN1; (-) strand; PAM type: YTN; PAM sequence: CTA
atatataataattagactaa

SEQ ID NO: 207076 - DNA, 20 bp, Artificial Sequence
  Description of Artificial Sequence: Synthetic oligonucleotide
  Target: ATXN1; (-) strand; PAM type: YTN; PAM sequence: TTA
gtctaatatataataattag

SEQ ID NO: 207077 - DNA, 20 bp, Artificial Sequence
  Description of Artificial Sequence: Synthetic oligonucleotide
  Target: ATXN1; (-) strand; PAM type: YTN; PAM sequence: CTA
tagacatatattagtctaat

SEQ ID NO: 207078 - DNA, 20 bp, Artificial Sequence
  Description of Artificial Sequence: Synthetic oligonucleotide
  Target: ATXN1; (-) strand; PAM type: YTN; PAM sequence: CTC
tatagacatatattagtcta

SEQ ID NO: 207079 - DNA, 20 bp, Artificial Sequence
  Description of Artificial Sequence: Synthetic oligonucleotide
  Target: ATXN1; (-) strand; PAM type: YTN; PAM sequence: CTA
tctctatagacatatattag

SEQ ID NO: 207080 - DNA, 20 bp, Artificial Sequence
  Description of Artificial Sequence: Synthetic oligonucleotide
  Target: ATXN1; (-) strand; PAM type: YTN; PAM sequence: TTC
tatctctatagacatatatt

SEQ ID NO: 207081 - DNA, 20 bp, Artificial Sequence
  Description of Artificial Sequence: Synthetic oligonucleotide
  Target: ATXN1; (-) strand; PAM type: YTN; PAM sequence: CTT
ctatctctatagacatatat

SEQ ID NO: 207082 - DNA, 20 bp, Artificial Sequence
  Description of Artificial Sequence: Synthetic oligonucleotide
  Target: ATXN1; (-) strand; PAM type: YTN; PAM sequence: TTA
gcttctatctctatagacat

SEQ ID NO: 207083 - DNA, 20 bp, Artificial Sequence
  Description of Artificial Sequence: Synthetic oligonucleotide
  Target: ATXN1; (-) strand; PAM type: YTN; PAM sequence: CTA
atatgtatattagcttctat

SEQ ID NO: 207084 - DNA, 20 bp, Artificial Sequence
  Description of Artificial Sequence: Synthetic oligonucleotide
  Target: ATXN1; (-) strand; PAM type: YTN; PAM sequence: TTG
actaatatgtatattagctt

SEQ ID NO: 207085 - DNA, 20 bp, Artificial Sequence
  Description of Artificial Sequence: Synthetic oligonucleotide
  Target: ATXN1; (-) strand; PAM type: YTN; PAM sequence: TTT
gactaatatgtatattagct

SEQ ID NO: 207086 - DNA, 20 bp, Artificial Sequence
  Description of Artificial Sequence: Synthetic oligonucleotide
  Target: ATXN1; (-) strand; PAM type: YTN; PAM sequence: CTA
atatgtataatttgactaat

SEQ ID NO: 207087 - DNA, 20 bp, Artificial Sequence
  Description of Artificial Sequence: Synthetic oligonucleotide
  Target: ATXN1; (-) strand; PAM type: YTN; PAM sequence: TTG
aactaatatgtataatttga

SEQ ID NO: 207088 - DNA, 20 bp, Artificial Sequence
  Description of Artificial Sequence: Synthetic oligonucleotide
  Target: ATXN1; (-) strand; PAM type: YTN; PAM sequence: CTA
atatataataattgaactaa

SEQ ID NO: 207089 - DNA, 20 bp, Artificial Sequence
  Description of Artificial Sequence: Synthetic oligonucleotide
  Target: ATXN1; (-) strand; PAM type: YTN; PAM sequence: TTA
gtctaatatataataattga

SEQ ID NO: 207090 - DNA, 20 bp, Artificial Sequence
  Description of Artificial Sequence: Synthetic oligonucleotide
  Target: ATXN1; (-) strand; PAM type: YTN; PAM sequence: CTA
atatatattagtctaatata

SEQ ID NO: 207091 - DNA, 20 bp, Artificial Sequence
  Description of Artificial Sequence: Synthetic oligonucleotide
  Target: ATXN1; (-) strand; PAM type: YTN; PAM sequence: CTG
tagactaatatatattagtc

SEQ ID NO: 207092 - DNA, 20 bp, Artificial Sequence
  Description of Artificial Sequence: Synthetic oligonucleotide
  Target: ATXN1; (-) strand; PAM type: YTN; PAM sequence: CTA
tccctgtagactaatatata

SEQ ID NO: 207093 - DNA, 20 bp, Artificial Sequence
  Description of Artificial Sequence: Synthetic oligonucleotide
  Target: ATXN1; (-) strand; PAM type: YTN; PAM sequence: TTC
tatccctgtagactaatata

SEQ ID NO: 207094 - DNA, 20 bp, Artificial Sequence
  Description of Artificial Sequence: Synthetic oligonucleotide
  Target: ATXN1; (-) strand; PAM type: YTN; PAM sequence: CTT
ctatccctgtagactaatat

SEQ ID NO: 207095 - DNA, 20 bp, Artificial Sequence
  Description of Artificial Sequence: Synthetic oligonucleotide
  Target: ATXN1; (-) strand; PAM type: YTN; PAM sequence: TTA
gcttctatccctgtagacta

SEQ ID NO: 207096 - DNA, 20 bp, Artificial Sequence
  Description of Artificial Sequence: Synthetic oligonucleotide
  Target: ATXN1; (-) strand; PAM type: YTN; PAM sequence: CTA
atatatattagcttctatcc

SEQ ID NO: 207097 - DNA, 20 bp, Artificial Sequence
  Description of Artificial Sequence: Synthetic oligonucleotide
  Target: ATXN1; (-) strand; PAM type: YTN; PAM sequence: TTA
gactaatatatattagcttc

SEQ ID NO: 207098 - DNA, 20 bp, Artificial Sequence
  Description of Artificial Sequence: Synthetic oligonucleotide
  Target: ATXN1; (-) strand; PAM type: YTN; PAM sequence: TTA
attagactaatatatattag

SEQ ID NO: 207099 - DNA, 20 bp, Artificial Sequence
  Description of Artificial Sequence: Synthetic oligonucleotide
  Target: ATXN1; (-) strand; PAM type: YTN; PAM sequence: CTA
atatatatattaattagact

SEQ ID NO: 207100 - DNA, 20 bp, Artificial Sequence
  Description of Artificial Sequence: Synthetic oligonucleotide
  Target: ATXN1; (-) strand; PAM type: YTN; PAM sequence: TTA
gactaatatatatattaatt

SEQ ID NO: 207101 - DNA, 20 bp, Artificial Sequence
  Description of Artificial Sequence: Synthetic oligonucleotide
  Target: ATXN1; (-) strand; PAM type: YTN; PAM sequence: CTA
atatatgacaattagactaa

SEQ ID NO: 207102 - DNA, 20 bp, Artificial Sequence
  Description of Artificial Sequence: Synthetic oligonucleotide
  Target: ATXN1; (-) strand; PAM type: YTN; PAM sequence: TTA
gtctaatatatgacaattag

SEQ ID NO: 207103 - DNA, 20 bp, Artificial Sequence
  Description of Artificial Sequence: Synthetic oligonucleotide
  Target: ATXN1; (-) strand; PAM type: YTN; PAM sequence: TTA
aaggtcgtcaacagacatat

SEQ ID NO: 207104 - DNA, 20 bp, Artificial Sequence
  Description of Artificial Sequence: Synthetic oligonucleotide
  Target: ATXN1; (-) strand; PAM type: YTN; PAM sequence: TTT
aaaggtcgtcaacagacata

SEQ ID NO: 207105 - DNA, 20 bp, Artificial Sequence
  Description of Artificial Sequence: Synthetic oligonucleotide
  Target: ATXN1; (-) strand; PAM type: YTN; PAM sequence: TTT
taaaggtcgtcaacagacat

SEQ ID NO: 207106 - DNA, 20 bp, Artificial Sequence
  Description of Artificial Sequence: Synthetic oligonucleotide
  Target: ATXN1; (-) strand; PAM type: YTN; PAM sequence: CTG
aaaaaattttaaaggtcgtc

SEQ ID NO: 207107 - DNA, 20 bp, Artificial Sequence
  Description of Artificial Sequence: Synthetic oligonucleotide
  Target: ATXN1; (-) strand; PAM type: YTN; PAM sequence: CTA
atagaaaaaaaaacgaagct

SEQ ID NO: 207108 - DNA, 20 bp, Artificial Sequence
  Description of Artificial Sequence: Synthetic oligonucleotide
  Target: ATXN1; (-) strand; PAM type: YTN; PAM sequence: TTC
taatagaaaaaaaaacgaag

SEQ ID NO: 207109 - DNA, 20 bp, Artificial Sequence
  Description of Artificial Sequence: Synthetic oligonucleotide
  Target: ATXN1; (-) strand; PAM type: YTN; PAM sequence: TTT
ctaatagaaaaaaaaacgaa

SEQ ID NO: 207110 - DNA, 20 bp, Artificial Sequence
  Description of Artificial Sequence: Synthetic oligonucleotide
  Target: ATXN1; (-) strand; PAM type: YTN; PAM sequence: TTG
tttctaatagaaaaaaaaac

SEQ ID NO: 207111 - DNA, 20 bp, Artificial Sequence
  Description of Artificial Sequence: Synthetic oligonucleotide
  Target: ATXN1; (-) strand; PAM type: YTN; PAM sequence: CTA
atggacacagcattgtttct

SEQ ID NO: 207112 - DNA, 20 bp, Artificial Sequence
  Description of Artificial Sequence: Synthetic oligonucleotide
  Target: ATXN1; (-) strand; PAM type: YTN; PAM sequence: TTC
ctaatggacacagcattgtt

SEQ ID NO: 207113 - DNA, 20 bp, Artificial Sequence
  Description of Artificial Sequence: Synthetic oligonucleotide
  Target: ATXN1; (-) strand; PAM type: YTN; PAM sequence: TTG
ttcctaatggacacagcatt

SEQ ID NO: 207114 - DNA, 20 bp, Artificial Sequence
  Description of Artificial Sequence: Synthetic oligonucleotide
  Target: ATXN1; (-) strand; PAM type: YTN; PAM sequence: CTG
atgggtattgttcctaatgg

SEQ ID NO: 207115 - DNA, 20 bp, Artificial Sequence
  Description of Artificial Sequence: Synthetic oligonucleotide
  Target: ATXN1; (-) strand; PAM type: YTN; PAM sequence: TTA
tgctgatgggtattgttcct

SEQ ID NO: 207116 - DNA, 20 bp, Artificial Sequence
  Description of Artificial Sequence: Synthetic oligonucleotide
  Target: ATXN1; (-) strand; PAM type: YTN; PAM sequence: CTT
atgctgatgggtattgttcc

SEQ ID NO: 207117 - DNA, 20 bp, Artificial Sequence
  Description of Artificial Sequence: Synthetic oligonucleotide
  Target: ATXN1; (-) strand; PAM type: YTN; PAM sequence: CTA
ggcaataacccagggaaact

SEQ ID NO: 207118 - DNA, 20 bp, Artificial Sequence
  Description of Artificial Sequence: Synthetic oligonucleotide
  Target: ATXN1; (-) strand; PAM type: YTN; PAM sequence: TTC
ctaggcaataacccagggaa

SEQ ID NO: 207119 - DNA, 20 bp, Artificial Sequence
  Description of Artificial Sequence: Synthetic oligonucleotide
  Target: ATXN1; (-) strand; PAM type: YTN; PAM sequence: TTC
atagacccattcctaggcaa

SEQ ID NO: 207120 - DNA, 20 bp, Artificial Sequence
  Description of Artificial Sequence: Synthetic oligonucleotide
  Target: ATXN1; (-) strand; PAM type: YTN; PAM sequence: TTA
acagtgaatattcatagacc

SEQ ID NO: 207121 - DNA, 20 bp, Artificial Sequence
  Description of Artificial Sequence: Synthetic oligonucleotide
  Target: ATXN1; (-) strand; PAM type: YTN; PAM sequence: TTT
aacagtgaatattcatagac

SEQ ID NO: 207122 - DNA, 20 bp, Artificial Sequence
  Description of Artificial Sequence: Synthetic oligonucleotide
  Target: ATXN1; (-) strand; PAM type: YTN; PAM sequence: TTG
tttaacagtgaatattcata

SEQ ID NO: 207123 - DNA, 20 bp, Artificial Sequence
  Description of Artificial Sequence: Synthetic oligonucleotide
  Target: ATXN1; (-) strand; PAM type: YTN; PAM sequence: CTA
ttgtttaacagtgaatattc

SEQ ID NO: 207124 - DNA, 20 bp, Artificial Sequence
  Description of Artificial Sequence: Synthetic oligonucleotide
  Target: ATXN1; (-) strand; PAM type: YTN; PAM sequence: TTG
gcactattgtttaacagtga

SEQ ID NO: 207125 - DNA, 20 bp, Artificial Sequence
  Description of Artificial Sequence: Synthetic oligonucleotide
  Target: ATXN1; (-) strand; PAM type: YTN; PAM sequence: TTT
ggcactattgtttaacagtg

SEQ ID NO: 207126 - DNA, 20 bp, Artificial Sequence
  Description of Artificial Sequence: Synthetic oligonucleotide
  Target: ATXN1; (-) strand; PAM type: YTN; PAM sequence: TTG
ggaaagcaatttggcactat

SEQ ID NO: 207127 - DNA, 20 bp, Artificial Sequence
  Description of Artificial Sequence: Synthetic oligonucleotide
  Target: ATXN1; (-) strand; PAM type: YTN; PAM sequence: TTT
gggaaagcaatttggcacta

SEQ ID NO: 207128 - DNA, 20 bp, Artificial Sequence
  Description of Artificial Sequence: Synthetic oligonucleotide
  Target: ATXN1; (-) strand; PAM type: YTN; PAM sequence: TTG
atatagtcatttgggaaagc

SEQ ID NO: 207129 - DNA, 20 bp, Artificial Sequence
  Description of Artificial Sequence: Synthetic oligonucleotide
  Target: ATXN1; (-) strand; PAM type: YTN; PAM sequence: CTG
gtgggagtgtaggttgatat

SEQ ID NO: 207130 - DNA, 20 bp, Artificial Sequence
  Description of Artificial Sequence: Synthetic oligonucleotide
  Target: ATXN1; (-) strand; PAM type: YTN; PAM sequence: CTG
ctggtgggagtgtaggttga

SEQ ID NO: 207131 - DNA, 20 bp, Artificial Sequence
  Description of Artificial Sequence: Synthetic oligonucleotide
  Target: ATXN1; (-) strand; PAM type: YTN; PAM sequence: TTA
aaaaatggtggggtgcactg

SEQ ID NO: 207132 - DNA, 20 bp, Artificial Sequence
  Description of Artificial Sequence: Synthetic oligonucleotide
  Target: ATXN1; (-) strand; PAM type: YTN; PAM sequence: TTT
aaaaaatggtggggtgcact

SEQ ID NO: 207133 - DNA, 20 bp, Artificial Sequence
  Description of Artificial Sequence: Synthetic oligonucleotide
  Target: ATXN1; (-) strand; PAM type: YTN; PAM sequence: TTT
taaaaaatggtggggtgcac

SEQ ID NO: 207134 - DNA, 20 bp, Artificial Sequence
  Description of Artificial Sequence: Synthetic oligonucleotide
  Target: ATXN1; (-) strand; PAM type: YTN; PAM sequence: TTA
tcagttttaaaaaatggtgg

SEQ ID NO: 207135 - DNA, 20 bp, Artificial Sequence
  Description of Artificial Sequence: Synthetic oligonucleotide
  Target: ATXN1; (-) strand; PAM type: YTN; PAM sequence: TTT
atcagttttaaaaaatggtg

SEQ ID NO: 207136 - DNA, 20 bp, Artificial Sequence
  Description of Artificial Sequence: Synthetic oligonucleotide
  Target: ATXN1; (-) strand; PAM type: YTN; PAM sequence: CTG
aaatgatttatcagttttaa

SEQ ID NO: 207137 - DNA, 20 bp, Artificial Sequence
  Description of Artificial Sequence: Synthetic oligonucleotide
  Target: ATXN1; (-) strand; PAM type: YTN; PAM sequence: TTC
tgaaatgatttatcagtttt

SEQ ID NO: 207138 - DNA, 20 bp, Artificial Sequence
  Description of Artificial Sequence: Synthetic oligonucleotide
  Target: ATXN1; (-) strand; PAM type: YTN; PAM sequence: TTG
attctgaaatgatttatcag

SEQ ID NO: 207139 - DNA, 20 bp, Artificial Sequence
  Description of Artificial Sequence: Synthetic oligonucleotide
  Target: ATXN1; (-) strand; PAM type: YTN; PAM sequence: CTT
gattctgaaatgatttatca

SEQ ID NO: 207140 - DNA, 20 bp, Artificial Sequence
  Description of Artificial Sequence: Synthetic oligonucleotide
  Target: ATXN1; (-) strand; PAM type: YTN; PAM sequence: TTC
ttgattctgaaatgatttat

SEQ ID NO: 207141 - DNA, 20 bp, Artificial Sequence
  Description of Artificial Sequence: Synthetic oligonucleotide
  Target: ATXN1; (-) strand; PAM type: YTN; PAM sequence: TTT
cttgattctgaaatgattta

SEQ ID NO: 207142 - DNA, 20 bp, Artificial Sequence
  Description of Artificial Sequence: Synthetic oligonucleotide
  Target: ATXN1; (-) strand; PAM type: YTN; PAM sequence: CTT
tcttgattctgaaatgattt

SEQ ID NO: 207143 - DNA, 20 bp, Artificial Sequence
  Description of Artificial Sequence: Synthetic oligonucleotide
  Target: ATXN1; (-) strand; PAM type: YTN; PAM sequence: CTC
tttcttgattctgaaatgat

SEQ ID NO: 207144 - DNA, 20 bp, Artificial Sequence
  Description of Artificial Sequence: Synthetic oligonucleotide
  Target: ATXN1; (-) strand; PAM type: YTN; PAM sequence: TTC
agcacaaatagatctctttc

SEQ ID NO: 207145 - DNA, 20 bp, Artificial Sequence
  Description of Artificial Sequence: Synthetic oligonucleotide
  Target: ATXN1; (-) strand; PAM type: YTN; PAM sequence: CTT
cagcacaaatagatctcttt

SEQ ID NO: 207146 - DNA, 20 bp, Artificial Sequence
  Description of Artificial Sequence: Synthetic oligonucleotide
  Target: ATXN1; (-) strand; PAM type: YTN; PAM sequence: CTG
taacaccaacttcagcacaa

SEQ ID NO: 207147 - DNA, 20 bp, Artificial Sequence
  Description of Artificial Sequence: Synthetic oligonucleotide
  Target: ATXN1; (-) strand; PAM type: YTN; PAM sequence: TTG
agcctgtaacaccaacttca

SEQ ID NO: 207148 - DNA, 20 bp, Artificial Sequence
  Description of Artificial Sequence: Synthetic oligonucleotide
  Target: ATXN1; (-) strand; PAM type: YTN; PAM sequence: TTT
gagcctgtaacaccaacttc

SEQ ID NO: 207149 - DNA, 20 bp, Artificial Sequence
  Description of Artificial Sequence: Synthetic oligonucleotide
  Target: ATXN1; (-) strand; PAM type: YTN; PAM sequence: CTC
aaaaaataaataaataaaaa

SEQ ID NO: 207150 - DNA, 20 bp, Artificial Sequence
  Description of Artificial Sequence: Synthetic oligonucleotide
  Target: ATXN1; (-) strand; PAM type: YTN; PAM sequence: CTC
cgtctcaaaaaataaataaa

SEQ ID NO: 207151 - DNA, 20 bp, Artificial Sequence
  Description of Artificial Sequence: Synthetic oligonucleotide
  Target: ATXN1; (-) strand; PAM type: YTN; PAM sequence: CTG
gcgacagaatgagactccgt

SEQ ID NO: 207152 - DNA, 20 bp, Artificial Sequence
  Description of Artificial Sequence: Synthetic oligonucleotide
  Target: ATXN1; (-) strand; PAM type: YTN; PAM sequence: CTC
cagcctggcgacagaatgag

SEQ ID NO: 207153 - DNA, 20 bp, Artificial Sequence
  Description of Artificial Sequence: Synthetic oligonucleotide
  Target: ATXN1; (-) strand; PAM type: YTN; PAM sequence: CTG
cactccagcctggcgacaga

SEQ ID NO: 207154 - DNA, 20 bp, Artificial Sequence
  Description of Artificial Sequence: Synthetic oligonucleotide
  Target: ATXN1; (-) strand; PAM type: YTN; PAM sequence: CTG
tagtgagccgagatcgtgcc

SEQ ID NO: 207155 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggtggaggctg

SEQ ID NO: 207156 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggtggaggct

SEQ ID NO: 207157 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcacttgaa

SEQ ID NO: 207158 - DNA, 20 bp, Artificial Sequence
  Description of Artificial Sequence: Synthetic oligonucleotide
  Target: ATXN1; (-) strand; PAM type: YTN; PAM sequence: CTC
gggaggctgaggcaggagaa

SEQ ID NO: 207159 - DNA, 20 bp, Artificial Sequence
  Description of Artificial Sequence: Synthetic oligonucleotide
  Target: ATXN1; (-) strand; PAM type: YTN; PAM sequence: CTG
tagtcccagatactcgggag

SEQ ID NO: 207160 - DNA, 20 bp, Artificial Sequence
  Description of Artificial Sequence: Synthetic oligonucleotide
  Target: ATXN1; (-) strand; PAM type: YTN; PAM sequence: TTA
ggtgggggtggtggtgcgca

SEQ ID NO: 207161 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattaggtgg

SEQ ID NO: 207162 - DNA, 20 bp, Artificial Sequence
  Description of Artificial Sequence: Synthetic oligonucleotide
  Target: ATXN1; (-) strand; PAM type: YTN; PAM sequence: TTC
taaaaatacaaaaattaggt

SEQ ID NO: 207163 - DNA, 20 bp, Artificial Sequence
  Description of Artificial Sequence: Synthetic oligonucleotide
  Target: ATXN1; (-) strand; PAM type: YTN; PAM sequence: CTT
ctaaaaatacaaaaattagg

SEQ ID NO: 207164 - DNA, 20 bp, Artificial Sequence
  Description of Artificial Sequence: Synthetic oligonucleotide
  Target: ATXN1; (-) strand; PAM type: YTN; PAM sequence: CTC
ttctaaaaatacaaaaatta

SEQ ID NO: 207165 - DNA, 20 bp, Artificial Sequence
  Description of Artificial Sequence: Synthetic oligonucleotide
  Target: ATXN1; (-) strand; PAM type: YTN; PAM sequence: CTC
gtctcttctaaaaatacaaa

SEQ ID NO: 207166 - DNA, 20 bp, Artificial Sequence
  Description of Artificial Sequence: Synthetic oligonucleotide
  Target: ATXN1; (-) strand; PAM type: YTN; PAM sequence: CTG
gccaacatagtgaaacctcg

SEQ ID NO: 207167 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcaggcggat

SEQ ID NO: 207168 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaggcaggcgga

SEQ ID NO: 207169 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaggcaggcgg

SEQ ID NO: 207170 - DNA, 20 bp, Artificial Sequence
  Description of Artificial Sequence: Synthetic oligonucleotide
  Target: ATXN1; (-) strand; PAM type: YTN; PAM sequence: CTG
taatcccagcactttgggag

SEQ ID NO: 207171 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatcccagcact

SEQ ID NO: 207172 - DNA, 20 bp, Artificial Sequence
  Description of Artificial Sequence: Synthetic oligonucleotide
  Target: ATXN1; (-) strand; PAM type: YTN; PAM sequence: CTG
ggcacggtggctcacgcctg

SEQ ID NO: 207173 - DNA, 20 bp, Artificial Sequence
  Description of Artificial Sequence: Synthetic oligonucleotide
  Target: ATXN1; (-) strand; PAM type: YTN; PAM sequence: CTG
taggctgggcacggtggctc

SEQ ID NO: 207174 - DNA, 20 bp, Artificial Sequence
  Description of Artificial Sequence: Synthetic oligonucleotide
  Target: ATXN1; (-) strand; PAM type: YTN; PAM sequence: TTG
agcctgtaggctgggcacgg

SEQ ID NO: 207175 - DNA, 20 bp, Artificial Sequence
  Description of Artificial Sequence: Synthetic oligonucleotide
  Target: ATXN1; (-) strand; PAM type: YTN; PAM sequence: TTT
gagcctgtaggctgggcacg

SEQ ID NO: 207176 - DNA, 20 bp, Artificial Sequence
  Description of Artificial Sequence: Synthetic oligonucleotide
  Target: ATXN1; (-) strand; PAM type: YTN; PAM sequence: TTA
gaatttgagcctgtaggctg

SEQ ID NO: 207177 - DNA, 20 bp, Artificial Sequence
  Description of Artificial Sequence: Synthetic oligonucleotide
  Target: ATXN1; (-) strand; PAM type: YTN; PAM sequence: TTT
agaatttgagcctgtaggct

SEQ ID NO: 207178 - DNA, 20 bp, Artificial Sequence
  Description of Artificial Sequence: Synthetic oligonucleotide
  Target: ATXN1; (-) strand; PAM type: YTN; PAM sequence: TTA
tggatatttagaatttgagc

SEQ ID NO: 207179 - DNA, 20 bp, Artificial Sequence
  Description of Artificial Sequence: Synthetic oligonucleotide
  Target: ATXN1; (-) strand; PAM type: YTN; PAM sequence: TTT
atggatatttagaatttgag

SEQ ID NO: 207180 - DNA, 20 bp, Artificial Sequence
  Description of Artificial Sequence: Synthetic oligonucleotide
  Target: ATXN1; (-) strand; PAM type: YTN; PAM sequence: CTT
tatggatatttagaatttga

SEQ ID NO: 207181 - DNA, 20 bp, Artificial Sequence
  Description of Artificial Sequence: Synthetic oligonucleotide
  Target: ATXN1; (-) strand; PAM type: YTN; PAM sequence: TTC
tttatggatatttagaattt

SEQ ID NO: 207182 - DNA, 20 bp, Artificial Sequence
  Description of Artificial Sequence: Synthetic oligonucleotide
  Target: ATXN1; (-) strand; PAM type: YTN; PAM sequence: TTT
ctttatggatatttagaatt

SEQ ID NO: 207183 - DNA, 20 bp, Artificial Sequence
  Description of Artificial Sequence: Synthetic oligonucleotide
  Target: ATXN1; (-) strand; PAM type: YTN; PAM sequence: TTA
tttctttatggatatttaga

SEQ ID NO: 207184 - DNA, 20 bp, Artificial Sequence
  Description of Artificial Sequence: Synthetic oligonucleotide
  Target: ATXN1; (-) strand; PAM type: YTN; PAM sequence: CTT
atttctttatggatatttag

SEQ ID NO: 207185 - DNA, 20 bp, Artificial Sequence
  Description of Artificial Sequence: Synthetic oligonucleotide
  Target: ATXN1; (-) strand; PAM type: YTN; PAM sequence: CTC
accaatgtgagagacaggga

SEQ ID NO: 207186 - DNA, 20 bp, Artificial Sequence
  Description of Artificial Sequence: Synthetic oligonucleotide
  Target: ATXN1; (-) strand; PAM type: YTN; PAM sequence: CTG
aacaaagtataaactcacca

SEQ ID NO: 207187 - DNA, 20 bp, Artificial Sequence
  Description of Artificial Sequence: Synthetic oligonucleotide
  Target: ATXN1; (-) strand; PAM type: YTN; PAM sequence: TTA
gtgctgaacaaagtataaac

SEQ ID NO: 207188 - DNA, 20 bp, Artificial Sequence
  Description of Artificial Sequence: Synthetic oligonucleotide
  Target: ATXN1; (-) strand; PAM type: YTN; PAM sequence: CTT
agtgctgaacaaagtataaa

SEQ ID NO: 207189 - DNA, 20 bp, Artificial Sequence
  Description of Artificial Sequence: Synthetic oligonucleotide
  Target: ATXN1; (-) strand; PAM type: YTN; PAM sequence: TTA
tgcttagtgctgaacaaagt

SEQ ID NO: 207190 - DNA, 20 bp, Artificial Sequence
  Description of Artificial Sequence: Synthetic oligonucleotide
  Target: ATXN1; (-) strand; PAM type: YTN; PAM sequence: TTG
ttatgcttagtgctgaacaa

SEQ ID NO: 207191 - DNA, 20 bp, Artificial Sequence
  Description of Artificial Sequence: Synthetic oligonucleotide
  Target: ATXN1; (-) strand; PAM type: YTN; PAM sequence: TTT
gttatgcttagtgctgaaca

SEQ ID NO: 207192 - DNA, 20 bp, Artificial Sequence
  Description of Artificial Sequence: Synthetic oligonucleotide
  Target: ATXN1; (-) strand; PAM type: YTN; PAM sequence: CTC
gtttgttatgcttagtgctg

SEQ ID NO: 207193 - DNA, 20 bp, Artificial Sequence
  Description of Artificial Sequence: Synthetic oligonucleotide
  Target: ATXN1; (-) strand; PAM type: YTN; PAM sequence: CTC
tcgtttgttatgcttagtgc

SEQ ID NO: 207194 - DNA, 20 bp, Artificial Sequence
  Description of Artificial Sequence: Synthetic oligonucleotide
  Target: ATXN1; (-) strand; PAM type: YTN; PAM sequence: TTA
cgaagtaactctcgtttgtt

SEQ ID NO: 207195 - DNA, 20 bp, Artificial Sequence
  Description of Artificial Sequence: Synthetic oligonucleotide
  Target: ATXN1; (-) strand; PAM type: YTN; PAM sequence: CTT
acgaagtaactctcgtttgt

SEQ ID NO: 207196 - DNA, 20 bp, Artificial Sequence
  Description of Artificial Sequence: Synthetic oligonucleotide
  Target: ATXN1; (-) strand; PAM type: YTN; PAM sequence: TTG
aaggtggtaaagtaaccgtc

SEQ ID NO: 207197 - DNA, 20 bp, Artificial Sequence
  Description of Artificial Sequence: Synthetic oligonucleotide
  Target: ATXN1; (-) strand; PAM type: YTN; PAM sequence: TTT
gaaggtggtaaagtaaccgt

SEQ ID NO: 207198 - DNA, 20 bp, Artificial Sequence
  Description of Artificial Sequence: Synthetic oligonucleotide
  Target: ATXN1; (-) strand; PAM type: YTN; PAM sequence: TTA
atgccatgtttgaaggtggt

SEQ ID NO: 207199 - DNA, 20 bp, Artificial Sequence
  Description of Artificial Sequence: Synthetic oligonucleotide
  Target: ATXN1; (-) strand; PAM type: YTN; PAM sequence: TTA
gttaatgccatgtttgaagg

SEQ ID NO: 207200 - DNA, 20 bp, Artificial Sequence
  Description of Artificial Sequence: Synthetic oligonucleotide
  Target: ATXN1; (-) strand; PAM type: YTN; PAM sequence: CTA
agtcattagttaatgccatg

SEQ ID NO: 207201 - DNA, 20 bp, Artificial Sequence
  Description of Artificial Sequence: Synthetic oligonucleotide
  Target: ATXN1; (-) strand; PAM type: YTN; PAM sequence: CTC
agtccaatctaagtcattag

SEQ ID NO: 207202 - DNA, 20 bp, Artificial Sequence
  Description of Artificial Sequence: Synthetic oligonucleotide
  Target: ATXN1; (-) strand; PAM type: YTN; PAM sequence: TTA
accctcagtccaatctaagt

SEQ ID NO: 207203 - DNA, 20 bp, Artificial Sequence
  Description of Artificial Sequence: Synthetic oligonucleotide
  Target: ATXN1; (-) strand; PAM type: YTN; PAM sequence: TTA
ttaaccctcagtccaatcta

SEQ ID NO: 207204 - DNA, 20 bp, Artificial Sequence
  Description of Artificial Sequence: Synthetic oligonucleotide
  Target: ATXN1; (-) strand; PAM type: YTN; PAM sequence: TTC
aaattattaaccctcagtcc

SEQ ID NO: 207205 - DNA, 20 bp, Artificial Sequence
  Description of Artificial Sequence: Synthetic oligonucleotide
  Target: ATXN1; (-) strand; PAM type: YTN; PAM sequence: CTT
caaattattaaccctcagtc

SEQ ID NO: 207206 - DNA, 20 bp, Artificial Sequence
  Description of Artificial Sequence: Synthetic oligonucleotide
  Target: ATXN1; (-) strand; PAM type: YTN; PAM sequence: CTA
ggaaagaaggtcatggggag

SEQ ID NO: 207207 - DNA, 20 bp, Artificial Sequence
  Description of Artificial Sequence: Synthetic oligonucleotide
  Target: ATXN1; (-) strand; PAM type: YTN; PAM sequence: TTG
aatgactaggaaagaaggtc

SEQ ID NO: 207208 - DNA, 20 bp, Artificial Sequence
  Description of Artificial Sequence: Synthetic oligonucleotide
  Target: ATXN1; (-) strand; PAM type: YTN; PAM sequence: TTA
agaattgaatgactaggaaa

SEQ ID NO: 207209 - DNA, 20 bp, Artificial Sequence
  Description of Artificial Sequence: Synthetic oligonucleotide
  Target: ATXN1; (-) strand; PAM type: YTN; PAM sequence: CTT
aagaattgaatgactaggaa

SEQ ID NO: 207210 - DNA, 20 bp, Artificial Sequence
  Description of Artificial Sequence: Synthetic oligonucleotide
  Target: ATXN1; (-) strand; PAM type: YTN; PAM sequence: TTG
cttaagaattgaatgactag

SEQ ID NO: 207211 - DNA, 20 bp, Artificial Sequence
  Description of Artificial Sequence: Synthetic oligonucleotide
  Target: ATXN1; (-) strand; PAM type: YTN; PAM sequence: CTT
gcttaagaattgaatgacta

SEQ ID NO: 207212 - DNA, 20 bp, Artificial Sequence
  Description of Artificial Sequence: Synthetic oligonucleotide
  Target: ATXN1; (-) strand; PAM type: YTN; PAM sequence: TTG
gtatccaccttgcttaagaa

SEQ ID NO: 207213 - DNA, 20 bp, Artificial Sequence
  Description of Artificial Sequence: Synthetic oligonucleotide
  Target: ATXN1; (-) strand; PAM type: YTN; PAM sequence: TTT
ggtatccaccttgcttaaga

SEQ ID NO: 207214 - DNA, 20 bp, Artificial Sequence
  Description of Artificial Sequence: Synthetic oligonucleotide
  Target: ATXN1; (-) strand; PAM type: YTN; PAM sequence: TTT
tggtatccaccttgcttaag

SEQ ID NO: 207215 - DNA, 20 bp, Artificial Sequence
  Description of Artificial Sequence: Synthetic oligonucleotide
  Target: ATXN1; (-) strand; PAM type: YTN; PAM sequence: CTT
ttggtatccaccttgcttaa

SEQ ID NO: 207216 - DNA, 20 bp, Artificial Sequence
  Description of Artificial Sequence: Synthetic oligonucleotide
  Target: ATXN1; (-) strand; PAM type: YTN; PAM sequence: TTG
gacacttttggtatccacct

SEQ ID NO: 207217 - DNA, 20 bp, Artificial Sequence
  Description of Artificial Sequence: Synthetic oligonucleotide
  Target: ATXN1; (-) strand; PAM type: YTN; PAM sequence: TTT
ggacacttttggtatccacc

SEQ ID NO: 207218 - DNA, 20 bp, Artificial Sequence
  Description of Artificial Sequence: Synthetic oligonucleotide
  Target: ATXN1; (-) strand; PAM type: YTN; PAM sequence: TTT
tggacacttttggtatccac

SEQ ID NO: 207219 - DNA, 20 bp, Artificial Sequence
  Description of Artificial Sequence: Synthetic oligonucleotide
  Target: ATXN1; (-) strand; PAM type: YTN; PAM sequence: TTT
ttggacacttttggtatcca

SEQ ID NO: 207220 - DNA, 20 bp, Artificial Sequence
  Description of Artificial Sequence: Synthetic oligonucleotide
  Target: ATXN1; (-) strand; PAM type: YTN; PAM sequence: CTA
gggcatttttggacactttt

SEQ ID NO: 207221 - DNA, 20 bp, Artificial Sequence
  Description of Artificial Sequence: Synthetic oligonucleotide
  Target: ATXN1; (-) strand; PAM type: YTN; PAM sequence: TTC
atgtacgctagggcattttt

SEQ ID NO: 207222 - DNA, 20 bp, Artificial Sequence
  Description of Artificial Sequence: Synthetic oligonucleotide
  Target: ATXN1; (-) strand; PAM type: YTN; PAM sequence: CTT
catgtacgctagggcatttt

SEQ ID NO: 207223 - DNA, 20 bp, Artificial Sequence
  Description of Artificial Sequence: Synthetic oligonucleotide
  Target: ATXN1; (-) strand; PAM type: YTN; PAM sequence: CTG
gcacttcatgtacgctaggg

SEQ ID NO: 207224 - DNA, 20 bp, Artificial Sequence
  Description of Artificial Sequence: Synthetic oligonucleotide
  Target: ATXN1; (-) strand; PAM type: YTN; PAM sequence: TTG
gcccctggcacttcatgtac

SEQ ID NO: 207225 - DNA, 20 bp, Artificial Sequence
  Description of Artificial Sequence: Synthetic oligonucleotide
  Target: ATXN1; (-) strand; PAM type: YTN; PAM sequence: TTT
ggcccctggcacttcatgta

SEQ ID NO: 207226 - DNA, 20 bp, Artificial Sequence
  Description of Artificial Sequence: Synthetic oligonucleotide
  Target: ATXN1; (-) strand; PAM type: YTN; PAM sequence: TTT
tggcccctggcacttcatgt

SEQ ID NO: 207227 - DNA, 20 bp, Artificial Sequence
  Description of Artificial Sequence: Synthetic oligonucleotide
  Target: ATXN1; (-) strand; PAM type: YTN; PAM sequence: CTA
agtgggtggttttggcccct

SEQ ID NO: 207228 - DNA, 20 bp, Artificial Sequence
  Description of Artificial Sequence: Synthetic oligonucleotide
  Target: ATXN1; (-) strand; PAM type: YTN; PAM sequence: TTC
taagtgggtggttttggccc

SEQ ID NO: 207229 - DNA, 20 bp, Artificial Sequence
  Description of Artificial Sequence: Synthetic oligonucleotide
  Target: ATXN1; (-) strand; PAM type: YTN; PAM sequence: CTG
ttctaagtgggtggttttgg

SEQ ID NO: 207230 - DNA, 20 bp, Artificial Sequence
  Description of Artificial Sequence: Synthetic oligonucleotide
  Target: ATXN1; (-) strand; PAM type: YTN; PAM sequence: TTC
ctgttctaagtgggtggttt

SEQ ID NO: 207231 - DNA, 20 bp, Artificial Sequence
  Description of Artificial Sequence: Synthetic oligonucleotide
  Target: ATXN1; (-) strand; PAM type: YTN; PAM sequence: TTT
cctgttctaagtgggtggtt

SEQ ID NO: 207232 - DNA, 20 bp, Artificial Sequence
  Description of Artificial Sequence: Synthetic oligonucleotide
  Target: ATXN1; (-) strand; PAM type: YTN; PAM sequence: TTG
tacatgatttcctgttctaa

SEQ ID NO: 207233 - DNA, 20 bp, Artificial Sequence
  Description of Artificial Sequence: Synthetic oligonucleotide
  Target: ATXN1; (-) strand; PAM type: YTN; PAM sequence: TTT
gtacatgatttcctgttcta

SEQ ID NO: 207234 - DNA, 20 bp, Artificial Sequence
  Description of Artificial Sequence: Synthetic oligonucleotide
  Target: ATXN1; (-) strand; PAM type: YTN; PAM sequence: TTA
tatttgtacatgatttcctg

SEQ ID NO: 207235 - DNA, 20 bp, Artificial Sequence
  Description of Artificial Sequence: Synthetic oligonucleotide
  Target: ATXN1; (-) strand; PAM type: YTN; PAM sequence: CTT
atatttgtacatgatttcct

SEQ ID NO: 207236 - DNA, 20 bp, Artificial Sequence
  Description of Artificial Sequence: Synthetic oligonucleotide
  Target: ATXN1; (-) strand; PAM type: YTN; PAM sequence: TTG
aggtacttatatttgtacat

SEQ ID NO: 207237 - DNA, 20 bp, Artificial Sequence
  Description of Artificial Sequence: Synthetic oligonucleotide
  Target: ATXN1; (-) strand; PAM type: YTN; PAM sequence: CTT
gaggtacttatatttgtaca

SEQ ID NO: 207238 - DNA, 20 bp, Artificial Sequence
  Description of Artificial Sequence: Synthetic oligonucleotide
  Target: ATXN1; (-) strand; PAM type: YTN; PAM sequence: TTC
acaagcttgaggtacttata

SEQ ID NO: 207239 - DNA, 20 bp, Artificial Sequence
  Description of Artificial Sequence: Synthetic oligonucleotide
  Target: ATXN1; (-) strand; PAM type: YTN; PAM sequence: TTT
cacaagcttgaggtacttat

SEQ ID NO: 207240 - DNA, 20 bp, Artificial Sequence
  Description of Artificial Sequence: Synthetic oligonucleotide
  Target: ATXN1; (-) strand; PAM type: YTN; PAM sequence: CTC
aatttcacaagcttgaggta

SEQ ID NO: 207241 - DNA, 20 bp, Artificial Sequence
  Description of Artificial Sequence: Synthetic oligonucleotide
  Target: ATXN1; (-) strand; PAM type: YTN; PAM sequence: CTC
tcaatttcacaagcttgagg

SEQ ID NO: 207242 - DNA, 20 bp, Artificial Sequence
  Description of Artificial Sequence: Synthetic oligonucleotide
  Target: ATXN1; (-) strand; PAM type: YTN; PAM sequence: CTA
atagtgaaggaaataaagaa

SEQ ID NO: 207243 - DNA, 20 bp, Artificial Sequence
  Description of Artificial Sequence: Synthetic oligonucleotide
  Target: ATXN1; (-) strand; PAM type: YTN; PAM sequence: TTC
taatagtgaaggaaataaag

SEQ ID NO: 207244 - DNA, 20 bp, Artificial Sequence
  Description of Artificial Sequence: Synthetic oligonucleotide
  Target: ATXN1; (-) strand; PAM type: YTN; PAM sequence: CTT
ctaatagtgaaggaaataaa

SEQ ID NO: 207245 - DNA, 20 bp, Artificial Sequence
  Description of Artificial Sequence: Synthetic oligonucleotide
  Target: ATXN1; (-) strand; PAM type: YTN; PAM sequence: CTG
cttctaatagtgaaggaaat

SEQ ID NO: 207246 - DNA, 20 bp, Artificial Sequence
  Description of Artificial Sequence: Synthetic oligonucleotide
  Target: ATXN1; (-) strand; PAM type: YTN; PAM sequence: CTC
tgcttctaatagtgaaggaa

SEQ ID NO: 207247 - DNA, 20 bp, Artificial Sequence
  Description of Artificial Sequence: Synthetic oligonucleotide
  Target: ATXN1; (-) strand; PAM type: YTN; PAM sequence: TTC
ctctgcttctaatagtgaag

SEQ ID NO: 207248 - DNA, 20 bp, Artificial Sequence
  Description of Artificial Sequence: Synthetic oligonucleotide
  Target: ATXN1; (-) strand; PAM type: YTN; PAM sequence: CTT
cctctgcttctaatagtgaa

SEQ ID NO: 207249 - DNA, 20 bp, Artificial Sequence
  Description of Artificial Sequence: Synthetic oligonucleotide
  Target: ATXN1; (-) strand; PAM type: YTN; PAM sequence: CTC
ttcctctgcttctaatagtg

SEQ ID NO: 207250 - DNA, 20 bp, Artificial Sequence
  Description of Artificial Sequence: Synthetic oligonucleotide
  Target: ATXN1; (-) strand; PAM type: YTN; PAM sequence: CTC
tcttcctctgcttctaatag

SEQ ID NO: 207251 - DNA, 20 bp, Artificial Sequence
  Description of Artificial Sequence: Synthetic oligonucleotide
  Target: ATXN1; (-) strand; PAM type: YTN; PAM sequence: CTA
atcagccctctcttcctctg

SEQ ID NO: 207252 - DNA, 20 bp, Artificial Sequence
  Description of Artificial Sequence: Synthetic oligonucleotide
  Target: ATXN1; (-) strand; PAM type: YTN; PAM sequence: TTC
cccccatctaatcagccctc

SEQ ID NO: 207253 - DNA, 20 bp, Artificial Sequence
  Description of Artificial Sequence: Synthetic oligonucleotide
  Target: ATXN1; (-) strand; PAM type: YTN; PAM sequence: CTT
ccccccatctaatcagccct

SEQ ID NO: 207254 - DNA, 20 bp, Artificial Sequence
  Description of Artificial Sequence: Synthetic oligonucleotide
  Target: ATXN1; (-) strand; PAM type: YTN; PAM sequence: CTA
agccttccccccatctaatc

SEQ ID NO: 207255 - DNA, 20 bp, Artificial Sequence
  Description of Artificial Sequence: Synthetic oligonucleotide
  Target: ATXN1; (-) strand; PAM type: YTN; PAM sequence: TTA
aaataaaagctaagccttcc

SEQ ID NO: 207256 - DNA, 20 bp, Artificial Sequence
  Description of Artificial Sequence: Synthetic oligonucleotide
  Target: ATXN1; (-) strand; PAM type: YTN; PAM sequence: TTT
aaaataaaagctaagccttc

SEQ ID NO: 207257 - DNA, 20 bp, Artificial Sequence
  Description of Artificial Sequence: Synthetic oligonucleotide
  Target: ATXN1; (-) strand; PAM type: YTN; PAM sequence: TTT
taaaataaaagctaagcctt

SEQ ID NO: 207258 - DNA, 20 bp, Artificial Sequence
  Description of Artificial Sequence: Synthetic oligonucleotide
  Target: ATXN1; (-) strand; PAM type: YTN; PAM sequence: CTA
ttttaaaataaaagctaagc

SEQ ID NO: 207259 - DNA, 20 bp, Artificial Sequence
  Description of Artificial Sequence: Synthetic oligonucleotide
  Target: ATXN1; (-) strand; PAM type: YTN; PAM sequence: TTG
ctattttaaaataaaagcta

SEQ ID NO: 207260 - DNA, 20 bp, Artificial Sequence
  Description of Artificial Sequence: Synthetic oligonucleotide
  Target: ATXN1; (-) strand; PAM type: YTN; PAM sequence: TTT
gctattttaaaataaaagct

SEQ ID NO: 207261 - DNA, 20 bp, Artificial Sequence
  Description of Artificial Sequence: Synthetic oligonucleotide
  Target: ATXN1; (-) strand; PAM type: YTN; PAM sequence: TTT
tgctattttaaaataaaagc

SEQ ID NO: 207262 - DNA, 20 bp, Artificial Sequence
  Description of Artificial Sequence: Synthetic oligonucleotide
  Target: ATXN1; (-) strand; PAM type: YTN; PAM sequence: TTC
gattttgctattttaaaata

SEQ ID NO: 207263 - DNA, 20 bp, Artificial Sequence
  Description of Artificial Sequence: Synthetic oligonucleotide
  Target: ATXN1; (-) strand; PAM type: YTN; PAM sequence: TTT
cgattttgctattttaaaat

SEQ ID NO: 207264 - DNA, 20 bp, Artificial Sequence
  Description of Artificial Sequence: Synthetic oligonucleotide
  Target: ATXN1; (-) strand; PAM type: YTN; PAM sequence: TTT
tcgattttgctattttaaaa

SEQ ID NO: 207265 - DNA, 20 bp, Artificial Sequence
  Description of Artificial Sequence: Synthetic oligonucleotide
  Target: ATXN1; (-) strand; PAM type: YTN; PAM sequence: TTT
ttcgattttgctattttaaa

SEQ ID NO: 207266 - DNA, 20 bp, Artificial Sequence
  Description of Artificial Sequence: Synthetic oligonucleotide
  Target: ATXN1; (-) strand; PAM type: YTN; PAM sequence: TTA
caaagtttttcgattttgct

SEQ ID NO: 207267 - DNA, 20 bp, Artificial Sequence
  Description of Artificial Sequence: Synthetic oligonucleotide
  Target: ATXN1; (-) strand; PAM type: YTN; PAM sequence: CTA
attacaaagtttttcgattt

SEQ ID NO: 207268 - DNA, 20 bp, Artificial Sequence
  Description of Artificial Sequence: Synthetic oligonucleotide
  Target: ATXN1; (-) strand; PAM type: YTN; PAM sequence: CTG
gcaaaatctaattacaaagt

SEQ ID NO: 207269 - DNA, 20 bp, Artificial Sequence
  Description of Artificial Sequence: Synthetic oligonucleotide
  Target: ATXN1; (-) strand; PAM type: YTN; PAM sequence: CTA
agtctggcaaaatctaatta

SEQ ID NO: 207270 - DNA, 20 bp, Artificial Sequence
  Description of Artificial Sequence: Synthetic oligonucleotide
  Target: ATXN1; (-) strand; PAM type: YTN; PAM sequence: TTA
agcctaagtctggcaaaatc

SEQ ID NO: 207271 - DNA, 20 bp, Artificial Sequence
  Description of Artificial Sequence: Synthetic oligonucleotide
  Target: ATXN1; (-) strand; PAM type: YTN; PAM sequence: TTT
aagcctaagtctggcaaaat

SEQ ID NO: 207272 - DNA, 20 bp, Artificial Sequence
  Description of Artificial Sequence: Synthetic oligonucleotide
  Target: ATXN1; (-) strand; PAM type: YTN; PAM sequence: CTT
taagcctaagtctggcaaaa

SEQ ID NO: 207273 - DNA, 20 bp, Artificial Sequence
  Description of Artificial Sequence: Synthetic oligonucleotide
  Target: ATXN1; (-) strand; PAM type: YTN; PAM sequence: TTC
ctttaagcctaagtctggca

SEQ ID NO: 207274 - DNA, 20 bp, Artificial Sequence
  Description of Artificial Sequence: Synthetic oligonucleotide
  Target: ATXN1; (-) strand; PAM type: YTN; PAM sequence: TTT
cctttaagcctaagtctggc

SEQ ID NO: 207275 - DNA, 20 bp, Artificial Sequence
  Description of Artificial Sequence: Synthetic oligonucleotide
  Target: ATXN1; (-) strand; PAM type: YTN; PAM sequence: TTT
tcctttaagcctaagtctgg

SEQ ID NO: 207276 - DNA, 20 bp, Artificial Sequence
  Description of Artificial Sequence: Synthetic oligonucleotide
  Target: ATXN1; (-) strand; PAM type: YTN; PAM sequence: TTG
gagaggaaagaatcattttc

SEQ ID NO: 207277 - DNA, 20 bp, Artificial Sequence
  Description of Artificial Sequence: Synthetic oligonucleotide
  Target: ATXN1; (-) strand; PAM type: YTN; PAM sequence: TTT
ggagaggaaagaatcatttt

SEQ ID NO: 207278 - DNA, 20 bp, Artificial Sequence
  Description of Artificial Sequence: Synthetic oligonucleotide
  Target: ATXN1; (-) strand; PAM type: YTN; PAM sequence: TTT
tggagaggaaagaatcattt

SEQ ID NO: 207279 - DNA, 20 bp, Artificial Sequence
  Description of Artificial Sequence: Synthetic oligonucleotide
  Target: ATXN1; (-) strand; PAM type: YTN; PAM sequence: CTT
ttggagaggaaagaatcatt

SEQ ID NO: 207280 - DNA, 20 bp, Artificial Sequence
  Description of Artificial Sequence: Synthetic oligonucleotide
  Target: ATXN1; (-) strand; PAM type: YTN; PAM sequence: TTC
ttttggagaggaaagaatca

SEQ ID NO: 207281 - DNA, 20 bp, Artificial Sequence
  Description of Artificial Sequence: Synthetic oligonucleotide
  Target: ATXN1; (-) strand; PAM type: YTN; PAM sequence: TTA
ttcttttggagaggaaagaa

SEQ ID NO: 207282 - DNA, 20 bp, Artificial Sequence
  Description of Artificial Sequence: Synthetic oligonucleotide
  Target: ATXN1; (-) strand; PAM type: YTN; PAM sequence: CTT
attcttttggagaggaaaga

SEQ ID NO: 207283 - DNA, 20 bp, Artificial Sequence
  Description of Artificial Sequence: Synthetic oligonucleotide
  Target: ATXN1; (-) strand; PAM type: YTN; PAM sequence: CTG
accttattcttttggagagg

SEQ ID NO: 207284 - DNA, 20 bp, Artificial Sequence
  Description of Artificial Sequence: Synthetic oligonucleotide
  Target: ATXN1; (-) strand; PAM type: YTN; PAM sequence: CTC
tgaccttattcttttggaga

SEQ ID NO: 207285 - DNA, 20 bp, Artificial Sequence
  Description of Artificial Sequence: Synthetic oligonucleotide
  Target: ATXN1; (-) strand; PAM type: YTN; PAM sequence: TTA
ggctctgaccttattctttt

SEQ ID NO: 207286 - DNA, 20 bp, Artificial Sequence
  Description of Artificial Sequence: Synthetic oligonucleotide
  Target: ATXN1; (-) strand; PAM type: YTN; PAM sequence: CTT
aggctctgaccttattcttt

SEQ ID NO: 207287 - DNA, 20 bp, Artificial Sequence
  Description of Artificial Sequence: Synthetic oligonucleotide
  Target: ATXN1; (-) strand; PAM type: YTN; PAM sequence: TTG
ggagtcttaggctctgacct

SEQ ID NO: 207288 - DNA, 20 bp, Artificial Sequence
  Description of Artificial Sequence: Synthetic oligonucleotide
  Target: ATXN1; (-) strand; PAM type: YTN; PAM sequence: TTT
gggagtcttaggctctgacc

SEQ ID NO: 207289 - DNA, 20 bp, Artificial Sequence
  Description of Artificial Sequence: Synthetic oligonucleotide
  Target: ATXN1; (-) strand; PAM type: YTN; PAM sequence: TTG
agccaggaccaaaggtttgg

SEQ ID NO: 207290 - DNA, 20 bp, Artificial Sequence
  Description of Artificial Sequence: Synthetic oligonucleotide
  Target: ATXN1; (-) strand; PAM type: YTN; PAM sequence: TTT
gagccaggaccaaaggtttg

SEQ ID NO: 207291 - DNA, 20 bp, Artificial Sequence
  Description of Artificial Sequence: Synthetic oligonucleotide
  Target: ATXN1; (-) strand; PAM type: YTN; PAM sequence: CTT
tgagccaggaccaaaggttt

SEQ ID NO: 207292 - DNA, 20 bp, Artificial Sequence
  Description of Artificial Sequence: Synthetic oligonucleotide
  Target: ATXN1; (-) strand; PAM type: YTN; PAM sequence: CTC
accctttgagccaggaccaa

SEQ ID NO: 207293 - DNA, 20 bp, Artificial Sequence
  Description of Artificial Sequence: Synthetic oligonucleotide
  Target: ATXN1; (-) strand; PAM type: YTN; PAM sequence: TTC
gtagctcaccctttgagcca

SEQ ID NO: 207294 - DNA, 20 bp, Artificial Sequence
  Description of Artificial Sequence: Synthetic oligonucleotide
  Target: ATXN1; (-) strand; PAM type: YTN; PAM sequence: CTA
taggtatatgtaggaggatg

SEQ ID NO: 207295 - DNA, 20 bp, Artificial Sequence
  Description of Artificial Sequence: Synthetic oligonucleotide
  Target: ATXN1; (-) strand; PAM type: YTN; PAM sequence: CTC
atgcccagacagatctatag

SEQ ID NO: 207296 - DNA, 20 bp, Artificial Sequence
  Description of Artificial Sequence: Synthetic oligonucleotide
  Target: ATXN1; (-) strand; PAM type: YTN; PAM sequence: CTG
tactcatgcccagacagatc

SEQ ID NO: 207297 - DNA, 20 bp, Artificial Sequence
  Description of Artificial Sequence: Synthetic oligonucleotide
  Target: ATXN1; (-) strand; PAM type: YTN; PAM sequence: TTC
tgtactcatgcccagacaga

SEQ ID NO: 207298 - DNA, 20 bp, Artificial Sequence
  Description of Artificial Sequence: Synthetic oligonucleotide
  Target: ATXN1; (-) strand; PAM type: YTN; PAM sequence: TTG
ccaattctgtactcatgccc

SEQ ID NO: 207299 - DNA, 20 bp, Artificial Sequence
  Description of Artificial Sequence: Synthetic oligonucleotide
  Target: ATXN1; (-) strand; PAM type: YTN; PAM sequence: TTT
gccaattctgtactcatgcc

SEQ ID NO: 207300 - DNA, 20 bp, Artificial Sequence
  Description of Artificial Sequence: Synthetic oligonucleotide
  Target: ATXN1; (-) strand; PAM type: YTN; PAM sequence: CTG
tatttgccaattctgtactc

SEQ ID NO: 207301 - DNA, 20 bp, Artificial Sequence
  Description of Artificial Sequence: Synthetic oligonucleotide
  Target: ATXN1; (-) strand; PAM type: YTN; PAM sequence: CTC
ataccctgtatttgccaatt

SEQ ID NO: 207302 - DNA, 20 bp, Artificial Sequence
  Description of Artificial Sequence: Synthetic oligonucleotide
  Target: ATXN1; (-) strand; PAM type: YTN; PAM sequence: TTC
tcataccctgtatttgccaa

SEQ ID NO: 207303 - DNA, 20 bp, Artificial Sequence
  Description of Artificial Sequence: Synthetic oligonucleotide
  Target: ATXN1; (-) strand; PAM type: YTN; PAM sequence: CTT
ctcataccctgtatttgcca

SEQ ID NO: 207304 - DNA, 20 bp, Artificial Sequence
  Description of Artificial Sequence: Synthetic oligonucleotide
  Target: ATXN1; (-) strand; PAM type: YTN; PAM sequence: CTC
ttctcataccctgtatttgc

SEQ ID NO: 207305 - DNA, 20 bp, Artificial Sequence
  Description of Artificial Sequence: Synthetic oligonucleotide
  Target: ATXN1; (-) strand; PAM type: YTN; PAM sequence: TTG
tctcttctcataccctgtat

SEQ ID NO: 207306 - DNA, 20 bp, Artificial Sequence
  Description of Artificial Sequence: Synthetic oligonucleotide
  Target: ATXN1; (-) strand; PAM type: YTN; PAM sequence: TTA
tcgttgtctcttctcatacc

SEQ ID NO: 207307 - DNA, 20 bp, Artificial Sequence
  Description of Artificial Sequence: Synthetic oligonucleotide
  Target: ATXN1; (-) strand; PAM type: YTN; PAM sequence: TTT
atcgttgtctcttctcatac

SEQ ID NO: 207308 - DNA, 20 bp, Artificial Sequence
  Description of Artificial Sequence: Synthetic oligonucleotide
  Target: ATXN1; (-) strand; PAM type: YTN; PAM sequence: TTT
tatcgttgtctcttctcata

SEQ ID NO: 207309 - DNA, 20 bp, Artificial Sequence
  Description of Artificial Sequence: Synthetic oligonucleotide
  Target: ATXN1; (-) strand; PAM type: YTN; PAM sequence: CTG
tccgttttatcgttgtctct

SEQ ID NO: 207310 - DNA, 20 bp, Artificial Sequence
  Description of Artificial Sequence: Synthetic oligonucleotide
  Target: ATXN1; (-) strand; PAM type: YTN; PAM sequence: TTC
tgtccgttttatcgttgtct

SEQ ID NO: 207311 - DNA, 20 bp, Artificial Sequence
  Description of Artificial Sequence: Synthetic oligonucleotide
  Target: ATXN1; (-) strand; PAM type: YTN; PAM sequence: TTG
aacagtaccacattctgtcc

SEQ ID NO: 207312 - DNA, 20 bp, Artificial Sequence
  Description of Artificial Sequence: Synthetic oligonucleotide
  Target: ATXN1; (-) strand; PAM type: YTN; PAM sequence: TTT
gaacagtaccacattctgtc

SEQ ID NO: 207313 - DNA, 20 bp, Artificial Sequence
  Description of Artificial Sequence: Synthetic oligonucleotide
  Target: ATXN1; (-) strand; PAM type: YTN; PAM sequence: TTA
acatttgaacagtaccacat

SEQ ID NO: 207314 - DNA, 20 bp, Artificial Sequence
  Description of Artificial Sequence: Synthetic oligonucleotide
  Target: ATXN1; (-) strand; PAM type: YTN; PAM sequence: CTT
aacatttgaacagtaccaca

SEQ ID NO: 207315 - DNA, 20 bp, Artificial Sequence
  Description of Artificial Sequence: Synthetic oligonucleotide
  Target: ATXN1; (-) strand; PAM type: YTN; PAM sequence: TTC
ttaacatttgaacagtacca

SEQ ID NO: 207316 - DNA, 20 bp, Artificial Sequence
  Description of Artificial Sequence: Synthetic oligonucleotide
  Target: ATXN1; (-) strand; PAM type: YTN; PAM sequence: CTT
cttaacatttgaacagtacc

SEQ ID NO: 207317 - DNA, 20 bp, Artificial Sequence
  Description of Artificial Sequence: Synthetic oligonucleotide
  Target: ATXN1; (-) strand; PAM type: YTN; PAM sequence: CTG
acacttcttaacatttgaac

SEQ ID NO: 207318 - DNA, 20 bp, Artificial Sequence
  Description of Artificial Sequence: Synthetic oligonucleotide
  Target: ATXN1; (-) strand; PAM type: YTN; PAM sequence: TTC
ctgacacttcttaacatttg

SEQ ID NO: 207319 - DNA, 20 bp, Artificial Sequence
  Description of Artificial Sequence: Synthetic oligonucleotide
  Target: ATXN1; (-) strand; PAM type: YTN; PAM sequence: TTT
cctgacacttcttaacattt

SEQ ID NO: 207320 - DNA, 20 bp, Artificial Sequence
  Description of Artificial Sequence: Synthetic oligonucleotide
  Target: ATXN1; (-) strand; PAM type: YTN; PAM sequence: CTT
tcctgacacttcttaacatt

SEQ ID NO: 207321 - DNA, 20 bp, Artificial Sequence
  Description of Artificial Sequence: Synthetic oligonucleotide
  Target: ATXN1; (-) strand; PAM type: YTN; PAM sequence: CTG
tggtgctttcctgacacttc

SEQ ID NO: 207322 - DNA, 20 bp, Artificial Sequence
  Description of Artificial Sequence: Synthetic oligonucleotide
  Target: ATXN1; (-) strand; PAM type: YTN; PAM sequence: TTC
agcgtcagctgtggtgcttt

SEQ ID NO: 207323 - DNA, 20 bp, Artificial Sequence
  Description of Artificial Sequence: Synthetic oligonucleotide
  Target: ATXN1; (-) strand; PAM type: YTN; PAM sequence: CTT
cagcgtcagctgtggtgctt

SEQ ID NO: 207324 - DNA, 20 bp, Artificial Sequence
  Description of Artificial Sequence: Synthetic oligonucleotide
  Target: ATXN1; (-) strand; PAM type: YTN; PAM sequence: TTA
acttcagcgtcagctgtggt

SEQ ID NO: 207325 - DNA, 20 bp, Artificial Sequence
  Description of Artificial Sequence: Synthetic oligonucleotide
  Target: ATXN1; (-) strand; PAM type: YTN; PAM sequence: CTC
cagattaacttcagcgtcag

SEQ ID NO: 207326 - DNA, 20 bp, Artificial Sequence
  Description of Artificial Sequence: Synthetic oligonucleotide
  Target: ATXN1; (-) strand; PAM type: YTN; PAM sequence: TTC
ccctccagattaacttcagc

SEQ ID NO: 207327 - DNA, 20 bp, Artificial Sequence
  Description of Artificial Sequence: Synthetic oligonucleotide
  Target: ATXN1; (-) strand; PAM type: YTN; PAM sequence: TTA
gttcccctccagattaactt

SEQ ID NO: 207328 - DNA, 20 bp, Artificial Sequence
  Description of Artificial Sequence: Synthetic oligonucleotide
  Target: ATXN1; (-) strand; PAM type: YTN; PAM sequence: TTA
aagaaggtaaattagttccc

SEQ ID NO: 207329 - DNA, 20 bp, Artificial Sequence
  Description of Artificial Sequence: Synthetic oligonucleotide
  Target: ATXN1; (-) strand; PAM type: YTN; PAM sequence: TTG
tgttaaagaaggtaaattag

SEQ ID NO: 207330 - DNA, 20 bp, Artificial Sequence
  Description of Artificial Sequence: Synthetic oligonucleotide
  Target: ATXN1; (-) strand; PAM type: YTN; PAM sequence: CTT
gtgttaaagaaggtaaatta

SEQ ID NO: 207331 - DNA, 20 bp, Artificial Sequence
  Description of Artificial Sequence: Synthetic oligonucleotide
  Target: ATXN1; (-) strand; PAM type: YTN; PAM sequence: CTC
cacttgtgttaaagaaggta

SEQ ID NO: 207332 - DNA, 20 bp, Artificial Sequence
  Description of Artificial Sequence: Synthetic oligonucleotide
  Target: ATXN1; (-) strand; PAM type: YTN; PAM sequence: CTC
atctccacttgtgttaaaga

SEQ ID NO: 207333 - DNA, 20 bp, Artificial Sequence
  Description of Artificial Sequence: Synthetic oligonucleotide
  Target: ATXN1; (-) strand; PAM type: YTN; PAM sequence: TTG
ccctcatctccacttgtgtt

SEQ ID NO: 207334 - DNA, 20 bp, Artificial Sequence
  Description of Artificial Sequence: Synthetic oligonucleotide
  Target: ATXN1; (-) strand; PAM type: YTN; PAM sequence: CTG
ttgccctcatctccacttgt

SEQ ID NO: 207335 - DNA, 20 bp, Artificial Sequence
  Description of Artificial Sequence: Synthetic oligonucleotide
  Target: ATXN1; (-) strand; PAM type: YTN; PAM sequence: TTC
acagactgttgccctcatct

SEQ ID NO: 207336 - DNA, 20 bp, Artificial Sequence
  Description of Artificial Sequence: Synthetic oligonucleotide
  Target: ATXN1; (-) strand; PAM type: YTN; PAM sequence: TTT
cacagactgttgccctcatc

SEQ ID NO: 207337 - DNA, 20 bp, Artificial Sequence
  Description of Artificial Sequence: Synthetic oligonucleotide
  Target: ATXN1; (-) strand; PAM type: YTN; PAM sequence: CTG
tgtttcacagactgttgccc

SEQ ID NO: 207338 - DNA, 20 bp, Artificial Sequence
  Description of Artificial Sequence: Synthetic oligonucleotide
  Target: ATXN1; (-) strand; PAM type: YTN; PAM sequence: CTG
actgtgtttcacagactgtt

SEQ ID NO: 207339 - DNA, 20 bp, Artificial Sequence
  Description of Artificial Sequence: Synthetic oligonucleotide
  Target: ATXN1; (-) strand; PAM type: YTN; PAM sequence: TTA
accagtaagaaagagaccat

SEQ ID NO: 207340 - DNA, 20 bp, Artificial Sequence
  Description of Artificial Sequence: Synthetic oligonucleotide
  Target: ATXN1; (-) strand; PAM type: YTN; PAM sequence: TTG
tagttaaccagtaagaaaga

SEQ ID NO: 207341 - DNA, 20 bp, Artificial Sequence
  Description of Artificial Sequence: Synthetic oligonucleotide
  Target: ATXN1; (-) strand; PAM type: YTN; PAM sequence: TTT
gtagttaaccagtaagaaag

SEQ ID NO: 207342 - DNA, 20 bp, Artificial Sequence
  Description of Artificial Sequence: Synthetic oligonucleotide
  Target: ATXN1; (-) strand; PAM type: YTN; PAM sequence: TTT
tgtagttaaccagtaagaaa

SEQ ID NO: 207343 - DNA, 20 bp, Artificial Sequence
  Description of Artificial Sequence: Synthetic oligonucleotide
  Target: ATXN1; (-) strand; PAM type: YTN; PAM sequence: TTT
ttgtagttaaccagtaagaa

SEQ ID NO: 207344 - DNA, 20 bp, Artificial Sequence
  Description of Artificial Sequence: Synthetic oligonucleotide
  Target: ATXN1; (-) strand; PAM type: YTN; PAM sequence: CTT
tttgtagttaaccagtaaga

SEQ ID NO: 207345 - DNA, 20 bp, Artificial Sequence
  Description of Artificial Sequence: Synthetic oligonucleotide
  Target: ATXN1; (-) strand; PAM type: YTN; PAM sequence: TTG
ctttttgtagttaaccagta

SEQ ID NO: 207346 - DNA, 20 bp, Artificial Sequence
  Description of Artificial Sequence: Synthetic oligonucleotide
  Target: ATXN1; (-) strand; PAM type: YTN; PAM sequence: CTT
gctttttgtagttaaccagt

SEQ ID NO: 207347 - DNA, 20 bp, Artificial Sequence
  Description of Artificial Sequence: Synthetic oligonucleotide
  Target: ATXN1; (-) strand; PAM type: YTN; PAM sequence: TTC
cttgctttttgtagttaacc

SEQ ID NO: 207348 - DNA, 20 bp, Artificial Sequence
  Description of Artificial Sequence: Synthetic oligonucleotide
  Target: ATXN1; (-) strand; PAM type: YTN; PAM sequence: TTT
ccttgctttttgtagttaac

SEQ ID NO: 207349 - DNA, 20 bp, Artificial Sequence
  Description of Artificial Sequence: Synthetic oligonucleotide
  Target: ATXN1; (-) strand; PAM type: YTN; PAM sequence: TTC
agccatttccttgctttttg

SEQ ID NO: 207350 - DNA, 20 bp, Artificial Sequence
  Description of Artificial Sequence: Synthetic oligonucleotide
  Target: ATXN1; (-) strand; PAM type: YTN; PAM sequence: TTT
cagccatttccttgcttttt

SEQ ID NO: 207351 - DNA, 20 bp, Artificial Sequence
  Description of Artificial Sequence: Synthetic oligonucleotide
  Target: ATXN1; (-) strand; PAM type: YTN; PAM sequence: CTT
tcagccatttccttgctttt

SEQ ID NO: 207352 - DNA, 20 bp, Artificial Sequence
  Description of Artificial Sequence: Synthetic oligonucleotide
  Target: ATXN1; (-) strand; PAM type: YTN; PAM sequence: CTG
cctttcagccatttccttgc

SEQ ID NO: 207353 - DNA, 20 bp, Artificial Sequence
  Description of Artificial Sequence: Synthetic oligonucleotide
  Target: ATXN1; (-) strand; PAM type: YTN; PAM sequence: CTG
cctgcctttcagccatttcc

SEQ ID NO: 207354 - DNA, 20 bp, Artificial Sequence
  Description of Artificial Sequence: Synthetic oligonucleotide
  Target: ATXN1; (-) strand; PAM type: YTN; PAM sequence: CTC
actgcctgcctttcagccat

SEQ ID NO: 207355 - DNA, 20 bp, Artificial Sequence
  Description of Artificial Sequence: Synthetic oligonucleotide
  Target: ATXN1; (-) strand; PAM type: YTN; PAM sequence: CTC
ccctcactgcctgcctttca

SEQ ID NO: 207356 - DNA, 20 bp, Artificial Sequence
  Description of Artificial Sequence: Synthetic oligonucleotide
  Target: ATXN1; (-) strand; PAM type: YTN; PAM sequence: CTC
tcccctcactgcctgccttt

SEQ ID NO: 207357 - DNA, 20 bp, Artificial Sequence
  Description of Artificial Sequence: Synthetic oligonucleotide
  Target: ATXN1; (-) strand; PAM type: YTN; PAM sequence: CTC
cctctcccctcactgcctgc

SEQ ID NO: 207358 - DNA, 20 bp, Artificial Sequence
  Description of Artificial Sequence: Synthetic oligonucleotide
  Target: ATXN1; (-) strand; PAM type: YTN; PAM sequence: TTC
ctccctctcccctcactgcc

SEQ ID NO: 207359 - DNA, 20 bp, Artificial Sequence
  Description of Artificial Sequence: Synthetic oligonucleotide
  Target: ATXN1; (-) strand; PAM type: YTN; PAM sequence: CTC
attcctccctctcccctcac

SEQ ID NO: 207360 - DNA, 20 bp, Artificial Sequence
  Description of Artificial Sequence: Synthetic oligonucleotide
  Target: ATXN1; (-) strand; PAM type: YTN; PAM sequence: CTC
tcattcctccctctcccctc

SEQ ID NO: 207361 - DNA, 20 bp, Artificial Sequence
  Description of Artificial Sequence: Synthetic oligonucleotide
  Target: ATXN1; (-) strand; PAM type: YTN; PAM sequence: TTC
gtacaggtgaaagtctctca

SEQ ID NO: 207362 - DNA, 20 bp, Artificial Sequence
  Description of Artificial Sequence: Synthetic oligonucleotide
  Target: ATXN1; (-) strand; PAM type: YTN; PAM sequence: CTT
cgtacaggtgaaagtctctc

SEQ ID NO: 207363 - DNA, 20 bp, Artificial Sequence
  Description of Artificial Sequence: Synthetic oligonucleotide
  Target: ATXN1; (-) strand; PAM type: YTN; PAM sequence: TTC
cagagacatccttcgtacag

SEQ ID NO: 207364 - DNA, 20 bp, Artificial Sequence
  Description of Artificial Sequence: Synthetic oligonucleotide
  Target: ATXN1; (-) strand; PAM type: YTN; PAM sequence: TTT
ccagagacatccttcgtaca

SEQ ID NO: 207365 - DNA, 20 bp, Artificial Sequence
  Description of Artificial Sequence: Synthetic oligonucleotide
  Target: ATXN1; (-) strand; PAM type: YTN; PAM sequence: TTT
tccagagacatccttcgtac

SEQ ID NO: 207366 - DNA, 20 bp, Artificial Sequence
  Description of Artificial Sequence: Synthetic oligonucleotide
  Target: ATXN1; (-) strand; PAM type: YTN; PAM sequence: TTC
cgttttccagagacatcctt

SEQ ID NO: 207367 - DNA, 20 bp, Artificial Sequence
  Description of Artificial Sequence: Synthetic oligonucleotide
  Target: ATXN1; (-) strand; PAM type: YTN; PAM sequence: CTG
tcaacattccgttttccaga

SEQ ID NO: 207368 - DNA, 20 bp, Artificial Sequence
  Description of Artificial Sequence: Synthetic oligonucleotide
  Target: ATXN1; (-) strand; PAM type: YTN; PAM sequence: CTC
tgtcaacattccgttttcca

SEQ ID NO: 207369 - DNA, 20 bp, Artificial Sequence
  Description of Artificial Sequence: Synthetic oligonucleotide
  Target: ATXN1; (-) strand; PAM type: YTN; PAM sequence: CTC
tctgtcaacattccgttttc

SEQ ID NO: 207370 - DNA, 20 bp, Artificial Sequence
  Description of Artificial Sequence: Synthetic oligonucleotide
  Target: ATXN1; (-) strand; PAM type: YTN; PAM sequence: TTA
ctctctgtcaacattccgtt

SEQ ID NO: 207371 - DNA, 20 bp, Artificial Sequence
  Description of Artificial Sequence: Synthetic oligonucleotide
  Target: ATXN1; (-) strand; PAM type: YTN; PAM sequence: TTT
actctctgtcaacattccgt

SEQ ID NO: 207372 - DNA, 20 bp, Artificial Sequence
  Description of Artificial Sequence: Synthetic oligonucleotide
  Target: ATXN1; (-) strand; PAM type: YTN; PAM sequence: TTG
tttactctctgtcaacattc

SEQ ID NO: 207373 - DNA, 20 bp, Artificial Sequence
  Description of Artificial Sequence: Synthetic oligonucleotide
  Target: ATXN1; (-) strand; PAM type: YTN; PAM sequence: CTT
gtttactctctgtcaacatt

SEQ ID NO: 207374 - DNA, 20 bp, Artificial Sequence
  Description of Artificial Sequence: Synthetic oligonucleotide
  Target: ATXN1; (-) strand; PAM type: YTN; PAM sequence: TTG
cttgtttactctctgtcaac

SEQ ID NO: 207375 - DNA, 20 bp, Artificial Sequence
  Description of Artificial Sequence: Synthetic oligonucleotide
  Target: ATXN1; (-) strand; PAM type: YTN; PAM sequence: TTA
atagcatatgttgcttgttt

SEQ ID NO: 207376 - DNA, 20 bp, Artificial Sequence
  Description of Artificial Sequence: Synthetic oligonucleotide
  Target: ATXN1; (-) strand; PAM type: YTN; PAM sequence: TTA
acaggcattaatagcatatg

SEQ ID NO: 207377 - DNA, 20 bp, Artificial Sequence
  Description of Artificial Sequence: Synthetic oligonucleotide
  Target: ATXN1; (-) strand; PAM type: YTN; PAM sequence: CTT
aacaggcattaatagcatat

SEQ ID NO: 207378 - DNA, 20 bp, Artificial Sequence
  Description of Artificial Sequence: Synthetic oligonucleotide
  Target: ATXN1; (-) strand; PAM type: YTN; PAM sequence: CTC
aaaaaggtgacttaacaggc

SEQ ID NO: 207379 - DNA, 20 bp, Artificial Sequence
  Description of Artificial Sequence: Synthetic oligonucleotide
  Target: ATXN1; (-) strand; PAM type: YTN; PAM sequence: CTG
atagtcaccaaaaaatctca

SEQ ID NO: 207380 - DNA, 20 bp, Artificial Sequence
  Description of Artificial Sequence: Synthetic oligonucleotide
  Target: ATXN1; (-) strand; PAM type: YTN; PAM sequence: TTC
actgatagtcaccaaaaaat

SEQ ID NO: 207381 - DNA, 20 bp, Artificial Sequence
  Description of Artificial Sequence: Synthetic oligonucleotide
  Target: ATXN1; (-) strand; PAM type: YTN; PAM sequence: CTT
cactgatagtcaccaaaaaa

SEQ ID NO: 207382 - DNA, 20 bp, Artificial Sequence
  Description of Artificial Sequence: Synthetic oligonucleotide
  Target: ATXN1; (-) strand; PAM type: YTN; PAM sequence: TTA
ataagaggcataagacttca

SEQ ID NO: 207383 - DNA, 20 bp, Artificial Sequence
  Description of Artificial Sequence: Synthetic oligonucleotide
  Target: ATXN1; (-) strand; PAM type: YTN; PAM sequence: TTT
aataagaggcataagacttc

SEQ ID NO: 207384 - DNA, 20 bp, Artificial Sequence
  Description of Artificial Sequence: Synthetic oligonucleotide
  Target: ATXN1; (-) strand; PAM type: YTN; PAM sequence: TTA
aaacagtgtgagaatttaat

SEQ ID NO: 207385 - DNA, 20 bp, Artificial Sequence
  Description of Artificial Sequence: Synthetic oligonucleotide
  Target: ATXN1; (-) strand; PAM type: YTN; PAM sequence: TTA
attaaaacagtgtgagaatt

SEQ ID NO: 207386 - DNA, 20 bp, Artificial Sequence
  Description of Artificial Sequence: Synthetic oligonucleotide
  Target: ATXN1; (-) strand; PAM type: YTN; PAM sequence: CTT
aattaaaacagtgtgagaat

SEQ ID NO: 207387 - DNA, 20 bp, Artificial Sequence
  Description of Artificial Sequence: Synthetic oligonucleotide
  Target: ATXN1; (-) strand; PAM type: YTN; PAM sequence: CTA
cttaattaaaacagtgtgag

SEQ ID NO: 207388 - DNA, 20 bp, Artificial Sequence
  Description of Artificial Sequence: Synthetic oligonucleotide
  Target: ATXN1; (-) strand; PAM type: YTN; PAM sequence: TTA
aaataaggccctacttaatt

SEQ ID NO: 207389 - DNA, 20 bp, Artificial Sequence
  Description of Artificial Sequence: Synthetic oligonucleotide
  Target: ATXN1; (-) strand; PAM type: YTN; PAM sequence: CTG
tgattaaaataaggccctac

SEQ ID NO: 207390 - DNA, 20 bp, Artificial Sequence
  Description of Artificial Sequence: Synthetic oligonucleotide
  Target: ATXN1; (-) strand; PAM type: YTN; PAM sequence: TTA
aaacgagaaggcaccaccac

SEQ ID NO: 207391 - DNA, 20 bp, Artificial Sequence
  Description of Artificial Sequence: Synthetic oligonucleotide
  Target: ATXN1; (-) strand; PAM type: YTN; PAM sequence: CTT
aaaacgagaaggcaccacca

SEQ ID NO: 207392 - DNA, 20 bp, Artificial Sequence
  Description of Artificial Sequence: Synthetic oligonucleotide
  Target: ATXN1; (-) strand; PAM type: YTN; PAM sequence: CTA
gcttaaaacgagaaggcacc

SEQ ID NO: 207393 - DNA, 20 bp, Artificial Sequence
  Description of Artificial Sequence: Synthetic oligonucleotide
  Target: ATXN1; (-) strand; PAM type: YTN; PAM sequence: CTC
actagcttaaaacgagaagg

SEQ ID NO: 207394 - DNA, 20 bp, Artificial Sequence
  Description of Artificial Sequence: Synthetic oligonucleotide
  Target: ATXN1; (-) strand; PAM type: YTN; PAM sequence: TTC
cagctcactagcttaaaacg

SEQ ID NO: 207395 - DNA, 20 bp, Artificial Sequence
  Description of Artificial Sequence: Synthetic oligonucleotide
  Target: ATXN1; (-) strand; PAM type: YTN; PAM sequence: CTG
ggttccagctcactagctta

SEQ ID NO: 207396 - DNA, 20 bp, Artificial Sequence
  Description of Artificial Sequence: Synthetic oligonucleotide
  Target: ATXN1; (-) strand; PAM type: YTN; PAM sequence: CTG
gctgggttccagctcactag

SEQ ID NO: 207397 - DNA, 20 bp, Artificial Sequence
  Description of Artificial Sequence: Synthetic oligonucleotide
  Target: ATXN1; (-) strand; PAM type: YTN; PAM sequence: CTG
cctggctgggttccagctca

SEQ ID NO: 207398 - DNA, 20 bp, Artificial Sequence
  Description of Artificial Sequence: Synthetic oligonucleotide
  Target: ATXN1; (-) strand; PAM type: YTN; PAM sequence: TTA
acactgcctggctgggttcc

SEQ ID NO: 207399 - DNA, 20 bp, Artificial Sequence
  Description of Artificial Sequence: Synthetic oligonucleotide
  Target: ATXN1; (-) strand; PAM type: YTN; PAM sequence: TTT
aacactgcctggctgggttc

SEQ ID NO: 207400 - DNA, 20 bp, Artificial Sequence
  Description of Artificial Sequence: Synthetic oligonucleotide
  Target: ATXN1; (-) strand; PAM type: YTN; PAM sequence: CTG
tttaacactgcctggctggg

SEQ ID NO: 207401 - DNA, 20 bp, Artificial Sequence
  Description of Artificial Sequence: Synthetic oligonucleotide
  Target: ATXN1; (-) strand; PAM type: YTN; PAM sequence: CTC
ctgtttaacactgcctggct

SEQ ID NO: 207402 - DNA, 20 bp, Artificial Sequence
  Description of Artificial Sequence: Synthetic oligonucleotide
  Target: ATXN1; (-) strand; PAM type: YTN; PAM sequence: CTC
gctcctgtttaacactgcct

SEQ ID NO: 207403 - DNA, 20 bp, Artificial Sequence
  Description of Artificial Sequence: Synthetic oligonucleotide
  Target: ATXN1; (-) strand; PAM type: YTN; PAM sequence: CTC
tcgctcctgtttaacactgc

SEQ ID NO: 207404 - DNA, 20 bp, Artificial Sequence
  Description of Artificial Sequence: Synthetic oligonucleotide
  Target: ATXN1; (-) strand; PAM type: YTN; PAM sequence: TTG
acgaagaaggaaagtctctc

SEQ ID NO: 207405 - DNA, 20 bp, Artificial Sequence
  Description of Artificial Sequence: Synthetic oligonucleotide
  Target: ATXN1; (-) strand; PAM type: YTN; PAM sequence: CTT
gacgaagaaggaaagtctct

SEQ ID NO: 207406 - DNA, 20 bp, Artificial Sequence
  Description of Artificial Sequence: Synthetic oligonucleotide
  Target: ATXN1; (-) strand; PAM type: YTN; PAM sequence: TTC
cttgacgaagaaggaaagtc

SEQ ID NO: 207407 - DNA, 20 bp, Artificial Sequence
  Description of Artificial Sequence: Synthetic oligonucleotide
  Target: ATXN1; (-) strand; PAM type: YTN; PAM sequence: CTT
ccttgacgaagaaggaaagt

SEQ ID NO: 207408 - DNA, 20 bp, Artificial Sequence
  Description of Artificial Sequence: Synthetic oligonucleotide
  Target: ATXN1; (-) strand; PAM type: YTN; PAM sequence: CTG
caaaagcttccttgacgaag

SEQ ID NO: 207409 - DNA, 20 bp, Artificial Sequence
  Description of Artificial Sequence: Synthetic oligonucleotide
  Target: ATXN1; (-) strand; PAM type: YTN; PAM sequence: CTG
aaaaataaaaaaacaaaata

SEQ ID NO: 207410 - DNA, 20 bp, Artificial Sequence
  Description of Artificial Sequence: Synthetic oligonucleotide
  Target: ATXN1; (-) strand; PAM type: YTN; PAM sequence: CTC
tgaaaaataaaaaaacaaaa

SEQ ID NO: 207411 - DNA, 20 bp, Artificial Sequence
  Description of Artificial Sequence: Synthetic oligonucleotide
  Target: ATXN1; (-) strand; PAM type: YTN; PAM sequence: TTC
agtctctgaaaaataaaaaa

SEQ ID NO: 207412 - DNA, 20 bp, Artificial Sequence
  Description of Artificial Sequence: Synthetic oligonucleotide
  Target: ATXN1; (-) strand; PAM type: YTN; PAM sequence: CTA
gattcagtctctgaaaaata

SEQ ID NO: 207413 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagctagattcag

SEQ ID NO: 207414 - DNA, 20 bp, Artificial Sequence
  Description of Artificial Sequence: Synthetic oligonucleotide
  Target: ATXN1; (-) strand; PAM type: YTN; PAM sequence: TTG
cacagcctgggtgacagagc

SEQ ID NO: 207415 - DNA, 20 bp, Artificial Sequence
  Description of Artificial Sequence: Synthetic oligonucleotide
  Target: ATXN1; (-) strand; PAM type: YTN; PAM sequence: CTA
tgatcgtgccattgcacagc

SEQ ID NO: 207416 - DNA, 20 bp, Artificial Sequence
  Description of Artificial Sequence: Synthetic oligonucleotide
  Target: ATXN1; (-) strand; PAM type: YTN; PAM sequence: CTG
cagtgagctatgatcgtgcc

SEQ ID NO: 207417 - DNA, 20 bp, Artificial Sequence
  Description of Artificial Sequence: Synthetic oligonucleotide
  Target: ATXN1; (-) strand; PAM type: YTN; PAM sequence: TTA
gaggctgcagtgagctatga

SEQ ID NO: 207418 - DNA, 20 bp, Artificial Sequence
  Description of Artificial Sequence: Synthetic oligonucleotide
  Target: ATXN1; (-) strand; PAM type: YTN; PAM sequence: TTG
agcccaggagttagaggctg

SEQ ID NO: 207419 - DNA, 20 bp, Artificial Sequence
  Description of Artificial Sequence: Synthetic oligonucleotide
  Target: ATXN1; (-) strand; PAM type: YTN; PAM sequence: CTT
gagcccaggagttagaggct

SEQ ID NO: 207420 - DNA, 20 bp, Artificial Sequence
  Description of Artificial Sequence: Synthetic oligonucleotide
  Target: ATXN1; (-) strand; PAM type: YTN; PAM sequence: TTG
cttgagcccaggagttagag

SEQ ID NO: 207421 - DNA, 20 bp, Artificial Sequence
  Description of Artificial Sequence: Synthetic oligonucleotide
  Target: ATXN1; (-) strand; PAM type: YTN; PAM sequence: CTG
aggcaggaggattgcttgag

SEQ ID NO: 207422 - DNA, 20 bp, Artificial Sequence
  Description of Artificial Sequence: Synthetic oligonucleotide
  Target: ATXN1; (-) strand; PAM type: YTN; PAM sequence: CTG
gaggctgaggcaggaggatt

SEQ ID NO: 207423 - DNA, 20 bp, Artificial Sequence
  Description of Artificial Sequence: Synthetic oligonucleotide
  Target: ATXN1; (-) strand; PAM type: YTN; PAM sequence: CTC
tggaggctgaggcaggagga

SEQ ID NO: 207424 - DNA, 20 bp, Artificial Sequence
  Description of Artificial Sequence: Synthetic oligonucleotide
  Target: ATXN1; (-) strand; PAM type: YTN; PAM sequence: CTC
ctctggaggctgaggcagga

SEQ ID NO: 207425 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctcctctggag

SEQ ID NO: 207426 - DNA, 20 bp, Artificial Sequence
  Description of Artificial Sequence: Synthetic oligonucleotide
  Target: ATXN1; (-) strand; PAM type: YTN; PAM sequence: TTA
gccaagcatggaggcgtgca

SEQ ID NO: 207427 - DNA, 20 bp, Artificial Sequence
  Description of Artificial Sequence: Synthetic oligonucleotide
  Target: ATXN1; (-) strand; PAM type: YTN; PAM sequence: TTA
caaaaaataagtaaaaatta

SEQ ID NO: 207428 - DNA, 20 bp, Artificial Sequence
  Description of Artificial Sequence: Synthetic oligonucleotide
  Target: ATXN1; (-) strand; PAM type: YTN; PAM sequence: TTT
acaaaaaataagtaaaaatt

SEQ ID NO: 207429 - DNA, 20 bp, Artificial Sequence
  Description of Artificial Sequence: Synthetic oligonucleotide
  Target: ATXN1; (-) strand; PAM type: YTN; PAM sequence: CTT
tacaaaaaataagtaaaaat

SEQ ID NO: 207430 - DNA, 20 bp, Artificial Sequence
  Description of Artificial Sequence: Synthetic oligonucleotide
  Target: ATXN1; (-) strand; PAM type: YTN; PAM sequence: CTC
gtctttacaaaaaataagta

SEQ ID NO: 207431 - DNA, 20 bp, Artificial Sequence
  Description of Artificial Sequence: Synthetic oligonucleotide
  Target: ATXN1; (-) strand; PAM type: YTN; PAM sequence: TTG
gcaagatagagacctcgtct

SEQ ID NO: 207432 - DNA, 20 bp, Artificial Sequence
  Description of Artificial Sequence: Synthetic oligonucleotide
  Target: ATXN1; (-) strand; PAM type: YTN; PAM sequence: TTT
ggcaagatagagacctcgtc

SEQ ID NO: 207433 - DNA, 20 bp, Artificial Sequence
  Description of Artificial Sequence: Synthetic oligonucleotide
  Target: ATXN1; (-) strand; PAM type: YTN; PAM sequence: CTT
tggcaagatagagacctcgt

SEQ ID NO: 207434 - DNA, 20 bp, Artificial Sequence
  Description of Artificial Sequence: Synthetic oligonucleotide
  Target: ATXN1; (-) strand; PAM type: YTN; PAM sequence: TTC
aagatcagctttggcaagat

SEQ ID NO: 207435 - DNA, 20 bp, Artificial Sequence
  Description of Artificial Sequence: Synthetic oligonucleotide
  Target: ATXN1; (-) strand; PAM type: YTN; PAM sequence: TTG
aggccaggagttcaagatca

SEQ ID NO: 207436 - DNA, 20 bp, Artificial Sequence
  Description of Artificial Sequence: Synthetic oligonucleotide
  Target: ATXN1; (-) strand; PAM type: YTN; PAM sequence: CTT
gaggccaggagttcaagatc

SEQ ID NO: 207437 - DNA, 20 bp, Artificial Sequence
  Description of Artificial Sequence: Synthetic oligonucleotide
  Target: ATXN1; (-) strand; PAM type: YTN; PAM sequence: TTG
cttgaggccaggagttcaag

SEQ ID NO: 207438 - DNA, 20 bp, Artificial Sequence
  Description of Artificial Sequence: Synthetic oligonucleotide
  Target: ATXN1; (-) strand; PAM type: YTN; PAM sequence: TTG
ggaggccaagatgagaggat

SEQ ID NO: 207439 - DNA, 20 bp, Artificial Sequence
  Description of Artificial Sequence: Synthetic oligonucleotide
  Target: ATXN1; (-) strand; PAM type: YTN; PAM sequence: TTT
gggaggccaagatgagagga

SEQ ID NO: 207440 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaagatgagagg

SEQ ID NO: 207441 - DNA, 20 bp, Artificial Sequence
  Description of Artificial Sequence: Synthetic oligonucleotide
  Target: ATXN1; (-) strand; PAM type: YTN; PAM sequence: TTA
tccagcactttgggaggcca

SEQ ID NO: 207442 - DNA, 20 bp, Artificial Sequence
  Description of Artificial Sequence: Synthetic oligonucleotide
  Target: ATXN1; (-) strand; PAM type: YTN; PAM sequence: CTG
ttatccagcactttgggagg

SEQ ID NO: 207443 - DNA, 20 bp, Artificial Sequence
  Description of Artificial Sequence: Synthetic oligonucleotide
  Target: ATXN1; (-) strand; PAM type: YTN; PAM sequence: CTG
ggcacggtggccacacctgt

SEQ ID NO: 207444 - DNA, 20 bp, Artificial Sequence
  Description of Artificial Sequence: Synthetic oligonucleotide
  Target: ATXN1; (-) strand; PAM type: YTN; PAM sequence: CTG
aggctgggcacggtggccac

SEQ ID NO: 207445 - DNA, 20 bp, Artificial Sequence
  Description of Artificial Sequence: Synthetic oligonucleotide
  Target: ATXN1; (-) strand; PAM type: YTN; PAM sequence: TTG
gataggggagaaaaggaggt

SEQ ID NO: 207446 - DNA, 20 bp, Artificial Sequence
  Description of Artificial Sequence: Synthetic oligonucleotide
  Target: ATXN1; (-) strand; PAM type: YTN; PAM sequence: TTT
ggataggggagaaaaggagg

SEQ ID NO: 207447 - DNA, 20 bp, Artificial Sequence
  Description of Artificial Sequence: Synthetic oligonucleotide
  Target: ATXN1; (-) strand; PAM type: YTN; PAM sequence: CTT
tggataggggagaaaaggag

SEQ ID NO: 207448 - DNA, 20 bp, Artificial Sequence
  Description of Artificial Sequence: Synthetic oligonucleotide
  Target: ATXN1; (-) strand; PAM type: YTN; PAM sequence: TTA
ccaggctttggataggggag

SEQ ID NO: 207449 - DNA, 20 bp, Artificial Sequence
  Description of Artificial Sequence: Synthetic oligonucleotide
  Target: ATXN1; (-) strand; PAM type: YTN; PAM sequence: TTT
accaggctttggatagggga

SEQ ID NO: 207450 - DNA, 20 bp, Artificial Sequence
  Description of Artificial Sequence: Synthetic oligonucleotide
  Target: ATXN1; (-) strand; PAM type: YTN; PAM sequence: TTG
tttaccaggctttggatagg

SEQ ID NO: 207451 - DNA, 20 bp, Artificial Sequence
  Description of Artificial Sequence: Synthetic oligonucleotide
  Target: ATXN1; (-) strand; PAM type: YTN; PAM sequence: TTT
gtttaccaggctttggatag

SEQ ID NO: 207452 - DNA, 20 bp, Artificial Sequence
  Description of Artificial Sequence: Synthetic oligonucleotide
  Target: ATXN1; (-) strand; PAM type: YTN; PAM sequence: CTT
tgtttaccaggctttggata

SEQ ID NO: 207453 - DNA, 20 bp, Artificial Sequence
  Description of Artificial Sequence: Synthetic oligonucleotide
  Target: ATXN1; (-) strand; PAM type: YTN; PAM sequence: CTC
actttgtttaccaggctttg

SEQ ID NO: 207454 - DNA, 20 bp, Artificial Sequence
  Description of Artificial Sequence: Synthetic oligonucleotide
  Target: ATXN1; (-) strand; PAM type: YTN; PAM sequence: TTA
gatatgcaaatcagctcact

SEQ ID NO: 207455 - DNA, 20 bp, Artificial Sequence
  Description of Artificial Sequence: Synthetic oligonucleotide
  Target: ATXN1; (-) strand; PAM type: YTN; PAM sequence: TTT
agatatgcaaatcagctcac

SEQ ID NO: 207456 - DNA, 20 bp, Artificial Sequence
  Description of Artificial Sequence: Synthetic oligonucleotide
  Target: ATXN1; (-) strand; PAM type: YTN; PAM sequence: TTT
tagatatgcaaatcagctca

SEQ ID NO: 207457 - DNA, 20 bp, Artificial Sequence
  Description of Artificial Sequence: Synthetic oligonucleotide
  Target: ATXN1; (-) strand; PAM type: YTN; PAM sequence: TTG
caggcatccagcacccgatt

SEQ ID NO: 207458 - DNA, 20 bp, Artificial Sequence
  Description of Artificial Sequence: Synthetic oligonucleotide
  Target: ATXN1; (-) strand; PAM type: YTN; PAM sequence: TTT
gcaggcatccagcacccgat

SEQ ID NO: 207459 - DNA, 20 bp, Artificial Sequence
  Description of Artificial Sequence: Synthetic oligonucleotide
  Target: ATXN1; (-) strand; PAM type: YTN; PAM sequence: CTA
tcatatttgcaggcatccag

SEQ ID NO: 207460 - DNA, 20 bp, Artificial Sequence
  Description of Artificial Sequence: Synthetic oligonucleotide
  Target: ATXN1; (-) strand; PAM type: YTN; PAM sequence: TTC
cctatcatatttgcaggcat

SEQ ID NO: 207461 - DNA, 20 bp, Artificial Sequence
  Description of Artificial Sequence: Synthetic oligonucleotide
  Target: ATXN1; (-) strand; PAM type: YTN; PAM sequence: TTT
ccctatcatatttgcaggca

SEQ ID NO: 207462 - DNA, 20 bp, Artificial Sequence
  Description of Artificial Sequence: Synthetic oligonucleotide
  Target: ATXN1; (-) strand; PAM type: YTN; PAM sequence: TTC
caaatacatatttccctatc

SEQ ID NO: 207463 - DNA, 20 bp, Artificial Sequence
  Description of Artificial Sequence: Synthetic oligonucleotide
  Target: ATXN1; (-) strand; PAM type: YTN; PAM sequence: CTG
aggttccaaatacatatttc

SEQ ID NO: 207464 - DNA, 20 bp, Artificial Sequence
  Description of Artificial Sequence: Synthetic oligonucleotide
  Target: ATXN1; (-) strand; PAM type: YTN; PAM sequence: TTC
acctgaggttccaaatacat

SEQ ID NO: 207465 - DNA, 20 bp, Artificial Sequence
  Description of Artificial Sequence: Synthetic oligonucleotide
  Target: ATXN1; (-) strand; PAM type: YTN; PAM sequence: TTT
cacctgaggttccaaataca

SEQ ID NO: 207466 - DNA, 20 bp, Artificial Sequence
  Description of Artificial Sequence: Synthetic oligonucleotide
  Target: ATXN1; (-) strand; PAM type: YTN; PAM sequence: CTG
gggtttcacctgaggttcca

SEQ ID NO: 207467 - DNA, 20 bp, Artificial Sequence
  Description of Artificial Sequence: Synthetic oligonucleotide
  Target: ATXN1; (-) strand; PAM type: YTN; PAM sequence: TTG
ctggggtttcacctgaggtt

SEQ ID NO: 207468 - DNA, 20 bp, Artificial Sequence
  Description of Artificial Sequence: Synthetic oligonucleotide
  Target: ATXN1; (-) strand; PAM type: YTN; PAM sequence: TTT
gctggggtttcacctgaggt

SEQ ID NO: 207469 - DNA, 20 bp, Artificial Sequence
  Description of Artificial Sequence: Synthetic oligonucleotide
  Target: ATXN1; (-) strand; PAM type: YTN; PAM sequence: TTT
tgctggggtttcacctgagg

SEQ ID NO: 207470 - DNA, 20 bp, Artificial Sequence
  Description of Artificial Sequence: Synthetic oligonucleotide
  Target: ATXN1; (-) strand; PAM type: YTN; PAM sequence: TTT
ttgctggggtttcacctgag

SEQ ID NO: 207471 - DNA, 20 bp, Artificial Sequence
  Description of Artificial Sequence: Synthetic oligonucleotide
  Target: ATXN1; (-) strand; PAM type: YTN; PAM sequence: TTA
atgtttttgctggggtttca

SEQ ID NO: 207472 - DNA, 20 bp, Artificial Sequence
  Description of Artificial Sequence: Synthetic oligonucleotide
  Target: ATXN1; (-) strand; PAM type: YTN; PAM sequence: TTT
aatgtttttgctggggtttc

SEQ ID NO: 207473 - DNA, 20 bp, Artificial Sequence
  Description of Artificial Sequence: Synthetic oligonucleotide
  Target: ATXN1; (-) strand; PAM type: YTN; PAM sequence: TTT
taatgtttttgctggggttt

SEQ ID NO: 207474 - DNA, 20 bp, Artificial Sequence
  Description of Artificial Sequence: Synthetic oligonucleotide
  Target: ATXN1; (-) strand; PAM type: YTN; PAM sequence: TTC
aaatgtgatgattttaatgt

SEQ ID NO: 207475 - DNA, 20 bp, Artificial Sequence
  Description of Artificial Sequence: Synthetic oligonucleotide
  Target: ATXN1; (-) strand; PAM type: YTN; PAM sequence: CTT
caaatgtgatgattttaatg

SEQ ID NO: 207476 - DNA, 20 bp, Artificial Sequence
  Description of Artificial Sequence: Synthetic oligonucleotide
  Target: ATXN1; (-) strand; PAM type: YTN; PAM sequence: CTC
cttcaaatgtgatgatttta

SEQ ID NO: 207477 - DNA, 20 bp, Artificial Sequence
  Description of Artificial Sequence: Synthetic oligonucleotide
  Target: ATXN1; (-) strand; PAM type: YTN; PAM sequence: TTA
caaagggctccttcaaatgt

SEQ ID NO: 207478 - DNA, 20 bp, Artificial Sequence
  Description of Artificial Sequence: Synthetic oligonucleotide
  Target: ATXN1; (-) strand; PAM type: YTN; PAM sequence: TTA
catatcagcattacaaaggg

SEQ ID NO: 207479 - DNA, 20 bp, Artificial Sequence
  Description of Artificial Sequence: Synthetic oligonucleotide
  Target: ATXN1; (-) strand; PAM type: YTN; PAM sequence: TTT
acatatcagcattacaaagg

SEQ ID NO: 207480 - DNA, 20 bp, Artificial Sequence
  Description of Artificial Sequence: Synthetic oligonucleotide
  Target: ATXN1; (-) strand; PAM type: YTN; PAM sequence: CTT
tacatatcagcattacaaag

SEQ ID NO: 207481 - DNA, 20 bp, Artificial Sequence
  Description of Artificial Sequence: Synthetic oligonucleotide
  Target: ATXN1; (-) strand; PAM type: YTN; PAM sequence: TTA
atgggatctttacatatcag

SEQ ID NO: 207482 - DNA, 20 bp, Artificial Sequence
  Description of Artificial Sequence: Synthetic oligonucleotide
  Target: ATXN1; (-) strand; PAM type: YTN; PAM sequence: TTT
aatgggatctttacatatca

SEQ ID NO: 207483 - DNA, 20 bp, Artificial Sequence
  Description of Artificial Sequence: Synthetic oligonucleotide
  Target: ATXN1; (-) strand; PAM type: YTN; PAM sequence: TTT
taatgggatctttacatatc

SEQ ID NO: 207484 - DNA, 20 bp, Artificial Sequence
  Description of Artificial Sequence: Synthetic oligonucleotide
  Target: ATXN1; (-) strand; PAM type: YTN; PAM sequence: CTG
tgttttaatgggatctttac

SEQ ID NO: 207485 - DNA, 20 bp, Artificial Sequence
  Description of Artificial Sequence: Synthetic oligonucleotide
  Target: ATXN1; (-) strand; PAM type: YTN; PAM sequence: TTG
tggagaatggctgtgtttta

SEQ ID NO: 207486 - DNA, 20 bp, Artificial Sequence
  Description of Artificial Sequence: Synthetic oligonucleotide
  Target: ATXN1; (-) strand; PAM type: YTN; PAM sequence: TTG
tagttgtggagaatggctgt

SEQ ID NO: 207487 - DNA, 20 bp, Artificial Sequence
  Description of Artificial Sequence: Synthetic oligonucleotide
  Target: ATXN1; (-) strand; PAM type: YTN; PAM sequence: TTT
gtagttgtggagaatggctg

SEQ ID NO: 207488 - DNA, 20 bp, Artificial Sequence
  Description of Artificial Sequence: Synthetic oligonucleotide
  Target: ATXN1; (-) strand; PAM type: YTN; PAM sequence: TTT
tgtagttgtggagaatggct

SEQ ID NO: 207489 - DNA, 20 bp, Artificial Sequence
  Description of Artificial Sequence: Synthetic oligonucleotide
  Target: ATXN1; (-) strand; PAM type: YTN; PAM sequence: TTT
ttgtagttgtggagaatggc

SEQ ID NO: 207490 - DNA, 20 bp, Artificial Sequence
  Description of Artificial Sequence: Synthetic oligonucleotide
  Target: ATXN1; (-) strand; PAM type: YTN; PAM sequence: TTA
aatcaaagatttttgtagtt

SEQ ID NO: 207491 - DNA, 20 bp, Artificial Sequence
  Description of Artificial Sequence: Synthetic oligonucleotide
  Target: ATXN1; (-) strand; PAM type: YTN; PAM sequence: TTT
aaatcaaagatttttgtagt

SEQ ID NO: 207492 - DNA, 20 bp, Artificial Sequence
  Description of Artificial Sequence: Synthetic oligonucleotide
  Target: ATXN1; (-) strand; PAM type: YTN; PAM sequence: TTT
taaatcaaagatttttgtag

SEQ ID NO: 207493 - DNA, 20 bp, Artificial Sequence
  Description of Artificial Sequence: Synthetic oligonucleotide
  Target: ATXN1; (-) strand; PAM type: YTN; PAM sequence: TTT
ttaaatcaaagatttttgta

SEQ ID NO: 207494 - DNA, 20 bp, Artificial Sequence
  Description of Artificial Sequence: Synthetic oligonucleotide
  Target: ATXN1; (-) strand; PAM type: YTN; PAM sequence: TTA
acgtgacataggaatccaaa

SEQ ID NO: 207495 - DNA, 20 bp, Artificial Sequence
  Description of Artificial Sequence: Synthetic oligonucleotide
  Target: ATXN1; (-) strand; PAM type: YTN; PAM sequence: TTT
aacgtgacataggaatccaa

SEQ ID NO: 207496 - DNA, 20 bp, Artificial Sequence
  Description of Artificial Sequence: Synthetic oligonucleotide
  Target: ATXN1; (-) strand; PAM type: YTN; PAM sequence: TTT
taacgtgacataggaatcca

SEQ ID NO: 207497 - DNA, 20 bp, Artificial Sequence
  Description of Artificial Sequence: Synthetic oligonucleotide
  Target: ATXN1; (-) strand; PAM type: YTN; PAM sequence: CTT
ttaacgtgacataggaatcc

SEQ ID NO: 207498 - DNA, 20 bp, Artificial Sequence
  Description of Artificial Sequence: Synthetic oligonucleotide
  Target: ATXN1; (-) strand; PAM type: YTN; PAM sequence: CTG
gataaaatgcccaacacact

SEQ ID NO: 207499 - DNA, 20 bp, Artificial Sequence
  Description of Artificial Sequence: Synthetic oligonucleotide
  Target: ATXN1; (-) strand; PAM type: YTN; PAM sequence: CTA
agtcactggataaaatgccc

SEQ ID NO: 207500 - DNA, 20 bp, Artificial Sequence
  Description of Artificial Sequence: Synthetic oligonucleotide
  Target: ATXN1; (-) strand; PAM type: YTN; PAM sequence: CTG
aaaggataatctaagtcact

SEQ ID NO: 207501 - DNA, 20 bp, Artificial Sequence
  Description of Artificial Sequence: Synthetic oligonucleotide
  Target: ATXN1; (-) strand; PAM type: YTN; PAM sequence: CTC
ctgaaaggataatctaagtc

SEQ ID NO: 207502 - DNA, 20 bp, Artificial Sequence
  Description of Artificial Sequence: Synthetic oligonucleotide
  Target: ATXN1; (-) strand; PAM type: YTN; PAM sequence: TTC
tcctgaaaggataatctaag

SEQ ID NO: 207503 - DNA, 20 bp, Artificial Sequence
  Description of Artificial Sequence: Synthetic oligonucleotide
  Target: ATXN1; (-) strand; PAM type: YTN; PAM sequence: TTT
ctcctgaaaggataatctaa

SEQ ID NO: 207504 - DNA, 20 bp, Artificial Sequence
  Description of Artificial Sequence: Synthetic oligonucleotide
  Target: ATXN1; (-) strand; PAM type: YTN; PAM sequence: TTA
caatgaagtacagtatttct

SEQ ID NO: 207505 - DNA, 20 bp, Artificial Sequence
  Description of Artificial Sequence: Synthetic oligonucleotide
  Target: ATXN1; (-) strand; PAM type: YTN; PAM sequence: CTT
acaatgaagtacagtatttc

SEQ ID NO: 207506 - DNA, 20 bp, Artificial Sequence
  Description of Artificial Sequence: Synthetic oligonucleotide
  Target: ATXN1; (-) strand; PAM type: YTN; PAM sequence: TTA
aggacttacaatgaagtaca

SEQ ID NO: 207507 - DNA, 20 bp, Artificial Sequence
  Description of Artificial Sequence: Synthetic oligonucleotide
  Target: ATXN1; (-) strand; PAM type: YTN; PAM sequence: CTC
attaaggacttacaatgaag

SEQ ID NO: 207508 - DNA, 20 bp, Artificial Sequence
  Description of Artificial Sequence: Synthetic oligonucleotide
  Target: ATXN1; (-) strand; PAM type: YTN; PAM sequence: TTG
gtccctcattaaggacttac

SEQ ID NO: 207509 - DNA, 20 bp, Artificial Sequence
  Description of Artificial Sequence: Synthetic oligonucleotide
  Target: ATXN1; (-) strand; PAM type: YTN; PAM sequence: CTA
attggtccctcattaaggac

SEQ ID NO: 207510 - DNA, 20 bp, Artificial Sequence
  Description of Artificial Sequence: Synthetic oligonucleotide
  Target: ATXN1; (-) strand; PAM type: YTN; PAM sequence: TTG
aagtggaggggaaggactaa

SEQ ID NO: 207511 - DNA, 20 bp, Artificial Sequence
  Description of Artificial Sequence: Synthetic oligonucleotide
  Target: ATXN1; (-) strand; PAM type: YTN; PAM sequence: TTT
gaagtggaggggaaggacta

SEQ ID NO: 207512 - DNA, 20 bp, Artificial Sequence
  Description of Artificial Sequence: Synthetic oligonucleotide
  Target: ATXN1; (-) strand; PAM type: YTN; PAM sequence: TTC
ccagaggaatttgaagtgga

SEQ ID NO: 207513 - DNA, 20 bp, Artificial Sequence
  Description of Artificial Sequence: Synthetic oligonucleotide
  Target: ATXN1; (-) strand; PAM type: YTN; PAM sequence: TTT
cccagaggaatttgaagtgg

SEQ ID NO: 207514 - DNA, 20 bp, Artificial Sequence
  Description of Artificial Sequence: Synthetic oligonucleotide
  Target: ATXN1; (-) strand; PAM type: YTN; PAM sequence: CTC
atttcccagaggaatttgaa

SEQ ID NO: 207515 - DNA, 20 bp, Artificial Sequence
  Description of Artificial Sequence: Synthetic oligonucleotide
  Target: ATXN1; (-) strand; PAM type: YTN; PAM sequence: CTG
acctcatttcccagaggaat

SEQ ID NO: 207516 - DNA, 20 bp, Artificial Sequence
  Description of Artificial Sequence: Synthetic oligonucleotide
  Target: ATXN1; (-) strand; PAM type: YTN; PAM sequence: TTC
tgacctcatttcccagagga

SEQ ID NO: 207517 - DNA, 20 bp, Artificial Sequence
  Description of Artificial Sequence: Synthetic oligonucleotide
  Target: ATXN1; (-) strand; PAM type: YTN; PAM sequence: TTG
ggtgggaagtggattctgac

SEQ ID NO: 207518 - DNA, 20 bp, Artificial Sequence
  Description of Artificial Sequence: Synthetic oligonucleotide
  Target: ATXN1; (-) strand; PAM type: YTN; PAM sequence: TTT
gggtgggaagtggattctga

SEQ ID NO: 207519 - DNA, 20 bp, Artificial Sequence
  Description of Artificial Sequence: Synthetic oligonucleotide
  Target: ATXN1; (-) strand; PAM type: YTN; PAM sequence: CTT
tgggtgggaagtggattctg

SEQ ID NO: 207520 - DNA, 20 bp, Artificial Sequence
  Description of Artificial Sequence: Synthetic oligonucleotide
  Target: ATXN1; (-) strand; PAM type: YTN; PAM sequence: CTC
catgaggtgctttgggtggg

SEQ ID NO: 207521 - DNA, 20 bp, Artificial Sequence
  Description of Artificial Sequence: Synthetic oligonucleotide
  Target: ATXN1; (-) strand; PAM type: YTN; PAM sequence: TTG
atgcagcctccatgaggtgc

SEQ ID NO: 207522 - DNA, 20 bp, Artificial Sequence
  Description of Artificial Sequence: Synthetic oligonucleotide
  Target: ATXN1; (-) strand; PAM type: YTN; PAM sequence: TTT
gatgcagcctccatgaggtg

SEQ ID NO: 207523 - DNA, 20 bp, Artificial Sequence
  Description of Artificial Sequence: Synthetic oligonucleotide
  Target: ATXN1; (-) strand; PAM type: YTN; PAM sequence: CTG
tagtatttgatgcagcctcc

SEQ ID NO: 207524 - DNA, 20 bp, Artificial Sequence
  Description of Artificial Sequence: Synthetic oligonucleotide
  Target: ATXN1; (-) strand; PAM type: YTN; PAM sequence: CTG
ctgtagtatttgatgcagcc

SEQ ID NO: 207525 - DNA, 20 bp, Artificial Sequence
  Description of Artificial Sequence: Synthetic oligonucleotide
  Target: ATXN1; (-) strand; PAM type: YTN; PAM sequence: TTG
acaaatgctgctgtagtatt

SEQ ID NO: 207526 - DNA, 20 bp, Artificial Sequence
  Description of Artificial Sequence: Synthetic oligonucleotide
  Target: ATXN1; (-) strand; PAM type: YTN; PAM sequence: TTT
gacaaatgctgctgtagtat

SEQ ID NO: 207527 - DNA, 20 bp, Artificial Sequence
  Description of Artificial Sequence: Synthetic oligonucleotide
  Target: ATXN1; (-) strand; PAM type: YTN; PAM sequence: CTT
tgacaaatgctgctgtagta

SEQ ID NO: 207528 - DNA, 20 bp, Artificial Sequence
  Description of Artificial Sequence: Synthetic oligonucleotide
  Target: ATXN1; (-) strand; PAM type: YTN; PAM sequence: CTC
ccctttgacaaatgctgctg

SEQ ID NO: 207529 - DNA, 20 bp, Artificial Sequence
  Description of Artificial Sequence: Synthetic oligonucleotide
  Target: ATXN1; (-) strand; PAM type: YTN; PAM sequence: TTG
gaaagggctcccctttgaca

SEQ ID NO: 207530 - DNA, 20 bp, Artificial Sequence
  Description of Artificial Sequence: Synthetic oligonucleotide
  Target: ATXN1; (-) strand; PAM type: YTN; PAM sequence: TTT
ggaaagggctcccctttgac

SEQ ID NO: 207531 - DNA, 20 bp, Artificial Sequence
  Description of Artificial Sequence: Synthetic oligonucleotide
  Target: ATXN1; (-) strand; PAM type: YTN; PAM sequence: CTT
tggaaagggctcccctttga

SEQ ID NO: 207532 - DNA, 20 bp, Artificial Sequence
  Description of Artificial Sequence: Synthetic oligonucleotide
  Target: ATXN1; (-) strand; PAM type: YTN; PAM sequence: TTG
cctttggaaagggctcccct

SEQ ID NO: 207533 - DNA, 20 bp, Artificial Sequence
  Description of Artificial Sequence: Synthetic oligonucleotide
  Target: ATXN1; (-) strand; PAM type: YTN; PAM sequence: CTT
gcctttggaaagggctcccc

SEQ ID NO: 207534 - DNA, 20 bp, Artificial Sequence
  Description of Artificial Sequence: Synthetic oligonucleotide
  Target: ATXN1; (-) strand; PAM type: YTN; PAM sequence: CTA
cccatcttgcctttggaaag

SEQ ID NO: 207535 - DNA, 20 bp, Artificial Sequence
  Description of Artificial Sequence: Synthetic oligonucleotide
  Target: ATXN1; (-) strand; PAM type: YTN; PAM sequence: TTC
tacccatcttgcctttggaa

SEQ ID NO: 207536 - DNA, 20 bp, Artificial Sequence
  Description of Artificial Sequence: Synthetic oligonucleotide
  Target: ATXN1; (-) strand; PAM type: YTN; PAM sequence: CTT
ctacccatcttgcctttgga

SEQ ID NO: 207537 - DNA, 20 bp, Artificial Sequence
  Description of Artificial Sequence: Synthetic oligonucleotide
  Target: ATXN1; (-) strand; PAM type: YTN; PAM sequence: CTC
cttctacccatcttgccttt

SEQ ID NO: 207538 - DNA, 20 bp, Artificial Sequence
  Description of Artificial Sequence: Synthetic oligonucleotide
  Target: ATXN1; (-) strand; PAM type: YTN; PAM sequence: TTC
tccttctacccatcttgcct

SEQ ID NO: 207539 - DNA, 20 bp, Artificial Sequence
  Description of Artificial Sequence: Synthetic oligonucleotide
  Target: ATXN1; (-) strand; PAM type: YTN; PAM sequence: TTT
ctccttctacccatcttgcc

SEQ ID NO: 207540 - DNA, 20 bp, Artificial Sequence
  Description of Artificial Sequence: Synthetic oligonucleotide
  Target: ATXN1; (-) strand; PAM type: YTN; PAM sequence: TTG
atgaagatttctccttctac

SEQ ID NO: 207541 - DNA, 20 bp, Artificial Sequence
  Description of Artificial Sequence: Synthetic oligonucleotide
  Target: ATXN1; (-) strand; PAM type: YTN; PAM sequence: CTT
gatgaagatttctccttcta

SEQ ID NO: 207542 - DNA, 20 bp, Artificial Sequence
  Description of Artificial Sequence: Synthetic oligonucleotide
  Target: ATXN1; (-) strand; PAM type: YTN; PAM sequence: CTG
tcggtggaaggcatagccct

SEQ ID NO: 207543 - DNA, 20 bp, Artificial Sequence
  Description of Artificial Sequence: Synthetic oligonucleotide
  Target: ATXN1; (-) strand; PAM type: YTN; PAM sequence: CTG
tgcctgtcggtggaaggcat

SEQ ID NO: 207544 - DNA, 20 bp, Artificial Sequence
  Description of Artificial Sequence: Synthetic oligonucleotide
  Target: ATXN1; (-) strand; PAM type: YTN; PAM sequence: CTC
tgtgcctgtcggtggaaggc

SEQ ID NO: 207545 - DNA, 20 bp, Artificial Sequence
  Description of Artificial Sequence: Synthetic oligonucleotide
  Target: ATXN1; (-) strand; PAM type: YTN; PAM sequence: TTG
tgctctgtgcctgtcggtgg

SEQ ID NO: 207546 - DNA, 20 bp, Artificial Sequence
  Description of Artificial Sequence: Synthetic oligonucleotide
  Target: ATXN1; (-) strand; PAM type: YTN; PAM sequence: TTT
gtgctctgtgcctgtcggtg

SEQ ID NO: 207547 - DNA, 20 bp, Artificial Sequence
  Description of Artificial Sequence: Synthetic oligonucleotide
  Target: ATXN1; (-) strand; PAM type: YTN; PAM sequence: CTT
tgtgctctgtgcctgtcggt

SEQ ID NO: 207548 - DNA, 20 bp, Artificial Sequence
  Description of Artificial Sequence: Synthetic oligonucleotide
  Target: ATXN1; (-) strand; PAM type: YTN; PAM sequence: TTC
tttgtgctctgtgcctgtcg

SEQ ID NO: 207549 - DNA, 20 bp, Artificial Sequence
  Description of Artificial Sequence: Synthetic oligonucleotide
  Target: ATXN1; (-) strand; PAM type: YTN; PAM sequence: CTT
ctttgtgctctgtgcctgtc

SEQ ID NO: 207550 - DNA, 20 bp, Artificial Sequence
  Description of Artificial Sequence: Synthetic oligonucleotide
  Target: ATXN1; (-) strand; PAM type: YTN; PAM sequence: CTG
agcttctttgtgctctgtgc

SEQ ID NO: 207551 - DNA, 20 bp, Artificial Sequence
  Description of Artificial Sequence: Synthetic oligonucleotide
  Target: ATXN1; (-) strand; PAM type: YTN; PAM sequence: TTA
tagtaaatgctgagcttctt

SEQ ID NO: 207552 - DNA, 20 bp, Artificial Sequence
  Description of Artificial Sequence: Synthetic oligonucleotide
  Target: ATXN1; (-) strand; PAM type: YTN; PAM sequence: CTT
atagtaaatgctgagcttct

SEQ ID NO: 207553 - DNA, 20 bp, Artificial Sequence
  Description of Artificial Sequence: Synthetic oligonucleotide
  Target: ATXN1; (-) strand; PAM type: YTN; PAM sequence: CTG
tgcaagatcttatagtaaat

SEQ ID NO: 207554 - DNA, 20 bp, Artificial Sequence
  Description of Artificial Sequence: Synthetic oligonucleotide
  Target: ATXN1; (-) strand; PAM type: YTN; PAM sequence: CTC
ctgtgcaagatcttatagta

SEQ ID NO: 207555 - DNA, 20 bp, Artificial Sequence
  Description of Artificial Sequence: Synthetic oligonucleotide
  Target: ATXN1; (-) strand; PAM type: YTN; PAM sequence: TTG
aacagctcctgtgcaagatc

SEQ ID NO: 207556 - DNA, 20 bp, Artificial Sequence
  Description of Artificial Sequence: Synthetic oligonucleotide
  Target: ATXN1; (-) strand; PAM type: YTN; PAM sequence: TTT
gaacagctcctgtgcaagat

SEQ ID NO: 207557 - DNA, 20 bp, Artificial Sequence
  Description of Artificial Sequence: Synthetic oligonucleotide
  Target: ATXN1; (-) strand; PAM type: YTN; PAM sequence: TTG
tttgaacagctcctgtgcaa

SEQ ID NO: 207558 - DNA, 20 bp, Artificial Sequence
  Description of Artificial Sequence: Synthetic oligonucleotide
  Target: ATXN1; (-) strand; PAM type: YTN; PAM sequence: CTT
gtttgaacagctcctgtgca

SEQ ID NO: 207559 - DNA, 20 bp, Artificial Sequence
  Description of Artificial Sequence: Synthetic oligonucleotide
  Target: ATXN1; (-) strand; PAM type: YTN; PAM sequence: TTC
agcttgtttgaacagctcct

SEQ ID NO: 207560 - DNA, 20 bp, Artificial Sequence
  Description of Artificial Sequence: Synthetic oligonucleotide
  Target: ATXN1; (-) strand; PAM type: YTN; PAM sequence: CTT
cagcttgtttgaacagctcc

SEQ ID NO: 207561 - DNA, 20 bp, Artificial Sequence
  Description of Artificial Sequence: Synthetic oligonucleotide
  Target: ATXN1; (-) strand; PAM type: YTN; PAM sequence: TTC
gtgggtgtgtgcttcagctt

SEQ ID NO: 207562 - DNA, 20 bp, Artificial Sequence
  Description of Artificial Sequence: Synthetic oligonucleotide
  Target: ATXN1; (-) strand; PAM type: YTN; PAM sequence: CTG
agatgaaattcgtgggtgtg

SEQ ID NO: 207563 - DNA, 20 bp, Artificial Sequence
  Description of Artificial Sequence: Synthetic oligonucleotide
  Target: ATXN1; (-) strand; PAM type: YTN; PAM sequence: CTG
tggcagcaggtaaaagagag

SEQ ID NO: 207564 - DNA, 20 bp, Artificial Sequence
  Description of Artificial Sequence: Synthetic oligonucleotide
  Target: ATXN1; (-) strand; PAM type: YTN; PAM sequence: CTG
tccctgtggcagcaggtaaa

SEQ ID NO: 207565 - DNA, 20 bp, Artificial Sequence
  Description of Artificial Sequence: Synthetic oligonucleotide
  Target: ATXN1; (-) strand; PAM type: YTN; PAM sequence: CTG
caggtgagtgcacagccagc

SEQ ID NO: 207566 - DNA, 20 bp, Artificial Sequence
  Description of Artificial Sequence: Synthetic oligonucleotide
  Target: ATXN1; (-) strand; PAM type: YTN; PAM sequence: CTG
cgccctgcaggtgagtgcac

SEQ ID NO: 207567 - DNA, 20 bp, Artificial Sequence
  Description of Artificial Sequence: Synthetic oligonucleotide
  Target: ATXN1; (-) strand; PAM type: YTN; PAM sequence: CTG
agtgcatgatgcagatggag

SEQ ID NO: 207568 - DNA, 20 bp, Artificial Sequence
  Description of Artificial Sequence: Synthetic oligonucleotide
  Target: ATXN1; (-) strand; PAM type: YTN; PAM sequence: CTC
tgagtgcatgatgcagatgg

SEQ ID NO: 207569 - DNA, 20 bp, Artificial Sequence
  Description of Artificial Sequence: Synthetic oligonucleotide
  Target: ATXN1; (-) strand; PAM type: YTN; PAM sequence: CTC
ccctctgagtgcatgatgca

SEQ ID NO: 207570 - DNA, 20 bp, Artificial Sequence
  Description of Artificial Sequence: Synthetic oligonucleotide
  Target: ATXN1; (-) strand; PAM type: YTN; PAM sequence: CTG
gtgacccagagcagtggcac

SEQ ID NO: 207571 - DNA, 20 bp, Artificial Sequence
  Description of Artificial Sequence: Synthetic oligonucleotide
  Target: ATXN1; (-) strand; PAM type: YTN; PAM sequence: CTG
cggcagagccagagcaggct

SEQ ID NO: 207572 - DNA, 20 bp, Artificial Sequence
  Description of Artificial Sequence: Synthetic oligonucleotide
  Target: ATXN1; (-) strand; PAM type: YTN; PAM sequence: CTG
ggaggctgcggcagagccag

SEQ ID NO: 207573 - DNA, 20 bp, Artificial Sequence
  Description of Artificial Sequence: Synthetic oligonucleotide
  Target: ATXN1; (-) strand; PAM type: YTN; PAM sequence: CTC
aatcccctgggaggctgcgg

SEQ ID NO: 207574 - DNA, 20 bp, Artificial Sequence
  Description of Artificial Sequence: Synthetic oligonucleotide
  Target: ATXN1; (-) strand; PAM type: YTN; PAM sequence: CTA
gtggaaggagtaggagctca

SEQ ID NO: 207575 - DNA, 20 bp, Artificial Sequence
  Description of Artificial Sequence: Synthetic oligonucleotide
  Target: ATXN1; (-) strand; PAM type: YTN; PAM sequence: TTC
tagtggaaggagtaggagct

SEQ ID NO: 207576 - DNA, 20 bp, Artificial Sequence
  Description of Artificial Sequence: Synthetic oligonucleotide
  Target: ATXN1; (-) strand; PAM type: YTN; PAM sequence: CTT
ctagtggaaggagtaggagc

SEQ ID NO: 207577 - DNA, 20 bp, Artificial Sequence
  Description of Artificial Sequence: Synthetic oligonucleotide
  Target: ATXN1; (-) strand; PAM type: YTN; PAM sequence: CTC
accatgcttctagtggaagg

SEQ ID NO: 207578 - DNA, 20 bp, Artificial Sequence
  Description of Artificial Sequence: Synthetic oligonucleotide
  Target: ATXN1; (-) strand; PAM type: YTN; PAM sequence: TTG
ctcaccatgcttctagtgga

SEQ ID NO: 207579 - DNA, 20 bp, Artificial Sequence
  Description of Artificial Sequence: Synthetic oligonucleotide
  Target: ATXN1; (-) strand; PAM type: YTN; PAM sequence: TTT
gctcaccatgcttctagtgg

SEQ ID NO: 207580 - DNA, 20 bp, Artificial Sequence
  Description of Artificial Sequence: Synthetic oligonucleotide
  Target: ATXN1; (-) strand; PAM type: YTN; PAM sequence: CTA
atttgctcaccatgcttcta

SEQ ID NO: 207581 - DNA, 20 bp, Artificial Sequence
  Description of Artificial Sequence: Synthetic oligonucleotide
  Target: ATXN1; (-) strand; PAM type: YTN; PAM sequence: CTC
taatttgctcaccatgcttc

SEQ ID NO: 207582 - DNA, 20 bp, Artificial Sequence
  Description of Artificial Sequence: Synthetic oligonucleotide
  Target: ATXN1; (-) strand; PAM type: YTN; PAM sequence: TTA
taacctctaatttgctcacc

SEQ ID NO: 207583 - DNA, 20 bp, Artificial Sequence
  Description of Artificial Sequence: Synthetic oligonucleotide
  Target: ATXN1; (-) strand; PAM type: YTN; PAM sequence: TTT
ataacctctaatttgctcac

SEQ ID NO: 207584 - DNA, 20 bp, Artificial Sequence
  Description of Artificial Sequence: Synthetic oligonucleotide
  Target: ATXN1; (-) strand; PAM type: YTN; PAM sequence: TTC
caccggaggtgtttataacc

SEQ ID NO: 207585 - DNA, 20 bp, Artificial Sequence
  Description of Artificial Sequence: Synthetic oligonucleotide
  Target: ATXN1; (-) strand; PAM type: YTN; PAM sequence: CTT
ccaccggaggtgtttataac

SEQ ID NO: 207586 - DNA, 20 bp, Artificial Sequence
  Description of Artificial Sequence: Synthetic oligonucleotide
  Target: ATXN1; (-) strand; PAM type: YTN; PAM sequence: CTC
cttccaccggaggtgtttat

SEQ ID NO: 207587 - DNA, 20 bp, Artificial Sequence
  Description of Artificial Sequence: Synthetic oligonucleotide
  Target: ATXN1; (-) strand; PAM type: YTN; PAM sequence: CTC
ctccttccaccggaggtgtt

SEQ ID NO: 207588 - DNA, 20 bp, Artificial Sequence
  Description of Artificial Sequence: Synthetic oligonucleotide
  Target: ATXN1; (-) strand; PAM type: YTN; PAM sequence: TTC
tcctccttccaccggaggtg

SEQ ID NO: 207589 - DNA, 20 bp, Artificial Sequence
  Description of Artificial Sequence: Synthetic oligonucleotide
  Target: ATXN1; (-) strand; PAM type: YTN; PAM sequence: TTA
caaagcccaaaggaattctc

SEQ ID NO: 207590 - DNA, 20 bp, Artificial Sequence
  Description of Artificial Sequence: Synthetic oligonucleotide
  Target: ATXN1; (-) strand; PAM type: YTN; PAM sequence: CTT
acaaagcccaaaggaattct

SEQ ID NO: 207591 - DNA, 20 bp, Artificial Sequence
  Description of Artificial Sequence: Synthetic oligonucleotide
  Target: ATXN1; (-) strand; PAM type: YTN; PAM sequence: TTC
ccttacaaagcccaaaggaa

SEQ ID NO: 207592 - DNA, 20 bp, Artificial Sequence
  Description of Artificial Sequence: Synthetic oligonucleotide
  Target: ATXN1; (-) strand; PAM type: YTN; PAM sequence: CTG
acgaggttcccttacaaagc

SEQ ID NO: 207593 - DNA, 20 bp, Artificial Sequence
  Description of Artificial Sequence: Synthetic oligonucleotide
  Target: ATXN1; (-) strand; PAM type: YTN; PAM sequence: TTG
cggctgacgaggttccctta

SEQ ID NO: 207594 - DNA, 20 bp, Artificial Sequence
  Description of Artificial Sequence: Synthetic oligonucleotide
  Target: ATXN1; (-) strand; PAM type: YTN; PAM sequence: CTT
gcggctgacgaggttccctt

SEQ ID NO: 207595 - DNA, 20 bp, Artificial Sequence
  Description of Artificial Sequence: Synthetic oligonucleotide
  Target: ATXN1; (-) strand; PAM type: YTN; PAM sequence: TTC
ttgcggctgacgaggttccc

SEQ ID NO: 207596 - DNA, 20 bp, Artificial Sequence
  Description of Artificial Sequence: Synthetic oligonucleotide
  Target: ATXN1; (-) strand; PAM type: YTN; PAM sequence: TTA
taccccggagattcttgcgg

SEQ ID NO: 207597 - DNA, 20 bp, Artificial Sequence
  Description of Artificial Sequence: Synthetic oligonucleotide
  Target: ATXN1; (-) strand; PAM type: YTN; PAM sequence: CTT
ataccccggagattcttgcg

SEQ ID NO: 207598 - DNA, 20 bp, Artificial Sequence
  Description of Artificial Sequence: Synthetic oligonucleotide
  Target: ATXN1; (-) strand; PAM type: YTN; PAM sequence: CTA
tgtcttataccccggagatt

SEQ ID NO: 207599 - DNA, 20 bp, Artificial Sequence
  Description of Artificial Sequence: Synthetic oligonucleotide
  Target: ATXN1; (-) strand; PAM type: YTN; PAM sequence: TTG
tgggcagaaaaaggtgtggt

SEQ ID NO: 207600 - DNA, 20 bp, Artificial Sequence
  Description of Artificial Sequence: Synthetic oligonucleotide
  Target: ATXN1; (-) strand; PAM type: YTN; PAM sequence: CTG
ccataattgtgggcagaaaa

SEQ ID NO: 207601 - DNA, 20 bp, Artificial Sequence
  Description of Artificial Sequence: Synthetic oligonucleotide
  Target: ATXN1; (-) strand; PAM type: YTN; PAM sequence: TTC
tgccataattgtgggcagaa

SEQ ID NO: 207602 - DNA, 20 bp, Artificial Sequence
  Description of Artificial Sequence: Synthetic oligonucleotide
  Target: ATXN1; (-) strand; PAM type: YTN; PAM sequence: TTT
ctgccataattgtgggcaga

SEQ ID NO: 207603 - DNA, 20 bp, Artificial Sequence
  Description of Artificial Sequence: Synthetic oligonucleotide
  Target: ATXN1; (-) strand; PAM type: YTN; PAM sequence: CTG
gatgggcatttctgccataa

SEQ ID NO: 207604 - DNA, 20 bp, Artificial Sequence
  Description of Artificial Sequence: Synthetic oligonucleotide
  Target: ATXN1; (-) strand; PAM type: YTN; PAM sequence: TTC
ctggatgggcatttctgcca

SEQ ID NO: 207605 - DNA, 20 bp, Artificial Sequence
  Description of Artificial Sequence: Synthetic oligonucleotide
  Target: ATXN1; (-) strand; PAM type: YTN; PAM sequence: TTT
cctggatgggcatttctgcc

SEQ ID NO: 207606 - DNA, 20 bp, Artificial Sequence
  Description of Artificial Sequence: Synthetic oligonucleotide
  Target: ATXN1; (-) strand; PAM type: YTN; PAM sequence: TTT
tcctggatgggcatttctgc

SEQ ID NO: 207607 - DNA, 20 bp, Artificial Sequence
  Description of Artificial Sequence: Synthetic oligonucleotide
  Target: ATXN1; (-) strand; PAM type: YTN; PAM sequence: TTC
gaacatgtgaagcagcattt

SEQ ID NO: 207608 - DNA, 20 bp, Artificial Sequence
  Description of Artificial Sequence: Synthetic oligonucleotide
  Target: ATXN1; (-) strand; PAM type: YTN; PAM sequence: CTT
cgaacatgtgaagcagcatt

SEQ ID NO: 207609 - DNA, 20 bp, Artificial Sequence
  Description of Artificial Sequence: Synthetic oligonucleotide
  Target: ATXN1; (-) strand; PAM type: YTN; PAM sequence: TTC
ttcgaacatgtgaagcagca

SEQ ID NO: 207610 - DNA, 20 bp, Artificial Sequence
  Description of Artificial Sequence: Synthetic oligonucleotide
  Target: ATXN1; (-) strand; PAM type: YTN; PAM sequence: CTC
aaccatgtgaggcattcttc

SEQ ID NO: 207611 - DNA, 20 bp, Artificial Sequence
  Description of Artificial Sequence: Synthetic oligonucleotide
  Target: ATXN1; (-) strand; PAM type: YTN; PAM sequence: TTC
tcaaccatgtgaggcattct

SEQ ID NO: 207612 - DNA, 20 bp, Artificial Sequence
  Description of Artificial Sequence: Synthetic oligonucleotide
  Target: ATXN1; (-) strand; PAM type: YTN; PAM sequence: TTG
aggaccagcagtattctcaa

SEQ ID NO: 207613 - DNA, 20 bp, Artificial Sequence
  Description of Artificial Sequence: Synthetic oligonucleotide
  Target: ATXN1; (-) strand; PAM type: YTN; PAM sequence: TTG
ttgaggaccagcagtattct

SEQ ID NO: 207614 - DNA, 20 bp, Artificial Sequence
  Description of Artificial Sequence: Synthetic oligonucleotide
  Target: ATXN1; (-) strand; PAM type: YTN; PAM sequence: CTT
gttgaggaccagcagtattc

SEQ ID NO: 207615 - DNA, 20 bp, Artificial Sequence
  Description of Artificial Sequence: Synthetic oligonucleotide
  Target: ATXN1; (-) strand; PAM type: YTN; PAM sequence: CTG
cttgttgaggaccagcagta

SEQ ID NO: 207616 - DNA, 20 bp, Artificial Sequence
  Description of Artificial Sequence: Synthetic oligonucleotide
  Target: ATXN1; (-) strand; PAM type: YTN; PAM sequence: TTA
tgctgcttgttgaggaccag

SEQ ID NO: 207617 - DNA, 20 bp, Artificial Sequence
  Description of Artificial Sequence: Synthetic oligonucleotide
  Target: ATXN1; (-) strand; PAM type: YTN; PAM sequence: TTT
atgctgcttgttgaggacca

SEQ ID NO: 207618 - DNA, 20 bp, Artificial Sequence
  Description of Artificial Sequence: Synthetic oligonucleotide
  Target: ATXN1; (-) strand; PAM type: YTN; PAM sequence: CTC
aaaaaaaaaaaaaaaataga

SEQ ID NO: 207619 - DNA, 20 bp, Artificial Sequence
  Description of Artificial Sequence: Synthetic oligonucleotide
  Target: ATXN1; (-) strand; PAM type: YTN; PAM sequence: CTG
tctcaaaaaaaaaaaaaaaa

SEQ ID NO: 207620 - DNA, 20 bp, Artificial Sequence
  Description of Artificial Sequence: Synthetic oligonucleotide
  Target: ATXN1; (-) strand; PAM type: YTN; PAM sequence: CTC
tgtctcaaaaaaaaaaaaaa

SEQ ID NO: 207621 - DNA, 20 bp, Artificial Sequence
  Description of Artificial Sequence: Synthetic oligonucleotide
  Target: ATXN1; (-) strand; PAM type: YTN; PAM sequence: CTG
ggtgacagagcaagactctg

SEQ ID NO: 207622 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtgacagagcaa

SEQ ID NO: 207623 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtgacag

SEQ ID NO: 207624 - DNA, 20 bp, Artificial Sequence
  Description of Artificial Sequence: Synthetic oligonucleotide
  Target: ATXN1; (-) strand; PAM type: YTN; PAM sequence: TTG
cgccactgcactccagcctg

SEQ ID NO: 207625 - DNA, 20 bp, Artificial Sequence
  Description of Artificial Sequence: Synthetic oligonucleotide
  Target: ATXN1; (-) strand; PAM type: YTN; PAM sequence: CTG
cagtgagccaagattgcgcc

SEQ ID NO: 207626 - DNA, 20 bp, Artificial Sequence
  Description of Artificial Sequence: Synthetic oligonucleotide
  Target: ATXN1; (-) strand; PAM type: YTN; PAM sequence: CTG
agaggtagaggctgcagtga

SEQ ID NO: 207627 - DNA, 20 bp, Artificial Sequence
  Description of Artificial Sequence: Synthetic oligonucleotide
  Target: ATXN1; (-) strand; PAM type: YTN; PAM sequence: CTA
gaatctgagaggtagaggct

SEQ ID NO: 207628 - DNA, 20 bp, Artificial Sequence
  Description of Artificial Sequence: Synthetic oligonucleotide
  Target: ATXN1; (-) strand; PAM type: YTN; PAM sequence: CTG
gggaggcagaggcaggagaa

SEQ ID NO: 207629 - DNA, 20 bp, Artificial Sequence
  Description of Artificial Sequence: Synthetic oligonucleotide
  Target: ATXN1; (-) strand; PAM type: YTN; PAM sequence: CTA
ctggggaggcagaggcagga

SEQ ID NO: 207630 - DNA, 20 bp, Artificial Sequence
  Description of Artificial Sequence: Synthetic oligonucleotide
  Target: ATXN1; (-) strand; PAM type: YTN; PAM sequence: CTG
gaagcccagctactggggag

SEQ ID NO: 207631 - DNA, 20 bp, Artificial Sequence
  Description of Artificial Sequence: Synthetic oligonucleotide
  Target: ATXN1; (-) strand; PAM type: YTN; PAM sequence: CTG
aaaatacaaaaaaatagcca

SEQ ID NO: 207632 - DNA, 20 bp, Artificial Sequence
  Description of Artificial Sequence: Synthetic oligonucleotide
  Target: ATXN1; (-) strand; PAM type: YTN; PAM sequence: CTC
gactgaaaatacaaaaaaat

SEQ ID NO: 207633 - DNA, 20 bp, Artificial Sequence
  Description of Artificial Sequence: Synthetic oligonucleotide
  Target: ATXN1; (-) strand; PAM type: YTN; PAM sequence: CTA
accaacatggtgaaaccccg

SEQ ID NO: 207634 - DNA, 20 bp, Artificial Sequence
  Description of Artificial Sequence: Synthetic oligonucleotide
  Target: ATXN1; (-) strand; PAM type: YTN; PAM sequence: TTG
agatcagcctaaccaacatg

SEQ ID NO: 207635 - DNA, 20 bp, Artificial Sequence
  Description of Artificial Sequence: Synthetic oligonucleotide
  Target: ATXN1; (-) strand; PAM type: YTN; PAM sequence: TTT
gagatcagcctaaccaacat

SEQ ID NO: 207636 - DNA, 20 bp, Artificial Sequence
  Description of Artificial Sequence: Synthetic oligonucleotide
  Target: ATXN1; (-) strand; PAM type: YTN; PAM sequence: CTG
aggtcgggagtttgagatca

SEQ ID NO: 207637 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaggcgggtggat

SEQ ID NO: 207638 - DNA, 20 bp, Artificial Sequence
  Description of Artificial Sequence: Synthetic oligonucleotide
  Target: ATXN1; (-) strand; PAM type: YTN; PAM sequence: CTT
gggaggccgaggcgggtgga

SEQ ID NO: 207639 - DNA, 20 bp, Artificial Sequence
  Description of Artificial Sequence: Synthetic oligonucleotide
  Target: ATXN1; (-) strand; PAM type: YTN; PAM sequence: CTG
caaatcccagcaccttggga

SEQ ID NO: 207640 - DNA, 20 bp, Artificial Sequence
  Description of Artificial Sequence: Synthetic oligonucleotide
  Target: ATXN1; (-) strand; PAM type: YTN; PAM sequence: CTC
acgcctgcaaatcccagcac

SEQ ID NO: 207641 - DNA, 20 bp, Artificial Sequence
  Description of Artificial Sequence: Synthetic oligonucleotide
  Target: ATXN1; (-) strand; PAM type: YTN; PAM sequence: TTA
ggccaggcatggtggctcac

SEQ ID NO: 207642 - DNA, 20 bp, Artificial Sequence
  Description of Artificial Sequence: Synthetic oligonucleotide
  Target: ATXN1; (-) strand; PAM type: YTN; PAM sequence: TTT
aggccaggcatggtggctca

SEQ ID NO: 207643 - DNA, 20 bp, Artificial Sequence
  Description of Artificial Sequence: Synthetic oligonucleotide
  Target: ATXN1; (-) strand; PAM type: YTN; PAM sequence: TTT
taggccaggcatggtggctc

SEQ ID NO: 207644 - DNA, 20 bp, Artificial Sequence
  Description of Artificial Sequence: Synthetic oligonucleotide
  Target: ATXN1; (-) strand; PAM type: YTN; PAM sequence: TTA
catcaagaatagttttaggc

SEQ ID NO: 207645 - DNA, 20 bp, Artificial Sequence
  Description of Artificial Sequence: Synthetic oligonucleotide
  Target: ATXN1; (-) strand; PAM type: YTN; PAM sequence: CTT
acatcaagaatagttttagg

SEQ ID NO: 207646 - DNA, 20 bp, Artificial Sequence
  Description of Artificial Sequence: Synthetic oligonucleotide
  Target: ATXN1; (-) strand; PAM type: YTN; PAM sequence: CTC
cttacatcaagaatagtttt

SEQ ID NO: 207647 - DNA, 20 bp, Artificial Sequence
  Description of Artificial Sequence: Synthetic oligonucleotide
  Target: ATXN1; (-) strand; PAM type: YTN; PAM sequence: TTC
tccttacatcaagaatagtt

SEQ ID NO: 207648 - DNA, 20 bp, Artificial Sequence
  Description of Artificial Sequence: Synthetic oligonucleotide
  Target: ATXN1; (-) strand; PAM type: YTN; PAM sequence: TTT
ctccttacatcaagaatagt

SEQ ID NO: 207649 - DNA, 20 bp, Artificial Sequence
  Description of Artificial Sequence: Synthetic oligonucleotide
  Target: ATXN1; (-) strand; PAM type: YTN; PAM sequence: TTA
ggaatatgtttctccttaca

SEQ ID NO: 207650 - DNA, 20 bp, Artificial Sequence
  Description of Artificial Sequence: Synthetic oligonucleotide
  Target: ATXN1; (-) strand; PAM type: YTN; PAM sequence: TTT
aggaatatgtttctccttac

SEQ ID NO: 207651 - DNA, 20 bp, Artificial Sequence
  Description of Artificial Sequence: Synthetic oligonucleotide
  Target: ATXN1; (-) strand; PAM type: YTN; PAM sequence: TTA
gcatttaggaatatgtttct

SEQ ID NO: 207652 - DNA, 20 bp, Artificial Sequence
  Description of Artificial Sequence: Synthetic oligonucleotide
  Target: ATXN1; (-) strand; PAM type: YTN; PAM sequence: TTT
agcatttaggaatatgtttc

SEQ ID NO: 207653 - DNA, 20 bp, Artificial Sequence
  Description of Artificial Sequence: Synthetic oligonucleotide
  Target: ATXN1; (-) strand; PAM type: YTN; PAM sequence: CTT
tagcatttaggaatatgttt

SEQ ID NO: 207654 - DNA, 20 bp, Artificial Sequence
  Description of Artificial Sequence: Synthetic oligonucleotide
  Target: ATXN1; (-) strand; PAM type: YTN; PAM sequence: CTG
cctttagcatttaggaatat

SEQ ID NO: 207655 - DNA, 20 bp, Artificial Sequence
  Description of Artificial Sequence: Synthetic oligonucleotide
  Target: ATXN1; (-) strand; PAM type: YTN; PAM sequence: TTG
gcagcactgcctttagcatt

SEQ ID NO: 207656 - DNA, 20 bp, Artificial Sequence
  Description of Artificial Sequence: Synthetic oligonucleotide
  Target: ATXN1; (-) strand; PAM type: YTN; PAM sequence: TTT
ggcagcactgcctttagcat

SEQ ID NO: 207657 - DNA, 20 bp, Artificial Sequence
  Description of Artificial Sequence: Synthetic oligonucleotide
  Target: ATXN1; (-) strand; PAM type: YTN; PAM sequence: CTG
ggagccatggatttggcagc

SEQ ID NO: 207658 - DNA, 20 bp, Artificial Sequence
  Description of Artificial Sequence: Synthetic oligonucleotide
  Target: ATXN1; (-) strand; PAM type: YTN; PAM sequence: CTA
tgctgggagccatggatttg

SEQ ID NO: 207659 - DNA, 20 bp, Artificial Sequence
  Description of Artificial Sequence: Synthetic oligonucleotide
  Target: ATXN1; (-) strand; PAM type: YTN; PAM sequence: TTA
gcctatgctgggagccatgg

SEQ ID NO: 207660 - DNA, 20 bp, Artificial Sequence
  Description of Artificial Sequence: Synthetic oligonucleotide
  Target: ATXN1; (-) strand; PAM type: YTN; PAM sequence: TTT
agcctatgctgggagccatg

SEQ ID NO: 207661 - DNA, 20 bp, Artificial Sequence
  Description of Artificial Sequence: Synthetic oligonucleotide
  Target: ATXN1; (-) strand; PAM type: YTN; PAM sequence: CTT
tagcctatgctgggagccat

SEQ ID NO: 207662 - DNA, 20 bp, Artificial Sequence
  Description of Artificial Sequence: Synthetic oligonucleotide
  Target: ATXN1; (-) strand; PAM type: YTN; PAM sequence: CTA
ataaaactttagcctatgct

SEQ ID NO: 207663 - DNA, 20 bp, Artificial Sequence
  Description of Artificial Sequence: Synthetic oligonucleotide
  Target: ATXN1; (-) strand; PAM type: YTN; PAM sequence: CTC
ctaataaaactttagcctat

SEQ ID NO: 207664 - DNA, 20 bp, Artificial Sequence
  Description of Artificial Sequence: Synthetic oligonucleotide
  Target: ATXN1; (-) strand; PAM type: YTN; PAM sequence: CTG
gtctcctaataaaactttag

SEQ ID NO: 207665 - DNA, 20 bp, Artificial Sequence
  Description of Artificial Sequence: Synthetic oligonucleotide
  Target: ATXN1; (-) strand; PAM type: YTN; PAM sequence: CTC
ctggtctcctaataaaactt

SEQ ID NO: 207666 - DNA, 20 bp, Artificial Sequence
  Description of Artificial Sequence: Synthetic oligonucleotide
  Target: ATXN1; (-) strand; PAM type: YTN; PAM sequence: CTG
gccagagatgtgtgcactcc

SEQ ID NO: 207667 - DNA, 20 bp, Artificial Sequence
  Description of Artificial Sequence: Synthetic oligonucleotide
  Target: ATXN1; (-) strand; PAM type: YTN; PAM sequence: CTG
tccctggccagagatgtgtg

SEQ ID NO: 207668 - DNA, 20 bp, Artificial Sequence
  Description of Artificial Sequence: Synthetic oligonucleotide
  Target: ATXN1; (-) strand; PAM type: YTN; PAM sequence: TTG
ctgtccctggccagagatgt

SEQ ID NO: 207669 - DNA, 20 bp, Artificial Sequence
  Description of Artificial Sequence: Synthetic oligonucleotide
  Target: ATXN1; (-) strand; PAM type: YTN; PAM sequence: TTT
gctgtccctggccagagatg

SEQ ID NO: 207670 - DNA, 20 bp, Artificial Sequence
  Description of Artificial Sequence: Synthetic oligonucleotide
  Target: ATXN1; (-) strand; PAM type: YTN; PAM sequence: CTT
tgctgtccctggccagagat

SEQ ID NO: 207671 - DNA, 20 bp, Artificial Sequence
  Description of Artificial Sequence: Synthetic oligonucleotide
  Target: ATXN1; (-) strand; PAM type: YTN; PAM sequence: TTC
tttgctgtccctggccagag

SEQ ID NO: 207672 - DNA, 20 bp, Artificial Sequence
  Description of Artificial Sequence: Synthetic oligonucleotide
  Target: ATXN1; (-) strand; PAM type: YTN; PAM sequence: TTT
ctttgctgtccctggccaga

SEQ ID NO: 207673 - DNA, 20 bp, Artificial Sequence
  Description of Artificial Sequence: Synthetic oligonucleotide
  Target: ATXN1; (-) strand; PAM type: YTN; PAM sequence: CTT
tctttgctgtccctggccag

SEQ ID NO: 207674 - DNA, 20 bp, Artificial Sequence
  Description of Artificial Sequence: Synthetic oligonucleotide
  Target: ATXN1; (-) strand; PAM type: YTN; PAM sequence: CTG
cctttctttgctgtccctgg

SEQ ID NO: 207675 - DNA, 20 bp, Artificial Sequence
  Description of Artificial Sequence: Synthetic oligonucleotide
  Target: ATXN1; (-) strand; PAM type: YTN; PAM sequence: CTC
agctgcctttctttgctgtc

SEQ ID NO: 207676 - DNA, 20 bp, Artificial Sequence
  Description of Artificial Sequence: Synthetic oligonucleotide
  Target: ATXN1; (-) strand; PAM type: YTN; PAM sequence: TTG
taggactcagctgcctttct

SEQ ID NO: 207677 - DNA, 20 bp, Artificial Sequence
  Description of Artificial Sequence: Synthetic oligonucleotide
  Target: ATXN1; (-) strand; PAM type: YTN; PAM sequence: TTC
cagcagtgttgtaggactca

SEQ ID NO: 207678 - DNA, 20 bp, Artificial Sequence
  Description of Artificial Sequence: Synthetic oligonucleotide
  Target: ATXN1; (-) strand; PAM type: YTN; PAM sequence: CTT
ccagcagtgttgtaggactc

SEQ ID NO: 207679 - DNA, 20 bp, Artificial Sequence
  Description of Artificial Sequence: Synthetic oligonucleotide
  Target: ATXN1; (-) strand; PAM type: YTN; PAM sequence: CTC
cttccagcagtgttgtagga

SEQ ID NO: 207680 - DNA, 20 bp, Artificial Sequence
  Description of Artificial Sequence: Synthetic oligonucleotide
  Target: ATXN1; (-) strand; PAM type: YTN; PAM sequence: TTC
tccttccagcagtgttgtag

SEQ ID NO: 207681 - DNA, 20 bp, Artificial Sequence
  Description of Artificial Sequence: Synthetic oligonucleotide
  Target: ATXN1; (-) strand; PAM type: YTN; PAM sequence: CTT
ctccttccagcagtgttgta

SEQ ID NO: 207682 - DNA, 20 bp, Artificial Sequence
  Description of Artificial Sequence: Synthetic oligonucleotide
  Target: ATXN1; (-) strand; PAM type: YTN; PAM sequence: TTG
gcttctccttccagcagtgt

SEQ ID NO: 207683 - DNA, 20 bp, Artificial Sequence
  Description of Artificial Sequence: Synthetic oligonucleotide
  Target: ATXN1; (-) strand; PAM type: YTN; PAM sequence: CTG
ttggcttctccttccagcag

SEQ ID NO: 207684 - DNA, 20 bp, Artificial Sequence
  Description of Artificial Sequence: Synthetic oligonucleotide
  Target: ATXN1; (-) strand; PAM type: YTN; PAM sequence: CTA
gactgttggcttctccttcc

SEQ ID NO: 207685 - DNA, 20 bp, Artificial Sequence
  Description of Artificial Sequence: Synthetic oligonucleotide
  Target: ATXN1; (-) strand; PAM type: YTN; PAM sequence: TTA
aatcctagactgttggcttc

SEQ ID NO: 207686 - DNA, 20 bp, Artificial Sequence
  Description of Artificial Sequence: Synthetic oligonucleotide
  Target: ATXN1; (-) strand; PAM type: YTN; PAM sequence: TTT
aaatcctagactgttggctt

SEQ ID NO: 207687 - DNA, 20 bp, Artificial Sequence
  Description of Artificial Sequence: Synthetic oligonucleotide
  Target: ATXN1; (-) strand; PAM type: YTN; PAM sequence: TTT
taaatcctagactgttggct

SEQ ID NO: 207688 - DNA, 20 bp, Artificial Sequence
  Description of Artificial Sequence: Synthetic oligonucleotide
  Target: ATXN1; (-) strand; PAM type: YTN; PAM sequence: TTT
ttaaatcctagactgttggc

SEQ ID NO: 207689 - DNA, 20 bp, Artificial Sequence
  Description of Artificial Sequence: Synthetic oligonucleotide
  Target: ATXN1; (-) strand; PAM type: YTN; PAM sequence: TTT
tttaaatcctagactgttgg

SEQ ID NO: 207690 - DNA, 20 bp, Artificial Sequence
  Description of Artificial Sequence: Synthetic oligonucleotide
  Target: ATXN1; (-) strand; PAM type: YTN; PAM sequence: TTT
ttttaaatcctagactgttg

SEQ ID NO: 207691 - DNA, 20 bp, Artificial Sequence
  Description of Artificial Sequence: Synthetic oligonucleotide
  Target: ATXN1; (-) strand; PAM type: YTN; PAM sequence: TTT
tttttaaatcctagactgtt

SEQ ID NO: 207692 - DNA, 20 bp, Artificial Sequence
  Description of Artificial Sequence: Synthetic oligonucleotide
  Target: ATXN1; (-) strand; PAM type: YTN; PAM sequence: TTT
ttttttaaatcctagactgt

SEQ ID NO: 207693 - DNA, 20 bp, Artificial Sequence
  Description of Artificial Sequence: Synthetic oligonucleotide
  Target: ATXN1; (-) strand; PAM type: YTN; PAM sequence: TTT
tttttttaaatcctagactg

SEQ ID NO: 207694 - DNA, 20 bp, Artificial Sequence
  Description of Artificial Sequence: Synthetic oligonucleotide
  Target: ATXN1; (-) strand; PAM type: YTN; PAM sequence: TTT
ttttttttaaatcctagact

SEQ ID NO: 207695 - DNA, 20 bp, Artificial Sequence
  Description of Artificial Sequence: Synthetic oligonucleotide
  Target: ATXN1; (-) strand; PAM type: YTN; PAM sequence: CTT
tttttttttaaatcctagac

SEQ ID NO: 207696 - DNA, 20 bp, Artificial Sequence
  Description of Artificial Sequence: Synthetic oligonucleotide
  Target: ATXN1; (-) strand; PAM type: YTN; PAM sequence: TTC
tttttttttttaaatcctag

SEQ ID NO: 207697 - DNA, 20 bp, Artificial Sequence
  Description of Artificial Sequence: Synthetic oligonucleotide
  Target: ATXN1; (-) strand; PAM type: YTN; PAM sequence: CTT
ctttttttttttaaatccta

SEQ ID NO: 207698 - DNA, 20 bp, Artificial Sequence
  Description of Artificial Sequence: Synthetic oligonucleotide
  Target: ATXN1; (-) strand; PAM type: YTN; PAM sequence: CTC
agcttctttttttttttaaa

SEQ ID NO: 207699 - DNA, 20 bp, Artificial Sequence
  Description of Artificial Sequence: Synthetic oligonucleotide
  Target: ATXN1; (-) strand; PAM type: YTN; PAM sequence: TTA
atggcagactcagcttcttt

SEQ ID NO: 207700 - DNA, 20 bp, Artificial Sequence
  Description of Artificial Sequence: Synthetic oligonucleotide
  Target: ATXN1; (-) strand; PAM type: YTN; PAM sequence: CTT
aatggcagactcagcttctt

SEQ ID NO: 207701 - DNA, 20 bp, Artificial Sequence
  Description of Artificial Sequence: Synthetic oligonucleotide
  Target: ATXN1; (-) strand; PAM type: YTN; PAM sequence: TTC
ttaatggcagactcagcttc

SEQ ID NO: 207702 - DNA, 20 bp, Artificial Sequence
  Description of Artificial Sequence: Synthetic oligonucleotide
  Target: ATXN1; (-) strand; PAM type: YTN; PAM sequence: TTC
attcttaatggcagactcag

SEQ ID NO: 207703 - DNA, 20 bp, Artificial Sequence
  Description of Artificial Sequence: Synthetic oligonucleotide
  Target: ATXN1; (-) strand; PAM type: YTN; PAM sequence: CTT
cattcttaatggcagactca

SEQ ID NO: 207704 - DNA, 20 bp, Artificial Sequence
  Description of Artificial Sequence: Synthetic oligonucleotide
  Target: ATXN1; (-) strand; PAM type: YTN; PAM sequence: TTA
cttcattcttaatggcagac

SEQ ID NO: 207705 - DNA, 20 bp, Artificial Sequence
  Description of Artificial Sequence: Synthetic oligonucleotide
  Target: ATXN1; (-) strand; PAM type: YTN; PAM sequence: TTT
acttcattcttaatggcaga

SEQ ID NO: 207706 - DNA, 20 bp, Artificial Sequence
  Description of Artificial Sequence: Synthetic oligonucleotide
  Target: ATXN1; (-) strand; PAM type: YTN; PAM sequence: TTA
gcaatttacttcattcttaa

SEQ ID NO: 207707 - DNA, 20 bp, Artificial Sequence
  Description of Artificial Sequence: Synthetic oligonucleotide
  Target: ATXN1; (-) strand; PAM type: YTN; PAM sequence: CTG
tgttagcaatttacttcatt

SEQ ID NO: 207708 - DNA, 20 bp, Artificial Sequence
  Description of Artificial Sequence: Synthetic oligonucleotide
  Target: ATXN1; (-) strand; PAM type: YTN; PAM sequence: TTA
aaaatctgtgttagcaattt

SEQ ID NO: 207709 - DNA, 20 bp, Artificial Sequence
  Description of Artificial Sequence: Synthetic oligonucleotide
  Target: ATXN1; (-) strand; PAM type: YTN; PAM sequence: TTG
tgtgtgtgtaagaacattaa

SEQ ID NO: 207710 - DNA, 20 bp, Artificial Sequence
  Description of Artificial Sequence: Synthetic oligonucleotide
  Target: ATXN1; (-) strand; PAM type: YTN; PAM sequence: TTT
gtgtgtgtgtaagaacatta

SEQ ID NO: 207711 - DNA, 20 bp, Artificial Sequence
  Description of Artificial Sequence: Synthetic oligonucleotide
  Target: ATXN1; (-) strand; PAM type: YTN; PAM sequence: TTT
tgtgtgtgtgtaagaacatt

SEQ ID NO: 207712 - DNA, 20 bp, Artificial Sequence
  Description of Artificial Sequence: Synthetic oligonucleotide
  Target: ATXN1; (-) strand; PAM type: YTN; PAM sequence: TTA
tcattttgtgtgtgtgtaag

SEQ ID NO: 207713 - DNA, 20 bp, Artificial Sequence
  Description of Artificial Sequence: Synthetic oligonucleotide
  Target: ATXN1; (-) strand; PAM type: YTN; PAM sequence: TTT
atcattttgtgtgtgtgtaa

SEQ ID NO: 207714 - DNA, 20 bp, Artificial Sequence
  Description of Artificial Sequence: Synthetic oligonucleotide
  Target: ATXN1; (-) strand; PAM type: YTN; PAM sequence: CTC
accagtttatcattttgtgt

SEQ ID NO: 207715 - DNA, 20 bp, Artificial Sequence
  Description of Artificial Sequence: Synthetic oligonucleotide
  Target: ATXN1; (-) strand; PAM type: YTN; PAM sequence: TTC
atcacctcaccagtttatca

SEQ ID NO: 207716 - DNA, 20 bp, Artificial Sequence
  Description of Artificial Sequence: Synthetic oligonucleotide
  Target: ATXN1; (-) strand; PAM type: YTN; PAM sequence: TTA
atatattcatcacctcacca

SEQ ID NO: 207717 - DNA, 20 bp, Artificial Sequence
  Description of Artificial Sequence: Synthetic oligonucleotide
  Target: ATXN1; (-) strand; PAM type: YTN; PAM sequence: CTA
gttaatatattcatcacctc

SEQ ID NO: 207718 - DNA, 20 bp, Artificial Sequence
  Description of Artificial Sequence: Synthetic oligonucleotide
  Target: ATXN1; (-) strand; PAM type: YTN; PAM sequence: TTC
aatcaagctagttaatatat

SEQ ID NO: 207719 - DNA, 20 bp, Artificial Sequence
  Description of Artificial Sequence: Synthetic oligonucleotide
  Target: ATXN1; (-) strand; PAM type: YTN; PAM sequence: TTA
taacaagattcaatcaagct

SEQ ID NO: 207720 - DNA, 20 bp, Artificial Sequence
  Description of Artificial Sequence: Synthetic oligonucleotide
  Target: ATXN1; (-) strand; PAM type: YTN; PAM sequence: TTA
taatgcatacattataacaa

SEQ ID NO: 207721 - DNA, 20 bp, Artificial Sequence
  Description of Artificial Sequence: Synthetic oligonucleotide
  Target: ATXN1; (-) strand; PAM type: YTN; PAM sequence: TTT
ataatgcatacattataaca

SEQ ID NO: 207722 - DNA, 20 bp, Artificial Sequence
  Description of Artificial Sequence: Synthetic oligonucleotide
  Target: ATXN1; (-) strand; PAM type: YTN; PAM sequence: TTT
tataatgcatacattataac

SEQ ID NO: 207723 - DNA, 20 bp, Artificial Sequence
  Description of Artificial Sequence: Synthetic oligonucleotide
  Target: ATXN1; (-) strand; PAM type: YTN; PAM sequence: TTT
ttataatgcatacattataa

SEQ ID NO: 207724 - DNA, 20 bp, Artificial Sequence
  Description of Artificial Sequence: Synthetic oligonucleotide
  Target: ATXN1; (-) strand; PAM type: YTN; PAM sequence: TTA
tggggtacagtgtgatgttt

SEQ ID NO: 207725 - DNA, 20 bp, Artificial Sequence
  Description of Artificial Sequence: Synthetic oligonucleotide
  Target: ATXN1; (-) strand; PAM type: YTN; PAM sequence: TTT
atggggtacagtgtgatgtt

SEQ ID NO: 207726 - DNA, 20 bp, Artificial Sequence
  Description of Artificial Sequence: Synthetic oligonucleotide
  Target: ATXN1; (-) strand; PAM type: YTN; PAM sequence: TTA
tgtatatttatggggtacag

SEQ ID NO: 207727 - DNA, 20 bp, Artificial Sequence
  Description of Artificial Sequence: Synthetic oligonucleotide
  Target: ATXN1; (-) strand; PAM type: YTN; PAM sequence: TTA
taggcaataattatgtatat

SEQ ID NO: 207728 - DNA, 20 bp, Artificial Sequence
  Description of Artificial Sequence: Synthetic oligonucleotide
  Target: ATXN1; (-) strand; PAM type: YTN; PAM sequence: TTT
ataggcaataattatgtata

SEQ ID NO: 207729 - DNA, 20 bp, Artificial Sequence
  Description of Artificial Sequence: Synthetic oligonucleotide
  Target: ATXN1; (-) strand; PAM type: YTN; PAM sequence: TTA
tatttataggcaataattat

SEQ ID NO: 207730 - DNA, 20 bp, Artificial Sequence
  Description of Artificial Sequence: Synthetic oligonucleotide
  Target: ATXN1; (-) strand; PAM type: YTN; PAM sequence: TTT
atatttataggcaataatta

SEQ ID NO: 207731 - DNA, 20 bp, Artificial Sequence
  Description of Artificial Sequence: Synthetic oligonucleotide
  Target: ATXN1; (-) strand; PAM type: YTN; PAM sequence: TTT
tatatttataggcaataatt

SEQ ID NO: 207732 - DNA, 20 bp, Artificial Sequence
  Description of Artificial Sequence: Synthetic oligonucleotide
  Target: ATXN1; (-) strand; PAM type: YTN; PAM sequence: TTT
ttatatttataggcaataat

SEQ ID NO: 207733 - DNA, 20 bp, Artificial Sequence
  Description of Artificial Sequence: Synthetic oligonucleotide
  Target: ATXN1; (-) strand; PAM type: YTN; PAM sequence: CTT
tttatatttataggcaataa

SEQ ID NO: 207734 - DNA, 20 bp, Artificial Sequence
  Description of Artificial Sequence: Synthetic oligonucleotide
  Target: ATXN1; (-) strand; PAM type: YTN; PAM sequence: TTA
actttttatatttataggca

SEQ ID NO: 207735 - DNA, 20 bp, Artificial Sequence
  Description of Artificial Sequence: Synthetic oligonucleotide
  Target: ATXN1; (-) strand; PAM type: YTN; PAM sequence: TTT
aactttttatatttataggc

SEQ ID NO: 207736 - DNA, 20 bp, Artificial Sequence
  Description of Artificial Sequence: Synthetic oligonucleotide
  Target: ATXN1; (-) strand; PAM type: YTN; PAM sequence: TTT
taactttttatatttatagg

SEQ ID NO: 207737 - DNA, 20 bp, Artificial Sequence
  Description of Artificial Sequence: Synthetic oligonucleotide
  Target: ATXN1; (-) strand; PAM type: YTN; PAM sequence: TTG
ttttaactttttatatttat

SEQ ID NO: 207738 - DNA, 20 bp, Artificial Sequence
  Description of Artificial Sequence: Synthetic oligonucleotide
  Target: ATXN1; (-) strand; PAM type: YTN; PAM sequence: TTT
gttttaactttttatattta

SEQ ID NO: 207739 - DNA, 20 bp, Artificial Sequence
  Description of Artificial Sequence: Synthetic oligonucleotide
  Target: ATXN1; (-) strand; PAM type: YTN; PAM sequence: TTT
tgttttaactttttatattt

SEQ ID NO: 207740 - DNA, 20 bp, Artificial Sequence
  Description of Artificial Sequence: Synthetic oligonucleotide
  Target: ATXN1; (-) strand; PAM type: YTN; PAM sequence: TTT
ttgttttaactttttatatt

SEQ ID NO: 207741 - DNA, 20 bp, Artificial Sequence
  Description of Artificial Sequence: Synthetic oligonucleotide
  Target: ATXN1; (-) strand; PAM type: YTN; PAM sequence: TTT
tttgttttaactttttatat

SEQ ID NO: 207742 - DNA, 20 bp, Artificial Sequence
  Description of Artificial Sequence: Synthetic oligonucleotide
  Target: ATXN1; (-) strand; PAM type: YTN; PAM sequence: TTA
attttttgttttaacttttt

SEQ ID NO: 207743 - DNA, 20 bp, Artificial Sequence
  Description of Artificial Sequence: Synthetic oligonucleotide
  Target: ATXN1; (-) strand; PAM type: YTN; PAM sequence: TTT
aattttttgttttaactttt

SEQ ID NO: 207744 - DNA, 20 bp, Artificial Sequence
  Description of Artificial Sequence: Synthetic oligonucleotide
  Target: ATXN1; (-) strand; PAM type: YTN; PAM sequence: CTT
taattttttgttttaacttt

SEQ ID NO: 207745 - DNA, 20 bp, Artificial Sequence
  Description of Artificial Sequence: Synthetic oligonucleotide
  Target: ATXN1; (-) strand; PAM type: YTN; PAM sequence: TTC
tttaattttttgttttaact

SEQ ID NO: 207746 - DNA, 20 bp, Artificial Sequence
  Description of Artificial Sequence: Synthetic oligonucleotide
  Target: ATXN1; (-) strand; PAM type: YTN; PAM sequence: TTT
ctttaattttttgttttaac

SEQ ID NO: 207747 - DNA, 20 bp, Artificial Sequence
  Description of Artificial Sequence: Synthetic oligonucleotide
  Target: ATXN1; (-) strand; PAM type: YTN; PAM sequence: TTA
tttctttaattttttgtttt

SEQ ID NO: 207748 - DNA, 20 bp, Artificial Sequence
  Description of Artificial Sequence: Synthetic oligonucleotide
  Target: ATXN1; (-) strand; PAM type: YTN; PAM sequence: TTT
atttctttaattttttgttt

SEQ ID NO: 207749 - DNA, 20 bp, Artificial Sequence
  Description of Artificial Sequence: Synthetic oligonucleotide
  Target: ATXN1; (-) strand; PAM type: YTN; PAM sequence: TTC
accatttatttctttaattt

SEQ ID NO: 207750 - DNA, 20 bp, Artificial Sequence
  Description of Artificial Sequence: Synthetic oligonucleotide
  Target: ATXN1; (-) strand; PAM type: YTN; PAM sequence: CTT
caccatttatttctttaatt

SEQ ID NO: 207751 - DNA, 20 bp, Artificial Sequence
  Description of Artificial Sequence: Synthetic oligonucleotide
  Target: ATXN1; (-) strand; PAM type: YTN; PAM sequence: TTA
aaaaatgtcttcaccattta

SEQ ID NO: 207752 - DNA, 20 bp, Artificial Sequence
  Description of Artificial Sequence: Synthetic oligonucleotide
  Target: ATXN1; (-) strand; PAM type: YTN; PAM sequence: TTT
aaaaaatgtcttcaccattt

SEQ ID NO: 207753 - DNA, 20 bp, Artificial Sequence
  Description of Artificial Sequence: Synthetic oligonucleotide
  Target: ATXN1; (-) strand; PAM type: YTN; PAM sequence: TTT
taaaaaatgtcttcaccatt

SEQ ID NO: 207754 - DNA, 20 bp, Artificial Sequence
  Description of Artificial Sequence: Synthetic oligonucleotide
  Target: ATXN1; (-) strand; PAM type: YTN; PAM sequence: TTT
ttaaaaaatgtcttcaccat

SEQ ID NO: 207755 - DNA, 20 bp, Artificial Sequence
  Description of Artificial Sequence: Synthetic oligonucleotide
  Target: ATXN1; (-) strand; PAM type: YTN; PAM sequence: TTT
tttaaaaaatgtcttcacca

SEQ ID NO: 207756 - DNA, 20 bp, Artificial Sequence
  Description of Artificial Sequence: Synthetic oligonucleotide
  Target: ATXN1; (-) strand; PAM type: YTN; PAM sequence: TTC
attttttaaaaaatgtcttc

SEQ ID NO: 207757 - DNA, 20 bp, Artificial Sequence
  Description of Artificial Sequence: Synthetic oligonucleotide
  Target: ATXN1; (-) strand; PAM type: YTN; PAM sequence: CTA
tgtagcatgcatgaaagcat

SEQ ID NO: 207758 - DNA, 20 bp, Artificial Sequence
  Description of Artificial Sequence: Synthetic oligonucleotide
  Target: ATXN1; (-) strand; PAM type: YTN; PAM sequence: TTG
tgacaagctatgtagcatgc

SEQ ID NO: 207759 - DNA, 20 bp, Artificial Sequence
  Description of Artificial Sequence: Synthetic oligonucleotide
  Target: ATXN1; (-) strand; PAM type: YTN; PAM sequence: TTC
cggcaggttgtgacaagcta

SEQ ID NO: 207760 - DNA, 20 bp, Artificial Sequence
  Description of Artificial Sequence: Synthetic oligonucleotide
  Target: ATXN1; (-) strand; PAM type: YTN; PAM sequence: TTG
gcaacccgttccggcaggtt

SEQ ID NO: 207761 - DNA, 20 bp, Artificial Sequence
  Description of Artificial Sequence: Synthetic oligonucleotide
  Target: ATXN1; (-) strand; PAM type: YTN; PAM sequence: TTA
aaagcatgtcacattggcaa

SEQ ID NO: 207762 - DNA, 20 bp, Artificial Sequence
  Description of Artificial Sequence: Synthetic oligonucleotide
  Target: ATXN1; (-) strand; PAM type: YTN; PAM sequence: CTT
aaaagcatgtcacattggca

SEQ ID NO: 207763 - DNA, 20 bp, Artificial Sequence
  Description of Artificial Sequence: Synthetic oligonucleotide
  Target: ATXN1; (-) strand; PAM type: YTN; PAM sequence: CTG
tgatcttaaaagcatgtcac

SEQ ID NO: 207764 - DNA, 20 bp, Artificial Sequence
  Description of Artificial Sequence: Synthetic oligonucleotide
  Target: ATXN1; (-) strand; PAM type: YTN; PAM sequence: CTG
gagggctgtgatcttaaaag

SEQ ID NO: 207765 - DNA, 20 bp, Artificial Sequence
  Description of Artificial Sequence: Synthetic oligonucleotide
  Target: ATXN1; (-) strand; PAM type: YTN; PAM sequence: TTG
ctggagggctgtgatcttaa

SEQ ID NO: 207766 - DNA, 20 bp, Artificial Sequence
  Description of Artificial Sequence: Synthetic oligonucleotide
  Target: ATXN1; (-) strand; PAM type: YTN; PAM sequence: TTC
aggtatcaatgtgttgctgg

SEQ ID NO: 207767 - DNA, 20 bp, Artificial Sequence
  Description of Artificial Sequence: Synthetic oligonucleotide
  Target: ATXN1; (-) strand; PAM type: YTN; PAM sequence: TTT
caggtatcaatgtgttgctg

SEQ ID NO: 207768 - DNA, 20 bp, Artificial Sequence
  Description of Artificial Sequence: Synthetic oligonucleotide
  Target: ATXN1; (-) strand; PAM type: YTN; PAM sequence: TTA
tggagtttcaggtatcaatg

SEQ ID NO: 207769 - DNA, 20 bp, Artificial Sequence
  Description of Artificial Sequence: Synthetic oligonucleotide
  Target: ATXN1; (-) strand; PAM type: YTN; PAM sequence: TTA
attatggagtttcaggtatc

SEQ ID NO: 207770 - DNA, 20 bp, Artificial Sequence
  Description of Artificial Sequence: Synthetic oligonucleotide
  Target: ATXN1; (-) strand; PAM type: YTN; PAM sequence: CTT
aattatggagtttcaggtat

SEQ ID NO: 207771 - DNA, 20 bp, Artificial Sequence
  Description of Artificial Sequence: Synthetic oligonucleotide
  Target: ATXN1; (-) strand; PAM type: YTN; PAM sequence: CTC
ttaattatggagtttcaggt

SEQ ID NO: 207772 - DNA, 20 bp, Artificial Sequence
  Description of Artificial Sequence: Synthetic oligonucleotide
  Target: ATXN1; (-) strand; PAM type: YTN; PAM sequence: TTA
aacaaaaggaaataactctt

SEQ ID NO: 207773 - DNA, 20 bp, Artificial Sequence
  Description of Artificial Sequence: Synthetic oligonucleotide
  Target: ATXN1; (-) strand; PAM type: YTN; PAM sequence: TTT
aaacaaaaggaaataactct

SEQ ID NO: 207774 - DNA, 20 bp, Artificial Sequence
  Description of Artificial Sequence: Synthetic oligonucleotide
  Target: ATXN1; (-) strand; PAM type: YTN; PAM sequence: CTT
taaacaaaaggaaataactc

SEQ ID NO: 207775 - DNA, 20 bp, Artificial Sequence
  Description of Artificial Sequence: Synthetic oligonucleotide
  Target: ATXN1; (-) strand; PAM type: YTN; PAM sequence: TTC
aaaagagaaaacatctttaa

SEQ ID NO: 207776 - DNA, 20 bp, Artificial Sequence
  Description of Artificial Sequence: Synthetic oligonucleotide
  Target: ATXN1; (-) strand; PAM type: YTN; PAM sequence: TTT
caaaagagaaaacatcttta

SEQ ID NO: 207777 - DNA, 20 bp, Artificial Sequence
  Description of Artificial Sequence: Synthetic oligonucleotide
  Target: ATXN1; (-) strand; PAM type: YTN; PAM sequence: CTG
aaatttcaaaagagaaaaca

SEQ ID NO: 207778 - DNA, 20 bp, Artificial Sequence
  Description of Artificial Sequence: Synthetic oligonucleotide
  Target: ATXN1; (-) strand; PAM type: YTN; PAM sequence: TTA
tactgaaatttcaaaagaga

SEQ ID NO: 207779 - DNA, 20 bp, Artificial Sequence
  Description of Artificial Sequence: Synthetic oligonucleotide
  Target: ATXN1; (-) strand; PAM type: YTN; PAM sequence: TTC
caaagtagcatattatactg

SEQ ID NO: 207780 - DNA, 20 bp, Artificial Sequence
  Description of Artificial Sequence: Synthetic oligonucleotide
  Target: ATXN1; (-) strand; PAM type: YTN; PAM sequence: CTT
ccaaagtagcatattatact

SEQ ID NO: 207781 - DNA, 20 bp, Artificial Sequence
  Description of Artificial Sequence: Synthetic oligonucleotide
  Target: ATXN1; (-) strand; PAM type: YTN; PAM sequence: CTG
gatataccacttccaaagta

SEQ ID NO: 207782 - DNA, 20 bp, Artificial Sequence
  Description of Artificial Sequence: Synthetic oligonucleotide
  Target: ATXN1; (-) strand; PAM type: YTN; PAM sequence: TTG
gagatctggatataccactt

SEQ ID NO: 207783 - DNA, 20 bp, Artificial Sequence
  Description of Artificial Sequence: Synthetic oligonucleotide
  Target: ATXN1; (-) strand; PAM type: YTN; PAM sequence: TTT
ggagatctggatataccact

SEQ ID NO: 207784 - DNA, 20 bp, Artificial Sequence
  Description of Artificial Sequence: Synthetic oligonucleotide
  Target: ATXN1; (-) strand; PAM type: YTN; PAM sequence: TTT
tggagatctggatataccac

SEQ ID NO: 207785 - DNA, 20 bp, Artificial Sequence
  Description of Artificial Sequence: Synthetic oligonucleotide
  Target: ATXN1; (-) strand; PAM type: YTN; PAM sequence: TTA
aaatatgcatatgcatatat

SEQ ID NO: 207786 - DNA, 20 bp, Artificial Sequence
  Description of Artificial Sequence: Synthetic oligonucleotide
  Target: ATXN1; (-) strand; PAM type: YTN; PAM sequence: TTT
aaaatatgcatatgcatata

SEQ ID NO: 207787 - DNA, 20 bp, Artificial Sequence
  Description of Artificial Sequence: Synthetic oligonucleotide
  Target: ATXN1; (-) strand; PAM type: YTN; PAM sequence: TTT
taaaatatgcatatgcatat

SEQ ID NO: 207788 - DNA, 20 bp, Artificial Sequence
  Description of Artificial Sequence: Synthetic oligonucleotide
  Target: ATXN1; (-) strand; PAM type: YTN; PAM sequence: TTG
attttaaaatatgcatatgc

SEQ ID NO: 207789 - DNA, 20 bp, Artificial Sequence
  Description of Artificial Sequence: Synthetic oligonucleotide
  Target: ATXN1; (-) strand; PAM type: YTN; PAM sequence: TTT
gattttaaaatatgcatatg

SEQ ID NO: 207790 - DNA, 20 bp, Artificial Sequence
  Description of Artificial Sequence: Synthetic oligonucleotide
  Target: ATXN1; (-) strand; PAM type: YTN; PAM sequence: CTT
tgattttaaaatatgcatat

SEQ ID NO: 207791 - DNA, 20 bp, Artificial Sequence
  Description of Artificial Sequence: Synthetic oligonucleotide
  Target: ATXN1; (-) strand; PAM type: YTN; PAM sequence: CTC
ggctttgattttaaaatatg

SEQ ID NO: 207792 - DNA, 20 bp, Artificial Sequence
  Description of Artificial Sequence: Synthetic oligonucleotide
  Target: ATXN1; (-) strand; PAM type: YTN; PAM sequence: TTA
ggatcaatactcggctttga

SEQ ID NO: 207793 - DNA, 20 bp, Artificial Sequence
  Description of Artificial Sequence: Synthetic oligonucleotide
  Target: ATXN1; (-) strand; PAM type: YTN; PAM sequence: CTG
gaaagtggtaaagttaggat

SEQ ID NO: 207794 - DNA, 20 bp, Artificial Sequence
  Description of Artificial Sequence: Synthetic oligonucleotide
  Target: ATXN1; (-) strand; PAM type: YTN; PAM sequence: CTC
aaagtgacagagctggaaag

SEQ ID NO: 207795 - DNA, 20 bp, Artificial Sequence
  Description of Artificial Sequence: Synthetic oligonucleotide
  Target: ATXN1; (-) strand; PAM type: YTN; PAM sequence: TTC
ctcaaagtgacagagctgga

SEQ ID NO: 207796 - DNA, 20 bp, Artificial Sequence
  Description of Artificial Sequence: Synthetic oligonucleotide
  Target: ATXN1; (-) strand; PAM type: YTN; PAM sequence: TTT
cctcaaagtgacagagctgg

SEQ ID NO: 207797 - DNA, 20 bp, Artificial Sequence
  Description of Artificial Sequence: Synthetic oligonucleotide
  Target: ATXN1; (-) strand; PAM type: YTN; PAM sequence: TTG
agggtcaagccagtaaataa

SEQ ID NO: 207798 - DNA, 20 bp, Artificial Sequence
  Description of Artificial Sequence: Synthetic oligonucleotide
  Target: ATXN1; (-) strand; PAM type: YTN; PAM sequence: CTT
gagggtcaagccagtaaata

SEQ ID NO: 207799 - DNA, 20 bp, Artificial Sequence
  Description of Artificial Sequence: Synthetic oligonucleotide
  Target: ATXN1; (-) strand; PAM type: YTN; PAM sequence: TTA
cagcggatgaacttgagggt

SEQ ID NO: 207800 - DNA, 20 bp, Artificial Sequence
  Description of Artificial Sequence: Synthetic oligonucleotide
  Target: ATXN1; (-) strand; PAM type: YTN; PAM sequence: TTT
acagcggatgaacttgaggg

SEQ ID NO: 207801 - DNA, 20 bp, Artificial Sequence
  Description of Artificial Sequence: Synthetic oligonucleotide
  Target: ATXN1; (-) strand; PAM type: YTN; PAM sequence: TTT
tacagcggatgaacttgagg

SEQ ID NO: 207802 - DNA, 20 bp, Artificial Sequence
  Description of Artificial Sequence: Synthetic oligonucleotide
  Target: ATXN1; (-) strand; PAM type: YTN; PAM sequence: CTT
ttacagcggatgaacttgag

SEQ ID NO: 207803 - DNA, 20 bp, Artificial Sequence
  Description of Artificial Sequence: Synthetic oligonucleotide
  Target: ATXN1; (-) strand; PAM type: YTN; PAM sequence: CTC
cttttacagcggatgaactt

SEQ ID NO: 207804 - DNA, 20 bp, Artificial Sequence
  Description of Artificial Sequence: Synthetic oligonucleotide
  Target: ATXN1; (-) strand; PAM type: YTN; PAM sequence: TTA
gtgactccttttacagcgga

SEQ ID NO: 207805 - DNA, 20 bp, Artificial Sequence
  Description of Artificial Sequence: Synthetic oligonucleotide
  Target: ATXN1; (-) strand; PAM type: YTN; PAM sequence: CTG
agacaagcgttagtgactcc

SEQ ID NO: 207806 - DNA, 20 bp, Artificial Sequence
  Description of Artificial Sequence: Synthetic oligonucleotide
  Target: ATXN1; (-) strand; PAM type: YTN; PAM sequence: TTC
tgagacaagcgttagtgact

SEQ ID NO: 207807 - DNA, 20 bp, Artificial Sequence
  Description of Artificial Sequence: Synthetic oligonucleotide
  Target: ATXN1; (-) strand; PAM type: YTN; PAM sequence: CTT
ctgagacaagcgttagtgac

SEQ ID NO: 207808 - DNA, 20 bp, Artificial Sequence
  Description of Artificial Sequence: Synthetic oligonucleotide
  Target: ATXN1; (-) strand; PAM type: YTN; PAM sequence: TTA
tatacgtaacaaccttctga

SEQ ID NO: 207809 - DNA, 20 bp, Artificial Sequence
  Description of Artificial Sequence: Synthetic oligonucleotide
  Target: ATXN1; (-) strand; PAM type: YTN; PAM sequence: TTT
atatacgtaacaaccttctg

SEQ ID NO: 207810 - DNA, 20 bp, Artificial Sequence
  Description of Artificial Sequence: Synthetic oligonucleotide
  Target: ATXN1; (-) strand; PAM type: YTN; PAM sequence: TTT
tatatacgtaacaaccttct

SEQ ID NO: 207811 - DNA, 20 bp, Artificial Sequence
  Description of Artificial Sequence: Synthetic oligonucleotide
  Target: ATXN1; (-) strand; PAM type: YTN; PAM sequence: CTG
ggccgcgtagttttatatac

SEQ ID NO: 207812 - DNA, 20 bp, Artificial Sequence
  Description of Artificial Sequence: Synthetic oligonucleotide
  Target: ATXN1; (-) strand; PAM type: YTN; PAM sequence: CTG
tgggtgtggtctgggccgcg

SEQ ID NO: 207813 - DNA, 20 bp, Artificial Sequence
  Description of Artificial Sequence: Synthetic oligonucleotide
  Target: ATXN1; (-) strand; PAM type: YTN; PAM sequence: CTG
ctgtgggtgtggtctgggcc

SEQ ID NO: 207814 - DNA, 20 bp, Artificial Sequence
  Description of Artificial Sequence: Synthetic oligonucleotide
  Target: ATXN1; (-) strand; PAM type: YTN; PAM sequence: CTG
tgtagaaagagaggggaaaa

SEQ ID NO: 207815 - DNA, 20 bp, Artificial Sequence
  Description of Artificial Sequence: Synthetic oligonucleotide
  Target: ATXN1; (-) strand; PAM type: YTN; PAM sequence: CTG
ctgtgtagaaagagagggga

SEQ ID NO: 207816 - DNA, 20 bp, Artificial Sequence
  Description of Artificial Sequence: Synthetic oligonucleotide
  Target: ATXN1; (-) strand; PAM type: YTN; PAM sequence: TTA
tgacctgctgtgtagaaaga

SEQ ID NO: 207817 - DNA, 20 bp, Artificial Sequence
  Description of Artificial Sequence: Synthetic oligonucleotide
  Target: ATXN1; (-) strand; PAM type: YTN; PAM sequence: CTT
atgacctgctgtgtagaaag

SEQ ID NO: 207818 - DNA, 20 bp, Artificial Sequence
  Description of Artificial Sequence: Synthetic oligonucleotide
  Target: ATXN1; (-) strand; PAM type: YTN; PAM sequence: TTC
ttatgacctgctgtgtagaa

SEQ ID NO: 207819 - DNA, 20 bp, Artificial Sequence
  Description of Artificial Sequence: Synthetic oligonucleotide
  Target: ATXN1; (-) strand; PAM type: YTN; PAM sequence: CTT
cttatgacctgctgtgtaga

SEQ ID NO: 207820 - DNA, 20 bp, Artificial Sequence
  Description of Artificial Sequence: Synthetic oligonucleotide
  Target: ATXN1; (-) strand; PAM type: YTN; PAM sequence: TTA
cttcttatgacctgctgtgt

SEQ ID NO: 207821 - DNA, 20 bp, Artificial Sequence
  Description of Artificial Sequence: Synthetic oligonucleotide
  Target: ATXN1; (-) strand; PAM type: YTN; PAM sequence: CTT
acttcttatgacctgctgtg

SEQ ID NO: 207822 - DNA, 20 bp, Artificial Sequence
  Description of Artificial Sequence: Synthetic oligonucleotide
  Target: ATXN1; (-) strand; PAM type: YTN; PAM sequence: TTG
tccttacttcttatgacctg

SEQ ID NO: 207823 - DNA, 20 bp, Artificial Sequence
  Description of Artificial Sequence: Synthetic oligonucleotide
  Target: ATXN1; (-) strand; PAM type: YTN; PAM sequence: TTG
agttgtccttacttcttatg

SEQ ID NO: 207824 - DNA, 20 bp, Artificial Sequence
  Description of Artificial Sequence: Synthetic oligonucleotide
  Target: ATXN1; (-) strand; PAM type: YTN; PAM sequence: CTT
gagttgtccttacttcttat

SEQ ID NO: 207825 - DNA, 20 bp, Artificial Sequence
  Description of Artificial Sequence: Synthetic oligonucleotide
  Target: ATXN1; (-) strand; PAM type: YTN; PAM sequence: TTC
cacaccaggaagccagcatc

SEQ ID NO: 207826 - DNA, 20 bp, Artificial Sequence
  Description of Artificial Sequence: Synthetic oligonucleotide
  Target: ATXN1; (-) strand; PAM type: YTN; PAM sequence: TTA
tcattccacaccaggaagcc

SEQ ID NO: 207827 - DNA, 20 bp, Artificial Sequence
  Description of Artificial Sequence: Synthetic oligonucleotide
  Target: ATXN1; (-) strand; PAM type: YTN; PAM sequence: CTT
atcattccacaccaggaagc

SEQ ID NO: 207828 - DNA, 20 bp, Artificial Sequence
  Description of Artificial Sequence: Synthetic oligonucleotide
  Target: ATXN1; (-) strand; PAM type: YTN; PAM sequence: CTG
gccgccttatcattccacac

SEQ ID NO: 207829 - DNA, 20 bp, Artificial Sequence
  Description of Artificial Sequence: Synthetic oligonucleotide
  Target: ATXN1; (-) strand; PAM type: YTN; PAM sequence: TTG
ctggccgccttatcattcca

SEQ ID NO: 207830 - DNA, 20 bp, Artificial Sequence
  Description of Artificial Sequence: Synthetic oligonucleotide
  Target: ATXN1; (-) strand; PAM type: YTN; PAM sequence: CTT
gctggccgccttatcattcc

SEQ ID NO: 207831 - DNA, 20 bp, Artificial Sequence
  Description of Artificial Sequence: Synthetic oligonucleotide
  Target: ATXN1; (-) strand; PAM type: YTN; PAM sequence: CTC
cagcttgctggccgccttat

SEQ ID NO: 207832 - DNA, 20 bp, Artificial Sequence
  Description of Artificial Sequence: Synthetic oligonucleotide
  Target: ATXN1; (-) strand; PAM type: YTN; PAM sequence: CTG
ccacccccactccagcttgc

SEQ ID NO: 207833 - DNA, 20 bp, Artificial Sequence
  Description of Artificial Sequence: Synthetic oligonucleotide
  Target: ATXN1; (-) strand; PAM type: YTN; PAM sequence: CTC
ctgccacccccactccagct

SEQ ID NO: 207834 - DNA, 20 bp, Artificial Sequence
  Description of Artificial Sequence: Synthetic oligonucleotide
  Target: ATXN1; (-) strand; PAM type: YTN; PAM sequence: TTC
tcctgccacccccactccag

SEQ ID NO: 207835 - DNA, 20 bp, Artificial Sequence
  Description of Artificial Sequence: Synthetic oligonucleotide
  Target: ATXN1; (-) strand; PAM type: YTN; PAM sequence: TTT
ctcctgccacccccactcca

SEQ ID NO: 207836 - DNA, 20 bp, Artificial Sequence
  Description of Artificial Sequence: Synthetic oligonucleotide
  Target: ATXN1; (-) strand; PAM type: YTN; PAM sequence: TTT
tctcctgccacccccactcc

SEQ ID NO: 207837 - DNA, 20 bp, Artificial Sequence
  Description of Artificial Sequence: Synthetic oligonucleotide
  Target: ATXN1; (-) strand; PAM type: YTN; PAM sequence: CTT
ttctcctgccacccccactc

SEQ ID NO: 207838 - DNA, 20 bp, Artificial Sequence
  Description of Artificial Sequence: Synthetic oligonucleotide
  Target: ATXN1; (-) strand; PAM type: YTN; PAM sequence: CTG
tcatggggcccaggtgtcct

SEQ ID NO: 207839 - DNA, 20 bp, Artificial Sequence
  Description of Artificial Sequence: Synthetic oligonucleotide
  Target: ATXN1; (-) strand; PAM type: YTN; PAM sequence: TTC
tgtcatggggcccaggtgtc

SEQ ID NO: 207840 - DNA, 20 bp, Artificial Sequence
  Description of Artificial Sequence: Synthetic oligonucleotide
  Target: ATXN1; (-) strand; PAM type: YTN; PAM sequence: TTG
tgaaacaggttctgtcatgg

SEQ ID NO: 207841 - DNA, 20 bp, Artificial Sequence
  Description of Artificial Sequence: Synthetic oligonucleotide
  Target: ATXN1; (-) strand; PAM type: YTN; PAM sequence: TTT
gtgaaacaggttctgtcatg

SEQ ID NO: 207842 - DNA, 20 bp, Artificial Sequence
  Description of Artificial Sequence: Synthetic oligonucleotide
  Target: ATXN1; (-) strand; PAM type: YTN; PAM sequence: CTC
accacatttgtgaaacaggt

SEQ ID NO: 207843 - DNA, 20 bp, Artificial Sequence
  Description of Artificial Sequence: Synthetic oligonucleotide
  Target: ATXN1; (-) strand; PAM type: YTN; PAM sequence: CTC
ccctcaccacatttgtgaaa

SEQ ID NO: 207844 - DNA, 20 bp, Artificial Sequence
  Description of Artificial Sequence: Synthetic oligonucleotide
  Target: ATXN1; (-) strand; PAM type: YTN; PAM sequence: CTG
gagcagagctcccctcacca

SEQ ID NO: 207845 - DNA, 20 bp, Artificial Sequence
  Description of Artificial Sequence: Synthetic oligonucleotide
  Target: ATXN1; (-) strand; PAM type: YTN; PAM sequence: TTG
tgcactggagcagagctccc

SEQ ID NO: 207846 - DNA, 20 bp, Artificial Sequence
  Description of Artificial Sequence: Synthetic oligonucleotide
  Target: ATXN1; (-) strand; PAM type: YTN; PAM sequence: TTT
gtgcactggagcagagctcc

SEQ ID NO: 207847 - DNA, 20 bp, Artificial Sequence
  Description of Artificial Sequence: Synthetic oligonucleotide
  Target: ATXN1; (-) strand; PAM type: YTN; PAM sequence: TTT
tgtgcactggagcagagctc

SEQ ID NO: 207848 - DNA, 20 bp, Artificial Sequence
  Description of Artificial Sequence: Synthetic oligonucleotide
  Target: ATXN1; (-) strand; PAM type: YTN; PAM sequence: TTT
ttgtgcactggagcagagct

SEQ ID NO: 207849 - DNA, 20 bp, Artificial Sequence
  Description of Artificial Sequence: Synthetic oligonucleotide
  Target: ATXN1; (-) strand; PAM type: YTN; PAM sequence: CTT
tttgtgcactggagcagagc

SEQ ID NO: 207850 - DNA, 20 bp, Artificial Sequence
  Description of Artificial Sequence: Synthetic oligonucleotide
  Target: ATXN1; (-) strand; PAM type: YTN; PAM sequence: CTG
cagcctttttgtgcactgga

SEQ ID NO: 207851 - DNA, 20 bp, Artificial Sequence
  Description of Artificial Sequence: Synthetic oligonucleotide
  Target: ATXN1; (-) strand; PAM type: YTN; PAM sequence: CTG
caaaatggtgtcagcctgca

SEQ ID NO: 207852 - DNA, 20 bp, Artificial Sequence
  Description of Artificial Sequence: Synthetic oligonucleotide
  Target: ATXN1; (-) strand; PAM type: YTN; PAM sequence: TTG
ccagtgaacactgcaaaatg

SEQ ID NO: 207853 - DNA, 20 bp, Artificial Sequence
  Description of Artificial Sequence: Synthetic oligonucleotide
  Target: ATXN1; (-) strand; PAM type: YTN; PAM sequence: CTT
gccagtgaacactgcaaaat

SEQ ID NO: 207854 - DNA, 20 bp, Artificial Sequence
  Description of Artificial Sequence: Synthetic oligonucleotide
  Target: ATXN1; (-) strand; PAM type: YTN; PAM sequence: CTA
tgtcagcagccttgccagtg

SEQ ID NO: 207855 - DNA, 20 bp, Artificial Sequence
  Description of Artificial Sequence: Synthetic oligonucleotide
  Target: ATXN1; (-) strand; PAM type: YTN; PAM sequence: TTC
tatgtcagcagccttgccag

SEQ ID NO: 207856 - DNA, 20 bp, Artificial Sequence
  Description of Artificial Sequence: Synthetic oligonucleotide
  Target: ATXN1; (-) strand; PAM type: YTN; PAM sequence: TTT
ctatgtcagcagccttgcca

SEQ ID NO: 207857 - DNA, 20 bp, Artificial Sequence
  Description of Artificial Sequence: Synthetic oligonucleotide
  Target: ATXN1; (-) strand; PAM type: YTN; PAM sequence: TTG
acggaggccagtttctatgt

SEQ ID NO: 207858 - DNA, 20 bp, Artificial Sequence
  Description of Artificial Sequence: Synthetic oligonucleotide
  Target: ATXN1; (-) strand; PAM type: YTN; PAM sequence: TTT
gacggaggccagtttctatg

SEQ ID NO: 207859 - DNA, 20 bp, Artificial Sequence
  Description of Artificial Sequence: Synthetic oligonucleotide
  Target: ATXN1; (-) strand; PAM type: YTN; PAM sequence: TTT
tgacggaggccagtttctat

SEQ ID NO: 207860 - DNA, 20 bp, Artificial Sequence
  Description of Artificial Sequence: Synthetic oligonucleotide
  Target: ATXN1; (-) strand; PAM type: YTN; PAM sequence: TTT
ttgacggaggccagtttcta

SEQ ID NO: 207861 - DNA, 20 bp, Artificial Sequence
  Description of Artificial Sequence: Synthetic oligonucleotide
  Target: ATXN1; (-) strand; PAM type: YTN; PAM sequence: CTT
tttgacggaggccagtttct

SEQ ID NO: 207862 - DNA, 20 bp, Artificial Sequence
  Description of Artificial Sequence: Synthetic oligonucleotide
  Target: ATXN1; (-) strand; PAM type: YTN; PAM sequence: CTG
gacaccaagccaggaaaagg

SEQ ID NO: 207863 - DNA, 20 bp, Artificial Sequence
  Description of Artificial Sequence: Synthetic oligonucleotide
  Target: ATXN1; (-) strand; PAM type: YTN; PAM sequence: TTC
agctggacaccaagccagga

SEQ ID NO: 207864 - DNA, 20 bp, Artificial Sequence
  Description of Artificial Sequence: Synthetic oligonucleotide
  Target: ATXN1; (-) strand; PAM type: YTN; PAM sequence: TTT
cagctggacaccaagccagg

SEQ ID NO: 207865 - DNA, 20 bp, Artificial Sequence
  Description of Artificial Sequence: Synthetic oligonucleotide
  Target: ATXN1; (-) strand; PAM type: YTN; PAM sequence: TTT
tcagctggacaccaagccag

SEQ ID NO: 207866 - DNA, 20 bp, Artificial Sequence
  Description of Artificial Sequence: Synthetic oligonucleotide
  Target: ATXN1; (-) strand; PAM type: YTN; PAM sequence: CTT
ttcagctggacaccaagcca

SEQ ID NO: 207867 - DNA, 20 bp, Artificial Sequence
  Description of Artificial Sequence: Synthetic oligonucleotide
  Target: ATXN1; (-) strand; PAM type: YTN; PAM sequence: CTC
ttttcagctggacaccaagc

SEQ ID NO: 207868 - DNA, 20 bp, Artificial Sequence
  Description of Artificial Sequence: Synthetic oligonucleotide
  Target: ATXN1; (-) strand; PAM type: YTN; PAM sequence: CTC
ctcttttcagctggacacca

SEQ ID NO: 207869 - DNA, 20 bp, Artificial Sequence
  Description of Artificial Sequence: Synthetic oligonucleotide
  Target: ATXN1; (-) strand; PAM type: YTN; PAM sequence: CTG
tccagatgcacatgaacccc

SEQ ID NO: 207870 - DNA, 20 bp, Artificial Sequence
  Description of Artificial Sequence: Synthetic oligonucleotide
  Target: ATXN1; (-) strand; PAM type: YTN; PAM sequence: TTG
gggtaaagctgtccagatgc

SEQ ID NO: 207871 - DNA, 20 bp, Artificial Sequence
  Description of Artificial Sequence: Synthetic oligonucleotide
  Target: ATXN1; (-) strand; PAM type: YTN; PAM sequence: CTT
ggggtaaagctgtccagatg

SEQ ID NO: 207872 - DNA, 20 bp, Artificial Sequence
  Description of Artificial Sequence: Synthetic oligonucleotide
  Target: ATXN1; (-) strand; PAM type: YTN; PAM sequence: TTG
caggtgcccttggggtaaag

SEQ ID NO: 207873 - DNA, 20 bp, Artificial Sequence
  Description of Artificial Sequence: Synthetic oligonucleotide
  Target: ATXN1; (-) strand; PAM type: YTN; PAM sequence: CTT
gcaggtgcccttggggtaaa

SEQ ID NO: 207874 - DNA, 20 bp, Artificial Sequence
  Description of Artificial Sequence: Synthetic oligonucleotide
  Target: ATXN1; (-) strand; PAM type: YTN; PAM sequence: CTA
ccttgcaggtgcccttgggg

SEQ ID NO: 207875 - DNA, 20 bp, Artificial Sequence
  Description of Artificial Sequence: Synthetic oligonucleotide
  Target: ATXN1; (-) strand; PAM type: YTN; PAM sequence: CTA
ctaccttgcaggtgcccttg

SEQ ID NO: 207876 - DNA, 20 bp, Artificial Sequence
  Description of Artificial Sequence: Synthetic oligonucleotide
  Target: ATXN1; (-) strand; PAM type: YTN; PAM sequence: CTC
ctactaccttgcaggtgccc

SEQ ID NO: 207877 - DNA, 20 bp, Artificial Sequence
  Description of Artificial Sequence: Synthetic oligonucleotide
  Target: ATXN1; (-) strand; PAM type: YTN; PAM sequence: CTG
ctcctactaccttgcaggtg

SEQ ID NO: 207878 - DNA, 20 bp, Artificial Sequence
  Description of Artificial Sequence: Synthetic oligonucleotide
  Target: ATXN1; (-) strand; PAM type: YTN; PAM sequence: CTC
atctgctcctactaccttgc

SEQ ID NO: 207879 - DNA, 20 bp, Artificial Sequence
  Description of Artificial Sequence: Synthetic oligonucleotide
  Target: ATXN1; (-) strand; PAM type: YTN; PAM sequence: CTG
gccatagcctcatctgctcc

SEQ ID NO: 207880 - DNA, 20 bp, Artificial Sequence
  Description of Artificial Sequence: Synthetic oligonucleotide
  Target: ATXN1; (-) strand; PAM type: YTN; PAM sequence: CTG
tcatctggccatagcctcat

SEQ ID NO: 207881 - DNA, 20 bp, Artificial Sequence
  Description of Artificial Sequence: Synthetic oligonucleotide
  Target: ATXN1; (-) strand; PAM type: YTN; PAM sequence: CTG
gcatgtccccctgtcatctg

SEQ ID NO: 207882 - DNA, 20 bp, Artificial Sequence
  Description of Artificial Sequence: Synthetic oligonucleotide
  Target: ATXN1; (-) strand; PAM type: YTN; PAM sequence: CTG
ctggcatgtccccctgtcat

SEQ ID NO: 207883 - DNA, 20 bp, Artificial Sequence
  Description of Artificial Sequence: Synthetic oligonucleotide
  Target: ATXN1; (-) strand; PAM type: YTN; PAM sequence: TTC
tgctggcatgtccccctgtc

SEQ ID NO: 207884 - DNA, 20 bp, Artificial Sequence
  Description of Artificial Sequence: Synthetic oligonucleotide
  Target: ATXN1; (-) strand; PAM type: YTN; PAM sequence: CTT
ctgctggcatgtccccctgt

SEQ ID NO: 207885 - DNA, 20 bp, Artificial Sequence
  Description of Artificial Sequence: Synthetic oligonucleotide
  Target: ATXN1; (-) strand; PAM type: YTN; PAM sequence: TTC
cttctgctggcatgtccccc

SEQ ID NO: 207886 - DNA, 20 bp, Artificial Sequence
  Description of Artificial Sequence: Synthetic oligonucleotide
  Target: ATXN1; (-) strand; PAM type: YTN; PAM sequence: TTA
gttccttctgctggcatgtc

SEQ ID NO: 207887 - DNA, 20 bp, Artificial Sequence
  Description of Artificial Sequence: Synthetic oligonucleotide
  Target: ATXN1; (-) strand; PAM type: YTN; PAM sequence: CTG
cattagttccttctgctggc

SEQ ID NO: 207888 - DNA, 20 bp, Artificial Sequence
  Description of Artificial Sequence: Synthetic oligonucleotide
  Target: ATXN1; (-) strand; PAM type: YTN; PAM sequence: TTG
gaagctgcattagttccttc

SEQ ID NO: 207889 - DNA, 20 bp, Artificial Sequence
  Description of Artificial Sequence: Synthetic oligonucleotide
  Target: ATXN1; (-) strand; PAM type: YTN; PAM sequence: CTG
ggcaccagcaagttggaagc

SEQ ID NO: 207890 - DNA, 20 bp, Artificial Sequence
  Description of Artificial Sequence: Synthetic oligonucleotide
  Target: ATXN1; (-) strand; PAM type: YTN; PAM sequence: CTG
gctgggcaccagcaagttgg

SEQ ID NO: 207891 - DNA, 20 bp, Artificial Sequence
  Description of Artificial Sequence: Synthetic oligonucleotide
  Target: ATXN1; (-) strand; PAM type: YTN; PAM sequence: CTC
caaatcagtggggtctggct

SEQ ID NO: 207892 - DNA, 20 bp, Artificial Sequence
  Description of Artificial Sequence: Synthetic oligonucleotide
  Target: ATXN1; (-) strand; PAM type: YTN; PAM sequence: TTG
gcaggaaagtctccaaatca

SEQ ID NO: 207893 - DNA, 20 bp, Artificial Sequence
  Description of Artificial Sequence: Synthetic oligonucleotide
  Target: ATXN1; (-) strand; PAM type: YTN; PAM sequence: TTG
gcaagttggcaggaaagtct

SEQ ID NO: 207894 - DNA, 20 bp, Artificial Sequence
  Description of Artificial Sequence: Synthetic oligonucleotide
  Target: ATXN1; (-) strand; PAM type: YTN; PAM sequence: TTT
ggcaagttggcaggaaagtc

SEQ ID NO: 207895 - DNA, 20 bp, Artificial Sequence
  Description of Artificial Sequence: Synthetic oligonucleotide
  Target: ATXN1; (-) strand; PAM type: YTN; PAM sequence: TTT
tggcaagttggcaggaaagt

SEQ ID NO: 207896 - DNA, 20 bp, Artificial Sequence
  Description of Artificial Sequence: Synthetic oligonucleotide
  Target: ATXN1; (-) strand; PAM type: YTN; PAM sequence: TTT
ttggcaagttggcaggaaag

SEQ ID NO: 207897 - DNA, 20 bp, Artificial Sequence
  Description of Artificial Sequence: Synthetic oligonucleotide
  Target: ATXN1; (-) strand; PAM type: YTN; PAM sequence: TTG
ggtgtcagatcagtttttgg

SEQ ID NO: 207898 - DNA, 20 bp, Artificial Sequence
  Description of Artificial Sequence: Synthetic oligonucleotide
  Target: ATXN1; (-) strand; PAM type: YTN; PAM sequence: TTG
gtgacaccattgggtgtcag

SEQ ID NO: 207899 - DNA, 20 bp, Artificial Sequence
  Description of Artificial Sequence: Synthetic oligonucleotide
  Target: ATXN1; (-) strand; PAM type: YTN; PAM sequence: TTT
ggtgacaccattgggtgtca

SEQ ID NO: 207900 - DNA, 20 bp, Artificial Sequence
  Description of Artificial Sequence: Synthetic oligonucleotide
  Target: ATXN1; (-) strand; PAM type: YTN; PAM sequence: CTT
tggtgacaccattgggtgtc

SEQ ID NO: 207901 - DNA, 20 bp, Artificial Sequence
  Description of Artificial Sequence: Synthetic oligonucleotide
  Target: ATXN1; (-) strand; PAM type: YTN; PAM sequence: CTG
atgcataggaaaagaaaaca

SEQ ID NO: 207902 - DNA, 20 bp, Artificial Sequence
  Description of Artificial Sequence: Synthetic oligonucleotide
  Target: ATXN1; (-) strand; PAM type: YTN; PAM sequence: CTG
ggtgtggaggtactgatgca

SEQ ID NO: 207903 - DNA, 20 bp, Artificial Sequence
  Description of Artificial Sequence: Synthetic oligonucleotide
  Target: ATXN1; (-) strand; PAM type: YTN; PAM sequence: CTG
atccctgggtgtggaggtac

SEQ ID NO: 207904 - DNA, 20 bp, Artificial Sequence
  Description of Artificial Sequence: Synthetic oligonucleotide
  Target: ATXN1; (-) strand; PAM type: YTN; PAM sequence: TTA
gagtgaggtgaaggaagact

SEQ ID NO: 207905 - DNA, 20 bp, Artificial Sequence
  Description of Artificial Sequence: Synthetic oligonucleotide
  Target: ATXN1; (-) strand; PAM type: YTN; PAM sequence: TTT
agagtgaggtgaaggaagac

SEQ ID NO: 207906 - DNA, 20 bp, Artificial Sequence
  Description of Artificial Sequence: Synthetic oligonucleotide
  Target: ATXN1; (-) strand; PAM type: YTN; PAM sequence: CTT
tagagtgaggtgaaggaaga

SEQ ID NO: 207907 - DNA, 20 bp, Artificial Sequence
  Description of Artificial Sequence: Synthetic oligonucleotide
  Target: ATXN1; (-) strand; PAM type: YTN; PAM sequence: CTG
gccctttagagtgaggtgaa

SEQ ID NO: 207908 - DNA, 20 bp, Artificial Sequence
  Description of Artificial Sequence: Synthetic oligonucleotide
  Target: ATXN1; (-) strand; PAM type: YTN; PAM sequence: TTG
gaaggcaatgatggctggcc

SEQ ID NO: 207909 - DNA, 20 bp, Artificial Sequence
  Description of Artificial Sequence: Synthetic oligonucleotide
  Target: ATXN1; (-) strand; PAM type: YTN; PAM sequence: CTT
ggaaggcaatgatggctggc

SEQ ID NO: 207910 - DNA, 20 bp, Artificial Sequence
  Description of Artificial Sequence: Synthetic oligonucleotide
  Target: ATXN1; (-) strand; PAM type: YTN; PAM sequence: TTC
ataccttggaaggcaatgat

SEQ ID NO: 207911 - DNA, 20 bp, Artificial Sequence
  Description of Artificial Sequence: Synthetic oligonucleotide
  Target: ATXN1; (-) strand; PAM type: YTN; PAM sequence: TTG
gttcataccttggaaggcaa

SEQ ID NO: 207912 - DNA, 20 bp, Artificial Sequence
  Description of Artificial Sequence: Synthetic oligonucleotide
  Target: ATXN1; (-) strand; PAM type: YTN; PAM sequence: CTT
ggttcataccttggaaggca

SEQ ID NO: 207913 - DNA, 20 bp, Artificial Sequence
  Description of Artificial Sequence: Synthetic oligonucleotide
  Target: ATXN1; (-) strand; PAM type: YTN; PAM sequence: TTC
ttggttcataccttggaagg

SEQ ID NO: 207914 - DNA, 20 bp, Artificial Sequence
  Description of Artificial Sequence: Synthetic oligonucleotide
  Target: ATXN1; (-) strand; PAM type: YTN; PAM sequence: TTT
cttggttcataccttggaag

SEQ ID NO: 207915 - DNA, 20 bp, Artificial Sequence
  Description of Artificial Sequence: Synthetic oligonucleotide
  Target: ATXN1; (-) strand; PAM type: YTN; PAM sequence: CTG
agtgagtggtgacatttctt

SEQ ID NO: 207916 - DNA, 20 bp, Artificial Sequence
  Description of Artificial Sequence: Synthetic oligonucleotide
  Target: ATXN1; (-) strand; PAM type: YTN; PAM sequence: TTC
acctgagtgagtggtgacat

SEQ ID NO: 207917 - DNA, 20 bp, Artificial Sequence
  Description of Artificial Sequence: Synthetic oligonucleotide
  Target: ATXN1; (-) strand; PAM type: YTN; PAM sequence: CTG
ttcacctgagtgagtggtga

SEQ ID NO: 207918 - DNA, 20 bp, Artificial Sequence
  Description of Artificial Sequence: Synthetic oligonucleotide
  Target: ATXN1; (-) strand; PAM type: YTN; PAM sequence: CTG
tggcctgttcacctgagtga

SEQ ID NO: 207919 - DNA, 20 bp, Artificial Sequence
  Description of Artificial Sequence: Synthetic oligonucleotide
  Target: ATXN1; (-) strand; PAM type: YTN; PAM sequence: CTC
tgtggcctgttcacctgagt

SEQ ID NO: 207920 - DNA, 20 bp, Artificial Sequence
  Description of Artificial Sequence: Synthetic oligonucleotide
  Target: ATXN1; (-) strand; PAM type: YTN; PAM sequence: TTA
gtcctctgtggcctgttcac

SEQ ID NO: 207921 - DNA, 20 bp, Artificial Sequence
  Description of Artificial Sequence: Synthetic oligonucleotide
  Target: ATXN1; (-) strand; PAM type: YTN; PAM sequence: TTT
agtcctctgtggcctgttca

SEQ ID NO: 207922 - DNA, 20 bp, Artificial Sequence
  Description of Artificial Sequence: Synthetic oligonucleotide
  Target: ATXN1; (-) strand; PAM type: YTN; PAM sequence: TTT
tagtcctctgtggcctgttc

SEQ ID NO: 207923 - DNA, 20 bp, Artificial Sequence
  Description of Artificial Sequence: Synthetic oligonucleotide
  Target: ATXN1; (-) strand; PAM type: YTN; PAM sequence: CTT
ttagtcctctgtggcctgtt

SEQ ID NO: 207924 - DNA, 20 bp, Artificial Sequence
  Description of Artificial Sequence: Synthetic oligonucleotide
  Target: ATXN1; (-) strand; PAM type: YTN; PAM sequence: CTA
tagggccagcacttttagtc

SEQ ID NO: 207925 - DNA, 20 bp, Artificial Sequence
  Description of Artificial Sequence: Synthetic oligonucleotide
  Target: ATXN1; (-) strand; PAM type: YTN; PAM sequence: CTG
ctatagggccagcactttta

SEQ ID NO: 207926 - DNA, 20 bp, Artificial Sequence
  Description of Artificial Sequence: Synthetic oligonucleotide
  Target: ATXN1; (-) strand; PAM type: YTN; PAM sequence: TTG
catgaggctgctatagggcc

SEQ ID NO: 207927 - DNA, 20 bp, Artificial Sequence
  Description of Artificial Sequence: Synthetic oligonucleotide
  Target: ATXN1; (-) strand; PAM type: YTN; PAM sequence: TTT
gcatgaggctgctatagggc

SEQ ID NO: 207928 - DNA, 20 bp, Artificial Sequence
  Description of Artificial Sequence: Synthetic oligonucleotide
  Target: ATXN1; (-) strand; PAM type: YTN; PAM sequence: TTT
tgcatgaggctgctataggg

SEQ ID NO: 207929 - DNA, 20 bp, Artificial Sequence
  Description of Artificial Sequence: Synthetic oligonucleotide
  Target: ATXN1; (-) strand; PAM type: YTN; PAM sequence: TTT
ttgcatgaggctgctatagg

SEQ ID NO: 207930 - DNA, 20 bp, Artificial Sequence
  Description of Artificial Sequence: Synthetic oligonucleotide
  Target: ATXN1; (-) strand; PAM type: YTN; PAM sequence: CTG
tttttgcatgaggctgctat

SEQ ID NO: 207931 - DNA, 20 bp, Artificial Sequence
  Description of Artificial Sequence: Synthetic oligonucleotide
  Target: ATXN1; (-) strand; PAM type: YTN; PAM sequence: CTC
agtgcacaaatctgtttttg

SEQ ID NO: 207932 - DNA, 20 bp, Artificial Sequence
  Description of Artificial Sequence: Synthetic oligonucleotide
  Target: ATXN1; (-) strand; PAM type: YTN; PAM sequence: TTC
tcagtgcacaaatctgtttt

SEQ ID NO: 207933 - DNA, 20 bp, Artificial Sequence
  Description of Artificial Sequence: Synthetic oligonucleotide
  Target: ATXN1; (-) strand; PAM type: YTN; PAM sequence: CTT
ctcagtgcacaaatctgttt

SEQ ID NO: 207934 - DNA, 20 bp, Artificial Sequence
  Description of Artificial Sequence: Synthetic oligonucleotide
  Target: ATXN1; (-) strand; PAM type: YTN; PAM sequence: TTC
aaaagtcttctcagtgcaca

SEQ ID NO: 207935 - DNA, 20 bp, Artificial Sequence
  Description of Artificial Sequence: Synthetic oligonucleotide
  Target: ATXN1; (-) strand; PAM type: YTN; PAM sequence: TTT
caaaagtcttctcagtgcac

SEQ ID NO: 207936 - DNA, 20 bp, Artificial Sequence
  Description of Artificial Sequence: Synthetic oligonucleotide
  Target: ATXN1; (-) strand; PAM type: YTN; PAM sequence: TTC
aaatttcaaaagtcttctca

SEQ ID NO: 207937 - DNA, 20 bp, Artificial Sequence
  Description of Artificial Sequence: Synthetic oligonucleotide
  Target: ATXN1; (-) strand; PAM type: YTN; PAM sequence: TTT
caaatttcaaaagtcttctc

SEQ ID NO: 207938 - DNA, 20 bp, Artificial Sequence
  Description of Artificial Sequence: Synthetic oligonucleotide
  Target: ATXN1; (-) strand; PAM type: YTN; PAM sequence: CTT
tcaaatttcaaaagtcttct

SEQ ID NO: 207939 - DNA, 20 bp, Artificial Sequence
  Description of Artificial Sequence: Synthetic oligonucleotide
  Target: ATXN1; (-) strand; PAM type: YTN; PAM sequence: TTA
gtagcggcctttcaaatttc

SEQ ID NO: 207940 - DNA, 20 bp, Artificial Sequence
  Description of Artificial Sequence: Synthetic oligonucleotide
  Target: ATXN1; (-) strand; PAM type: YTN; PAM sequence: CTT
agtagcggcctttcaaattt

SEQ ID NO: 207941 - DNA, 20 bp, Artificial Sequence
  Description of Artificial Sequence: Synthetic oligonucleotide
  Target: ATXN1; (-) strand; PAM type: YTN; PAM sequence: TTC
ttagtagcggcctttcaaat

SEQ ID NO: 207942 - DNA, 20 bp, Artificial Sequence
  Description of Artificial Sequence: Synthetic oligonucleotide
  Target: ATXN1; (-) strand; PAM type: YTN; PAM sequence: CTT
cttagtagcggcctttcaaa

SEQ ID NO: 207943 - DNA, 20 bp, Artificial Sequence
  Description of Artificial Sequence: Synthetic oligonucleotide
  Target: ATXN1; (-) strand; PAM type: YTN; PAM sequence: TTA
tcttcttagtagcggccttt

SEQ ID NO: 207944 - DNA, 20 bp, Artificial Sequence
  Description of Artificial Sequence: Synthetic oligonucleotide
  Target: ATXN1; (-) strand; PAM type: YTN; PAM sequence: TTT
atcttcttagtagcggcctt

SEQ ID NO: 207945 - DNA, 20 bp, Artificial Sequence
  Description of Artificial Sequence: Synthetic oligonucleotide
  Target: ATXN1; (-) strand; PAM type: YTN; PAM sequence: TTG
gagggtttatcttcttagta

SEQ ID NO: 207946 - DNA, 20 bp, Artificial Sequence
  Description of Artificial Sequence: Synthetic oligonucleotide
  Target: ATXN1; (-) strand; PAM type: YTN; PAM sequence: TTT
ggagggtttatcttcttagt

SEQ ID NO: 207947 - DNA, 20 bp, Artificial Sequence
  Description of Artificial Sequence: Synthetic oligonucleotide
  Target: ATXN1; (-) strand; PAM type: YTN; PAM sequence: CTT
tggagggtttatcttcttag

SEQ ID NO: 207948 - DNA, 20 bp, Artificial Sequence
  Description of Artificial Sequence: Synthetic oligonucleotide
  Target: ATXN1; (-) strand; PAM type: YTN; PAM sequence: TTA
atgaataacaatgatagaag

SEQ ID NO: 207949 - DNA, 20 bp, Artificial Sequence
  Description of Artificial Sequence: Synthetic oligonucleotide
  Target: ATXN1; (-) strand; PAM type: YTN; PAM sequence: TTT
aatgaataacaatgatagaa

SEQ ID NO: 207950 - DNA, 20 bp, Artificial Sequence
  Description of Artificial Sequence: Synthetic oligonucleotide
  Target: ATXN1; (-) strand; PAM type: YTN; PAM sequence: TTT
taatgaataacaatgataga

SEQ ID NO: 207951 - DNA, 20 bp, Artificial Sequence
  Description of Artificial Sequence: Synthetic oligonucleotide
  Target: ATXN1; (-) strand; PAM type: YTN; PAM sequence: TTT
ttaatgaataacaatgatag

SEQ ID NO: 207952 - DNA, 20 bp, Artificial Sequence
  Description of Artificial Sequence: Synthetic oligonucleotide
  Target: ATXN1; (-) strand; PAM type: YTN; PAM sequence: TTT
tttaatgaataacaatgata

SEQ ID NO: 207953 - DNA, 20 bp, Artificial Sequence
  Description of Artificial Sequence: Synthetic oligonucleotide
  Target: ATXN1; (-) strand; PAM type: YTN; PAM sequence: TTT
ttttaatgaataacaatgat

SEQ ID NO: 207954 - DNA, 20 bp, Artificial Sequence
  Description of Artificial Sequence: Synthetic oligonucleotide
  Target: ATXN1; (-) strand; PAM type: YTN; PAM sequence: TTT
tttttaatgaataacaatga

SEQ ID NO: 207955 - DNA, 20 bp, Artificial Sequence
  Description of Artificial Sequence: Synthetic oligonucleotide
  Target: ATXN1; (-) strand; PAM type: YTN; PAM sequence: TTT
ttttttaatgaataacaatg

SEQ ID NO: 207956 - DNA, 20 bp, Artificial Sequence
  Description of Artificial Sequence: Synthetic oligonucleotide
  Target: ATXN1; (-) strand; PAM type: YTN; PAM sequence: TTT
tttttttaatgaataacaat

SEQ ID NO: 207957 - DNA, 20 bp, Artificial Sequence
  Description of Artificial Sequence: Synthetic oligonucleotide
  Target: ATXN1; (-) strand; PAM type: YTN; PAM sequence: TTG
ttttttttttaatgaataac

SEQ ID NO: 207958 - DNA, 20 bp, Artificial Sequence
  Description of Artificial Sequence: Synthetic oligonucleotide
  Target: ATXN1; (-) strand; PAM type: YTN; PAM sequence: CTT
gttttttttttaatgaataa

SEQ ID NO: 207959 - DNA, 20 bp, Artificial Sequence
  Description of Artificial Sequence: Synthetic oligonucleotide
  Target: ATXN1; (-) strand; PAM type: YTN; PAM sequence: CTA
agcttgttttttttttaatg

SEQ ID NO: 207960 - DNA, 20 bp, Artificial Sequence
  Description of Artificial Sequence: Synthetic oligonucleotide
  Target: ATXN1; (-) strand; PAM type: YTN; PAM sequence: TTA
caggtgtgagccaccatgcc

SEQ ID NO: 207961 - DNA, 20 bp, Artificial Sequence
  Description of Artificial Sequence: Synthetic oligonucleotide
  Target: ATXN1; (-) strand; PAM type: YTN; PAM sequence: CTG
ggattacaggtgtgagccac

SEQ ID NO: 207962 - DNA, 20 bp, Artificial Sequence
  Description of Artificial Sequence: Synthetic oligonucleotide
  Target: ATXN1; (-) strand; PAM type: YTN; PAM sequence: CTC
ccaaaatgctgggattacag

SEQ ID NO: 207963 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaaatgctggga

SEQ ID NO: 207964 - DNA, 20 bp, Artificial Sequence
  Description of Artificial Sequence: Synthetic oligonucleotide
  Target: ATXN1; (-) strand; PAM type: YTN; PAM sequence: CTC
gcctcagcctcccaaaatgc

SEQ ID NO: 207965 - DNA, 20 bp, Artificial Sequence
  Description of Artificial Sequence: Synthetic oligonucleotide
  Target: ATXN1; (-) strand; PAM type: YTN; PAM sequence: CTC
atgatccgctcgcctcagcc

SEQ ID NO: 207966 - DNA, 20 bp, Artificial Sequence
  Description of Artificial Sequence: Synthetic oligonucleotide
  Target: ATXN1; (-) strand; PAM type: YTN; PAM sequence: CTG
acctcatgatccgctcgcct

SEQ ID NO: 207967 - DNA, 20 bp, Artificial Sequence
  Description of Artificial Sequence: Synthetic oligonucleotide
  Target: ATXN1; (-) strand; PAM type: YTN; PAM sequence: TTC
tgacctcatgatccgctcgc

SEQ ID NO: 207968 - DNA, 20 bp, Artificial Sequence
  Description of Artificial Sequence: Synthetic oligonucleotide
  Target: ATXN1; (-) strand; PAM type: YTN; PAM sequence: CTT
ctgacctcatgatccgctcg

SEQ ID NO: 207969 - DNA, 20 bp, Artificial Sequence
  Description of Artificial Sequence: Synthetic oligonucleotide
  Target: ATXN1; (-) strand; PAM type: YTN; PAM sequence: TTC
gatcttctgacctcatgatc

SEQ ID NO: 207970 - DNA, 20 bp, Artificial Sequence
  Description of Artificial Sequence: Synthetic oligonucleotide
  Target: ATXN1; (-) strand; PAM type: YTN; PAM sequence: TTT
cgatcttctgacctcatgat

SEQ ID NO: 207971 - DNA, 20 bp, Artificial Sequence
  Description of Artificial Sequence: Synthetic oligonucleotide
  Target: ATXN1; (-) strand; PAM type: YTN; PAM sequence: TTG
gccaggatggtttcgatctt

SEQ ID NO: 207972 - DNA, 20 bp, Artificial Sequence
  Description of Artificial Sequence: Synthetic oligonucleotide
  Target: ATXN1; (-) strand; PAM type: YTN; PAM sequence: TTC
agcatgttggccaggatggt

SEQ ID NO: 207973 - DNA, 20 bp, Artificial Sequence
  Description of Artificial Sequence: Synthetic oligonucleotide
  Target: ATXN1; (-) strand; PAM type: YTN; PAM sequence: TTT
cagcatgttggccaggatgg

SEQ ID NO: 207974 - DNA, 20 bp, Artificial Sequence
  Description of Artificial Sequence: Synthetic oligonucleotide
  Target: ATXN1; (-) strand; PAM type: YTN; PAM sequence: TTA
gtagagacaaggtttcagca

SEQ ID NO: 207975 - DNA, 20 bp, Artificial Sequence
  Description of Artificial Sequence: Synthetic oligonucleotide
  Target: ATXN1; (-) strand; PAM type: YTN; PAM sequence: TTT
agtagagacaaggtttcagc

SEQ ID NO: 207976 - DNA, 20 bp, Artificial Sequence
  Description of Artificial Sequence: Synthetic oligonucleotide
  Target: ATXN1; (-) strand; PAM type: YTN; PAM sequence: TTT
tagtagagacaaggtttcag

SEQ ID NO: 207977 - DNA, 20 bp, Artificial Sequence
  Description of Artificial Sequence: Synthetic oligonucleotide
  Target: ATXN1; (-) strand; PAM type: YTN; PAM sequence: TTT
ttagtagagacaaggtttca

SEQ ID NO: 207978 - DNA, 20 bp, Artificial Sequence
  Description of Artificial Sequence: Synthetic oligonucleotide
  Target: ATXN1; (-) strand; PAM type: YTN; PAM sequence: TTG
tatttttagtagagacaagg

SEQ ID NO: 207979 - DNA, 20 bp, Artificial Sequence
  Description of Artificial Sequence: Synthetic oligonucleotide
  Target: ATXN1; (-) strand; PAM type: YTN; PAM sequence: TTT
gtatttttagtagagacaag

SEQ ID NO: 207980 - DNA, 20 bp, Artificial Sequence
  Description of Artificial Sequence: Synthetic oligonucleotide
  Target: ATXN1; (-) strand; PAM type: YTN; PAM sequence: TTT
tgtatttttagtagagacaa

SEQ ID NO: 207981 - DNA, 20 bp, Artificial Sequence
  Description of Artificial Sequence: Synthetic oligonucleotide
  Target: ATXN1; (-) strand; PAM type: YTN; PAM sequence: TTT
ttgtatttttagtagagaca

SEQ ID NO: 207982 - DNA, 20 bp, Artificial Sequence
  Description of Artificial Sequence: Synthetic oligonucleotide
  Target: ATXN1; (-) strand; PAM type: YTN; PAM sequence: CTA
atttttgtatttttagtaga

SEQ ID NO: 207983 - DNA, 20 bp, Artificial Sequence
  Description of Artificial Sequence: Synthetic oligonucleotide
  Target: ATXN1; (-) strand; PAM type: YTN; PAM sequence: TTA
caggcacgtgccaccatacc

SEQ ID NO: 207984 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcacgtgccac

SEQ ID NO: 207985 - DNA, 20 bp, Artificial Sequence
  Description of Artificial Sequence: Synthetic oligonucleotide
  Target: ATXN1; (-) strand; PAM type: YTN; PAM sequence: CTG
agtagctgggattacaggca

SEQ ID NO: 207986 - DNA, 20 bp, Artificial Sequence
  Description of Artificial Sequence: Synthetic oligonucleotide
  Target: ATXN1; (-) strand; PAM type: YTN; PAM sequence: CTC
ctgagtagctgggattacag

SEQ ID NO: 207987 - DNA, 20 bp, Artificial Sequence
  Description of Artificial Sequence: Synthetic oligonucleotide
  Target: ATXN1; (-) strand; PAM type: YTN; PAM sequence: CTC
accctcctgagtagctggga

SEQ ID NO: 207988 - DNA, 20 bp, Artificial Sequence
  Description of Artificial Sequence: Synthetic oligonucleotide
  Target: ATXN1; (-) strand; PAM type: YTN; PAM sequence: CTG
tctcaccctcctgagtagct

SEQ ID NO: 207989 - DNA, 20 bp, Artificial Sequence
  Description of Artificial Sequence: Synthetic oligonucleotide
  Target: ATXN1; (-) strand; PAM type: YTN; PAM sequence: CTC
ctgtctcaccctcctgagta

SEQ ID NO: 207990 - DNA, 20 bp, Artificial Sequence
  Description of Artificial Sequence: Synthetic oligonucleotide
  Target: ATXN1; (-) strand; PAM type: YTN; PAM sequence: TTC
tcctgtctcaccctcctgag

SEQ ID NO: 207991 - DNA, 20 bp, Artificial Sequence
  Description of Artificial Sequence: Synthetic oligonucleotide
  Target: ATXN1; (-) strand; PAM type: YTN; PAM sequence: CTG
ttctcctgtctcaccctcct

SEQ ID NO: 207992 - DNA, 20 bp, Artificial Sequence
  Description of Artificial Sequence: Synthetic oligonucleotide
  Target: ATXN1; (-) strand; PAM type: YTN; PAM sequence: TTC
aagctgttctcctgtctcac

SEQ ID NO: 207993 - DNA, 20 bp, Artificial Sequence
  Description of Artificial Sequence: Synthetic oligonucleotide
  Target: ATXN1; (-) strand; PAM type: YTN; PAM sequence: CTG
gttcaagctgttctcctgtc

SEQ ID NO: 207994 - DNA, 20 bp, Artificial Sequence
  Description of Artificial Sequence: Synthetic oligonucleotide
  Target: ATXN1; (-) strand; PAM type: YTN; PAM sequence: CTC
cctggttcaagctgttctcc

SEQ ID NO: 207995 - DNA, 20 bp, Artificial Sequence
  Description of Artificial Sequence: Synthetic oligonucleotide
  Target: ATXN1; (-) strand; PAM type: YTN; PAM sequence: CTG
actccctggttcaagctgtt

SEQ ID NO: 207996 - DNA, 20 bp, Artificial Sequence
  Description of Artificial Sequence: Synthetic oligonucleotide
  Target: ATXN1; (-) strand; PAM type: YTN; PAM sequence: CTC
tgactccctggttcaagctg

SEQ ID NO: 207997 - DNA, 20 bp, Artificial Sequence
  Description of Artificial Sequence: Synthetic oligonucleotide
  Target: ATXN1; (-) strand; PAM type: YTN; PAM sequence: CTG
caacctctgactccctggtt

SEQ ID NO: 207998 - DNA, 20 bp, Artificial Sequence
  Description of Artificial Sequence: Synthetic oligonucleotide
  Target: ATXN1; (-) strand; PAM type: YTN; PAM sequence: CTC
actgcaacctctgactccct

SEQ ID NO: 207999 - DNA, 20 bp, Artificial Sequence
  Description of Artificial Sequence: Synthetic oligonucleotide
  Target: ATXN1; (-) strand; PAM type: YTN; PAM sequence: CTG
ctcactgcaacctctgactc

SEQ ID NO: 208000 - DNA, 20 bp, Artificial Sequence
  Description of Artificial Sequence: Synthetic oligonucleotide
  Target: ATXN1; (-) strand; PAM type: YTN; PAM sequence: CTC
tgctcactgcaacctctgac

SEQ ID NO: 208001 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgcgatctc

SEQ ID NO: 208002 - DNA, 20 bp, Artificial Sequence
  Description of Artificial Sequence: Synthetic oligonucleotide
  Target: ATXN1; (-) strand; PAM type: YTN; PAM sequence: CTG
tcaccaggctggagtgcagt

SEQ ID NO: 208003 - DNA, 20 bp, Artificial Sequence
  Description of Artificial Sequence: Synthetic oligonucleotide
  Target: ATXN1; (-) strand; PAM type: YTN; PAM sequence: CTC
tgtcaccaggctggagtgca

SEQ ID NO: 208004 - DNA, 20 bp, Artificial Sequence
  Description of Artificial Sequence: Synthetic oligonucleotide
  Target: ATXN1; (-) strand; PAM type: YTN; PAM sequence: TTC
actctgtcaccaggctggag

SEQ ID NO: 208005 - DNA, 20 bp, Artificial Sequence
  Description of Artificial Sequence: Synthetic oligonucleotide
  Target: ATXN1; (-) strand; PAM type: YTN; PAM sequence: TTT
cactctgtcaccaggctgga

SEQ ID NO: 208006 - DNA, 20 bp, Artificial Sequence
  Description of Artificial Sequence: Synthetic oligonucleotide
  Target: ATXN1; (-) strand; PAM type: YTN; PAM sequence: TTG
agacggagtttcactctgtc

SEQ ID NO: 208007 - DNA, 20 bp, Artificial Sequence
  Description of Artificial Sequence: Synthetic oligonucleotide
  Target: ATXN1; (-) strand; PAM type: YTN; PAM sequence: TTT
gagacggagtttcactctgt

SEQ ID NO: 208008 - DNA, 20 bp, Artificial Sequence
  Description of Artificial Sequence: Synthetic oligonucleotide
  Target: ATXN1; (-) strand; PAM type: YTN; PAM sequence: TTT
tgagacggagtttcactctg

SEQ ID NO: 208009 - DNA, 20 bp, Artificial Sequence
  Description of Artificial Sequence: Synthetic oligonucleotide
  Target: ATXN1; (-) strand; PAM type: YTN; PAM sequence: TTT
ttgagacggagtttcactct

SEQ ID NO: 208010 - DNA, 20 bp, Artificial Sequence
  Description of Artificial Sequence: Synthetic oligonucleotide
  Target: ATXN1; (-) strand; PAM type: YTN; PAM sequence: TTT
tttgagacggagtttcactc

SEQ ID NO: 208011 - DNA, 20 bp, Artificial Sequence
  Description of Artificial Sequence: Synthetic oligonucleotide
  Target: ATXN1; (-) strand; PAM type: YTN; PAM sequence: TTT
ttttgagacggagtttcact

SEQ ID NO: 208012 - DNA, 20 bp, Artificial Sequence
  Description of Artificial Sequence: Synthetic oligonucleotide
  Target: ATXN1; (-) strand; PAM type: YTN; PAM sequence: TTT
tttttgagacggagtttcac

SEQ ID NO: 208013 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacggagtttca

SEQ ID NO: 208014 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacggagtttc

SEQ ID NO: 208015 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacggagttt

SEQ ID NO: 208016 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacggagtt

SEQ ID NO: 208017 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacggagt

SEQ ID NO: 208018 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacggag

SEQ ID NO: 208019 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacgga

SEQ ID NO: 208020 - DNA, 20 bp, Artificial Sequence
  Description of Artificial Sequence: Synthetic oligonucleotide
  Target: ATXN1; (-) strand; PAM type: YTN; PAM sequence: CTT
tttttttttttttgagacgg

SEQ ID NO: 208021 - DNA, 20 bp, Artificial Sequence
  Description of Artificial Sequence: Synthetic oligonucleotide
  Target: ATXN1; (-) strand; PAM type: YTN; PAM sequence: TTA
agctttttttttttttttga

SEQ ID NO: 208022 - DNA, 20 bp, Artificial Sequence
  Description of Artificial Sequence: Synthetic oligonucleotide
  Target: ATXN1; (-) strand; PAM type: YTN; PAM sequence: TTC
aagttaagcttttttttttt

SEQ ID NO: 208023 - DNA, 20 bp, Artificial Sequence
  Description of Artificial Sequence: Synthetic oligonucleotide
  Target: ATXN1; (-) strand; PAM type: YTN; PAM sequence: TTC
attcaagttaagcttttttt

SEQ ID NO: 208024 - DNA, 20 bp, Artificial Sequence
  Description of Artificial Sequence: Synthetic oligonucleotide
  Target: ATXN1; (-) strand; PAM type: YTN; PAM sequence: TTC
ccattcattcaagttaagct

SEQ ID NO: 208025 - DNA, 20 bp, Artificial Sequence
  Description of Artificial Sequence: Synthetic oligonucleotide
  Target: ATXN1; (-) strand; PAM type: YTN; PAM sequence: TTG
ttcccattcattcaagttaa

SEQ ID NO: 208026 - DNA, 20 bp, Artificial Sequence
  Description of Artificial Sequence: Synthetic oligonucleotide
  Target: ATXN1; (-) strand; PAM type: YTN; PAM sequence: CTT
gttcccattcattcaagtta

SEQ ID NO: 208027 - DNA, 20 bp, Artificial Sequence
  Description of Artificial Sequence: Synthetic oligonucleotide
  Target: ATXN1; (-) strand; PAM type: YTN; PAM sequence: CTC
ttgttcccattcattcaagt

SEQ ID NO: 208028 - DNA, 20 bp, Artificial Sequence
  Description of Artificial Sequence: Synthetic oligonucleotide
  Target: ATXN1; (-) strand; PAM type: YTN; PAM sequence: TTA
aataaccctcttgttcccat

SEQ ID NO: 208029 - DNA, 20 bp, Artificial Sequence
  Description of Artificial Sequence: Synthetic oligonucleotide
  Target: ATXN1; (-) strand; PAM type: YTN; PAM sequence: TTT
aaataaccctcttgttccca

SEQ ID NO: 208030 - DNA, 20 bp, Artificial Sequence
  Description of Artificial Sequence: Synthetic oligonucleotide
  Target: ATXN1; (-) strand; PAM type: YTN; PAM sequence: TTT
taaataaccctcttgttccc

SEQ ID NO: 208031 - DNA, 20 bp, Artificial Sequence
  Description of Artificial Sequence: Synthetic oligonucleotide
  Target: ATXN1; (-) strand; PAM type: YTN; PAM sequence: TTT
ttaaataaccctcttgttcc

SEQ ID NO: 208032 - DNA, 20 bp, Artificial Sequence
  Description of Artificial Sequence: Synthetic oligonucleotide
  Target: ATXN1; (-) strand; PAM type: YTN; PAM sequence: TTT
tttaaataaccctcttgttc

SEQ ID NO: 208033 - DNA, 20 bp, Artificial Sequence
  Description of Artificial Sequence: Synthetic oligonucleotide
  Target: ATXN1; (-) strand; PAM type: YTN; PAM sequence: TTA
ttttttaaataaccctcttg

SEQ ID NO: 208034 - DNA, 20 bp, Artificial Sequence
  Description of Artificial Sequence: Synthetic oligonucleotide
  Target: ATXN1; (-) strand; PAM type: YTN; PAM sequence: TTA
ttattttttaaataaccctc

SEQ ID NO: 208035 - DNA, 20 bp, Artificial Sequence
  Description of Artificial Sequence: Synthetic oligonucleotide
  Target: ATXN1; (-) strand; PAM type: YTN; PAM sequence: TTT
attattttttaaataaccct

SEQ ID NO: 208036 - DNA, 20 bp, Artificial Sequence
  Description of Artificial Sequence: Synthetic oligonucleotide
  Target: ATXN1; (-) strand; PAM type: YTN; PAM sequence: CTG
tttattattttttaaataac

SEQ ID NO: 208037 - DNA, 20 bp, Artificial Sequence
  Description of Artificial Sequence: Synthetic oligonucleotide
  Target: ATXN1; (-) strand; PAM type: YTN; PAM sequence: TTA
ctgtttattattttttaaat

SEQ ID NO: 208038 - DNA, 20 bp, Artificial Sequence
  Description of Artificial Sequence: Synthetic oligonucleotide
  Target: ATXN1; (-) strand; PAM type: YTN; PAM sequence: CTG
ttactgtttattatttttta

SEQ ID NO: 208039 - DNA, 20 bp, Artificial Sequence
  Description of Artificial Sequence: Synthetic oligonucleotide
  Target: ATXN1; (-) strand; PAM type: YTN; PAM sequence: TTA
ggtgtgatagctgttactgt

SEQ ID NO: 208040 - DNA, 20 bp, Artificial Sequence
  Description of Artificial Sequence: Synthetic oligonucleotide
  Target: ATXN1; (-) strand; PAM type: YTN; PAM sequence: TTT
aggtgtgatagctgttactg

SEQ ID NO: 208041 - DNA, 20 bp, Artificial Sequence
  Description of Artificial Sequence: Synthetic oligonucleotide
  Target: ATXN1; (-) strand; PAM type: YTN; PAM sequence: CTT
taggtgtgatagctgttact

SEQ ID NO: 208042 - DNA, 20 bp, Artificial Sequence
  Description of Artificial Sequence: Synthetic oligonucleotide
  Target: ATXN1; (-) strand; PAM type: YTN; PAM sequence: CTA
gataatgtcacctttaggtg

SEQ ID NO: 208043 - DNA, 20 bp, Artificial Sequence
  Description of Artificial Sequence: Synthetic oligonucleotide
  Target: ATXN1; (-) strand; PAM type: YTN; PAM sequence: TTC
tagataatgtcacctttagg

SEQ ID NO: 208044 - DNA, 20 bp, Artificial Sequence
  Description of Artificial Sequence: Synthetic oligonucleotide
  Target: ATXN1; (-) strand; PAM type: YTN; PAM sequence: TTT
ctagataatgtcacctttag

SEQ ID NO: 208045 - DNA, 20 bp, Artificial Sequence
  Description of Artificial Sequence: Synthetic oligonucleotide
  Target: ATXN1; (-) strand; PAM type: YTN; PAM sequence: TTA
atgtttctagataatgtcac

SEQ ID NO: 208046 - DNA, 20 bp, Artificial Sequence
  Description of Artificial Sequence: Synthetic oligonucleotide
  Target: ATXN1; (-) strand; PAM type: YTN; PAM sequence: TTG
acatgttaatgtttctagat

SEQ ID NO: 208047 - DNA, 20 bp, Artificial Sequence
  Description of Artificial Sequence: Synthetic oligonucleotide
  Target: ATXN1; (-) strand; PAM type: YTN; PAM sequence: CTT
gacatgttaatgtttctaga

SEQ ID NO: 208048 - DNA, 20 bp, Artificial Sequence
  Description of Artificial Sequence: Synthetic oligonucleotide
  Target: ATXN1; (-) strand; PAM type: YTN; PAM sequence: CTG
atgtcttgacatgttaatgt

SEQ ID NO: 208049 - DNA, 20 bp, Artificial Sequence
  Description of Artificial Sequence: Synthetic oligonucleotide
  Target: ATXN1; (-) strand; PAM type: YTN; PAM sequence: TTG
ggggaacagaaggaacagaa

SEQ ID NO: 208050 - DNA, 20 bp, Artificial Sequence
  Description of Artificial Sequence: Synthetic oligonucleotide
  Target: ATXN1; (-) strand; PAM type: YTN; PAM sequence: CTT
gggggaacagaaggaacaga

SEQ ID NO: 208051 - DNA, 20 bp, Artificial Sequence
  Description of Artificial Sequence: Synthetic oligonucleotide
  Target: ATXN1; (-) strand; PAM type: YTN; PAM sequence: CTC
ttgggggaacagaaggaaca

SEQ ID NO: 208052 - DNA, 20 bp, Artificial Sequence
  Description of Artificial Sequence: Synthetic oligonucleotide
  Target: ATXN1; (-) strand; PAM type: YTN; PAM sequence: CTC
caaataggcctcttggggga

SEQ ID NO: 208053 - DNA, 20 bp, Artificial Sequence
  Description of Artificial Sequence: Synthetic oligonucleotide
  Target: ATXN1; (-) strand; PAM type: YTN; PAM sequence: CTG
gtgctccaaataggcctctt

SEQ ID NO: 208054 - DNA, 20 bp, Artificial Sequence
  Description of Artificial Sequence: Synthetic oligonucleotide
  Target: ATXN1; (-) strand; PAM type: YTN; PAM sequence: TTG
ctggtgctccaaataggcct

SEQ ID NO: 208055 - DNA, 20 bp, Artificial Sequence
  Description of Artificial Sequence: Synthetic oligonucleotide
  Target: ATXN1; (-) strand; PAM type: YTN; PAM sequence: TTT
gctggtgctccaaataggcc

SEQ ID NO: 208056 - DNA, 20 bp, Artificial Sequence
  Description of Artificial Sequence: Synthetic oligonucleotide
  Target: ATXN1; (-) strand; PAM type: YTN; PAM sequence: TTT
tgctggtgctccaaataggc

SEQ ID NO: 208057 - DNA, 20 bp, Artificial Sequence
  Description of Artificial Sequence: Synthetic oligonucleotide
  Target: ATXN1; (-) strand; PAM type: YTN; PAM sequence: CTC
caaatgcattttgctggtgc

SEQ ID NO: 208058 - DNA, 20 bp, Artificial Sequence
  Description of Artificial Sequence: Synthetic oligonucleotide
  Target: ATXN1; (-) strand; PAM type: YTN; PAM sequence: TTA
gtgatcctccaaatgcattt

SEQ ID NO: 208059 - DNA, 20 bp, Artificial Sequence
  Description of Artificial Sequence: Synthetic oligonucleotide
  Target: ATXN1; (-) strand; PAM type: YTN; PAM sequence: TTT
agtgatcctccaaatgcatt

SEQ ID NO: 208060 - DNA, 20 bp, Artificial Sequence
  Description of Artificial Sequence: Synthetic oligonucleotide
  Target: ATXN1; (-) strand; PAM type: YTN; PAM sequence: TTA
gatttagtgatcctccaaat

SEQ ID NO: 208061 - DNA, 20 bp, Artificial Sequence
  Description of Artificial Sequence: Synthetic oligonucleotide
  Target: ATXN1; (-) strand; PAM type: YTN; PAM sequence: CTG
ttagatttagtgatcctcca

SEQ ID NO: 208062 - DNA, 20 bp, Artificial Sequence
  Description of Artificial Sequence: Synthetic oligonucleotide
  Target: ATXN1; (-) strand; PAM type: YTN; PAM sequence: CTA
cagcagtgaacactgttaga

SEQ ID NO: 208063 - DNA, 20 bp, Artificial Sequence
  Description of Artificial Sequence: Synthetic oligonucleotide
  Target: ATXN1; (-) strand; PAM type: YTN; PAM sequence: CTC
ataacactacagcagtgaac

SEQ ID NO: 208064 - DNA, 20 bp, Artificial Sequence
  Description of Artificial Sequence: Synthetic oligonucleotide
  Target: ATXN1; (-) strand; PAM type: YTN; PAM sequence: CTC
tcataacactacagcagtga

SEQ ID NO: 208065 - DNA, 20 bp, Artificial Sequence
  Description of Artificial Sequence: Synthetic oligonucleotide
  Target: ATXN1; (-) strand; PAM type: YTN; PAM sequence: CTG
aaagtgaaacactctcataa

SEQ ID NO: 208066 - DNA, 20 bp, Artificial Sequence
  Description of Artificial Sequence: Synthetic oligonucleotide
  Target: ATXN1; (-) strand; PAM type: YTN; PAM sequence: TTC
ctgaaagtgaaacactctca

SEQ ID NO: 208067 - DNA, 20 bp, Artificial Sequence
  Description of Artificial Sequence: Synthetic oligonucleotide
  Target: ATXN1; (-) strand; PAM type: YTN; PAM sequence: TTT
cctgaaagtgaaacactctc

SEQ ID NO: 208068 - DNA, 20 bp, Artificial Sequence
  Description of Artificial Sequence: Synthetic oligonucleotide
  Target: ATXN1; (-) strand; PAM type: YTN; PAM sequence: TTG
aaatttcctgaaagtgaaac

SEQ ID NO: 208069 - DNA, 20 bp, Artificial Sequence
  Description of Artificial Sequence: Synthetic oligonucleotide
  Target: ATXN1; (-) strand; PAM type: YTN; PAM sequence: TTT
gaaatttcctgaaagtgaaa

SEQ ID NO: 208070 - DNA, 20 bp, Artificial Sequence
  Description of Artificial Sequence: Synthetic oligonucleotide
  Target: ATXN1; (-) strand; PAM type: YTN; PAM sequence: TTT
tgaaatttcctgaaagtgaa

SEQ ID NO: 208071 - DNA, 20 bp, Artificial Sequence
  Description of Artificial Sequence: Synthetic oligonucleotide
  Target: ATXN1; (-) strand; PAM type: YTN; PAM sequence: CTT
ttgaaatttcctgaaagtga

SEQ ID NO: 208072 - DNA, 20 bp, Artificial Sequence
  Description of Artificial Sequence: Synthetic oligonucleotide
  Target: ATXN1; (-) strand; PAM type: YTN; PAM sequence: TTC
ccttttgaaatttcctgaaa

SEQ ID NO: 208073 - DNA, 20 bp, Artificial Sequence
  Description of Artificial Sequence: Synthetic oligonucleotide
  Target: ATXN1; (-) strand; PAM type: YTN; PAM sequence: TTT
cccttttgaaatttcctgaa

SEQ ID NO: 208074 - DNA, 20 bp, Artificial Sequence
  Description of Artificial Sequence: Synthetic oligonucleotide
  Target: ATXN1; (-) strand; PAM type: YTN; PAM sequence: CTT
tcccttttgaaatttcctga

SEQ ID NO: 208075 - DNA, 20 bp, Artificial Sequence
  Description of Artificial Sequence: Synthetic oligonucleotide
  Target: ATXN1; (-) strand; PAM type: YTN; PAM sequence: TTC
ccacctttcccttttgaaat

SEQ ID NO: 208076 - DNA, 20 bp, Artificial Sequence
  Description of Artificial Sequence: Synthetic oligonucleotide
  Target: ATXN1; (-) strand; PAM type: YTN; PAM sequence: TTT
cccacctttcccttttgaaa

SEQ ID NO: 208077 - DNA, 20 bp, Artificial Sequence
  Description of Artificial Sequence: Synthetic oligonucleotide
  Target: ATXN1; (-) strand; PAM type: YTN; PAM sequence: TTG
tttcccacctttcccttttg

SEQ ID NO: 208078 - DNA, 20 bp, Artificial Sequence
  Description of Artificial Sequence: Synthetic oligonucleotide
  Target: ATXN1; (-) strand; PAM type: YTN; PAM sequence: TTC
catgtaggacacacattgtt

SEQ ID NO: 208079 - DNA, 20 bp, Artificial Sequence
  Description of Artificial Sequence: Synthetic oligonucleotide
  Target: ATXN1; (-) strand; PAM type: YTN; PAM sequence: TTT
ccatgtaggacacacattgt

SEQ ID NO: 208080 - DNA, 20 bp, Artificial Sequence
  Description of Artificial Sequence: Synthetic oligonucleotide
  Target: ATXN1; (-) strand; PAM type: YTN; PAM sequence: CTG
tgtaagaaaaaagacgcaat

SEQ ID NO: 208081 - DNA, 20 bp, Artificial Sequence
  Description of Artificial Sequence: Synthetic oligonucleotide
  Target: ATXN1; (-) strand; PAM type: YTN; PAM sequence: TTA
tataatggcagctgtgtaag

SEQ ID NO: 208082 - DNA, 20 bp, Artificial Sequence
  Description of Artificial Sequence: Synthetic oligonucleotide
  Target: ATXN1; (-) strand; PAM type: YTN; PAM sequence: TTA
aataaaaaacaatggccaag

SEQ ID NO: 208083 - DNA, 20 bp, Artificial Sequence
  Description of Artificial Sequence: Synthetic oligonucleotide
  Target: ATXN1; (-) strand; PAM type: YTN; PAM sequence: TTA
ttaaataaaaaacaatggcc

SEQ ID NO: 208084 - DNA, 20 bp, Artificial Sequence
  Description of Artificial Sequence: Synthetic oligonucleotide
  Target: ATXN1; (-) strand; PAM type: YTN; PAM sequence: TTA
attattaaataaaaaacaat

SEQ ID NO: 208085 - DNA, 20 bp, Artificial Sequence
  Description of Artificial Sequence: Synthetic oligonucleotide
  Target: ATXN1; (-) strand; PAM type: YTN; PAM sequence: CTT
aattattaaataaaaaacaa

SEQ ID NO: 208086 - DNA, 20 bp, Artificial Sequence
  Description of Artificial Sequence: Synthetic oligonucleotide
  Target: ATXN1; (-) strand; PAM type: YTN; PAM sequence: TTC
atcttaattattaaataaaa

SEQ ID NO: 208087 - DNA, 20 bp, Artificial Sequence
  Description of Artificial Sequence: Synthetic oligonucleotide
  Target: ATXN1; (-) strand; PAM type: YTN; PAM sequence: TTA
ttcatcttaattattaaata

SEQ ID NO: 208088 - DNA, 20 bp, Artificial Sequence
  Description of Artificial Sequence: Synthetic oligonucleotide
  Target: ATXN1; (-) strand; PAM type: YTN; PAM sequence: CTA
ccacagatacatatacaatg

SEQ ID NO: 208089 - DNA, 20 bp, Artificial Sequence
  Description of Artificial Sequence: Synthetic oligonucleotide
  Target: ATXN1; (-) strand; PAM type: YTN; PAM sequence: TTA
aacctaccacagatacatat

SEQ ID NO: 208090 - DNA, 20 bp, Artificial Sequence
  Description of Artificial Sequence: Synthetic oligonucleotide
  Target: ATXN1; (-) strand; PAM type: YTN; PAM sequence: TTT
aaacctaccacagatacata

SEQ ID NO: 208091 - DNA, 20 bp, Artificial Sequence
  Description of Artificial Sequence: Synthetic oligonucleotide
  Target: ATXN1; (-) strand; PAM type: YTN; PAM sequence: TTT
taaacctaccacagatacat

SEQ ID NO: 208092 - DNA, 20 bp, Artificial Sequence
  Description of Artificial Sequence: Synthetic oligonucleotide
  Target: ATXN1; (-) strand; PAM type: YTN; PAM sequence: TTT
ttaaacctaccacagataca

SEQ ID NO: 208093 - DNA, 20 bp, Artificial Sequence
  Description of Artificial Sequence: Synthetic oligonucleotide
  Target: ATXN1; (-) strand; PAM type: YTN; PAM sequence: CTG
gaatttttaaacctaccaca

SEQ ID NO: 208094 - DNA, 20 bp, Artificial Sequence
  Description of Artificial Sequence: Synthetic oligonucleotide
  Target: ATXN1; (-) strand; PAM type: YTN; PAM sequence: CTA
gggaaaggtcaactggaatt

SEQ ID NO: 208095 - DNA, 20 bp, Artificial Sequence
  Description of Artificial Sequence: Synthetic oligonucleotide
  Target: ATXN1; (-) strand; PAM type: YTN; PAM sequence: CTG
ggggctagggaaaggtcaac

SEQ ID NO: 208096 - DNA, 20 bp, Artificial Sequence
  Description of Artificial Sequence: Synthetic oligonucleotide
  Target: ATXN1; (-) strand; PAM type: YTN; PAM sequence: TTA
gggaggaagtagcccaaaag

SEQ ID NO: 208097 - DNA, 20 bp, Artificial Sequence
  Description of Artificial Sequence: Synthetic oligonucleotide
  Target: ATXN1; (-) strand; PAM type: YTN; PAM sequence: CTT
agggaggaagtagcccaaaa

SEQ ID NO: 208098 - DNA, 20 bp, Artificial Sequence
  Description of Artificial Sequence: Synthetic oligonucleotide
  Target: ATXN1; (-) strand; PAM type: YTN; PAM sequence: CTC
atcttagggaggaagtagcc

SEQ ID NO: 208099 - DNA, 20 bp, Artificial Sequence
  Description of Artificial Sequence: Synthetic oligonucleotide
  Target: ATXN1; (-) strand; PAM type: YTN; PAM sequence: TTG
tgccacatgtgtgcacatag

SEQ ID NO: 208100 - DNA, 20 bp, Artificial Sequence
  Description of Artificial Sequence: Synthetic oligonucleotide
  Target: ATXN1; (-) strand; PAM type: YTN; PAM sequence: TTA
aaattgtgccacatgtgtgc

SEQ ID NO: 208101 - DNA, 20 bp, Artificial Sequence
  Description of Artificial Sequence: Synthetic oligonucleotide
  Target: ATXN1; (-) strand; PAM type: YTN; PAM sequence: TTA
gatagtattaaaattgtgcc

SEQ ID NO: 208102 - DNA, 20 bp, Artificial Sequence
  Description of Artificial Sequence: Synthetic oligonucleotide
  Target: ATXN1; (-) strand; PAM type: YTN; PAM sequence: CTT
agatagtattaaaattgtgc

SEQ ID NO: 208103 - DNA, 20 bp, Artificial Sequence
  Description of Artificial Sequence: Synthetic oligonucleotide
  Target: ATXN1; (-) strand; PAM type: YTN; PAM sequence: TTG
cttagatagtattaaaattg

SEQ ID NO: 208104 - DNA, 20 bp, Artificial Sequence
  Description of Artificial Sequence: Synthetic oligonucleotide
  Target: ATXN1; (-) strand; PAM type: YTN; PAM sequence: TTT
gcttagatagtattaaaatt

SEQ ID NO: 208105 - DNA, 20 bp, Artificial Sequence
  Description of Artificial Sequence: Synthetic oligonucleotide
  Target: ATXN1; (-) strand; PAM type: YTN; PAM sequence: TTT
tgcttagatagtattaaaat

SEQ ID NO: 208106 - DNA, 20 bp, Artificial Sequence
  Description of Artificial Sequence: Synthetic oligonucleotide
  Target: ATXN1; (-) strand; PAM type: YTN; PAM sequence: TTG
tggttttgcttagatagtat

SEQ ID NO: 208107 - DNA, 20 bp, Artificial Sequence
  Description of Artificial Sequence: Synthetic oligonucleotide
  Target: ATXN1; (-) strand; PAM type: YTN; PAM sequence: TTT
gtggttttgcttagatagta

SEQ ID NO: 208108 - DNA, 20 bp, Artificial Sequence
  Description of Artificial Sequence: Synthetic oligonucleotide
  Target: ATXN1; (-) strand; PAM type: YTN; PAM sequence: TTG
gtttgtggttttgcttagat

SEQ ID NO: 208109 - DNA, 20 bp, Artificial Sequence
  Description of Artificial Sequence: Synthetic oligonucleotide
  Target: ATXN1; (-) strand; PAM type: YTN; PAM sequence: TTA
ttggtttgtggttttgctta

SEQ ID NO: 208110 - DNA, 20 bp, Artificial Sequence
  Description of Artificial Sequence: Synthetic oligonucleotide
  Target: ATXN1; (-) strand; PAM type: YTN; PAM sequence: TTT
attggtttgtggttttgctt

SEQ ID NO: 208111 - DNA, 20 bp, Artificial Sequence
  Description of Artificial Sequence: Synthetic oligonucleotide
  Target: ATXN1; (-) strand; PAM type: YTN; PAM sequence: TTT
tattggtttgtggttttgct

SEQ ID NO: 208112 - DNA, 20 bp, Artificial Sequence
  Description of Artificial Sequence: Synthetic oligonucleotide
  Target: ATXN1; (-) strand; PAM type: YTN; PAM sequence: CTT
ttattggtttgtggttttgc

SEQ ID NO: 208113 - DNA, 20 bp, Artificial Sequence
  Description of Artificial Sequence: Synthetic oligonucleotide
  Target: ATXN1; (-) strand; PAM type: YTN; PAM sequence: TTG
agaagcaccggatgatgctt

SEQ ID NO: 208114 - DNA, 20 bp, Artificial Sequence
  Description of Artificial Sequence: Synthetic oligonucleotide
  Target: ATXN1; (-) strand; PAM type: YTN; PAM sequence: TTT
gagaagcaccggatgatgct

SEQ ID NO: 208115 - DNA, 20 bp, Artificial Sequence
  Description of Artificial Sequence: Synthetic oligonucleotide
  Target: ATXN1; (-) strand; PAM type: YTN; PAM sequence: CTT
tgagaagcaccggatgatgc

SEQ ID NO: 208116 - DNA, 20 bp, Artificial Sequence
  Description of Artificial Sequence: Synthetic oligonucleotide
  Target: ATXN1; (-) strand; PAM type: YTN; PAM sequence: TTG
gctttgagaagcaccggatg

SEQ ID NO: 208117 - DNA, 20 bp, Artificial Sequence
  Description of Artificial Sequence: Synthetic oligonucleotide
  Target: ATXN1; (-) strand; PAM type: YTN; PAM sequence: TTT
ggctttgagaagcaccggat

SEQ ID NO: 208118 - DNA, 20 bp, Artificial Sequence
  Description of Artificial Sequence: Synthetic oligonucleotide
  Target: ATXN1; (-) strand; PAM type: YTN; PAM sequence: CTT
tggctttgagaagcaccgga

SEQ ID NO: 208119 - DNA, 20 bp, Artificial Sequence
  Description of Artificial Sequence: Synthetic oligonucleotide
  Target: ATXN1; (-) strand; PAM type: YTN; PAM sequence: TTC
ctttggctttgagaagcacc

SEQ ID NO: 208120 - DNA, 20 bp, Artificial Sequence
  Description of Artificial Sequence: Synthetic oligonucleotide
  Target: ATXN1; (-) strand; PAM type: YTN; PAM sequence: TTT
cctttggctttgagaagcac

SEQ ID NO: 208121 - DNA, 20 bp, Artificial Sequence
  Description of Artificial Sequence: Synthetic oligonucleotide
  Target: ATXN1; (-) strand; PAM type: YTN; PAM sequence: CTC
caaaatcatttcctttggct

SEQ ID NO: 208122 - DNA, 20 bp, Artificial Sequence
  Description of Artificial Sequence: Synthetic oligonucleotide
  Target: ATXN1; (-) strand; PAM type: YTN; PAM sequence: TTG
ctccaaaatcatttcctttg

SEQ ID NO: 208123 - DNA, 20 bp, Artificial Sequence
  Description of Artificial Sequence: Synthetic oligonucleotide
  Target: ATXN1; (-) strand; PAM type: YTN; PAM sequence: TTA
atggaatgtaatcagtgatg

SEQ ID NO: 208124 - DNA, 20 bp, Artificial Sequence
  Description of Artificial Sequence: Synthetic oligonucleotide
  Target: ATXN1; (-) strand; PAM type: YTN; PAM sequence: CTG
tattaatggaatgtaatcag

SEQ ID NO: 208125 - DNA, 20 bp, Artificial Sequence
  Description of Artificial Sequence: Synthetic oligonucleotide
  Target: ATXN1; (-) strand; PAM type: YTN; PAM sequence: TTA
tctgtattaatggaatgtaa

SEQ ID NO: 208126 - DNA, 20 bp, Artificial Sequence
  Description of Artificial Sequence: Synthetic oligonucleotide
  Target: ATXN1; (-) strand; PAM type: YTN; PAM sequence: TTA
attatctgtattaatggaat

SEQ ID NO: 208127 - DNA, 20 bp, Artificial Sequence
  Description of Artificial Sequence: Synthetic oligonucleotide
  Target: ATXN1; (-) strand; PAM type: YTN; PAM sequence: TTT
aattatctgtattaatggaa

SEQ ID NO: 208128 - DNA, 20 bp, Artificial Sequence
  Description of Artificial Sequence: Synthetic oligonucleotide
  Target: ATXN1; (-) strand; PAM type: YTN; PAM sequence: TTT
taattatctgtattaatgga

SEQ ID NO: 208129 - DNA, 20 bp, Artificial Sequence
  Description of Artificial Sequence: Synthetic oligonucleotide
  Target: ATXN1; (-) strand; PAM type: YTN; PAM sequence: CTT
ttaattatctgtattaatgg

SEQ ID NO: 208130 - DNA, 20 bp, Artificial Sequence
  Description of Artificial Sequence: Synthetic oligonucleotide
  Target: ATXN1; (-) strand; PAM type: YTN; PAM sequence: TTA
tacagtcaacttttaattat

SEQ ID NO: 208131 - DNA, 20 bp, Artificial Sequence
  Description of Artificial Sequence: Synthetic oligonucleotide
  Target: ATXN1; (-) strand; PAM type: YTN; PAM sequence: TTA
ttatacagtcaacttttaat

SEQ ID NO: 208132 - DNA, 20 bp, Artificial Sequence
  Description of Artificial Sequence: Synthetic oligonucleotide
  Target: ATXN1; (-) strand; PAM type: YTN; PAM sequence: TTA
acattattatacagtcaact

SEQ ID NO: 208133 - DNA, 20 bp, Artificial Sequence
  Description of Artificial Sequence: Synthetic oligonucleotide
  Target: ATXN1; (-) strand; PAM type: YTN; PAM sequence: TTT
aacattattatacagtcaac

SEQ ID NO: 208134 - DNA, 20 bp, Artificial Sequence
  Description of Artificial Sequence: Synthetic oligonucleotide
  Target: ATXN1; (-) strand; PAM type: YTN; PAM sequence: CTA
tttaacattattatacagtc

SEQ ID NO: 208135 - DNA, 20 bp, Artificial Sequence
  Description of Artificial Sequence: Synthetic oligonucleotide
  Target: ATXN1; (-) strand; PAM type: YTN; PAM sequence: CTG
ctatttaacattattataca

SEQ ID NO: 208136 - DNA, 20 bp, Artificial Sequence
  Description of Artificial Sequence: Synthetic oligonucleotide
  Target: ATXN1; (-) strand; PAM type: YTN; PAM sequence: TTA
tgcctgctatttaacattat

SEQ ID NO: 208137 - DNA, 20 bp, Artificial Sequence
  Description of Artificial Sequence: Synthetic oligonucleotide
  Target: ATXN1; (-) strand; PAM type: YTN; PAM sequence: TTC
aaaaaaagttatgcctgcta

SEQ ID NO: 208138 - DNA, 20 bp, Artificial Sequence
  Description of Artificial Sequence: Synthetic oligonucleotide
  Target: ATXN1; (-) strand; PAM type: YTN; PAM sequence: TTT
caaaaaaagttatgcctgct

SEQ ID NO: 208139 - DNA, 20 bp, Artificial Sequence
  Description of Artificial Sequence: Synthetic oligonucleotide
  Target: ATXN1; (-) strand; PAM type: YTN; PAM sequence: TTT
tcaaaaaaagttatgcctgc

SEQ ID NO: 208140 - DNA, 20 bp, Artificial Sequence
  Description of Artificial Sequence: Synthetic oligonucleotide
  Target: ATXN1; (-) strand; PAM type: YTN; PAM sequence: CTA
atatcacggagaaattttca

SEQ ID NO: 208141 - DNA, 20 bp, Artificial Sequence
  Description of Artificial Sequence: Synthetic oligonucleotide
  Target: ATXN1; (-) strand; PAM type: YTN; PAM sequence: TTG
catagctaatatcacggaga

SEQ ID NO: 208142 - DNA, 20 bp, Artificial Sequence
  Description of Artificial Sequence: Synthetic oligonucleotide
  Target: ATXN1; (-) strand; PAM type: YTN; PAM sequence: TTT
gcatagctaatatcacggag

SEQ ID NO: 208143 - DNA, 20 bp, Artificial Sequence
  Description of Artificial Sequence: Synthetic oligonucleotide
  Target: ATXN1; (-) strand; PAM type: YTN; PAM sequence: TTT
tgcatagctaatatcacgga

SEQ ID NO: 208144 - DNA, 20 bp, Artificial Sequence
  Description of Artificial Sequence: Synthetic oligonucleotide
  Target: ATXN1; (-) strand; PAM type: YTN; PAM sequence: TTT
ttgcatagctaatatcacgg

SEQ ID NO: 208145 - DNA, 20 bp, Artificial Sequence
  Description of Artificial Sequence: Synthetic oligonucleotide
  Target: ATXN1; (-) strand; PAM type: YTN; PAM sequence: TTC
agtcagtgtttttgcatagc

SEQ ID NO: 208146 - DNA, 20 bp, Artificial Sequence
  Description of Artificial Sequence: Synthetic oligonucleotide
  Target: ATXN1; (-) strand; PAM type: YTN; PAM sequence: TTG
aacattcagtcagtgttttt

SEQ ID NO: 208147 - DNA, 20 bp, Artificial Sequence
  Description of Artificial Sequence: Synthetic oligonucleotide
  Target: ATXN1; (-) strand; PAM type: YTN; PAM sequence: TTA
gcattgaacattcagtcagt

SEQ ID NO: 208148 - DNA, 20 bp, Artificial Sequence
  Description of Artificial Sequence: Synthetic oligonucleotide
  Target: ATXN1; (-) strand; PAM type: YTN; PAM sequence: TTG
attagcattgaacattcagt

SEQ ID NO: 208149 - DNA, 20 bp, Artificial Sequence
  Description of Artificial Sequence: Synthetic oligonucleotide
  Target: ATXN1; (-) strand; PAM type: YTN; PAM sequence: TTT
gattagcattgaacattcag

SEQ ID NO: 208150 - DNA, 20 bp, Artificial Sequence
  Description of Artificial Sequence: Synthetic oligonucleotide
  Target: ATXN1; (-) strand; PAM type: YTN; PAM sequence: TTA
agaggagatgaatttgatta

SEQ ID NO: 208151 - DNA, 20 bp, Artificial Sequence
  Description of Artificial Sequence: Synthetic oligonucleotide
  Target: ATXN1; (-) strand; PAM type: YTN; PAM sequence: CTT
aagaggagatgaatttgatt

SEQ ID NO: 208152 - DNA, 20 bp, Artificial Sequence
  Description of Artificial Sequence: Synthetic oligonucleotide
  Target: ATXN1; (-) strand; PAM type: YTN; PAM sequence: CTC
ttaagaggagatgaatttga

SEQ ID NO: 208153 - DNA, 20 bp, Artificial Sequence
  Description of Artificial Sequence: Synthetic oligonucleotide
  Target: ATXN1; (-) strand; PAM type: YTN; PAM sequence: CTG
ctcttaagaggagatgaatt

SEQ ID NO: 208154 - DNA, 20 bp, Artificial Sequence
  Description of Artificial Sequence: Synthetic oligonucleotide
  Target: ATXN1; (-) strand; PAM type: YTN; PAM sequence: TTA
tacgctgctcttaagaggag

SEQ ID NO: 208155 - DNA, 20 bp, Artificial Sequence
  Description of Artificial Sequence: Synthetic oligonucleotide
  Target: ATXN1; (-) strand; PAM type: YTN; PAM sequence: TTA
ttatacgctgctcttaagag

SEQ ID NO: 208156 - DNA, 20 bp, Artificial Sequence
  Description of Artificial Sequence: Synthetic oligonucleotide
  Target: ATXN1; (-) strand; PAM type: YTN; PAM sequence: TTT
attatacgctgctcttaaga

SEQ ID NO: 208157 - DNA, 20 bp, Artificial Sequence
  Description of Artificial Sequence: Synthetic oligonucleotide
  Target: ATXN1; (-) strand; PAM type: YTN; PAM sequence: CTA
cccatttattatacgctgct

SEQ ID NO: 208158 - DNA, 20 bp, Artificial Sequence
  Description of Artificial Sequence: Synthetic oligonucleotide
  Target: ATXN1; (-) strand; PAM type: YTN; PAM sequence: TTA
ggctacccatttattatacg

SEQ ID NO: 208159 - DNA, 20 bp, Artificial Sequence
  Description of Artificial Sequence: Synthetic oligonucleotide
  Target: ATXN1; (-) strand; PAM type: YTN; PAM sequence: TTT
aggctacccatttattatac

SEQ ID NO: 208160 - DNA, 20 bp, Artificial Sequence
  Description of Artificial Sequence: Synthetic oligonucleotide
  Target: ATXN1; (-) strand; PAM type: YTN; PAM sequence: TTT
taggctacccatttattata

SEQ ID NO: 208161 - DNA, 20 bp, Artificial Sequence
  Description of Artificial Sequence: Synthetic oligonucleotide
  Target: ATXN1; (-) strand; PAM type: YTN; PAM sequence: CTT
ttaggctacccatttattat

SEQ ID NO: 208162 - DNA, 20 bp, Artificial Sequence
  Description of Artificial Sequence: Synthetic oligonucleotide
  Target: ATXN1; (-) strand; PAM type: YTN; PAM sequence: TTC
cttttaggctacccatttat

SEQ ID NO: 208163 - DNA, 20 bp, Artificial Sequence
  Description of Artificial Sequence: Synthetic oligonucleotide
  Target: ATXN1; (-) strand; PAM type: YTN; PAM sequence: TTC
aaagcattccttttaggcta

SEQ ID NO: 208164 - DNA, 20 bp, Artificial Sequence
  Description of Artificial Sequence: Synthetic oligonucleotide
  Target: ATXN1; (-) strand; PAM type: YTN; PAM sequence: CTG
ttcaaagcattccttttagg

SEQ ID NO: 208165 - DNA, 20 bp, Artificial Sequence
  Description of Artificial Sequence: Synthetic oligonucleotide
  Target: ATXN1; (-) strand; PAM type: YTN; PAM sequence: TTC
tgttcaaagcattcctttta

SEQ ID NO: 208166 - DNA, 20 bp, Artificial Sequence
  Description of Artificial Sequence: Synthetic oligonucleotide
  Target: ATXN1; (-) strand; PAM type: YTN; PAM sequence: TTA
gaataatcagacaatagtga

SEQ ID NO: 208167 - DNA, 20 bp, Artificial Sequence
  Description of Artificial Sequence: Synthetic oligonucleotide
  Target: ATXN1; (-) strand; PAM type: YTN; PAM sequence: TTT
agaataatcagacaatagtg

SEQ ID NO: 208168 - DNA, 20 bp, Artificial Sequence
  Description of Artificial Sequence: Synthetic oligonucleotide
  Target: ATXN1; (-) strand; PAM type: YTN; PAM sequence: TTA
aatttagaataatcagacaa

SEQ ID NO: 208169 - DNA, 20 bp, Artificial Sequence
  Description of Artificial Sequence: Synthetic oligonucleotide
  Target: ATXN1; (-) strand; PAM type: YTN; PAM sequence: TTT
aaatttagaataatcagaca

SEQ ID NO: 208170 - DNA, 20 bp, Artificial Sequence
  Description of Artificial Sequence: Synthetic oligonucleotide
  Target: ATXN1; (-) strand; PAM type: YTN; PAM sequence: TTT
taaatttagaataatcagac

SEQ ID NO: 208171 - DNA, 20 bp, Artificial Sequence
  Description of Artificial Sequence: Synthetic oligonucleotide
  Target: ATXN1; (-) strand; PAM type: YTN; PAM sequence: TTG
gagttttaaatttagaataa

SEQ ID NO: 208172 - DNA, 20 bp, Artificial Sequence
  Description of Artificial Sequence: Synthetic oligonucleotide
  Target: ATXN1; (-) strand; PAM type: YTN; PAM sequence: TTG
ttggagttttaaatttagaa

SEQ ID NO: 208173 - DNA, 20 bp, Artificial Sequence
  Description of Artificial Sequence: Synthetic oligonucleotide
  Target: ATXN1; (-) strand; PAM type: YTN; PAM sequence: TTT
gttggagttttaaatttaga

SEQ ID NO: 208174 - DNA, 20 bp, Artificial Sequence
  Description of Artificial Sequence: Synthetic oligonucleotide
  Target: ATXN1; (-) strand; PAM type: YTN; PAM sequence: CTT
tgttggagttttaaatttag

SEQ ID NO: 208175 - DNA, 20 bp, Artificial Sequence
  Description of Artificial Sequence: Synthetic oligonucleotide
  Target: ATXN1; (-) strand; PAM type: YTN; PAM sequence: TTC
ctttgttggagttttaaatt

SEQ ID NO: 208176 - DNA, 20 bp, Artificial Sequence
  Description of Artificial Sequence: Synthetic oligonucleotide
  Target: ATXN1; (-) strand; PAM type: YTN; PAM sequence: TTT
cctttgttggagttttaaat

SEQ ID NO: 208177 - DNA, 20 bp, Artificial Sequence
  Description of Artificial Sequence: Synthetic oligonucleotide
  Target: ATXN1; (-) strand; PAM type: YTN; PAM sequence: CTT
tcctttgttggagttttaaa

SEQ ID NO: 208178 - DNA, 20 bp, Artificial Sequence
  Description of Artificial Sequence: Synthetic oligonucleotide
  Target: ATXN1; (-) strand; PAM type: YTN; PAM sequence: TTA
gaagaataatcctttccttt

SEQ ID NO: 208179 - DNA, 20 bp, Artificial Sequence
  Description of Artificial Sequence: Synthetic oligonucleotide
  Target: ATXN1; (-) strand; PAM type: YTN; PAM sequence: CTT
agaagaataatcctttcctt

SEQ ID NO: 208180 - DNA, 20 bp, Artificial Sequence
  Description of Artificial Sequence: Synthetic oligonucleotide
  Target: ATXN1; (-) strand; PAM type: YTN; PAM sequence: TTG
aaccttagaagaataatcct

SEQ ID NO: 208181 - DNA, 20 bp, Artificial Sequence
  Description of Artificial Sequence: Synthetic oligonucleotide
  Target: ATXN1; (-) strand; PAM type: YTN; PAM sequence: CTT
gaaccttagaagaataatcc

SEQ ID NO: 208182 - DNA, 20 bp, Artificial Sequence
  Description of Artificial Sequence: Synthetic oligonucleotide
  Target: ATXN1; (-) strand; PAM type: YTN; PAM sequence: CTC
acgaatcttgaaccttagaa

SEQ ID NO: 208183 - DNA, 20 bp, Artificial Sequence
  Description of Artificial Sequence: Synthetic oligonucleotide
  Target: ATXN1; (-) strand; PAM type: YTN; PAM sequence: TTA
ccaaatcctcacgaatcttg

SEQ ID NO: 208184 - DNA, 20 bp, Artificial Sequence
  Description of Artificial Sequence: Synthetic oligonucleotide
  Target: ATXN1; (-) strand; PAM type: YTN; PAM sequence: TTC
gttaccaaatcctcacgaat

SEQ ID NO: 208185 - DNA, 20 bp, Artificial Sequence
  Description of Artificial Sequence: Synthetic oligonucleotide
  Target: ATXN1; (-) strand; PAM type: YTN; PAM sequence: TTT
cgttaccaaatcctcacgaa

SEQ ID NO: 208186 - DNA, 20 bp, Artificial Sequence
  Description of Artificial Sequence: Synthetic oligonucleotide
  Target: ATXN1; (-) strand; PAM type: YTN; PAM sequence: TTA
aggaatttcgttaccaaatc

SEQ ID NO: 208187 - DNA, 20 bp, Artificial Sequence
  Description of Artificial Sequence: Synthetic oligonucleotide
  Target: ATXN1; (-) strand; PAM type: YTN; PAM sequence: CTT
aaggaatttcgttaccaaat

SEQ ID NO: 208188 - DNA, 20 bp, Artificial Sequence
  Description of Artificial Sequence: Synthetic oligonucleotide
  Target: ATXN1; (-) strand; PAM type: YTN; PAM sequence: CTG
tccttaaggaatttcgttac

SEQ ID NO: 208189 - DNA, 20 bp, Artificial Sequence
  Description of Artificial Sequence: Synthetic oligonucleotide
  Target: ATXN1; (-) strand; PAM type: YTN; PAM sequence: TTG
ctgtccttaaggaatttcgt

SEQ ID NO: 208190 - DNA, 20 bp, Artificial Sequence
  Description of Artificial Sequence: Synthetic oligonucleotide
  Target: ATXN1; (-) strand; PAM type: YTN; PAM sequence: TTT
gctgtccttaaggaatttcg

SEQ ID NO: 208191 - DNA, 20 bp, Artificial Sequence
  Description of Artificial Sequence: Synthetic oligonucleotide
  Target: ATXN1; (-) strand; PAM type: YTN; PAM sequence: TTA
atttgctgtccttaaggaat

SEQ ID NO: 208192 - DNA, 20 bp, Artificial Sequence
  Description of Artificial Sequence: Synthetic oligonucleotide
  Target: ATXN1; (-) strand; PAM type: YTN; PAM sequence: TTT
aatttgctgtccttaaggaa

SEQ ID NO: 208193 - DNA, 20 bp, Artificial Sequence
  Description of Artificial Sequence: Synthetic oligonucleotide
  Target: ATXN1; (-) strand; PAM type: YTN; PAM sequence: TTT
taatttgctgtccttaagga

SEQ ID NO: 208194 - DNA, 20 bp, Artificial Sequence
  Description of Artificial Sequence: Synthetic oligonucleotide
  Target: ATXN1; (-) strand; PAM type: YTN; PAM sequence: TTT
ttaatttgctgtccttaagg

SEQ ID NO: 208195 - DNA, 20 bp, Artificial Sequence
  Description of Artificial Sequence: Synthetic oligonucleotide
  Target: ATXN1; (-) strand; PAM type: YTN; PAM sequence: TTT
tttaatttgctgtccttaag

SEQ ID NO: 208196 - DNA, 20 bp, Artificial Sequence
  Description of Artificial Sequence: Synthetic oligonucleotide
  Target: ATXN1; (-) strand; PAM type: YTN; PAM sequence: TTG
tagatagcaattttttaatt

SEQ ID NO: 208197 - DNA, 20 bp, Artificial Sequence
  Description of Artificial Sequence: Synthetic oligonucleotide
  Target: ATXN1; (-) strand; PAM type: YTN; PAM sequence: CTT
gtagatagcaattttttaat

SEQ ID NO: 208198 - DNA, 20 bp, Artificial Sequence
  Description of Artificial Sequence: Synthetic oligonucleotide
  Target: ATXN1; (-) strand; PAM type: YTN; PAM sequence: CTA
tacagacataaaatagtggc

SEQ ID NO: 208199 - DNA, 20 bp, Artificial Sequence
  Description of Artificial Sequence: Synthetic oligonucleotide
  Target: ATXN1; (-) strand; PAM type: YTN; PAM sequence: TTA
aaacactatacagacataaa

SEQ ID NO: 208200 - DNA, 20 bp, Artificial Sequence
  Description of Artificial Sequence: Synthetic oligonucleotide
  Target: ATXN1; (-) strand; PAM type: YTN; PAM sequence: TTT
aaaacactatacagacataa

SEQ ID NO: 208201 - DNA, 20 bp, Artificial Sequence
  Description of Artificial Sequence: Synthetic oligonucleotide
  Target: ATXN1; (-) strand; PAM type: YTN; PAM sequence: TTT
taaaacactatacagacata

SEQ ID NO: 208202 - DNA, 20 bp, Artificial Sequence
  Description of Artificial Sequence: Synthetic oligonucleotide
  Target: ATXN1; (-) strand; PAM type: YTN; PAM sequence: TTG
attttaaaacactatacaga

SEQ ID NO: 208203 - DNA, 20 bp, Artificial Sequence
  Description of Artificial Sequence: Synthetic oligonucleotide
  Target: ATXN1; (-) strand; PAM type: YTN; PAM sequence: TTT
gattttaaaacactatacag

SEQ ID NO: 208204 - DNA, 20 bp, Artificial Sequence
  Description of Artificial Sequence: Synthetic oligonucleotide
  Target: ATXN1; (-) strand; PAM type: YTN; PAM sequence: CTT
tgattttaaaacactataca

SEQ ID NO: 208205 - DNA, 20 bp, Artificial Sequence
  Description of Artificial Sequence: Synthetic oligonucleotide
  Target: ATXN1; (-) strand; PAM type: YTN; PAM sequence: TTG
aatgggtagtgactttgatt

SEQ ID NO: 208206 - DNA, 20 bp, Artificial Sequence
  Description of Artificial Sequence: Synthetic oligonucleotide
  Target: ATXN1; (-) strand; PAM type: YTN; PAM sequence: TTG
ttgaatgggtagtgactttg

SEQ ID NO: 208207 - DNA, 20 bp, Artificial Sequence
  Description of Artificial Sequence: Synthetic oligonucleotide
  Target: ATXN1; (-) strand; PAM type: YTN; PAM sequence: TTG
ttgttgaatgggtagtgact

SEQ ID NO: 208208 - DNA, 20 bp, Artificial Sequence
  Description of Artificial Sequence: Synthetic oligonucleotide
  Target: ATXN1; (-) strand; PAM type: YTN; PAM sequence: TTT
gttgttgaatgggtagtgac

SEQ ID NO: 208209 - DNA, 20 bp, Artificial Sequence
  Description of Artificial Sequence: Synthetic oligonucleotide
  Target: ATXN1; (-) strand; PAM type: YTN; PAM sequence: TTC
caaacaaacatttgttgttg

SEQ ID NO: 208210 - DNA, 20 bp, Artificial Sequence
  Description of Artificial Sequence: Synthetic oligonucleotide
  Target: ATXN1; (-) strand; PAM type: YTN; PAM sequence: TTA
ttccaaacaaacatttgttg

SEQ ID NO: 208211 - DNA, 20 bp, Artificial Sequence
  Description of Artificial Sequence: Synthetic oligonucleotide
  Target: ATXN1; (-) strand; PAM type: YTN; PAM sequence: TTT
attccaaacaaacatttgtt

SEQ ID NO: 208212 - DNA, 20 bp, Artificial Sequence
  Description of Artificial Sequence: Synthetic oligonucleotide
  Target: ATXN1; (-) strand; PAM type: YTN; PAM sequence: TTC
atttattccaaacaaacatt

SEQ ID NO: 208213 - DNA, 20 bp, Artificial Sequence
  Description of Artificial Sequence: Synthetic oligonucleotide
  Target: ATXN1; (-) strand; PAM type: YTN; PAM sequence: TTC
attcatttattccaaacaaa

SEQ ID NO: 208214 - DNA, 20 bp, Artificial Sequence
  Description of Artificial Sequence: Synthetic oligonucleotide
  Target: ATXN1; (-) strand; PAM type: YTN; PAM sequence: TTT
cattcatttattccaaacaa

SEQ ID NO: 208215 - DNA, 20 bp, Artificial Sequence
  Description of Artificial Sequence: Synthetic oligonucleotide
  Target: ATXN1; (-) strand; PAM type: YTN; PAM sequence: CTT
tcattcatttattccaaaca

SEQ ID NO: 208216 - DNA, 20 bp, Artificial Sequence
  Description of Artificial Sequence: Synthetic oligonucleotide
  Target: ATXN1; (-) strand; PAM type: YTN; PAM sequence: TTC
tttcattcatttattccaaa

SEQ ID NO: 208217 - DNA, 20 bp, Artificial Sequence
  Description of Artificial Sequence: Synthetic oligonucleotide
  Target: ATXN1; (-) strand; PAM type: YTN; PAM sequence: TTT
ctttcattcatttattccaa

SEQ ID NO: 208218 - DNA, 20 bp, Artificial Sequence
  Description of Artificial Sequence: Synthetic oligonucleotide
  Target: ATXN1; (-) strand; PAM type: YTN; PAM sequence: CTG
tttctttcattcatttattc

SEQ ID NO: 208219 - DNA, 20 bp, Artificial Sequence
  Description of Artificial Sequence: Synthetic oligonucleotide
  Target: ATXN1; (-) strand; PAM type: YTN; PAM sequence: TTG
aggctgtttctttcattcat

SEQ ID NO: 208220 - DNA, 20 bp, Artificial Sequence
  Description of Artificial Sequence: Synthetic oligonucleotide
  Target: ATXN1; (-) strand; PAM type: YTN; PAM sequence: TTT
gaggctgtttctttcattca

SEQ ID NO: 208221 - DNA, 20 bp, Artificial Sequence
  Description of Artificial Sequence: Synthetic oligonucleotide
  Target: ATXN1; (-) strand; PAM type: YTN; PAM sequence: TTT
tgaggctgtttctttcattc

SEQ ID NO: 208222 - DNA, 20 bp, Artificial Sequence
  Description of Artificial Sequence: Synthetic oligonucleotide
  Target: ATXN1; (-) strand; PAM type: YTN; PAM sequence: TTG
taaagtattttgaggctgtt

SEQ ID NO: 208223 - DNA, 20 bp, Artificial Sequence
  Description of Artificial Sequence: Synthetic oligonucleotide
  Target: ATXN1; (-) strand; PAM type: YTN; PAM sequence: CTT
gtaaagtattttgaggctgt

SEQ ID NO: 208224 - DNA, 20 bp, Artificial Sequence
  Description of Artificial Sequence: Synthetic oligonucleotide
  Target: ATXN1; (-) strand; PAM type: YTN; PAM sequence: TTA
aacttgtaaagtattttgag

SEQ ID NO: 208225 - DNA, 20 bp, Artificial Sequence
  Description of Artificial Sequence: Synthetic oligonucleotide
  Target: ATXN1; (-) strand; PAM type: YTN; PAM sequence: TTA
taggtgattaaacttgtaaa

SEQ ID NO: 208226 - DNA, 20 bp, Artificial Sequence
  Description of Artificial Sequence: Synthetic oligonucleotide
  Target: ATXN1; (-) strand; PAM type: YTN; PAM sequence: CTT
ataggtgattaaacttgtaa

SEQ ID NO: 208227 - DNA, 20 bp, Artificial Sequence
  Description of Artificial Sequence: Synthetic oligonucleotide
  Target: ATXN1; (-) strand; PAM type: YTN; PAM sequence: TTC
ataacttataggtgattaaa

SEQ ID NO: 208228 - DNA, 20 bp, Artificial Sequence
  Description of Artificial Sequence: Synthetic oligonucleotide
  Target: ATXN1; (-) strand; PAM type: YTN; PAM sequence: CTA
attcataacttataggtgat

SEQ ID NO: 208229 - DNA, 20 bp, Artificial Sequence
  Description of Artificial Sequence: Synthetic oligonucleotide
  Target: ATXN1; (-) strand; PAM type: YTN; PAM sequence: CTG
cctaattcataacttatagg

SEQ ID NO: 208230 - DNA, 20 bp, Artificial Sequence
  Description of Artificial Sequence: Synthetic oligonucleotide
  Target: ATXN1; (-) strand; PAM type: YTN; PAM sequence: TTG
ctgcctaattcataacttat

SEQ ID NO: 208231 - DNA, 20 bp, Artificial Sequence
  Description of Artificial Sequence: Synthetic oligonucleotide
  Target: ATXN1; (-) strand; PAM type: YTN; PAM sequence: TTG
aagttgctgcctaattcata

SEQ ID NO: 208232 - DNA, 20 bp, Artificial Sequence
  Description of Artificial Sequence: Synthetic oligonucleotide
  Target: ATXN1; (-) strand; PAM type: YTN; PAM sequence: TTG
ggaatgattgaagttgctgc

SEQ ID NO: 208233 - DNA, 20 bp, Artificial Sequence
  Description of Artificial Sequence: Synthetic oligonucleotide
  Target: ATXN1; (-) strand; PAM type: YTN; PAM sequence: TTT
gggaatgattgaagttgctg

SEQ ID NO: 208234 - DNA, 20 bp, Artificial Sequence
  Description of Artificial Sequence: Synthetic oligonucleotide
  Target: ATXN1; (-) strand; PAM type: YTN; PAM sequence: TTC
aatcatttgggaatgattga

SEQ ID NO: 208235 - DNA, 20 bp, Artificial Sequence
  Description of Artificial Sequence: Synthetic oligonucleotide
  Target: ATXN1; (-) strand; PAM type: YTN; PAM sequence: TTA
ccccagcgaggtaaatgatt

SEQ ID NO: 208236 - DNA, 20 bp, Artificial Sequence
  Description of Artificial Sequence: Synthetic oligonucleotide
  Target: ATXN1; (-) strand; PAM type: YTN; PAM sequence: CTT
accccagcgaggtaaatgat

SEQ ID NO: 208237 - DNA, 20 bp, Artificial Sequence
  Description of Artificial Sequence: Synthetic oligonucleotide
  Target: ATXN1; (-) strand; PAM type: YTN; PAM sequence: TTG
ccagacatataccttacccc

SEQ ID NO: 208238 - DNA, 20 bp, Artificial Sequence
  Description of Artificial Sequence: Synthetic oligonucleotide
  Target: ATXN1; (-) strand; PAM type: YTN; PAM sequence: CTT
gccagacatataccttaccc

SEQ ID NO: 208239 - DNA, 20 bp, Artificial Sequence
  Description of Artificial Sequence: Synthetic oligonucleotide
  Target: ATXN1; (-) strand; PAM type: YTN; PAM sequence: TTG
gcttgccagacatatacctt

SEQ ID NO: 208240 - DNA, 20 bp, Artificial Sequence
  Description of Artificial Sequence: Synthetic oligonucleotide
  Target: ATXN1; (-) strand; PAM type: YTN; PAM sequence: TTT
ggcttgccagacatatacct

SEQ ID NO: 208241 - DNA, 20 bp, Artificial Sequence
  Description of Artificial Sequence: Synthetic oligonucleotide
  Target: ATXN1; (-) strand; PAM type: YTN; PAM sequence: CTT
tggcttgccagacatatacc

SEQ ID NO: 208242 - DNA, 20 bp, Artificial Sequence
  Description of Artificial Sequence: Synthetic oligonucleotide
  Target: ATXN1; (-) strand; PAM type: YTN; PAM sequence: CTG
gctttggcttgccagacata

SEQ ID NO: 208243 - DNA, 20 bp, Artificial Sequence
  Description of Artificial Sequence: Synthetic oligonucleotide
  Target: ATXN1; (-) strand; PAM type: YTN; PAM sequence: TTC
tggctttggcttgccagaca

SEQ ID NO: 208244 - DNA, 20 bp, Artificial Sequence
  Description of Artificial Sequence: Synthetic oligonucleotide
  Target: ATXN1; (-) strand; PAM type: YTN; PAM sequence: CTA
gttctggctttggcttgcca

SEQ ID NO: 208245 - DNA, 20 bp, Artificial Sequence
  Description of Artificial Sequence: Synthetic oligonucleotide
  Target: ATXN1; (-) strand; PAM type: YTN; PAM sequence: TTC
tagttctggctttggcttgc

SEQ ID NO: 208246 - DNA, 20 bp, Artificial Sequence
  Description of Artificial Sequence: Synthetic oligonucleotide
  Target: ATXN1; (-) strand; PAM type: YTN; PAM sequence: TTT
ctagttctggctttggcttg

SEQ ID NO: 208247 - DNA, 20 bp, Artificial Sequence
  Description of Artificial Sequence: Synthetic oligonucleotide
  Target: ATXN1; (-) strand; PAM type: YTN; PAM sequence: TTG
agtttctagttctggctttg

SEQ ID NO: 208248 - DNA, 20 bp, Artificial Sequence
  Description of Artificial Sequence: Synthetic oligonucleotide
  Target: ATXN1; (-) strand; PAM type: YTN; PAM sequence: CTT
gagtttctagttctggcttt

SEQ ID NO: 208249 - DNA, 20 bp, Artificial Sequence
  Description of Artificial Sequence: Synthetic oligonucleotide
  Target: ATXN1; (-) strand; PAM type: YTN; PAM sequence: TTA
cttgagtttctagttctggc

SEQ ID NO: 208250 - DNA, 20 bp, Artificial Sequence
  Description of Artificial Sequence: Synthetic oligonucleotide
  Target: ATXN1; (-) strand; PAM type: YTN; PAM sequence: CTA
agaatcaaaggaattacttg

SEQ ID NO: 208251 - DNA, 20 bp, Artificial Sequence
  Description of Artificial Sequence: Synthetic oligonucleotide
  Target: ATXN1; (-) strand; PAM type: YTN; PAM sequence: TTC
taagaatcaaaggaattact

SEQ ID NO: 208252 - DNA, 20 bp, Artificial Sequence
  Description of Artificial Sequence: Synthetic oligonucleotide
  Target: ATXN1; (-) strand; PAM type: YTN; PAM sequence: TTT
ctaagaatcaaaggaattac

SEQ ID NO: 208253 - DNA, 20 bp, Artificial Sequence
  Description of Artificial Sequence: Synthetic oligonucleotide
  Target: ATXN1; (-) strand; PAM type: YTN; PAM sequence: TTT
tctaagaatcaaaggaatta

SEQ ID NO: 208254 - DNA, 20 bp, Artificial Sequence
  Description of Artificial Sequence: Synthetic oligonucleotide
  Target: ATXN1; (-) strand; PAM type: YTN; PAM sequence: CTG
cgtcattttctaagaatcaa

SEQ ID NO: 208255 - DNA, 20 bp, Artificial Sequence
  Description of Artificial Sequence: Synthetic oligonucleotide
  Target: ATXN1; (-) strand; PAM type: YTN; PAM sequence: CTA
acaactgcgtcattttctaa

SEQ ID NO: 208256 - DNA, 20 bp, Artificial Sequence
  Description of Artificial Sequence: Synthetic oligonucleotide
  Target: ATXN1; (-) strand; PAM type: YTN; PAM sequence: CTC
taacaactgcgtcattttct

SEQ ID NO: 208257 - DNA, 20 bp, Artificial Sequence
  Description of Artificial Sequence: Synthetic oligonucleotide
  Target: ATXN1; (-) strand; PAM type: YTN; PAM sequence: CTG
cagcaggcaaccagctctaa

SEQ ID NO: 208258 - DNA, 20 bp, Artificial Sequence
  Description of Artificial Sequence: Synthetic oligonucleotide
  Target: ATXN1; (-) strand; PAM type: YTN; PAM sequence: TTG
agagtacacaggaagacaac

SEQ ID NO: 208259 - DNA, 20 bp, Artificial Sequence
  Description of Artificial Sequence: Synthetic oligonucleotide
  Target: ATXN1; (-) strand; PAM type: YTN; PAM sequence: TTG
tattgagagtacacaggaag

SEQ ID NO: 208260 - DNA, 20 bp, Artificial Sequence
  Description of Artificial Sequence: Synthetic oligonucleotide
  Target: ATXN1; (-) strand; PAM type: YTN; PAM sequence: TTC
caaattgtattgagagtaca

SEQ ID NO: 208261 - DNA, 20 bp, Artificial Sequence
  Description of Artificial Sequence: Synthetic oligonucleotide
  Target: ATXN1; (-) strand; PAM type: YTN; PAM sequence: CTT
ccaaattgtattgagagtac

SEQ ID NO: 208262 - DNA, 20 bp, Artificial Sequence
  Description of Artificial Sequence: Synthetic oligonucleotide
  Target: ATXN1; (-) strand; PAM type: YTN; PAM sequence: CTA
gataacatgccttccaaatt

SEQ ID NO: 208263 - DNA, 20 bp, Artificial Sequence
  Description of Artificial Sequence: Synthetic oligonucleotide
  Target: ATXN1; (-) strand; PAM type: YTN; PAM sequence: CTA
gcctagataacatgccttcc

SEQ ID NO: 208264 - DNA, 20 bp, Artificial Sequence
  Description of Artificial Sequence: Synthetic oligonucleotide
  Target: ATXN1; (-) strand; PAM type: YTN; PAM sequence: CTC
ccctagcctagataacatgc

SEQ ID NO: 208265 - DNA, 20 bp, Artificial Sequence
  Description of Artificial Sequence: Synthetic oligonucleotide
  Target: ATXN1; (-) strand; PAM type: YTN; PAM sequence: TTA
cctcccctagcctagataac

SEQ ID NO: 208266 - DNA, 20 bp, Artificial Sequence
  Description of Artificial Sequence: Synthetic oligonucleotide
  Target: ATXN1; (-) strand; PAM type: YTN; PAM sequence: TTA
ttacctcccctagcctagat

SEQ ID NO: 208267 - DNA, 20 bp, Artificial Sequence
  Description of Artificial Sequence: Synthetic oligonucleotide
  Target: ATXN1; (-) strand; PAM type: YTN; PAM sequence: TTG
ttattacctcccctagccta

SEQ ID NO: 208268 - DNA, 20 bp, Artificial Sequence
  Description of Artificial Sequence: Synthetic oligonucleotide
  Target: ATXN1; (-) strand; PAM type: YTN; PAM sequence: TTT
gttattacctcccctagcct

SEQ ID NO: 208269 - DNA, 20 bp, Artificial Sequence
  Description of Artificial Sequence: Synthetic oligonucleotide
  Target: ATXN1; (-) strand; PAM type: YTN; PAM sequence: CTT
tgttattacctcccctagcc

SEQ ID NO: 208270 - DNA, 20 bp, Artificial Sequence
  Description of Artificial Sequence: Synthetic oligonucleotide
  Target: ATXN1; (-) strand; PAM type: YTN; PAM sequence: CTC
ctttgttattacctccccta

SEQ ID NO: 208271 - DNA, 20 bp, Artificial Sequence
  Description of Artificial Sequence: Synthetic oligonucleotide
  Target: ATXN1; (-) strand; PAM type: YTN; PAM sequence: TTA
tgcctcctttgttattacct

SEQ ID NO: 208272 - DNA, 20 bp, Artificial Sequence
  Description of Artificial Sequence: Synthetic oligonucleotide
  Target: ATXN1; (-) strand; PAM type: YTN; PAM sequence: TTG
ttatgcctcctttgttatta

SEQ ID NO: 208273 - DNA, 20 bp, Artificial Sequence
  Description of Artificial Sequence: Synthetic oligonucleotide
  Target: ATXN1; (-) strand; PAM type: YTN; PAM sequence: CTA
attgttatgcctcctttgtt

SEQ ID NO: 208274 - DNA, 20 bp, Artificial Sequence
  Description of Artificial Sequence: Synthetic oligonucleotide
  Target: ATXN1; (-) strand; PAM type: YTN; PAM sequence: TTC
aggagcaagcctaattgtta

SEQ ID NO: 208275 - DNA, 20 bp, Artificial Sequence
  Description of Artificial Sequence: Synthetic oligonucleotide
  Target: ATXN1; (-) strand; PAM type: YTN; PAM sequence: TTT
caggagcaagcctaattgtt

SEQ ID NO: 208276 - DNA, 20 bp, Artificial Sequence
  Description of Artificial Sequence: Synthetic oligonucleotide
  Target: ATXN1; (-) strand; PAM type: YTN; PAM sequence: CTA
cccgtataatttcaggagca

SEQ ID NO: 208277 - DNA, 20 bp, Artificial Sequence
  Description of Artificial Sequence: Synthetic oligonucleotide
  Target: ATXN1; (-) strand; PAM type: YTN; PAM sequence: TTG
actacccgtataatttcagg

SEQ ID NO: 208278 - DNA, 20 bp, Artificial Sequence
  Description of Artificial Sequence: Synthetic oligonucleotide
  Target: ATXN1; (-) strand; PAM type: YTN; PAM sequence: TTT
gactacccgtataatttcag

SEQ ID NO: 208279 - DNA, 20 bp, Artificial Sequence
  Description of Artificial Sequence: Synthetic oligonucleotide
  Target: ATXN1; (-) strand; PAM type: YTN; PAM sequence: TTT
tgactacccgtataatttca

SEQ ID NO: 208280 - DNA, 20 bp, Artificial Sequence
  Description of Artificial Sequence: Synthetic oligonucleotide
  Target: ATXN1; (-) strand; PAM type: YTN; PAM sequence: TTT
ttgactacccgtataatttc

SEQ ID NO: 208281 - DNA, 20 bp, Artificial Sequence
  Description of Artificial Sequence: Synthetic oligonucleotide
  Target: ATXN1; (-) strand; PAM type: YTN; PAM sequence: TTT
tttgactacccgtataattt

SEQ ID NO: 208282 - DNA, 20 bp, Artificial Sequence
  Description of Artificial Sequence: Synthetic oligonucleotide
  Target: ATXN1; (-) strand; PAM type: YTN; PAM sequence: TTT
ttttgactacccgtataatt

SEQ ID NO: 208283 - DNA, 20 bp, Artificial Sequence
  Description of Artificial Sequence: Synthetic oligonucleotide
  Target: ATXN1; (-) strand; PAM type: YTN; PAM sequence: TTC
gtttttttgactacccgtat

SEQ ID NO: 208284 - DNA, 20 bp, Artificial Sequence
  Description of Artificial Sequence: Synthetic oligonucleotide
  Target: ATXN1; (-) strand; PAM type: YTN; PAM sequence: CTT
cgtttttttgactacccgta

SEQ ID NO: 208285 - DNA, 20 bp, Artificial Sequence
  Description of Artificial Sequence: Synthetic oligonucleotide
  Target: ATXN1; (-) strand; PAM type: YTN; PAM sequence: TTA
gtaggtgatggtggggtcct

SEQ ID NO: 208286 - DNA, 20 bp, Artificial Sequence
  Description of Artificial Sequence: Synthetic oligonucleotide
  Target: ATXN1; (-) strand; PAM type: YTN; PAM sequence: CTT
agtaggtgatggtggggtcc

SEQ ID NO: 208287 - DNA, 20 bp, Artificial Sequence
  Description of Artificial Sequence: Synthetic oligonucleotide
  Target: ATXN1; (-) strand; PAM type: YTN; PAM sequence: CTA
ggtacccatcacatagctta

SEQ ID NO: 208288 - DNA, 20 bp, Artificial Sequence
  Description of Artificial Sequence: Synthetic oligonucleotide
  Target: ATXN1; (-) strand; PAM type: YTN; PAM sequence: TTA
ccagctaggtacccatcaca

SEQ ID NO: 208289 - DNA, 20 bp, Artificial Sequence
  Description of Artificial Sequence: Synthetic oligonucleotide
  Target: ATXN1; (-) strand; PAM type: YTN; PAM sequence: TTT
accagctaggtacccatcac

SEQ ID NO: 208290 - DNA, 20 bp, Artificial Sequence
  Description of Artificial Sequence: Synthetic oligonucleotide
  Target: ATXN1; (-) strand; PAM type: YTN; PAM sequence: TTT
taccagctaggtacccatca

SEQ ID NO: 208291 - DNA, 20 bp, Artificial Sequence
  Description of Artificial Sequence: Synthetic oligonucleotide
  Target: ATXN1; (-) strand; PAM type: YTN; PAM sequence: CTT
ttaccagctaggtacccatc

SEQ ID NO: 208292 - DNA, 20 bp, Artificial Sequence
  Description of Artificial Sequence: Synthetic oligonucleotide
  Target: ATXN1; (-) strand; PAM type: YTN; PAM sequence: TTG
gaaacaccttttaccagcta

SEQ ID NO: 208293 - DNA, 20 bp, Artificial Sequence
  Description of Artificial Sequence: Synthetic oligonucleotide
  Target: ATXN1; (-) strand; PAM type: YTN; PAM sequence: CTT
ggaaacaccttttaccagct

SEQ ID NO: 208294 - DNA, 20 bp, Artificial Sequence
  Description of Artificial Sequence: Synthetic oligonucleotide
  Target: ATXN1; (-) strand; PAM type: YTN; PAM sequence: TTA
gatccggtcttggaaacacc

SEQ ID NO: 208295 - DNA, 20 bp, Artificial Sequence
  Description of Artificial Sequence: Synthetic oligonucleotide
  Target: ATXN1; (-) strand; PAM type: YTN; PAM sequence: CTT
agatccggtcttggaaacac

SEQ ID NO: 208296 - DNA, 20 bp, Artificial Sequence
  Description of Artificial Sequence: Synthetic oligonucleotide
  Target: ATXN1; (-) strand; PAM type: YTN; PAM sequence: CTA
tgaaataacttagatccggt

SEQ ID NO: 208297 - DNA, 20 bp, Artificial Sequence
  Description of Artificial Sequence: Synthetic oligonucleotide
  Target: ATXN1; (-) strand; PAM type: YTN; PAM sequence: TTA
cctatgaaataacttagatc

SEQ ID NO: 208298 - DNA, 20 bp, Artificial Sequence
  Description of Artificial Sequence: Synthetic oligonucleotide
  Target: ATXN1; (-) strand; PAM type: YTN; PAM sequence: CTA
aagttacctatgaaataact

SEQ ID NO: 208299 - DNA, 20 bp, Artificial Sequence
  Description of Artificial Sequence: Synthetic oligonucleotide
  Target: ATXN1; (-) strand; PAM type: YTN; PAM sequence: TTC
taaagttacctatgaaataa

SEQ ID NO: 208300 - DNA, 20 bp, Artificial Sequence
  Description of Artificial Sequence: Synthetic oligonucleotide
  Target: ATXN1; (-) strand; PAM type: YTN; PAM sequence: TTT
ctaaagttacctatgaaata

SEQ ID NO: 208301 - DNA, 20 bp, Artificial Sequence
  Description of Artificial Sequence: Synthetic oligonucleotide
  Target: ATXN1; (-) strand; PAM type: YTN; PAM sequence: CTT
tctaaagttacctatgaaat

SEQ ID NO: 208302 - DNA, 20 bp, Artificial Sequence
  Description of Artificial Sequence: Synthetic oligonucleotide
  Target: ATXN1; (-) strand; PAM type: YTN; PAM sequence: TTG
ggacgtgctttctaaagtta

SEQ ID NO: 208303 - DNA, 20 bp, Artificial Sequence
  Description of Artificial Sequence: Synthetic oligonucleotide
  Target: ATXN1; (-) strand; PAM type: YTN; PAM sequence: CTG
ccacgttgggacgtgctttc

SEQ ID NO: 208304 - DNA, 20 bp, Artificial Sequence
  Description of Artificial Sequence: Synthetic oligonucleotide
  Target: ATXN1; (-) strand; PAM type: YTN; PAM sequence: TTA
acactgccacgttgggacgt

SEQ ID NO: 208305 - DNA, 20 bp, Artificial Sequence
  Description of Artificial Sequence: Synthetic oligonucleotide
  Target: ATXN1; (-) strand; PAM type: YTN; PAM sequence: TTT
aacactgccacgttgggacg

SEQ ID NO: 208306 - DNA, 20 bp, Artificial Sequence
  Description of Artificial Sequence: Synthetic oligonucleotide
  Target: ATXN1; (-) strand; PAM type: YTN; PAM sequence: TTA
cacatgaatttaacactgcc

SEQ ID NO: 208307 - DNA, 20 bp, Artificial Sequence
  Description of Artificial Sequence: Synthetic oligonucleotide
  Target: ATXN1; (-) strand; PAM type: YTN; PAM sequence: TTG
aaattacacatgaatttaac

SEQ ID NO: 208308 - DNA, 20 bp, Artificial Sequence
  Description of Artificial Sequence: Synthetic oligonucleotide
  Target: ATXN1; (-) strand; PAM type: YTN; PAM sequence: TTT
gaaattacacatgaatttaa

SEQ ID NO: 208309 - DNA, 20 bp, Artificial Sequence
  Description of Artificial Sequence: Synthetic oligonucleotide
  Target: ATXN1; (-) strand; PAM type: YTN; PAM sequence: TTT
tgaaattacacatgaattta

SEQ ID NO: 208310 - DNA, 20 bp, Artificial Sequence
  Description of Artificial Sequence: Synthetic oligonucleotide
  Target: ATXN1; (-) strand; PAM type: YTN; PAM sequence: CTA
ttttgaaattacacatgaat

SEQ ID NO: 208311 - DNA, 20 bp, Artificial Sequence
  Description of Artificial Sequence: Synthetic oligonucleotide
  Target: ATXN1; (-) strand; PAM type: YTN; PAM sequence: CTG
ataccctattttgaaattac

SEQ ID NO: 208312 - DNA, 20 bp, Artificial Sequence
  Description of Artificial Sequence: Synthetic oligonucleotide
  Target: ATXN1; (-) strand; PAM type: YTN; PAM sequence: CTC
atacactgataccctatttt

SEQ ID NO: 208313 - DNA, 20 bp, Artificial Sequence
  Description of Artificial Sequence: Synthetic oligonucleotide
  Target: ATXN1; (-) strand; PAM type: YTN; PAM sequence: CTA
catgcctcatacactgatac

SEQ ID NO: 208314 - DNA, 20 bp, Artificial Sequence
  Description of Artificial Sequence: Synthetic oligonucleotide
  Target: ATXN1; (-) strand; PAM type: YTN; PAM sequence: CTA
cctacatgcctcatacactg

SEQ ID NO: 208315 - DNA, 20 bp, Artificial Sequence
  Description of Artificial Sequence: Synthetic oligonucleotide
  Target: ATXN1; (-) strand; PAM type: YTN; PAM sequence: TTA
gactacctacatgcctcata

SEQ ID NO: 208316 - DNA, 20 bp, Artificial Sequence
  Description of Artificial Sequence: Synthetic oligonucleotide
  Target: ATXN1; (-) strand; PAM type: YTN; PAM sequence: CTT
agactacctacatgcctcat

SEQ ID NO: 208317 - DNA, 20 bp, Artificial Sequence
  Description of Artificial Sequence: Synthetic oligonucleotide
  Target: ATXN1; (-) strand; PAM type: YTN; PAM sequence: CTG
tgtcacataacttagactac

SEQ ID NO: 208318 - DNA, 20 bp, Artificial Sequence
  Description of Artificial Sequence: Synthetic oligonucleotide
  Target: ATXN1; (-) strand; PAM type: YTN; PAM sequence: CTC
tgtgtcacataacttagact

SEQ ID NO: 208319 - DNA, 20 bp, Artificial Sequence
  Description of Artificial Sequence: Synthetic oligonucleotide
  Target: ATXN1; (-) strand; PAM type: YTN; PAM sequence: CTA
aatgctctgtgtcacataac

SEQ ID NO: 208320 - DNA, 20 bp, Artificial Sequence
  Description of Artificial Sequence: Synthetic oligonucleotide
  Target: ATXN1; (-) strand; PAM type: YTN; PAM sequence: TTG
atgtaggctaaatgctctgt

SEQ ID NO: 208321 - DNA, 20 bp, Artificial Sequence
  Description of Artificial Sequence: Synthetic oligonucleotide
  Target: ATXN1; (-) strand; PAM type: YTN; PAM sequence: TTT
gatgtaggctaaatgctctg

SEQ ID NO: 208322 - DNA, 20 bp, Artificial Sequence
  Description of Artificial Sequence: Synthetic oligonucleotide
  Target: ATXN1; (-) strand; PAM type: YTN; PAM sequence: TTT
tgatgtaggctaaatgctct

SEQ ID NO: 208323 - DNA, 20 bp, Artificial Sequence
  Description of Artificial Sequence: Synthetic oligonucleotide
  Target: ATXN1; (-) strand; PAM type: YTN; PAM sequence: CTT
ttgatgtaggctaaatgctc

SEQ ID NO: 208324 - DNA, 20 bp, Artificial Sequence
  Description of Artificial Sequence: Synthetic oligonucleotide
  Target: ATXN1; (-) strand; PAM type: YTN; PAM sequence: TTA
gcttttgatgtaggctaaat

SEQ ID NO: 208325 - DNA, 20 bp, Artificial Sequence
  Description of Artificial Sequence: Synthetic oligonucleotide
  Target: ATXN1; (-) strand; PAM type: YTN; PAM sequence: TTT
agcttttgatgtaggctaaa

SEQ ID NO: 208326 - DNA, 20 bp, Artificial Sequence
  Description of Artificial Sequence: Synthetic oligonucleotide
  Target: ATXN1; (-) strand; PAM type: YTN; PAM sequence: TTT
tagcttttgatgtaggctaa

SEQ ID NO: 208327 - DNA, 20 bp, Artificial Sequence
  Description of Artificial Sequence: Synthetic oligonucleotide
  Target: ATXN1; (-) strand; PAM type: YTN; PAM sequence: TTC
agttttagcttttgatgtag

SEQ ID NO: 208328 - DNA, 20 bp, Artificial Sequence
  Description of Artificial Sequence: Synthetic oligonucleotide
  Target: ATXN1; (-) strand; PAM type: YTN; PAM sequence: TTT
cagttttagcttttgatgta

SEQ ID NO: 208329 - DNA, 20 bp, Artificial Sequence
  Description of Artificial Sequence: Synthetic oligonucleotide
  Target: ATXN1; (-) strand; PAM type: YTN; PAM sequence: TTT
tcagttttagcttttgatgt

SEQ ID NO: 208330 - DNA, 20 bp, Artificial Sequence
  Description of Artificial Sequence: Synthetic oligonucleotide
  Target: ATXN1; (-) strand; PAM type: YTN; PAM sequence: TTT
ttcagttttagcttttgatg

SEQ ID NO: 208331 - DNA, 20 bp, Artificial Sequence
  Description of Artificial Sequence: Synthetic oligonucleotide
  Target: ATXN1; (-) strand; PAM type: YTN; PAM sequence: TTC
atttttcagttttagctttt

SEQ ID NO: 208332 - DNA, 20 bp, Artificial Sequence
  Description of Artificial Sequence: Synthetic oligonucleotide
  Target: ATXN1; (-) strand; PAM type: YTN; PAM sequence: TTT
catttttcagttttagcttt

SEQ ID NO: 208333 - DNA, 20 bp, Artificial Sequence
  Description of Artificial Sequence: Synthetic oligonucleotide
  Target: ATXN1; (-) strand; PAM type: YTN; PAM sequence: TTA
aataagaatttcatttttca

SEQ ID NO: 208334 - DNA, 20 bp, Artificial Sequence
  Description of Artificial Sequence: Synthetic oligonucleotide
  Target: ATXN1; (-) strand; PAM type: YTN; PAM sequence: CTT
aaataagaatttcatttttc

SEQ ID NO: 208335 - DNA, 20 bp, Artificial Sequence
  Description of Artificial Sequence: Synthetic oligonucleotide
  Target: ATXN1; (-) strand; PAM type: YTN; PAM sequence: TTA
gagtgaagatagcaacatac

SEQ ID NO: 208336 - DNA, 20 bp, Artificial Sequence
  Description of Artificial Sequence: Synthetic oligonucleotide
  Target: ATXN1; (-) strand; PAM type: YTN; PAM sequence: CTC
attagagtgaagatagcaac

SEQ ID NO: 208337 - DNA, 20 bp, Artificial Sequence
  Description of Artificial Sequence: Synthetic oligonucleotide
  Target: ATXN1; (-) strand; PAM type: YTN; PAM sequence: TTC
cacgtatctcattagagtga

SEQ ID NO: 208338 - DNA, 20 bp, Artificial Sequence
  Description of Artificial Sequence: Synthetic oligonucleotide
  Target: ATXN1; (-) strand; PAM type: YTN; PAM sequence: TTG
ttccacgtatctcattagag

SEQ ID NO: 208339 - DNA, 20 bp, Artificial Sequence
  Description of Artificial Sequence: Synthetic oligonucleotide
  Target: ATXN1; (-) strand; PAM type: YTN; PAM sequence: TTT
gttccacgtatctcattaga

SEQ ID NO: 208340 - DNA, 20 bp, Artificial Sequence
  Description of Artificial Sequence: Synthetic oligonucleotide
  Target: ATXN1; (-) strand; PAM type: YTN; PAM sequence: CTA
gccccagtaatttgttccac

SEQ ID NO: 208341 - DNA, 20 bp, Artificial Sequence
  Description of Artificial Sequence: Synthetic oligonucleotide
  Target: ATXN1; (-) strand; PAM type: YTN; PAM sequence: TTC
tagccccagtaatttgttcc

SEQ ID NO: 208342 - DNA, 20 bp, Artificial Sequence
  Description of Artificial Sequence: Synthetic oligonucleotide
  Target: ATXN1; (-) strand; PAM type: YTN; PAM sequence: TTA
taatacattctagccccagt

SEQ ID NO: 208343 - DNA, 20 bp, Artificial Sequence
  Description of Artificial Sequence: Synthetic oligonucleotide
  Target: ATXN1; (-) strand; PAM type: YTN; PAM sequence: TTG
ttataatacattctagcccc

SEQ ID NO: 208344 - DNA, 20 bp, Artificial Sequence
  Description of Artificial Sequence: Synthetic oligonucleotide
  Target: ATXN1; (-) strand; PAM type: YTN; PAM sequence: CTA
ttgttataatacattctagc

SEQ ID NO: 208345 - DNA, 20 bp, Artificial Sequence
  Description of Artificial Sequence: Synthetic oligonucleotide
  Target: ATXN1; (-) strand; PAM type: YTN; PAM sequence: TTA
ctattgttataatacattct

SEQ ID NO: 208346 - DNA, 20 bp, Artificial Sequence
  Description of Artificial Sequence: Synthetic oligonucleotide
  Target: ATXN1; (-) strand; PAM type: YTN; PAM sequence: CTT
actattgttataatacattc

SEQ ID NO: 208347 - DNA, 20 bp, Artificial Sequence
  Description of Artificial Sequence: Synthetic oligonucleotide
  Target: ATXN1; (-) strand; PAM type: YTN; PAM sequence: TTC
cttactattgttataataca

SEQ ID NO: 208348 - DNA, 20 bp, Artificial Sequence
  Description of Artificial Sequence: Synthetic oligonucleotide
  Target: ATXN1; (-) strand; PAM type: YTN; PAM sequence: CTT
ccttactattgttataatac

SEQ ID NO: 208349 - DNA, 20 bp, Artificial Sequence
  Description of Artificial Sequence: Synthetic oligonucleotide
  Target: ATXN1; (-) strand; PAM type: YTN; PAM sequence: TTC
ttccttactattgttataat

SEQ ID NO: 208350 - DNA, 20 bp, Artificial Sequence
  Description of Artificial Sequence: Synthetic oligonucleotide
  Target: ATXN1; (-) strand; PAM type: YTN; PAM sequence: CTT
cttccttactattgttataa

SEQ ID NO: 208351 - DNA, 20 bp, Artificial Sequence
  Description of Artificial Sequence: Synthetic oligonucleotide
  Target: ATXN1; (-) strand; PAM type: YTN; PAM sequence: TTA
ccaagtatccagcaggaacc

SEQ ID NO: 208352 - DNA, 20 bp, Artificial Sequence
  Description of Artificial Sequence: Synthetic oligonucleotide
  Target: ATXN1; (-) strand; PAM type: YTN; PAM sequence: CTT
accaagtatccagcaggaac

SEQ ID NO: 208353 - DNA, 20 bp, Artificial Sequence
  Description of Artificial Sequence: Synthetic oligonucleotide
  Target: ATXN1; (-) strand; PAM type: YTN; PAM sequence: CTC
ttaccaagtatccagcagga

SEQ ID NO: 208354 - DNA, 20 bp, Artificial Sequence
  Description of Artificial Sequence: Synthetic oligonucleotide
  Target: ATXN1; (-) strand; PAM type: YTN; PAM sequence: CTG
gaccccacccacctcttacc

SEQ ID NO: 208355 - DNA, 20 bp, Artificial Sequence
  Description of Artificial Sequence: Synthetic oligonucleotide
  Target: ATXN1; (-) strand; PAM type: YTN; PAM sequence: CTG
gaaatcctggaccccaccca

SEQ ID NO: 208356 - DNA, 20 bp, Artificial Sequence
  Description of Artificial Sequence: Synthetic oligonucleotide
  Target: ATXN1; (-) strand; PAM type: YTN; PAM sequence: CTC
aaagtcccctggaaatcctg

SEQ ID NO: 208357 - DNA, 20 bp, Artificial Sequence
  Description of Artificial Sequence: Synthetic oligonucleotide
  Target: ATXN1; (-) strand; PAM type: YTN; PAM sequence: TTG
gaagaataaactcaaagtcc

SEQ ID NO: 208358 - DNA, 20 bp, Artificial Sequence
  Description of Artificial Sequence: Synthetic oligonucleotide
  Target: ATXN1; (-) strand; PAM type: YTN; PAM sequence: TTA
gcagtgttggaagaataaac

SEQ ID NO: 208359 - DNA, 20 bp, Artificial Sequence
  Description of Artificial Sequence: Synthetic oligonucleotide
  Target: ATXN1; (-) strand; PAM type: YTN; PAM sequence: TTT
agcagtgttggaagaataaa

SEQ ID NO: 208360 - DNA, 20 bp, Artificial Sequence
  Description of Artificial Sequence: Synthetic oligonucleotide
  Target: ATXN1; (-) strand; PAM type: YTN; PAM sequence: TTT
tagcagtgttggaagaataa

SEQ ID NO: 208361 - DNA, 20 bp, Artificial Sequence
  Description of Artificial Sequence: Synthetic oligonucleotide
  Target: ATXN1; (-) strand; PAM type: YTN; PAM sequence: TTA
gaaagtcagaatagaaaata

SEQ ID NO: 208362 - DNA, 20 bp, Artificial Sequence
  Description of Artificial Sequence: Synthetic oligonucleotide
  Target: ATXN1; (-) strand; PAM type: YTN; PAM sequence: CTG
ttagaaagtcagaatagaaa

SEQ ID NO: 208363 - DNA, 20 bp, Artificial Sequence
  Description of Artificial Sequence: Synthetic oligonucleotide
  Target: ATXN1; (-) strand; PAM type: YTN; PAM sequence: TTG
catcctgttagaaagtcaga

SEQ ID NO: 208364 - DNA, 20 bp, Artificial Sequence
  Description of Artificial Sequence: Synthetic oligonucleotide
  Target: ATXN1; (-) strand; PAM type: YTN; PAM sequence: CTC
agattgcatcctgttagaaa

SEQ ID NO: 208365 - DNA, 20 bp, Artificial Sequence
  Description of Artificial Sequence: Synthetic oligonucleotide
  Target: ATXN1; (-) strand; PAM type: YTN; PAM sequence: CTC
tcagattgcatcctgttaga

SEQ ID NO: 208366 - DNA, 20 bp, Artificial Sequence
  Description of Artificial Sequence: Synthetic oligonucleotide
  Target: ATXN1; (-) strand; PAM type: YTN; PAM sequence: CTG
gctctcagattgcatcctgt

SEQ ID NO: 208367 - DNA, 20 bp, Artificial Sequence
  Description of Artificial Sequence: Synthetic oligonucleotide
  Target: ATXN1; (-) strand; PAM type: YTN; PAM sequence: CTG
gctggctctcagattgcatc

SEQ ID NO: 208368 - DNA, 20 bp, Artificial Sequence
  Description of Artificial Sequence: Synthetic oligonucleotide
  Target: ATXN1; (-) strand; PAM type: YTN; PAM sequence: TTA
agtggctggctggctctcag

SEQ ID NO: 208369 - DNA, 20 bp, Artificial Sequence
  Description of Artificial Sequence: Synthetic oligonucleotide
  Target: ATXN1; (-) strand; PAM type: YTN; PAM sequence: TTT
aagtggctggctggctctca

SEQ ID NO: 208370 - DNA, 20 bp, Artificial Sequence
  Description of Artificial Sequence: Synthetic oligonucleotide
  Target: ATXN1; (-) strand; PAM type: YTN; PAM sequence: TTT
taagtggctggctggctctc

SEQ ID NO: 208371 - DNA, 20 bp, Artificial Sequence
  Description of Artificial Sequence: Synthetic oligonucleotide
  Target: ATXN1; (-) strand; PAM type: YTN; PAM sequence: CTG
aaataaatagattttaagtg

SEQ ID NO: 208372 - DNA, 20 bp, Artificial Sequence
  Description of Artificial Sequence: Synthetic oligonucleotide
  Target: ATXN1; (-) strand; PAM type: YTN; PAM sequence: CTG
cgcacagctgaaataaatag

SEQ ID NO: 208373 - DNA, 20 bp, Artificial Sequence
  Description of Artificial Sequence: Synthetic oligonucleotide
  Target: ATXN1; (-) strand; PAM type: YTN; PAM sequence: TTA
caggcgtgagccactgcgca

SEQ ID NO: 208374 - DNA, 20 bp, Artificial Sequence
  Description of Artificial Sequence: Synthetic oligonucleotide
  Target: ATXN1; (-) strand; PAM type: YTN; PAM sequence: CTG
ggattacaggcgtgagccac

SEQ ID NO: 208375 - DNA, 20 bp, Artificial Sequence
  Description of Artificial Sequence: Synthetic oligonucleotide
  Target: ATXN1; (-) strand; PAM type: YTN; PAM sequence: CTA
agtgctgggattacaggcgt

SEQ ID NO: 208376 - DNA, 20 bp, Artificial Sequence
  Description of Artificial Sequence: Synthetic oligonucleotide
  Target: ATXN1; (-) strand; PAM type: YTN; PAM sequence: CTC
actaagtgctgggattacag

SEQ ID NO: 208377 - DNA, 20 bp, Artificial Sequence
  Description of Artificial Sequence: Synthetic oligonucleotide
  Target: ATXN1; (-) strand; PAM type: YTN; PAM sequence: CTC
ggcctcactaagtgctggga

SEQ ID NO: 208378 - DNA, 20 bp, Artificial Sequence
  Description of Artificial Sequence: Synthetic oligonucleotide
  Target: ATXN1; (-) strand; PAM type: YTN; PAM sequence: CTC
atggtccgcccgcctcggcc

SEQ ID NO: 208379 - DNA, 20 bp, Artificial Sequence
  Description of Artificial Sequence: Synthetic oligonucleotide
  Target: ATXN1; (-) strand; PAM type: YTN; PAM sequence: CTG
acctcatggtccgcccgcct

SEQ ID NO: 208380 - DNA, 20 bp, Artificial Sequence
  Description of Artificial Sequence: Synthetic oligonucleotide
  Target: ATXN1; (-) strand; PAM type: YTN; PAM sequence: CTC
ctgacctcatggtccgcccg

SEQ ID NO: 208381 - DNA, 20 bp, Artificial Sequence
  Description of Artificial Sequence: Synthetic oligonucleotide
  Target: ATXN1; (-) strand; PAM type: YTN; PAM sequence: CTC
gatctcctgacctcatggtc

SEQ ID NO: 208382 - DNA, 20 bp, Artificial Sequence
  Description of Artificial Sequence: Synthetic oligonucleotide
  Target: ATXN1; (-) strand; PAM type: YTN; PAM sequence: TTA
gccaggatggtctcgatctc

SEQ ID NO: 208383 - DNA, 20 bp, Artificial Sequence
  Description of Artificial Sequence: Synthetic oligonucleotide
  Target: ATXN1; (-) strand; PAM type: YTN; PAM sequence: TTC
accgtgttagccaggatggt

SEQ ID NO: 208384 - DNA, 20 bp, Artificial Sequence
  Description of Artificial Sequence: Synthetic oligonucleotide
  Target: ATXN1; (-) strand; PAM type: YTN; PAM sequence: TTT
caccgtgttagccaggatgg

SEQ ID NO: 208385 - DNA, 20 bp, Artificial Sequence
  Description of Artificial Sequence: Synthetic oligonucleotide
  Target: ATXN1; (-) strand; PAM type: YTN; PAM sequence: TTA
gtagagatggggtttcaccg

SEQ ID NO: 208386 - DNA, 20 bp, Artificial Sequence
  Description of Artificial Sequence: Synthetic oligonucleotide
  Target: ATXN1; (-) strand; PAM type: YTN; PAM sequence: TTT
agtagagatggggtttcacc

SEQ ID NO: 208387 - DNA, 20 bp, Artificial Sequence
  Description of Artificial Sequence: Synthetic oligonucleotide
  Target: ATXN1; (-) strand; PAM type: YTN; PAM sequence: TTT
tagtagagatggggtttcac

SEQ ID NO: 208388 - DNA, 20 bp, Artificial Sequence
  Description of Artificial Sequence: Synthetic oligonucleotide
  Target: ATXN1; (-) strand; PAM type: YTN; PAM sequence: TTT
ttagtagagatggggtttca

SEQ ID NO: 208389 - DNA, 20 bp, Artificial Sequence
  Description of Artificial Sequence: Synthetic oligonucleotide
  Target: ATXN1; (-) strand; PAM type: YTN; PAM sequence: TTT
tttagtagagatggggtttc

SEQ ID NO: 208390 - DNA, 20 bp, Artificial Sequence
  Description of Artificial Sequence: Synthetic oligonucleotide
  Target: ATXN1; (-) strand; PAM type: YTN; PAM sequence: TTG
tattttttagtagagatggg

SEQ ID NO: 208391 - DNA, 20 bp, Artificial Sequence
  Description of Artificial Sequence: Synthetic oligonucleotide
  Target: ATXN1; (-) strand; PAM type: YTN; PAM sequence: TTT
gtattttttagtagagatgg

SEQ ID NO: 208392 - DNA, 20 bp, Artificial Sequence
  Description of Artificial Sequence: Synthetic oligonucleotide
  Target: ATXN1; (-) strand; PAM type: YTN; PAM sequence: TTT
tgtattttttagtagagatg

SEQ ID NO: 208393 - DNA, 20 bp, Artificial Sequence
  Description of Artificial Sequence: Synthetic oligonucleotide
  Target: ATXN1; (-) strand; PAM type: YTN; PAM sequence: TTT
ttgtattttttagtagagat

SEQ ID NO: 208394 - DNA, 20 bp, Artificial Sequence
  Description of Artificial Sequence: Synthetic oligonucleotide
  Target: ATXN1; (-) strand; PAM type: YTN; PAM sequence: TTT
tttgtattttttagtagaga

SEQ ID NO: 208395 - DNA, 20 bp, Artificial Sequence
  Description of Artificial Sequence: Synthetic oligonucleotide
  Target: ATXN1; (-) strand; PAM type: YTN; PAM sequence: CTA
atattttttgtattttttag

SEQ ID NO: 208396 - DNA, 20 bp, Artificial Sequence
  Description of Artificial Sequence: Synthetic oligonucleotide
  Target: ATXN1; (-) strand; PAM type: YTN; PAM sequence: CTA
caggtgcccgccaccacacc

SEQ ID NO: 208397 - DNA, 20 bp, Artificial Sequence
  Description of Artificial Sequence: Synthetic oligonucleotide
  Target: ATXN1; (-) strand; PAM type: YTN; PAM sequence: CTG
ggactacaggtgcccgccac

SEQ ID NO: 208398 - DNA, 20 bp, Artificial Sequence
  Description of Artificial Sequence: Synthetic oligonucleotide
  Target: ATXN1; (-) strand; PAM type: YTN; PAM sequence: CTC
ccgagtagctgggactacag

SEQ ID NO: 208399 - DNA, 20 bp, Artificial Sequence
  Description of Artificial Sequence: Synthetic oligonucleotide
  Target: ATXN1; (-) strand; PAM type: YTN; PAM sequence: CTC
agcctcccgagtagctggga

SEQ ID NO: 208400 - DNA, 20 bp, Artificial Sequence
  Description of Artificial Sequence: Synthetic oligonucleotide
  Target: ATXN1; (-) strand; PAM type: YTN; PAM sequence: CTG
cctcagcctcccgagtagct

SEQ ID NO: 208401 - DNA, 20 bp, Artificial Sequence
  Description of Artificial Sequence: Synthetic oligonucleotide
  Target: ATXN1; (-) strand; PAM type: YTN; PAM sequence: TTC
ctgcctcagcctcccgagta

SEQ ID NO: 208402 - DNA, 20 bp, Artificial Sequence
  Description of Artificial Sequence: Synthetic oligonucleotide
  Target: ATXN1; (-) strand; PAM type: YTN; PAM sequence: TTT
cctgcctcagcctcccgagt

SEQ ID NO: 208403 - DNA, 20 bp, Artificial Sequence
  Description of Artificial Sequence: Synthetic oligonucleotide
  Target: ATXN1; (-) strand; PAM type: YTN; PAM sequence: TTT
tcctgcctcagcctcccgag

SEQ ID NO: 208404 - DNA, 20 bp, Artificial Sequence
  Description of Artificial Sequence: Synthetic oligonucleotide
  Target: ATXN1; (-) strand; PAM type: YTN; PAM sequence: TTC
acgccattttcctgcctcag

SEQ ID NO: 208405 - DNA, 20 bp, Artificial Sequence
  Description of Artificial Sequence: Synthetic oligonucleotide
  Target: ATXN1; (-) strand; PAM type: YTN; PAM sequence: CTG
ggttcacgccattttcctgc

SEQ ID NO: 208406 - DNA, 20 bp, Artificial Sequence
  Description of Artificial Sequence: Synthetic oligonucleotide
  Target: ATXN1; (-) strand; PAM type: YTN; PAM sequence: CTC
ctgggttcacgccattttcc

SEQ ID NO: 208407 - DNA, 20 bp, Artificial Sequence
  Description of Artificial Sequence: Synthetic oligonucleotide
  Target: ATXN1; (-) strand; PAM type: YTN; PAM sequence: CTC
cgcctcctgggttcacgcca

SEQ ID NO: 208408 - DNA, 20 bp, Artificial Sequence
  Description of Artificial Sequence: Synthetic oligonucleotide
  Target: ATXN1; (-) strand; PAM type: YTN; PAM sequence: CTG
caagctccgcctcctgggtt

SEQ ID NO: 208409 - DNA, 20 bp, Artificial Sequence
  Description of Artificial Sequence: Synthetic oligonucleotide
  Target: ATXN1; (-) strand; PAM type: YTN; PAM sequence: CTC
actgcaagctccgcctcctg

SEQ ID NO: 208410 - DNA, 20 bp, Artificial Sequence
  Description of Artificial Sequence: Synthetic oligonucleotide
  Target: ATXN1; (-) strand; PAM type: YTN; PAM sequence: TTG
gctcactgcaagctccgcct

SEQ ID NO: 208411 - DNA, 20 bp, Artificial Sequence
  Description of Artificial Sequence: Synthetic oligonucleotide
  Target: ATXN1; (-) strand; PAM type: YTN; PAM sequence: CTT
ggctcactgcaagctccgcc

SEQ ID NO: 208412 - DNA, 20 bp, Artificial Sequence
  Description of Artificial Sequence: Synthetic oligonucleotide
  Target: ATXN1; (-) strand; PAM type: YTN; PAM sequence: CTG
gaatgcagtggtgcaatctt

SEQ ID NO: 208413 - DNA, 20 bp, Artificial Sequence
  Description of Artificial Sequence: Synthetic oligonucleotide
  Target: ATXN1; (-) strand; PAM type: YTN; PAM sequence: CTG
tcatccaggctggaatgcag

SEQ ID NO: 208414 - DNA, 20 bp, Artificial Sequence
  Description of Artificial Sequence: Synthetic oligonucleotide
  Target: ATXN1; (-) strand; PAM type: YTN; PAM sequence: CTC
tgtcatccaggctggaatgc

SEQ ID NO: 208415 - DNA, 20 bp, Artificial Sequence
  Description of Artificial Sequence: Synthetic oligonucleotide
  Target: ATXN1; (-) strand; PAM type: YTN; PAM sequence: CTC
actctgtcatccaggctgga

SEQ ID NO: 208416 - DNA, 20 bp, Artificial Sequence
  Description of Artificial Sequence: Synthetic oligonucleotide
  Target: ATXN1; (-) strand; PAM type: YTN; PAM sequence: TTG
agacaaagtctcactctgtc

SEQ ID NO: 208417 - DNA, 20 bp, Artificial Sequence
  Description of Artificial Sequence: Synthetic oligonucleotide
  Target: ATXN1; (-) strand; PAM type: YTN; PAM sequence: TTT
gagacaaagtctcactctgt

SEQ ID NO: 208418 - DNA, 20 bp, Artificial Sequence
  Description of Artificial Sequence: Synthetic oligonucleotide
  Target: ATXN1; (-) strand; PAM type: YTN; PAM sequence: TTT
tgagacaaagtctcactctg

SEQ ID NO: 208419 - DNA, 20 bp, Artificial Sequence
  Description of Artificial Sequence: Synthetic oligonucleotide
  Target: ATXN1; (-) strand; PAM type: YTN; PAM sequence: TTT
ttgagacaaagtctcactct

SEQ ID NO: 208420 - DNA, 20 bp, Artificial Sequence
  Description of Artificial Sequence: Synthetic oligonucleotide
  Target: ATXN1; (-) strand; PAM type: YTN; PAM sequence: TTT
tttgagacaaagtctcactc

SEQ ID NO: 208421 - DNA, 20 bp, Artificial Sequence
  Description of Artificial Sequence: Synthetic oligonucleotide
  Target: ATXN1; (-) strand; PAM type: YTN; PAM sequence: CTT
ttttgagacaaagtctcact

SEQ ID NO: 208422 - DNA, 20 bp, Artificial Sequence
  Description of Artificial Sequence: Synthetic oligonucleotide
  Target: ATXN1; (-) strand; PAM type: YTN; PAM sequence: TTC
ttttttgagacaaagtctca

SEQ ID NO: 208423 - DNA, 20 bp, Artificial Sequence
  Description of Artificial Sequence: Synthetic oligonucleotide
  Target: ATXN1; (-) strand; PAM type: YTN; PAM sequence: TTT
cttttttgagacaaagtctc

SEQ ID NO: 208424 - DNA, 20 bp, Artificial Sequence
  Description of Artificial Sequence: Synthetic oligonucleotide
  Target: ATXN1; (-) strand; PAM type: YTN; PAM sequence: TTT
tcttttttgagacaaagtct

SEQ ID NO: 208425 - DNA, 20 bp, Artificial Sequence
  Description of Artificial Sequence: Synthetic oligonucleotide
  Target: ATXN1; (-) strand; PAM type: YTN; PAM sequence: TTT
ttcttttttgagacaaagtc

SEQ ID NO: 208426 - DNA, 20 bp, Artificial Sequence
  Description of Artificial Sequence: Synthetic oligonucleotide
  Target: ATXN1; (-) strand; PAM type: YTN; PAM sequence: TTT
tttcttttttgagacaaagt

SEQ ID NO: 208427 - DNA, 20 bp, Artificial Sequence
  Description of Artificial Sequence: Synthetic oligonucleotide
  Target: ATXN1; (-) strand; PAM type: YTN; PAM sequence: TTG
attttttcttttttgagaca

SEQ ID NO: 208428 - DNA, 20 bp, Artificial Sequence
  Description of Artificial Sequence: Synthetic oligonucleotide
  Target: ATXN1; (-) strand; PAM type: YTN; PAM sequence: TTG
aaacaaattgattttttctt

SEQ ID NO: 208429 - DNA, 20 bp, Artificial Sequence
  Description of Artificial Sequence: Synthetic oligonucleotide
  Target: ATXN1; (-) strand; PAM type: YTN; PAM sequence: TTG
ttgaaacaaattgatttttt

SEQ ID NO: 208430 - DNA, 20 bp, Artificial Sequence
  Description of Artificial Sequence: Synthetic oligonucleotide
  Target: ATXN1; (-) strand; PAM type: YTN; PAM sequence: CTG
gattgttgaaacaaattgat

SEQ ID NO: 208431 - DNA, 20 bp, Artificial Sequence
  Description of Artificial Sequence: Synthetic oligonucleotide
  Target: ATXN1; (-) strand; PAM type: YTN; PAM sequence: CTC
tggattgttgaaacaaattg

SEQ ID NO: 208432 - DNA, 20 bp, Artificial Sequence
  Description of Artificial Sequence: Synthetic oligonucleotide
  Target: ATXN1; (-) strand; PAM type: YTN; PAM sequence: CTA
ctctggattgttgaaacaaa

SEQ ID NO: 208433 - DNA, 20 bp, Artificial Sequence
  Description of Artificial Sequence: Synthetic oligonucleotide
  Target: ATXN1; (-) strand; PAM type: YTN; PAM sequence: TTC
tactctggattgttgaaaca

SEQ ID NO: 208434 - DNA, 20 bp, Artificial Sequence
  Description of Artificial Sequence: Synthetic oligonucleotide
  Target: ATXN1; (-) strand; PAM type: YTN; PAM sequence: TTT
ctactctggattgttgaaac

SEQ ID NO: 208435 - DNA, 20 bp, Artificial Sequence
  Description of Artificial Sequence: Synthetic oligonucleotide
  Target: ATXN1; (-) strand; PAM type: YTN; PAM sequence: TTG
tatttctactctggattgtt

SEQ ID NO: 208436 - DNA, 20 bp, Artificial Sequence
  Description of Artificial Sequence: Synthetic oligonucleotide
  Target: ATXN1; (-) strand; PAM type: YTN; PAM sequence: CTT
gtatttctactctggattgt

SEQ ID NO: 208437 - DNA, 20 bp, Artificial Sequence
  Description of Artificial Sequence: Synthetic oligonucleotide
  Target: ATXN1; (-) strand; PAM type: YTN; PAM sequence: CTA
cttgtatttctactctggat

SEQ ID NO: 208438 - DNA, 20 bp, Artificial Sequence
  Description of Artificial Sequence: Synthetic oligonucleotide
  Target: ATXN1; (-) strand; PAM type: YTN; PAM sequence: TTC
tacttgtatttctactctgg

SEQ ID NO: 208439 - DNA, 20 bp, Artificial Sequence
  Description of Artificial Sequence: Synthetic oligonucleotide
  Target: ATXN1; (-) strand; PAM type: YTN; PAM sequence: CTT
ctacttgtatttctactctg

SEQ ID NO: 208440 - DNA, 20 bp, Artificial Sequence
  Description of Artificial Sequence: Synthetic oligonucleotide
  Target: ATXN1; (-) strand; PAM type: YTN; PAM sequence: TTG
cacaaaatcttctacttgta

SEQ ID NO: 208441 - DNA, 20 bp, Artificial Sequence
  Description of Artificial Sequence: Synthetic oligonucleotide
  Target: ATXN1; (-) strand; PAM type: YTN; PAM sequence: CTT
gcacaaaatcttctacttgt

SEQ ID NO: 208442 - DNA, 20 bp, Artificial Sequence
  Description of Artificial Sequence: Synthetic oligonucleotide
  Target: ATXN1; (-) strand; PAM type: YTN; PAM sequence: TTG
cacaaaatacgcttgcacaa

SEQ ID NO: 208443 - DNA, 20 bp, Artificial Sequence
  Description of Artificial Sequence: Synthetic oligonucleotide
  Target: ATXN1; (-) strand; PAM type: YTN; PAM sequence: CTT
gcacaaaatacgcttgcaca

SEQ ID NO: 208444 - DNA, 20 bp, Artificial Sequence
  Description of Artificial Sequence: Synthetic oligonucleotide
  Target: ATXN1; (-) strand; PAM type: YTN; PAM sequence: TTA
cgcttgcacaaaatacgctt

SEQ ID NO: 208445 - DNA, 20 bp, Artificial Sequence
  Description of Artificial Sequence: Synthetic oligonucleotide
  Target: ATXN1; (-) strand; PAM type: YTN; PAM sequence: TTG
caaaatagattacgcttgca

SEQ ID NO: 208446 - DNA, 20 bp, Artificial Sequence
  Description of Artificial Sequence: Synthetic oligonucleotide
  Target: ATXN1; (-) strand; PAM type: YTN; PAM sequence: CTT
gcaaaatagattacgcttgc

SEQ ID NO: 208447 - DNA, 20 bp, Artificial Sequence
  Description of Artificial Sequence: Synthetic oligonucleotide
  Target: ATXN1; (-) strand; PAM type: YTN; PAM sequence: CTG
cttgcaaaatagattacgct

SEQ ID NO: 208448 - DNA, 20 bp, Artificial Sequence
  Description of Artificial Sequence: Synthetic oligonucleotide
  Target: ATXN1; (-) strand; PAM type: YTN; PAM sequence: TTC
tgcttgcaaaatagattacg

SEQ ID NO: 208449 - DNA, 20 bp, Artificial Sequence
  Description of Artificial Sequence: Synthetic oligonucleotide
  Target: ATXN1; (-) strand; PAM type: YTN; PAM sequence: TTT
ctgcttgcaaaatagattac

SEQ ID NO: 208450 - DNA, 20 bp, Artificial Sequence
  Description of Artificial Sequence: Synthetic oligonucleotide
  Target: ATXN1; (-) strand; PAM type: YTN; PAM sequence: TTT
tctgcttgcaaaatagatta

SEQ ID NO: 208451 - DNA, 20 bp, Artificial Sequence
  Description of Artificial Sequence: Synthetic oligonucleotide
  Target: ATXN1; (-) strand; PAM type: YTN; PAM sequence: CTA
aaatacgtgagaattttctg

SEQ ID NO: 208452 - DNA, 20 bp, Artificial Sequence
  Description of Artificial Sequence: Synthetic oligonucleotide
  Target: ATXN1; (-) strand; PAM type: YTN; PAM sequence: CTC
taaaatacgtgagaattttc

SEQ ID NO: 208453 - DNA, 20 bp, Artificial Sequence
  Description of Artificial Sequence: Synthetic oligonucleotide
  Target: ATXN1; (-) strand; PAM type: YTN; PAM sequence: CTG
actctaaaatacgtgagaat

SEQ ID NO: 208454 - DNA, 20 bp, Artificial Sequence
  Description of Artificial Sequence: Synthetic oligonucleotide
  Target: ATXN1; (-) strand; PAM type: YTN; PAM sequence: TTG
agaaccctgactctaaaata

SEQ ID NO: 208455 - DNA, 20 bp, Artificial Sequence
  Description of Artificial Sequence: Synthetic oligonucleotide
  Target: ATXN1; (-) strand; PAM type: YTN; PAM sequence: TTT
gagaaccctgactctaaaat

SEQ ID NO: 208456 - DNA, 20 bp, Artificial Sequence
  Description of Artificial Sequence: Synthetic oligonucleotide
  Target: ATXN1; (-) strand; PAM type: YTN; PAM sequence: TTA
tgatttgagaaccctgactc

SEQ ID NO: 208457 - DNA, 20 bp, Artificial Sequence
  Description of Artificial Sequence: Synthetic oligonucleotide
  Target: ATXN1; (-) strand; PAM type: YTN; PAM sequence: TTT
atgatttgagaaccctgact

SEQ ID NO: 208458 - DNA, 20 bp, Artificial Sequence
  Description of Artificial Sequence: Synthetic oligonucleotide
  Target: ATXN1; (-) strand; PAM type: YTN; PAM sequence: TTA
agatttatgatttgagaacc

SEQ ID NO: 208459 - DNA, 20 bp, Artificial Sequence
  Description of Artificial Sequence: Synthetic oligonucleotide
  Target: ATXN1; (-) strand; PAM type: YTN; PAM sequence: TTT
aagatttatgatttgagaac

SEQ ID NO: 208460 - DNA, 20 bp, Artificial Sequence
  Description of Artificial Sequence: Synthetic oligonucleotide
  Target: ATXN1; (-) strand; PAM type: YTN; PAM sequence: CTT
taagatttatgatttgagaa

SEQ ID NO: 208461 - DNA, 20 bp, Artificial Sequence
  Description of Artificial Sequence: Synthetic oligonucleotide
  Target: ATXN1; (-) strand; PAM type: YTN; PAM sequence: CTG
aaaactttaagatttatgat

SEQ ID NO: 208462 - DNA, 20 bp, Artificial Sequence
  Description of Artificial Sequence: Synthetic oligonucleotide
  Target: ATXN1; (-) strand; PAM type: YTN; PAM sequence: TTC
tgaaaactttaagatttatg

SEQ ID NO: 208463 - DNA, 20 bp, Artificial Sequence
  Description of Artificial Sequence: Synthetic oligonucleotide
  Target: ATXN1; (-) strand; PAM type: YTN; PAM sequence: TTG
gcatggattctgaaaacttt

SEQ ID NO: 208464 - DNA, 20 bp, Artificial Sequence
  Description of Artificial Sequence: Synthetic oligonucleotide
  Target: ATXN1; (-) strand; PAM type: YTN; PAM sequence: CTT
ggcatggattctgaaaactt

SEQ ID NO: 208465 - DNA, 20 bp, Artificial Sequence
  Description of Artificial Sequence: Synthetic oligonucleotide
  Target: ATXN1; (-) strand; PAM type: YTN; PAM sequence: TTA
agtcccttggcatggattct

SEQ ID NO: 208466 - DNA, 20 bp, Artificial Sequence
  Description of Artificial Sequence: Synthetic oligonucleotide
  Target: ATXN1; (-) strand; PAM type: YTN; PAM sequence: CTT
aagtcccttggcatggattc

SEQ ID NO: 208467 - DNA, 20 bp, Artificial Sequence
  Description of Artificial Sequence: Synthetic oligonucleotide
  Target: ATXN1; (-) strand; PAM type: YTN; PAM sequence: TTC
ttaagtcccttggcatggat

SEQ ID NO: 208468 - DNA, 20 bp, Artificial Sequence
  Description of Artificial Sequence: Synthetic oligonucleotide
  Target: ATXN1; (-) strand; PAM type: YTN; PAM sequence: TTT
cttaagtcccttggcatgga

SEQ ID NO: 208469 - DNA, 20 bp, Artificial Sequence
  Description of Artificial Sequence: Synthetic oligonucleotide
  Target: ATXN1; (-) strand; PAM type: YTN; PAM sequence: TTT
tcttaagtcccttggcatgg

SEQ ID NO: 208470 - DNA, 20 bp, Artificial Sequence
  Description of Artificial Sequence: Synthetic oligonucleotide
  Target: ATXN1; (-) strand; PAM type: YTN; PAM sequence: TTA
attttcttaagtcccttggc

SEQ ID NO: 208471 - DNA, 20 bp, Artificial Sequence
  Description of Artificial Sequence: Synthetic oligonucleotide
  Target: ATXN1; (-) strand; PAM type: YTN; PAM sequence: TTA
tatgggggcaatattaattt

SEQ ID NO: 208472 - DNA, 20 bp, Artificial Sequence
  Description of Artificial Sequence: Synthetic oligonucleotide
  Target: ATXN1; (-) strand; PAM type: YTN; PAM sequence: CTT
atatgggggcaatattaatt

SEQ ID NO: 208473 - DNA, 20 bp, Artificial Sequence
  Description of Artificial Sequence: Synthetic oligonucleotide
  Target: ATXN1; (-) strand; PAM type: YTN; PAM sequence: TTA
gtatacaaaagacagcttat

SEQ ID NO: 208474 - DNA, 20 bp, Artificial Sequence
  Description of Artificial Sequence: Synthetic oligonucleotide
  Target: ATXN1; (-) strand; PAM type: YTN; PAM sequence: CTT
agtatacaaaagacagctta

SEQ ID NO: 208475 - DNA, 20 bp, Artificial Sequence
  Description of Artificial Sequence: Synthetic oligonucleotide
  Target: ATXN1; (-) strand; PAM type: YTN; PAM sequence: CTG
atgcttagtatacaaaagac

SEQ ID NO: 208476 - DNA, 20 bp, Artificial Sequence
  Description of Artificial Sequence: Synthetic oligonucleotide
  Target: ATXN1; (-) strand; PAM type: YTN; PAM sequence: TTG
ctgatgcttagtatacaaaa

SEQ ID NO: 208477 - DNA, 20 bp, Artificial Sequence
  Description of Artificial Sequence: Synthetic oligonucleotide
  Target: ATXN1; (-) strand; PAM type: YTN; PAM sequence: TTT
gctgatgcttagtatacaaa

SEQ ID NO: 208478 - DNA, 20 bp, Artificial Sequence
  Description of Artificial Sequence: Synthetic oligonucleotide
  Target: ATXN1; (-) strand; PAM type: YTN; PAM sequence: CTT
tgctgatgcttagtatacaa

SEQ ID NO: 208479 - DNA, 20 bp, Artificial Sequence
  Description of Artificial Sequence: Synthetic oligonucleotide
  Target: ATXN1; (-) strand; PAM type: YTN; PAM sequence: TTG
ggggcagatgctttgctgat

SEQ ID NO: 208480 - DNA, 20 bp, Artificial Sequence
  Description of Artificial Sequence: Synthetic oligonucleotide
  Target: ATXN1; (-) strand; PAM type: YTN; PAM sequence: CTG
ttgggggcagatgctttgct

SEQ ID NO: 208481 - DNA, 20 bp, Artificial Sequence
  Description of Artificial Sequence: Synthetic oligonucleotide
  Target: ATXN1; (-) strand; PAM type: YTN; PAM sequence: CTG
ggaccagtaaaatagctgtt

SEQ ID NO: 208482 - DNA, 20 bp, Artificial Sequence
  Description of Artificial Sequence: Synthetic oligonucleotide
  Target: ATXN1; (-) strand; PAM type: YTN; PAM sequence: CTC
tgggaccagtaaaatagctg

SEQ ID NO: 208483 - DNA, 20 bp, Artificial Sequence
  Description of Artificial Sequence: Synthetic oligonucleotide
  Target: ATXN1; (-) strand; PAM type: YTN; PAM sequence: TTC
ctctgggaccagtaaaatag

SEQ ID NO: 208484 - DNA, 20 bp, Artificial Sequence
  Description of Artificial Sequence: Synthetic oligonucleotide
  Target: ATXN1; (-) strand; PAM type: YTN; PAM sequence: TTT
cctctgggaccagtaaaata

SEQ ID NO: 208485 - DNA, 20 bp, Artificial Sequence
  Description of Artificial Sequence: Synthetic oligonucleotide
  Target: ATXN1; (-) strand; PAM type: YTN; PAM sequence: CTT
tcctctgggaccagtaaaat

SEQ ID NO: 208486 - DNA, 20 bp, Artificial Sequence
  Description of Artificial Sequence: Synthetic oligonucleotide
  Target: ATXN1; (-) strand; PAM type: YTN; PAM sequence: TTA
tctttcctctgggaccagta

SEQ ID NO: 208487 - DNA, 20 bp, Artificial Sequence
  Description of Artificial Sequence: Synthetic oligonucleotide
  Target: ATXN1; (-) strand; PAM type: YTN; PAM sequence: CTT
atctttcctctgggaccagt

SEQ ID NO: 208488 - DNA, 20 bp, Artificial Sequence
  Description of Artificial Sequence: Synthetic oligonucleotide
  Target: ATXN1; (-) strand; PAM type: YTN; PAM sequence: CTG
cttatctttcctctgggacc

SEQ ID NO: 208489 - DNA, 20 bp, Artificial Sequence
  Description of Artificial Sequence: Synthetic oligonucleotide
  Target: ATXN1; (-) strand; PAM type: YTN; PAM sequence: CTC
tgcttatctttcctctggga

SEQ ID NO: 208490 - DNA, 20 bp, Artificial Sequence
  Description of Artificial Sequence: Synthetic oligonucleotide
  Target: ATXN1; (-) strand; PAM type: YTN; PAM sequence: TTG
cggaagacaactctgcttat

SEQ ID NO: 208491 - DNA, 20 bp, Artificial Sequence
  Description of Artificial Sequence: Synthetic oligonucleotide
  Target: ATXN1; (-) strand; PAM type: YTN; PAM sequence: TTT
gcggaagacaactctgctta

SEQ ID NO: 208492 - DNA, 20 bp, Artificial Sequence
  Description of Artificial Sequence: Synthetic oligonucleotide
  Target: ATXN1; (-) strand; PAM type: YTN; PAM sequence: TTT
tgcggaagacaactctgctt

SEQ ID NO: 208493 - DNA, 20 bp, Artificial Sequence
  Description of Artificial Sequence: Synthetic oligonucleotide
  Target: ATXN1; (-) strand; PAM type: YTN; PAM sequence: TTA
tgattttgcggaagacaact

SEQ ID NO: 208494 - DNA, 20 bp, Artificial Sequence
  Description of Artificial Sequence: Synthetic oligonucleotide
  Target: ATXN1; (-) strand; PAM type: YTN; PAM sequence: TTT
atgattttgcggaagacaac

SEQ ID NO: 208495 - DNA, 20 bp, Artificial Sequence
  Description of Artificial Sequence: Synthetic oligonucleotide
  Target: ATXN1; (-) strand; PAM type: YTN; PAM sequence: CTT
tatgattttgcggaagacaa

SEQ ID NO: 208496 - DNA, 20 bp, Artificial Sequence
  Description of Artificial Sequence: Synthetic oligonucleotide
  Target: ATXN1; (-) strand; PAM type: YTN; PAM sequence: TTC
tttatgattttgcggaagac

SEQ ID NO: 208497 - DNA, 20 bp, Artificial Sequence
  Description of Artificial Sequence: Synthetic oligonucleotide
  Target: ATXN1; (-) strand; PAM type: YTN; PAM sequence: CTT
ctttatgattttgcggaaga

SEQ ID NO: 208498 - DNA, 20 bp, Artificial Sequence
  Description of Artificial Sequence: Synthetic oligonucleotide
  Target: ATXN1; (-) strand; PAM type: YTN; PAM sequence: TTG
accttctttatgattttgcg

SEQ ID NO: 208499 - DNA, 20 bp, Artificial Sequence
  Description of Artificial Sequence: Synthetic oligonucleotide
  Target: ATXN1; (-) strand; PAM type: YTN; PAM sequence: CTT
gaccttctttatgattttgc

SEQ ID NO: 208500 - DNA, 20 bp, Artificial Sequence
  Description of Artificial Sequence: Synthetic oligonucleotide
  Target: ATXN1; (-) strand; PAM type: YTN; PAM sequence: CTA
cagatgaacttgaccttctt

SEQ ID NO: 208501 - DNA, 20 bp, Artificial Sequence
  Description of Artificial Sequence: Synthetic oligonucleotide
  Target: ATXN1; (-) strand; PAM type: YTN; PAM sequence: CTA
aggggaaggatcctacagat

SEQ ID NO: 208502 - DNA, 20 bp, Artificial Sequence
  Description of Artificial Sequence: Synthetic oligonucleotide
  Target: ATXN1; (-) strand; PAM type: YTN; PAM sequence: CTA
gagggcctaaggggaaggat

SEQ ID NO: 208503 - DNA, 20 bp, Artificial Sequence
  Description of Artificial Sequence: Synthetic oligonucleotide
  Target: ATXN1; (-) strand; PAM type: YTN; PAM sequence: CTG
gggcccaatggggaggcacc

SEQ ID NO: 208504 - DNA, 20 bp, Artificial Sequence
  Description of Artificial Sequence: Synthetic oligonucleotide
  Target: ATXN1; (-) strand; PAM type: YTN; PAM sequence: TTA
cggagtagaaacccctgggg

SEQ ID NO: 208505 - DNA, 20 bp, Artificial Sequence
  Description of Artificial Sequence: Synthetic oligonucleotide
  Target: ATXN1; (-) strand; PAM type: YTN; PAM sequence: TTG
acagggcaggggtgggaaag

SEQ ID NO: 208506 - DNA, 20 bp, Artificial Sequence
  Description of Artificial Sequence: Synthetic oligonucleotide
  Target: ATXN1; (-) strand; PAM type: YTN; PAM sequence: TTC
aagttgacagggcaggggtg

SEQ ID NO: 208507 - DNA, 20 bp, Artificial Sequence
  Description of Artificial Sequence: Synthetic oligonucleotide
  Target: ATXN1; (-) strand; PAM type: YTN; PAM sequence: CTG
gtgttcaagttgacagggca

SEQ ID NO: 208508 - DNA, 20 bp, Artificial Sequence
  Description of Artificial Sequence: Synthetic oligonucleotide
  Target: ATXN1; (-) strand; PAM type: YTN; PAM sequence: TTC
actggtgttcaagttgacag

SEQ ID NO: 208509 - DNA, 20 bp, Artificial Sequence
  Description of Artificial Sequence: Synthetic oligonucleotide
  Target: ATXN1; (-) strand; PAM type: YTN; PAM sequence: TTT
cactggtgttcaagttgaca

SEQ ID NO: 208510 - DNA, 20 bp, Artificial Sequence
  Description of Artificial Sequence: Synthetic oligonucleotide
  Target: ATXN1; (-) strand; PAM type: YTN; PAM sequence: CTG
tggtgtttcactggtgttca

SEQ ID NO: 208511 - DNA, 20 bp, Artificial Sequence
  Description of Artificial Sequence: Synthetic oligonucleotide
  Target: ATXN1; (-) strand; PAM type: YTN; PAM sequence: TTG
aaacactgtggtgtttcact

SEQ ID NO: 208512 - DNA, 20 bp, Artificial Sequence
  Description of Artificial Sequence: Synthetic oligonucleotide
  Target: ATXN1; (-) strand; PAM type: YTN; PAM sequence: TTC
atattgaaacactgtggtgt

SEQ ID NO: 208513 - DNA, 20 bp, Artificial Sequence
  Description of Artificial Sequence: Synthetic oligonucleotide
  Target: ATXN1; (-) strand; PAM type: YTN; PAM sequence: CTG
aagtgtattcatattgaaac

SEQ ID NO: 208514 - DNA, 20 bp, Artificial Sequence
  Description of Artificial Sequence: Synthetic oligonucleotide
  Target: ATXN1; (-) strand; PAM type: YTN; PAM sequence: TTG
gtgggcggagcaaaaacagt

SEQ ID NO: 208515 - DNA, 20 bp, Artificial Sequence
  Description of Artificial Sequence: Synthetic oligonucleotide
  Target: ATXN1; (-) strand; PAM type: YTN; PAM sequence: TTT
ggtgggcggagcaaaaacag

SEQ ID NO: 208516 - DNA, 20 bp, Artificial Sequence
  Description of Artificial Sequence: Synthetic oligonucleotide
  Target: ATXN1; (-) strand; PAM type: YTN; PAM sequence: TTT
tggtgggcggagcaaaaaca

SEQ ID NO: 208517 - DNA, 20 bp, Artificial Sequence
  Description of Artificial Sequence: Synthetic oligonucleotide
  Target: ATXN1; (-) strand; PAM type: YTN; PAM sequence: TTT
ttggtgggcggagcaaaaac

SEQ ID NO: 208518 - DNA, 20 bp, Artificial Sequence
  Description of Artificial Sequence: Synthetic oligonucleotide
  Target: ATXN1; (-) strand; PAM type: YTN; PAM sequence: TTT
tttggtgggcggagcaaaaa

SEQ ID NO: 208519 - DNA, 20 bp, Artificial Sequence
  Description of Artificial Sequence: Synthetic oligonucleotide
  Target: ATXN1; (-) strand; PAM type: YTN; PAM sequence: TTT
ttttggtgggcggagcaaaa

SEQ ID NO: 208520 - DNA, 20 bp, Artificial Sequence
  Description of Artificial Sequence: Synthetic oligonucleotide
  Target: ATXN1; (-) strand; PAM type: YTN; PAM sequence: TTT
tttttggtgggcggagcaaa

SEQ ID NO: 208521 - DNA, 20 bp, Artificial Sequence
  Description of Artificial Sequence: Synthetic oligonucleotide
  Target: ATXN1; (-) strand; PAM type: YTN; PAM sequence: TTA
aagtatggattttttttggt

SEQ ID NO: 208522 - DNA, 20 bp, Artificial Sequence
  Description of Artificial Sequence: Synthetic oligonucleotide
  Target: ATXN1; (-) strand; PAM type: YTN; PAM sequence: TTT
aaagtatggattttttttgg

SEQ ID NO: 208523 - DNA, 20 bp, Artificial Sequence
  Description of Artificial Sequence: Synthetic oligonucleotide
  Target: ATXN1; (-) strand; PAM type: YTN; PAM sequence: CTT
taaagtatggattttttttg

SEQ ID NO: 208524 - DNA, 20 bp, Artificial Sequence
  Description of Artificial Sequence: Synthetic oligonucleotide
  Target: ATXN1; (-) strand; PAM type: YTN; PAM sequence: TTA
aaagctttaaagtatggatt

SEQ ID NO: 208525 - DNA, 20 bp, Artificial Sequence
  Description of Artificial Sequence: Synthetic oligonucleotide
  Target: ATXN1; (-) strand; PAM type: YTN; PAM sequence: TTA
aaaaaattaaaagctttaaa

SEQ ID NO: 208526 - DNA, 20 bp, Artificial Sequence
  Description of Artificial Sequence: Synthetic oligonucleotide
  Target: ATXN1; (-) strand; PAM type: YTN; PAM sequence: CTT
aaaaaaattaaaagctttaa

SEQ ID NO: 208527 - DNA, 20 bp, Artificial Sequence
  Description of Artificial Sequence: Synthetic oligonucleotide
  Target: ATXN1; (-) strand; PAM type: YTN; PAM sequence: TTA
aaagcttaaaaaaattaaaa

SEQ ID NO: 208528 - DNA, 20 bp, Artificial Sequence
  Description of Artificial Sequence: Synthetic oligonucleotide
  Target: ATXN1; (-) strand; PAM type: YTN; PAM sequence: TTA
aaaaaattaaaagcttaaaa

SEQ ID NO: 208529 - DNA, 20 bp, Artificial Sequence
  Description of Artificial Sequence: Synthetic oligonucleotide
  Target: ATXN1; (-) strand; PAM type: YTN; PAM sequence: TTC
aattaaaaaaattaaaagct

SEQ ID NO: 208530 - DNA, 20 bp, Artificial Sequence
  Description of Artificial Sequence: Synthetic oligonucleotide
  Target: ATXN1; (-) strand; PAM type: YTN; PAM sequence: CTT
caattaaaaaaattaaaagc

SEQ ID NO: 208531 - DNA, 20 bp, Artificial Sequence
  Description of Artificial Sequence: Synthetic oligonucleotide
  Target: ATXN1; (-) strand; PAM type: YTN; PAM sequence: TTA
aaagaaagtaaagtgatgct

SEQ ID NO: 208532 - DNA, 20 bp, Artificial Sequence
  Description of Artificial Sequence: Synthetic oligonucleotide
  Target: ATXN1; (-) strand; PAM type: YTN; PAM sequence: TTT
aaaagaaagtaaagtgatgc

SEQ ID NO: 208533 - DNA, 20 bp, Artificial Sequence
  Description of Artificial Sequence: Synthetic oligonucleotide
  Target: ATXN1; (-) strand; PAM type: YTN; PAM sequence: TTA
gaatttaaaagaaagtaaag

SEQ ID NO: 208534 - DNA, 20 bp, Artificial Sequence
  Description of Artificial Sequence: Synthetic oligonucleotide
  Target: ATXN1; (-) strand; PAM type: YTN; PAM sequence: CTG
atgttagaatttaaaagaaa

SEQ ID NO: 208535 - DNA, 20 bp, Artificial Sequence
  Description of Artificial Sequence: Synthetic oligonucleotide
  Target: ATXN1; (-) strand; PAM type: YTN; PAM sequence: CTC
actgatgttagaatttaaaa

SEQ ID NO: 208536 - DNA, 20 bp, Artificial Sequence
  Description of Artificial Sequence: Synthetic oligonucleotide
  Target: ATXN1; (-) strand; PAM type: YTN; PAM sequence: CTG
ctcactgatgttagaattta

SEQ ID NO: 208537 - DNA, 20 bp, Artificial Sequence
  Description of Artificial Sequence: Synthetic oligonucleotide
  Target: ATXN1; (-) strand; PAM type: YTN; PAM sequence: TTG
gctgctcactgatgttagaa

SEQ ID NO: 208538 - DNA, 20 bp, Artificial Sequence
  Description of Artificial Sequence: Synthetic oligonucleotide
  Target: ATXN1; (-) strand; PAM type: YTN; PAM sequence: TTT
ggctgctcactgatgttaga

SEQ ID NO: 208539 - DNA, 20 bp, Artificial Sequence
  Description of Artificial Sequence: Synthetic oligonucleotide
  Target: ATXN1; (-) strand; PAM type: YTN; PAM sequence: TTT
tggctgctcactgatgttag

SEQ ID NO: 208540 - DNA, 20 bp, Artificial Sequence
  Description of Artificial Sequence: Synthetic oligonucleotide
  Target: ATXN1; (-) strand; PAM type: YTN; PAM sequence: CTA
aaaaaaaaaaaaaagaattt

SEQ ID NO: 208541 - DNA, 20 bp, Artificial Sequence
  Description of Artificial Sequence: Synthetic oligonucleotide
  Target: ATXN1; (-) strand; PAM type: YTN; PAM sequence: CTC
catctaaaaaaaaaaaaaaa

SEQ ID NO: 208542 - DNA, 20 bp, Artificial Sequence
  Description of Artificial Sequence: Synthetic oligonucleotide
  Target: ATXN1; (-) strand; PAM type: YTN; PAM sequence: CTG
ggtcacagagcgagactcca

SEQ ID NO: 208543 - DNA, 20 bp, Artificial Sequence
  Description of Artificial Sequence: Synthetic oligonucleotide
  Target: ATXN1; (-) strand; PAM type: YTN; PAM sequence: CTC
cagcctgggtcacagagcga

SEQ ID NO: 208544 - DNA, 20 bp, Artificial Sequence
  Description of Artificial Sequence: Synthetic oligonucleotide
  Target: ATXN1; (-) strand; PAM type: YTN; PAM sequence: CTG
cactccagcctgggtcacag

SEQ ID NO: 208545 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagatcatgcc

SEQ ID NO: 208546 - DNA, 20 bp, Artificial Sequence
  Description of Artificial Sequence: Synthetic oligonucleotide
  Target: ATXN1; (-) strand; PAM type: YTN; PAM sequence: TTG
aacccaggaggcgaaggttg

SEQ ID NO: 208547 - DNA, 20 bp, Artificial Sequence
  Description of Artificial Sequence: Synthetic oligonucleotide
  Target: ATXN1; (-) strand; PAM type: YTN; PAM sequence: CTT
gaacccaggaggcgaaggtt

SEQ ID NO: 208548 - DNA, 20 bp, Artificial Sequence
  Description of Artificial Sequence: Synthetic oligonucleotide
  Target: ATXN1; (-) strand; PAM type: YTN; PAM sequence: TTG
cttgaacccaggaggcgaag

SEQ ID NO: 208549 - DNA, 20 bp, Artificial Sequence
  Description of Artificial Sequence: Synthetic oligonucleotide
  Target: ATXN1; (-) strand; PAM type: YTN; PAM sequence: CTT
gcttgaacccaggaggcgaa

SEQ ID NO: 208550 - DNA, 20 bp, Artificial Sequence
  Description of Artificial Sequence: Synthetic oligonucleotide
  Target: ATXN1; (-) strand; PAM type: YTN; PAM sequence: CTG
aggcaagagacttgcttgaa

SEQ ID NO: 208551 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaagagact

SEQ ID NO: 208552 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaagagac

SEQ ID NO: 208553 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcaaga

SEQ ID NO: 208554 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggag

SEQ ID NO: 208555 - DNA, 20 bp, Artificial Sequence
  Description of Artificial Sequence: Synthetic oligonucleotide
  Target: ATXN1; (-) strand; PAM type: YTN; PAM sequence: CTG
cgcctgtagtcccagctact

SEQ ID NO: 208556 - DNA, 20 bp, Artificial Sequence
  Description of Artificial Sequence: Synthetic oligonucleotide
  Target: ATXN1; (-) strand; PAM type: YTN; PAM sequence: TTA
gcagggcatggtggcctgcg

SEQ ID NO: 208557 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaattagcagg

SEQ ID NO: 208558 - DNA, 20 bp, Artificial Sequence
  Description of Artificial Sequence: Synthetic oligonucleotide
  Target: ATXN1; (-) strand; PAM type: YTN; PAM sequence: CTG
tactaaaaatacaaaaatta

SEQ ID NO: 208559 - DNA, 20 bp, Artificial Sequence
  Description of Artificial Sequence: Synthetic oligonucleotide
  Target: ATXN1; (-) strand; PAM type: YTN; PAM sequence: CTG
gccaacacggtgaaacccca

SEQ ID NO: 208560 - DNA, 20 bp, Artificial Sequence
  Description of Artificial Sequence: Synthetic oligonucleotide
  Target: ATXN1; (-) strand; PAM type: YTN; PAM sequence: TTC
tggccaacacggtgaaaccc

SEQ ID NO: 208561 - DNA, 20 bp, Artificial Sequence
  Description of Artificial Sequence: Synthetic oligonucleotide
  Target: ATXN1; (-) strand; PAM type: YTN; PAM sequence: TTC
atgaggtcaagagatcaaga

SEQ ID NO: 208562 - DNA, 20 bp, Artificial Sequence
  Description of Artificial Sequence: Synthetic oligonucleotide
  Target: ATXN1; (-) strand; PAM type: YTN; PAM sequence: TTG
ggaggccgaagcgggtggtt

SEQ ID NO: 208563 - DNA, 20 bp, Artificial Sequence
  Description of Artificial Sequence: Synthetic oligonucleotide
  Target: ATXN1; (-) strand; PAM type: YTN; PAM sequence: TTT
gggaggccgaagcgggtggt

SEQ ID NO: 208564 - DNA, 20 bp, Artificial Sequence
  Description of Artificial Sequence: Synthetic oligonucleotide
  Target: ATXN1; (-) strand; PAM type: YTN; PAM sequence: CTT
tgggaggccgaagcgggtgg

SEQ ID NO: 208565 - DNA, 20 bp, Artificial Sequence
  Description of Artificial Sequence: Synthetic oligonucleotide
  Target: ATXN1; (-) strand; PAM type: YTN; PAM sequence: CTC
agcactttgggaggccgaag

SEQ ID NO: 208566 - DNA, 20 bp, Artificial Sequence
  Description of Artificial Sequence: Synthetic oligonucleotide
  Target: ATXN1; (-) strand; PAM type: YTN; PAM sequence: CTG
taatctcagcactttgggag

SEQ ID NO: 208567 - DNA, 20 bp, Artificial Sequence
  Description of Artificial Sequence: Synthetic oligonucleotide
  Target: ATXN1; (-) strand; PAM type: YTN; PAM sequence: CTC
acgcctgtaatctcagcact

SEQ ID NO: 208568 - DNA, 20 bp, Artificial Sequence
  Description of Artificial Sequence: Synthetic oligonucleotide
  Target: ATXN1; (-) strand; PAM type: YTN; PAM sequence: CTC
agtggctcacgcctgtaatc

SEQ ID NO: 208569 - DNA, 20 bp, Artificial Sequence
  Description of Artificial Sequence: Synthetic oligonucleotide
  Target: ATXN1; (-) strand; PAM type: YTN; PAM sequence: CTG
cggccaggctcagtggctca

SEQ ID NO: 208570 - DNA, 20 bp, Artificial Sequence
  Description of Artificial Sequence: Synthetic oligonucleotide
  Target: ATXN1; (-) strand; PAM type: YTN; PAM sequence: TTG
ggctgcggccaggctcagtg

SEQ ID NO: 208571 - DNA, 20 bp, Artificial Sequence
  Description of Artificial Sequence: Synthetic oligonucleotide
  Target: ATXN1; (-) strand; PAM type: YTN; PAM sequence: TTT
gggctgcggccaggctcagt

SEQ ID NO: 208572 - DNA, 20 bp, Artificial Sequence
  Description of Artificial Sequence: Synthetic oligonucleotide
  Target: ATXN1; (-) strand; PAM type: YTN; PAM sequence: TTC
agaatttgggctgcggccag

SEQ ID NO: 208573 - DNA, 20 bp, Artificial Sequence
  Description of Artificial Sequence: Synthetic oligonucleotide
  Target: ATXN1; (-) strand; PAM type: YTN; PAM sequence: TTC
cccgttcagaatttgggctg

SEQ ID NO: 208574 - DNA, 20 bp, Artificial Sequence
  Description of Artificial Sequence: Synthetic oligonucleotide
  Target: ATXN1; (-) strand; PAM type: YTN; PAM sequence: TTT
ccccgttcagaatttgggct

SEQ ID NO: 208575 - DNA, 20 bp, Artificial Sequence
  Description of Artificial Sequence: Synthetic oligonucleotide
  Target: ATXN1; (-) strand; PAM type: YTN; PAM sequence: CTT
tccccgttcagaatttgggc

SEQ ID NO: 208576 - DNA, 20 bp, Artificial Sequence
  Description of Artificial Sequence: Synthetic oligonucleotide
  Target: ATXN1; (-) strand; PAM type: YTN; PAM sequence: CTC
tttccccgttcagaatttgg

SEQ ID NO: 208577 - DNA, 20 bp, Artificial Sequence
  Description of Artificial Sequence: Synthetic oligonucleotide
  Target: ATXN1; (-) strand; PAM type: YTN; PAM sequence: TTA
tcctctttccccgttcagaa

SEQ ID NO: 208578 - DNA, 20 bp, Artificial Sequence
  Description of Artificial Sequence: Synthetic oligonucleotide
  Target: ATXN1; (-) strand; PAM type: YTN; PAM sequence: CTT
atcctctttccccgttcaga

SEQ ID NO: 208579 - DNA, 20 bp, Artificial Sequence
  Description of Artificial Sequence: Synthetic oligonucleotide
  Target: ATXN1; (-) strand; PAM type: YTN; PAM sequence: TTA
ccttatcctctttccccgtt

SEQ ID NO: 208580 - DNA, 20 bp, Artificial Sequence
  Description of Artificial Sequence: Synthetic oligonucleotide
  Target: ATXN1; (-) strand; PAM type: YTN; PAM sequence: TTG
caaaagtaggagacgttacc

SEQ ID NO: 208581 - DNA, 20 bp, Artificial Sequence
  Description of Artificial Sequence: Synthetic oligonucleotide
  Target: ATXN1; (-) strand; PAM type: YTN; PAM sequence: CTT
gcaaaagtaggagacgttac

SEQ ID NO: 208582 - DNA, 20 bp, Artificial Sequence
  Description of Artificial Sequence: Synthetic oligonucleotide
  Target: ATXN1; (-) strand; PAM type: YTN; PAM sequence: TTC
ataggaagcaaaagaagctt

SEQ ID NO: 208583 - DNA, 20 bp, Artificial Sequence
  Description of Artificial Sequence: Synthetic oligonucleotide
  Target: ATXN1; (-) strand; PAM type: YTN; PAM sequence: CTT
cataggaagcaaaagaagct

SEQ ID NO: 208584 - DNA, 20 bp, Artificial Sequence
  Description of Artificial Sequence: Synthetic oligonucleotide
  Target: ATXN1; (-) strand; PAM type: YTN; PAM sequence: TTA
tggcaagccttcataggaag

SEQ ID NO: 208585 - DNA, 20 bp, Artificial Sequence
  Description of Artificial Sequence: Synthetic oligonucleotide
  Target: ATXN1; (-) strand; PAM type: YTN; PAM sequence: TTT
atggcaagccttcataggaa

SEQ ID NO: 208586 - DNA, 20 bp, Artificial Sequence
  Description of Artificial Sequence: Synthetic oligonucleotide
  Target: ATXN1; (-) strand; PAM type: YTN; PAM sequence: CTT
tatggcaagccttcatagga

SEQ ID NO: 208587 - DNA, 20 bp, Artificial Sequence
  Description of Artificial Sequence: Synthetic oligonucleotide
  Target: ATXN1; (-) strand; PAM type: YTN; PAM sequence: CTA
tctttatggcaagccttcat

SEQ ID NO: 208588 - DNA, 20 bp, Artificial Sequence
  Description of Artificial Sequence: Synthetic oligonucleotide
  Target: ATXN1; (-) strand; PAM type: YTN; PAM sequence: TTC
tatctttatggcaagccttc

SEQ ID NO: 208589 - DNA, 20 bp, Artificial Sequence
  Description of Artificial Sequence: Synthetic oligonucleotide
  Target: ATXN1; (-) strand; PAM type: YTN; PAM sequence: TTT
ctatctttatggcaagcctt

SEQ ID NO: 208590 - DNA, 20 bp, Artificial Sequence
  Description of Artificial Sequence: Synthetic oligonucleotide
  Target: ATXN1; (-) strand; PAM type: YTN; PAM sequence: TTG
tgatgtcaaagcatttctat

SEQ ID NO: 208591 - DNA, 20 bp, Artificial Sequence
  Description of Artificial Sequence: Synthetic oligonucleotide
  Target: ATXN1; (-) strand; PAM type: YTN; PAM sequence: TTT
gtgatgtcaaagcatttcta

SEQ ID NO: 208592 - DNA, 20 bp, Artificial Sequence
  Description of Artificial Sequence: Synthetic oligonucleotide
  Target: ATXN1; (-) strand; PAM type: YTN; PAM sequence: CTG
tccatggtcacagtggaaca

SEQ ID NO: 208593 - DNA, 20 bp, Artificial Sequence
  Description of Artificial Sequence: Synthetic oligonucleotide
  Target: ATXN1; (-) strand; PAM type: YTN; PAM sequence: TTA
catagcctgtccatggtcac

SEQ ID NO: 208594 - DNA, 20 bp, Artificial Sequence
  Description of Artificial Sequence: Synthetic oligonucleotide
  Target: ATXN1; (-) strand; PAM type: YTN; PAM sequence: CTC
agttacatagcctgtccatg

SEQ ID NO: 208595 - DNA, 20 bp, Artificial Sequence
  Description of Artificial Sequence: Synthetic oligonucleotide
  Target: ATXN1; (-) strand; PAM type: YTN; PAM sequence: TTG
taaatgagtagccgaagctc

SEQ ID NO: 208596 - DNA, 20 bp, Artificial Sequence
  Description of Artificial Sequence: Synthetic oligonucleotide
  Target: ATXN1; (-) strand; PAM type: YTN; PAM sequence: TTT
gtaaatgagtagccgaagct

SEQ ID NO: 208597 - DNA, 20 bp, Artificial Sequence
  Description of Artificial Sequence: Synthetic oligonucleotide
  Target: ATXN1; (-) strand; PAM type: YTN; PAM sequence: TTT
tgtaaatgagtagccgaagc

SEQ ID NO: 208598 - DNA, 20 bp, Artificial Sequence
  Description of Artificial Sequence: Synthetic oligonucleotide
  Target: ATXN1; (-) strand; PAM type: YTN; PAM sequence: CTG
ttttgtaaatgagtagccga

SEQ ID NO: 208599 - DNA, 20 bp, Artificial Sequence
  Description of Artificial Sequence: Synthetic oligonucleotide
  Target: ATXN1; (-) strand; PAM type: YTN; PAM sequence: TTC
ctgttttgtaaatgagtagc

SEQ ID NO: 208600 - DNA, 20 bp, Artificial Sequence
  Description of Artificial Sequence: Synthetic oligonucleotide
  Target: ATXN1; (-) strand; PAM type: YTN; PAM sequence: TTA
tgataattcctgttttgtaa

SEQ ID NO: 208601 - DNA, 20 bp, Artificial Sequence
  Description of Artificial Sequence: Synthetic oligonucleotide
  Target: ATXN1; (-) strand; PAM type: YTN; PAM sequence: TTA
tattatgataattcctgttt

SEQ ID NO: 208602 - DNA, 20 bp, Artificial Sequence
  Description of Artificial Sequence: Synthetic oligonucleotide
  Target: ATXN1; (-) strand; PAM type: YTN; PAM sequence: TTA
cattatattatgataattcc

SEQ ID NO: 208603 - DNA, 20 bp, Artificial Sequence
  Description of Artificial Sequence: Synthetic oligonucleotide
  Target: ATXN1; (-) strand; PAM type: YTN; PAM sequence: TTA
cattacattatattatgata

SEQ ID NO: 208604 - DNA, 20 bp, Artificial Sequence
  Description of Artificial Sequence: Synthetic oligonucleotide
  Target: ATXN1; (-) strand; PAM type: YTN; PAM sequence: TTA
tattacattacattatatta

SEQ ID NO: 208605 - DNA, 20 bp, Artificial Sequence
  Description of Artificial Sequence: Synthetic oligonucleotide
  Target: ATXN1; (-) strand; PAM type: YTN; PAM sequence: TTA
ttatattacattacattata

SEQ ID NO: 208606 - DNA, 20 bp, Artificial Sequence
  Description of Artificial Sequence: Synthetic oligonucleotide
  Target: ATXN1; (-) strand; PAM type: YTN; PAM sequence: CTC
ataattattatattacatta

SEQ ID NO: 208607 - DNA, 20 bp, Artificial Sequence
  Description of Artificial Sequence: Synthetic oligonucleotide
  Target: ATXN1; (-) strand; PAM type: YTN; PAM sequence: TTA
tctcataattattatattac

SEQ ID NO: 208608 - DNA, 20 bp, Artificial Sequence
  Description of Artificial Sequence: Synthetic oligonucleotide
  Target: ATXN1; (-) strand; PAM type: YTN; PAM sequence: TTA
tatcattatctcataattat

SEQ ID NO: 208609 - DNA, 20 bp, Artificial Sequence
  Description of Artificial Sequence: Synthetic oligonucleotide
  Target: ATXN1; (-) strand; PAM type: YTN; PAM sequence: TTT
atatcattatctcataatta

SEQ ID NO: 208610 - DNA, 20 bp, Artificial Sequence
  Description of Artificial Sequence: Synthetic oligonucleotide
  Target: ATXN1; (-) strand; PAM type: YTN; PAM sequence: CTT
tatatcattatctcataatt

SEQ ID NO: 208611 - DNA, 20 bp, Artificial Sequence
  Description of Artificial Sequence: Synthetic oligonucleotide
  Target: ATXN1; (-) strand; PAM type: YTN; PAM sequence: TTG
caatgggccaatcactttat

SEQ ID NO: 208612 - DNA, 20 bp, Artificial Sequence
  Description of Artificial Sequence: Synthetic oligonucleotide
  Target: ATXN1; (-) strand; PAM type: YTN; PAM sequence: TTA
acattgcaatgggccaatca

SEQ ID NO: 208613 - DNA, 20 bp, Artificial Sequence
  Description of Artificial Sequence: Synthetic oligonucleotide
  Target: ATXN1; (-) strand; PAM type: YTN; PAM sequence: TTT
aacattgcaatgggccaatc

SEQ ID NO: 208614 - DNA, 20 bp, Artificial Sequence
  Description of Artificial Sequence: Synthetic oligonucleotide
  Target: ATXN1; (-) strand; PAM type: YTN; PAM sequence: CTT
taacattgcaatgggccaat

SEQ ID NO: 208615 - DNA, 20 bp, Artificial Sequence
  Description of Artificial Sequence: Synthetic oligonucleotide
  Target: ATXN1; (-) strand; PAM type: YTN; PAM sequence: CTC
tttaacattgcaatgggcca

SEQ ID NO: 208616 - DNA, 20 bp, Artificial Sequence
  Description of Artificial Sequence: Synthetic oligonucleotide
  Target: ATXN1; (-) strand; PAM type: YTN; PAM sequence: CTG
agagggctctttaacattgc

SEQ ID NO: 208617 - DNA, 20 bp, Artificial Sequence
  Description of Artificial Sequence: Synthetic oligonucleotide
  Target: ATXN1; (-) strand; PAM type: YTN; PAM sequence: TTC
tgagagggctctttaacatt

SEQ ID NO: 208618 - DNA, 20 bp, Artificial Sequence
  Description of Artificial Sequence: Synthetic oligonucleotide
  Target: ATXN1; (-) strand; PAM type: YTN; PAM sequence: CTT
ctgagagggctctttaacat

SEQ ID NO: 208619 - DNA, 20 bp, Artificial Sequence
  Description of Artificial Sequence: Synthetic oligonucleotide
  Target: ATXN1; (-) strand; PAM type: YTN; PAM sequence: CTC
cttctgagagggctctttaa

SEQ ID NO: 208620 - DNA, 20 bp, Artificial Sequence
  Description of Artificial Sequence: Synthetic oligonucleotide
  Target: ATXN1; (-) strand; PAM type: YTN; PAM sequence: TTA
gaaagaaagtatggtgctcc

SEQ ID NO: 208621 - DNA, 20 bp, Artificial Sequence
  Description of Artificial Sequence: Synthetic oligonucleotide
  Target: ATXN1; (-) strand; PAM type: YTN; PAM sequence: CTT
agaaagaaagtatggtgctc

SEQ ID NO: 208622 - DNA, 20 bp, Artificial Sequence
  Description of Artificial Sequence: Synthetic oligonucleotide
  Target: ATXN1; (-) strand; PAM type: YTN; PAM sequence: TTA
tcggcacttagaaagaaagt

SEQ ID NO: 208623 - DNA, 20 bp, Artificial Sequence
  Description of Artificial Sequence: Synthetic oligonucleotide
  Target: ATXN1; (-) strand; PAM type: YTN; PAM sequence: TTT
atcggcacttagaaagaaag

SEQ ID NO: 208624 - DNA, 20 bp, Artificial Sequence
  Description of Artificial Sequence: Synthetic oligonucleotide
  Target: ATXN1; (-) strand; PAM type: YTN; PAM sequence: TTT
tatcggcacttagaaagaaa

SEQ ID NO: 208625 - DNA, 20 bp, Artificial Sequence
  Description of Artificial Sequence: Synthetic oligonucleotide
  Target: ATXN1; (-) strand; PAM type: YTN; PAM sequence: TTA
ttttatcggcacttagaaag

SEQ ID NO: 208626 - DNA, 20 bp, Artificial Sequence
  Description of Artificial Sequence: Synthetic oligonucleotide
  Target: ATXN1; (-) strand; PAM type: YTN; PAM sequence: TTT
attttatcggcacttagaaa

SEQ ID NO: 208627 - DNA, 20 bp, Artificial Sequence
  Description of Artificial Sequence: Synthetic oligonucleotide
  Target: ATXN1; (-) strand; PAM type: YTN; PAM sequence: TTT
tattttatcggcacttagaa

SEQ ID NO: 208628 - DNA, 20 bp, Artificial Sequence
  Description of Artificial Sequence: Synthetic oligonucleotide
  Target: ATXN1; (-) strand; PAM type: YTN; PAM sequence: CTT
ttattttatcggcacttaga

SEQ ID NO: 208629 - DNA, 20 bp, Artificial Sequence
  Description of Artificial Sequence: Synthetic oligonucleotide
  Target: ATXN1; (-) strand; PAM type: YTN; PAM sequence: TTA
tcttttattttatcggcact

SEQ ID NO: 208630 - DNA, 20 bp, Artificial Sequence
  Description of Artificial Sequence: Synthetic oligonucleotide
  Target: ATXN1; (-) strand; PAM type: YTN; PAM sequence: TTT
atcttttattttatcggcac

SEQ ID NO: 208631 - DNA, 20 bp, Artificial Sequence
  Description of Artificial Sequence: Synthetic oligonucleotide
  Target: ATXN1; (-) strand; PAM type: YTN; PAM sequence: TTT
tatcttttattttatcggca

SEQ ID NO: 208632 - DNA, 20 bp, Artificial Sequence
  Description of Artificial Sequence: Synthetic oligonucleotide
  Target: ATXN1; (-) strand; PAM type: YTN; PAM sequence: CTT
ttatcttttattttatcggc

SEQ ID NO: 208633 - DNA, 20 bp, Artificial Sequence
  Description of Artificial Sequence: Synthetic oligonucleotide
  Target: ATXN1; (-) strand; PAM type: YTN; PAM sequence: CTG
cttttatcttttattttatc

SEQ ID NO: 208634 - DNA, 20 bp, Artificial Sequence
  Description of Artificial Sequence: Synthetic oligonucleotide
  Target: ATXN1; (-) strand; PAM type: YTN; PAM sequence: CTG
ggtcaatcccagtcggctgc

SEQ ID NO: 208635 - DNA, 20 bp, Artificial Sequence
  Description of Artificial Sequence: Synthetic oligonucleotide
  Target: ATXN1; (-) strand; PAM type: YTN; PAM sequence: TTA
gcagaggtggctgggtcaat

SEQ ID NO: 208636 - DNA, 20 bp, Artificial Sequence
  Description of Artificial Sequence: Synthetic oligonucleotide
  Target: ATXN1; (-) strand; PAM type: YTN; PAM sequence: CTT
agcagaggtggctgggtcaa

SEQ ID NO: 208637 - DNA, 20 bp, Artificial Sequence
  Description of Artificial Sequence: Synthetic oligonucleotide
  Target: ATXN1; (-) strand; PAM type: YTN; PAM sequence: CTA
ggtaggaggcccttagcaga

SEQ ID NO: 208638 - DNA, 20 bp, Artificial Sequence
  Description of Artificial Sequence: Synthetic oligonucleotide
  Target: ATXN1; (-) strand; PAM type: YTN; PAM sequence: CTC
taggtaggaggcccttagca

SEQ ID NO: 208639 - DNA, 20 bp, Artificial Sequence
  Description of Artificial Sequence: Synthetic oligonucleotide
  Target: ATXN1; (-) strand; PAM type: YTN; PAM sequence: CTG
tcccaggtcccagtgaggtg

SEQ ID NO: 208640 - DNA, 20 bp, Artificial Sequence
  Description of Artificial Sequence: Synthetic oligonucleotide
  Target: ATXN1; (-) strand; PAM type: YTN; PAM sequence: CTG
gtaagaatcatgctgtccca

SEQ ID NO: 208641 - DNA, 20 bp, Artificial Sequence
  Description of Artificial Sequence: Synthetic oligonucleotide
  Target: ATXN1; (-) strand; PAM type: YTN; PAM sequence: CTC
agaaactggtaagaatcatg

SEQ ID NO: 208642 - DNA, 20 bp, Artificial Sequence
  Description of Artificial Sequence: Synthetic oligonucleotide
  Target: ATXN1; (-) strand; PAM type: YTN; PAM sequence: CTC
tcagaaactggtaagaatca

SEQ ID NO: 208643 - DNA, 20 bp, Artificial Sequence
  Description of Artificial Sequence: Synthetic oligonucleotide
  Target: ATXN1; (-) strand; PAM type: YTN; PAM sequence: CTC
aagctctcagaaactggtaa

SEQ ID NO: 208644 - DNA, 20 bp, Artificial Sequence
  Description of Artificial Sequence: Synthetic oligonucleotide
  Target: ATXN1; (-) strand; PAM type: YTN; PAM sequence: CTC
gagggcccaagacctcaagc

SEQ ID NO: 208645 - DNA, 20 bp, Artificial Sequence
  Description of Artificial Sequence: Synthetic oligonucleotide
  Target: ATXN1; (-) strand; PAM type: YTN; PAM sequence: CTG
gctcgagggcccaagacctc

SEQ ID NO: 208646 - DNA, 20 bp, Artificial Sequence
  Description of Artificial Sequence: Synthetic oligonucleotide
  Target: ATXN1; (-) strand; PAM type: YTN; PAM sequence: TTA
gcggacgcctggctcgaggg

SEQ ID NO: 208647 - DNA, 20 bp, Artificial Sequence
  Description of Artificial Sequence: Synthetic oligonucleotide
  Target: ATXN1; (-) strand; PAM type: YTN; PAM sequence: TTT
agcggacgcctggctcgagg

SEQ ID NO: 208648 - DNA, 20 bp, Artificial Sequence
  Description of Artificial Sequence: Synthetic oligonucleotide
  Target: ATXN1; (-) strand; PAM type: YTN; PAM sequence: CTT
tagcggacgcctggctcgag

SEQ ID NO: 208649 - DNA, 20 bp, Artificial Sequence
  Description of Artificial Sequence: Synthetic oligonucleotide
  Target: ATXN1; (-) strand; PAM type: YTN; PAM sequence: CTG
cctttagcggacgcctggct

SEQ ID NO: 208650 - DNA, 20 bp, Artificial Sequence
  Description of Artificial Sequence: Synthetic oligonucleotide
  Target: ATXN1; (-) strand; PAM type: YTN; PAM sequence: CTC
agacctgcctttagcggacg

SEQ ID NO: 208651 - DNA, 20 bp, Artificial Sequence
  Description of Artificial Sequence: Synthetic oligonucleotide
  Target: ATXN1; (-) strand; PAM type: YTN; PAM sequence: CTA
acctcagacctgcctttagc

SEQ ID NO: 208652 - DNA, 20 bp, Artificial Sequence
  Description of Artificial Sequence: Synthetic oligonucleotide
  Target: ATXN1; (-) strand; PAM type: YTN; PAM sequence: CTG
ggaaatgggctaacctcaga

SEQ ID NO: 208653 - DNA, 20 bp, Artificial Sequence
  Description of Artificial Sequence: Synthetic oligonucleotide
  Target: ATXN1; (-) strand; PAM type: YTN; PAM sequence: TTG
gaaggagaaaagccagggga

SEQ ID NO: 208654 - DNA, 20 bp, Artificial Sequence
  Description of Artificial Sequence: Synthetic oligonucleotide
  Target: ATXN1; (-) strand; PAM type: YTN; PAM sequence: CTT
ggaaggagaaaagccagggg

SEQ ID NO: 208655 - DNA, 20 bp, Artificial Sequence
  Description of Artificial Sequence: Synthetic oligonucleotide
  Target: ATXN1; (-) strand; PAM type: YTN; PAM sequence: CTC
ttggaaggagaaaagccagg

SEQ ID NO: 208656 - DNA, 20 bp, Artificial Sequence
  Description of Artificial Sequence: Synthetic oligonucleotide
  Target: ATXN1; (-) strand; PAM type: YTN; PAM sequence: TTA
aagcctcttggaaggagaaa

SEQ ID NO: 208657 - DNA, 20 bp, Artificial Sequence
  Description of Artificial Sequence: Synthetic oligonucleotide
  Target: ATXN1; (-) strand; PAM type: YTN; PAM sequence: CTT
aaagcctcttggaaggagaa

SEQ ID NO: 208658 - DNA, 20 bp, Artificial Sequence
  Description of Artificial Sequence: Synthetic oligonucleotide
  Target: ATXN1; (-) strand; PAM type: YTN; PAM sequence: TTG
aggcaggggaccagaaggag

SEQ ID NO: 208659 - DNA, 20 bp, Artificial Sequence
  Description of Artificial Sequence: Synthetic oligonucleotide
  Target: ATXN1; (-) strand; PAM type: YTN; PAM sequence: CTG
ggtgagttgaggcaggggac

SEQ ID NO: 208660 - DNA, 20 bp, Artificial Sequence
  Description of Artificial Sequence: Synthetic oligonucleotide
  Target: ATXN1; (-) strand; PAM type: YTN; PAM sequence: CTC
tgggtgagttgaggcagggg

SEQ ID NO: 208661 - DNA, 20 bp, Artificial Sequence
  Description of Artificial Sequence: Synthetic oligonucleotide
  Target: ATXN1; (-) strand; PAM type: YTN; PAM sequence: CTC
agtctctgggtgagttgagg

SEQ ID NO: 208662 - DNA, 20 bp, Artificial Sequence
  Description of Artificial Sequence: Synthetic oligonucleotide
  Target: ATXN1; (-) strand; PAM type: YTN; PAM sequence: TTC
tcagtctctgggtgagttga

SEQ ID NO: 208663 - DNA, 20 bp, Artificial Sequence
  Description of Artificial Sequence: Synthetic oligonucleotide
  Target: ATXN1; (-) strand; PAM type: YTN; PAM sequence: CTG
cattctcagtctctgggtga

SEQ ID NO: 208664 - DNA, 20 bp, Artificial Sequence
  Description of Artificial Sequence: Synthetic oligonucleotide
  Target: ATXN1; (-) strand; PAM type: YTN; PAM sequence: CTG
gaaagggaaggtggcccagt

SEQ ID NO: 208665 - DNA, 20 bp, Artificial Sequence
  Description of Artificial Sequence: Synthetic oligonucleotide
  Target: ATXN1; (-) strand; PAM type: YTN; PAM sequence: TTA
cagaatggagtatggagcct

SEQ ID NO: 208666 - DNA, 20 bp, Artificial Sequence
  Description of Artificial Sequence: Synthetic oligonucleotide
  Target: ATXN1; (-) strand; PAM type: YTN; PAM sequence: TTA
ttacagaatggagtatggag

SEQ ID NO: 208667 - DNA, 20 bp, Artificial Sequence
  Description of Artificial Sequence: Synthetic oligonucleotide
  Target: ATXN1; (-) strand; PAM type: YTN; PAM sequence: TTT
attacagaatggagtatgga

SEQ ID NO: 208668 - DNA, 20 bp, Artificial Sequence
  Description of Artificial Sequence: Synthetic oligonucleotide
  Target: ATXN1; (-) strand; PAM type: YTN; PAM sequence: CTT
tattacagaatggagtatgg

SEQ ID NO: 208669 - DNA, 20 bp, Artificial Sequence
  Description of Artificial Sequence: Synthetic oligonucleotide
  Target: ATXN1; (-) strand; PAM type: YTN; PAM sequence: CTC
cccatgagaactttattaca

SEQ ID NO: 208670 - DNA, 20 bp, Artificial Sequence
  Description of Artificial Sequence: Synthetic oligonucleotide
  Target: ATXN1; (-) strand; PAM type: YTN; PAM sequence: TTG
gaggtctccccatgagaact

SEQ ID NO: 208671 - DNA, 20 bp, Artificial Sequence
  Description of Artificial Sequence: Synthetic oligonucleotide
  Target: ATXN1; (-) strand; PAM type: YTN; PAM sequence: CTG
ttggaggtctccccatgaga

SEQ ID NO: 208672 - DNA, 20 bp, Artificial Sequence
  Description of Artificial Sequence: Synthetic oligonucleotide
  Target: ATXN1; (-) strand; PAM type: YTN; PAM sequence: TTG
ggctgttggaggtctcccca

SEQ ID NO: 208673 - DNA, 20 bp, Artificial Sequence
  Description of Artificial Sequence: Synthetic oligonucleotide
  Target: ATXN1; (-) strand; PAM type: YTN; PAM sequence: CTG
ttgggctgttggaggtctcc

SEQ ID NO: 208674 - DNA, 20 bp, Artificial Sequence
  Description of Artificial Sequence: Synthetic oligonucleotide
  Target: ATXN1; (-) strand; PAM type: YTN; PAM sequence: CTC
aactgttgggctgttggagg

SEQ ID NO: 208675 - DNA, 20 bp, Artificial Sequence
  Description of Artificial Sequence: Synthetic oligonucleotide
  Target: ATXN1; (-) strand; PAM type: YTN; PAM sequence: CTG
tgtacactcaactgttgggc

SEQ ID NO: 208676 - DNA, 20 bp, Artificial Sequence
  Description of Artificial Sequence: Synthetic oligonucleotide
  Target: ATXN1; (-) strand; PAM type: YTN; PAM sequence: CTC
aaggctgtgtacactcaact

SEQ ID NO: 208677 - DNA, 20 bp, Artificial Sequence
  Description of Artificial Sequence: Synthetic oligonucleotide
  Target: ATXN1; (-) strand; PAM type: YTN; PAM sequence: CTA
agcactcaaggctgtgtaca

SEQ ID NO: 208678 - DNA, 20 bp, Artificial Sequence
  Description of Artificial Sequence: Synthetic oligonucleotide
  Target: ATXN1; (-) strand; PAM type: YTN; PAM sequence: CTG
gccgctaagcactcaaggct

SEQ ID NO: 208679 - DNA, 20 bp, Artificial Sequence
  Description of Artificial Sequence: Synthetic oligonucleotide
  Target: ATXN1; (-) strand; PAM type: YTN; PAM sequence: TTC
tggccgctaagcactcaagg

SEQ ID NO: 208680 - DNA, 20 bp, Artificial Sequence
  Description of Artificial Sequence: Synthetic oligonucleotide
  Target: ATXN1; (-) strand; PAM type: YTN; PAM sequence: TTC
aatgaggttctggccgctaa

SEQ ID NO: 208681 - DNA, 20 bp, Artificial Sequence
  Description of Artificial Sequence: Synthetic oligonucleotide
  Target: ATXN1; (-) strand; PAM type: YTN; PAM sequence: TTT
caatgaggttctggccgcta

SEQ ID NO: 208682 - DNA, 20 bp, Artificial Sequence
  Description of Artificial Sequence: Synthetic oligonucleotide
  Target: ATXN1; (-) strand; PAM type: YTN; PAM sequence: TTT
tcaatgaggttctggccgct

SEQ ID NO: 208683 - DNA, 20 bp, Artificial Sequence
  Description of Artificial Sequence: Synthetic oligonucleotide
  Target: ATXN1; (-) strand; PAM type: YTN; PAM sequence: CTG
tgttttcaatgaggttctgg

SEQ ID NO: 208684 - DNA, 20 bp, Artificial Sequence
  Description of Artificial Sequence: Synthetic oligonucleotide
  Target: ATXN1; (-) strand; PAM type: YTN; PAM sequence: TTA
tggaactgtgttttcaatga

SEQ ID NO: 208685 - DNA, 20 bp, Artificial Sequence
  Description of Artificial Sequence: Synthetic oligonucleotide
  Target: ATXN1; (-) strand; PAM type: YTN; PAM sequence: CTT
atggaactgtgttttcaatg

SEQ ID NO: 208686 - DNA, 20 bp, Artificial Sequence
  Description of Artificial Sequence: Synthetic oligonucleotide
  Target: ATXN1; (-) strand; PAM type: YTN; PAM sequence: TTC
cttatggaactgtgttttca

SEQ ID NO: 208687 - DNA, 20 bp, Artificial Sequence
  Description of Artificial Sequence: Synthetic oligonucleotide
  Target: ATXN1; (-) strand; PAM type: YTN; PAM sequence: TTT
ccttatggaactgtgttttc

SEQ ID NO: 208688 - DNA, 20 bp, Artificial Sequence
  Description of Artificial Sequence: Synthetic oligonucleotide
  Target: ATXN1; (-) strand; PAM type: YTN; PAM sequence: CTT
tccttatggaactgtgtttt

SEQ ID NO: 208689 - DNA, 20 bp, Artificial Sequence
  Description of Artificial Sequence: Synthetic oligonucleotide
  Target: ATXN1; (-) strand; PAM type: YTN; PAM sequence: CTG
cctttccttatggaactgtg

SEQ ID NO: 208690 - DNA, 20 bp, Artificial Sequence
  Description of Artificial Sequence: Synthetic oligonucleotide
  Target: ATXN1; (-) strand; PAM type: YTN; PAM sequence: TTA
aaacctgcctttccttatgg

SEQ ID NO: 208691 - DNA, 20 bp, Artificial Sequence
  Description of Artificial Sequence: Synthetic oligonucleotide
  Target: ATXN1; (-) strand; PAM type: YTN; PAM sequence: CTT
aaaacctgcctttccttatg

SEQ ID NO: 208692 - DNA, 20 bp, Artificial Sequence
  Description of Artificial Sequence: Synthetic oligonucleotide
  Target: ATXN1; (-) strand; PAM type: YTN; PAM sequence: CTC
gtcttaaaacctgcctttcc

SEQ ID NO: 208693 - DNA, 20 bp, Artificial Sequence
  Description of Artificial Sequence: Synthetic oligonucleotide
  Target: ATXN1; (-) strand; PAM type: YTN; PAM sequence: CTG
ctcgtcttaaaacctgcctt

SEQ ID NO: 208694 - DNA, 20 bp, Artificial Sequence
  Description of Artificial Sequence: Synthetic oligonucleotide
  Target: ATXN1; (-) strand; PAM type: YTN; PAM sequence: CTG
gtcacctgctcgtcttaaaa

SEQ ID NO: 208695 - DNA, 20 bp, Artificial Sequence
  Description of Artificial Sequence: Synthetic oligonucleotide
  Target: ATXN1; (-) strand; PAM type: YTN; PAM sequence: CTG
cctggtcacctgctcgtctt

SEQ ID NO: 208696 - DNA, 20 bp, Artificial Sequence
  Description of Artificial Sequence: Synthetic oligonucleotide
  Target: ATXN1; (-) strand; PAM type: YTN; PAM sequence: TTA
tggtgggggcctgcctggtc

SEQ ID NO: 208697 - DNA, 20 bp, Artificial Sequence
  Description of Artificial Sequence: Synthetic oligonucleotide
  Target: ATXN1; (-) strand; PAM type: YTN; PAM sequence: TTT
atggtgggggcctgcctggt

SEQ ID NO: 208698 - DNA, 20 bp, Artificial Sequence
  Description of Artificial Sequence: Synthetic oligonucleotide
  Target: ATXN1; (-) strand; PAM type: YTN; PAM sequence: CTC
accccatttatggtgggggc

SEQ ID NO: 208699 - DNA, 20 bp, Artificial Sequence
  Description of Artificial Sequence: Synthetic oligonucleotide
  Target: ATXN1; (-) strand; PAM type: YTN; PAM sequence: TTG
gcgagctcaccccatttatg

SEQ ID NO: 208700 - DNA, 20 bp, Artificial Sequence
  Description of Artificial Sequence: Synthetic oligonucleotide
  Target: ATXN1; (-) strand; PAM type: YTN; PAM sequence: TTT
ggcgagctcaccccatttat

SEQ ID NO: 208701 - DNA, 20 bp, Artificial Sequence
  Description of Artificial Sequence: Synthetic oligonucleotide
  Target: ATXN1; (-) strand; PAM type: YTN; PAM sequence: TTT
tggcgagctcaccccattta

SEQ ID NO: 208702 - DNA, 20 bp, Artificial Sequence
  Description of Artificial Sequence: Synthetic oligonucleotide
  Target: ATXN1; (-) strand; PAM type: YTN; PAM sequence: CTT
ttggcgagctcaccccattt

SEQ ID NO: 208703 - DNA, 20 bp, Artificial Sequence
  Description of Artificial Sequence: Synthetic oligonucleotide
  Target: ATXN1; (-) strand; PAM type: YTN; PAM sequence: CTA
gcttttggcgagctcacccc

SEQ ID NO: 208704 - DNA, 20 bp, Artificial Sequence
  Description of Artificial Sequence: Synthetic oligonucleotide
  Target: ATXN1; (-) strand; PAM type: YTN; PAM sequence: CTA
agtcaagcctagcttttggc

SEQ ID NO: 208705 - DNA, 20 bp, Artificial Sequence
  Description of Artificial Sequence: Synthetic oligonucleotide
  Target: ATXN1; (-) strand; PAM type: YTN; PAM sequence: CTC
caaatgaggcctaagtcaag

SEQ ID NO: 208706 - DNA, 20 bp, Artificial Sequence
  Description of Artificial Sequence: Synthetic oligonucleotide
  Target: ATXN1; (-) strand; PAM type: YTN; PAM sequence: CTC
agacctccaaatgaggccta

SEQ ID NO: 208707 - DNA, 20 bp, Artificial Sequence
  Description of Artificial Sequence: Synthetic oligonucleotide
  Target: ATXN1; (-) strand; PAM type: YTN; PAM sequence: TTC
aactcagacctccaaatgag

SEQ ID NO: 208708 - DNA, 20 bp, Artificial Sequence
  Description of Artificial Sequence: Synthetic oligonucleotide
  Target: ATXN1; (-) strand; PAM type: YTN; PAM sequence: TTG
aaattcaactcagacctcca

SEQ ID NO: 208709 - DNA, 20 bp, Artificial Sequence
  Description of Artificial Sequence: Synthetic oligonucleotide
  Target: ATXN1; (-) strand; PAM type: YTN; PAM sequence: TTT
gaaattcaactcagacctcc

SEQ ID NO: 208710 - DNA, 20 bp, Artificial Sequence
  Description of Artificial Sequence: Synthetic oligonucleotide
  Target: ATXN1; (-) strand; PAM type: YTN; PAM sequence: TTT
tgaaattcaactcagacctc

SEQ ID NO: 208711 - DNA, 20 bp, Artificial Sequence
  Description of Artificial Sequence: Synthetic oligonucleotide
  Target: ATXN1; (-) strand; PAM type: YTN; PAM sequence: TTT
ttgaaattcaactcagacct

SEQ ID NO: 208712 - DNA, 20 bp, Artificial Sequence
  Description of Artificial Sequence: Synthetic oligonucleotide
  Target: ATXN1; (-) strand; PAM type: YTN; PAM sequence: TTG
atttttgaaattcaactcag

SEQ ID NO: 208713 - DNA, 20 bp, Artificial Sequence
  Description of Artificial Sequence: Synthetic oligonucleotide
  Target: ATXN1; (-) strand; PAM type: YTN; PAM sequence: TTT
gatttttgaaattcaactca

SEQ ID NO: 208714 - DNA, 20 bp, Artificial Sequence
  Description of Artificial Sequence: Synthetic oligonucleotide
  Target: ATXN1; (-) strand; PAM type: YTN; PAM sequence: TTG
tatttgatttttgaaattca

SEQ ID NO: 208715 - DNA, 20 bp, Artificial Sequence
  Description of Artificial Sequence: Synthetic oligonucleotide
  Target: ATXN1; (-) strand; PAM type: YTN; PAM sequence: TTT
gtatttgatttttgaaattc

SEQ ID NO: 208716 - DNA, 20 bp, Artificial Sequence
  Description of Artificial Sequence: Synthetic oligonucleotide
  Target: ATXN1; (-) strand; PAM type: YTN; PAM sequence: TTT
tgtatttgatttttgaaatt

SEQ ID NO: 208717 - DNA, 20 bp, Artificial Sequence
  Description of Artificial Sequence: Synthetic oligonucleotide
  Target: ATXN1; (-) strand; PAM type: YTN; PAM sequence: TTT
ttgtatttgatttttgaaat

SEQ ID NO: 208718 - DNA, 20 bp, Artificial Sequence
  Description of Artificial Sequence: Synthetic oligonucleotide
  Target: ATXN1; (-) strand; PAM type: YTN; PAM sequence: CTG
ccagtgtttttgtatttgat

SEQ ID NO: 208719 - DNA, 20 bp, Artificial Sequence
  Description of Artificial Sequence: Synthetic oligonucleotide
  Target: ATXN1; (-) strand; PAM type: YTN; PAM sequence: TTC
tgccagtgtttttgtatttg

SEQ ID NO: 208720 - DNA, 20 bp, Artificial Sequence
  Description of Artificial Sequence: Synthetic oligonucleotide
  Target: ATXN1; (-) strand; PAM type: YTN; PAM sequence: CTT
ctgccagtgtttttgtattt

SEQ ID NO: 208721 - DNA, 20 bp, Artificial Sequence
  Description of Artificial Sequence: Synthetic oligonucleotide
  Target: ATXN1; (-) strand; PAM type: YTN; PAM sequence: CTA
aacttctgccagtgtttttg

SEQ ID NO: 208722 - DNA, 20 bp, Artificial Sequence
  Description of Artificial Sequence: Synthetic oligonucleotide
  Target: ATXN1; (-) strand; PAM type: YTN; PAM sequence: CTC
taaacttctgccagtgtttt

SEQ ID NO: 208723 - DNA, 20 bp, Artificial Sequence
  Description of Artificial Sequence: Synthetic oligonucleotide
  Target: ATXN1; (-) strand; PAM type: YTN; PAM sequence: CTC
tctaaacttctgccagtgtt

SEQ ID NO: 208724 - DNA, 20 bp, Artificial Sequence
  Description of Artificial Sequence: Synthetic oligonucleotide
  Target: ATXN1; (-) strand; PAM type: YTN; PAM sequence: CTG
cctctctaaacttctgccag

SEQ ID NO: 208725 - DNA, 20 bp, Artificial Sequence
  Description of Artificial Sequence: Synthetic oligonucleotide
  Target: ATXN1; (-) strand; PAM type: YTN; PAM sequence: TTC
tgcctctctaaacttctgcc

SEQ ID NO: 208726 - DNA, 20 bp, Artificial Sequence
  Description of Artificial Sequence: Synthetic oligonucleotide
  Target: ATXN1; (-) strand; PAM type: YTN; PAM sequence: TTT
ctgcctctctaaacttctgc

SEQ ID NO: 208727 - DNA, 20 bp, Artificial Sequence
  Description of Artificial Sequence: Synthetic oligonucleotide
  Target: ATXN1; (-) strand; PAM type: YTN; PAM sequence: TTT
tctgcctctctaaacttctg

SEQ ID NO: 208728 - DNA, 20 bp, Artificial Sequence
  Description of Artificial Sequence: Synthetic oligonucleotide
  Target: ATXN1; (-) strand; PAM type: YTN; PAM sequence: CTT
ttctgcctctctaaacttct

SEQ ID NO: 208729 - DNA, 20 bp, Artificial Sequence
  Description of Artificial Sequence: Synthetic oligonucleotide
  Target: ATXN1; (-) strand; PAM type: YTN; PAM sequence: CTC
ttttctgcctctctaaactt

SEQ ID NO: 208730 - DNA, 20 bp, Artificial Sequence
  Description of Artificial Sequence: Synthetic oligonucleotide
  Target: ATXN1; (-) strand; PAM type: YTN; PAM sequence: TTG
tggtaatgctcttttctgcc

SEQ ID NO: 208731 - DNA, 20 bp, Artificial Sequence
  Description of Artificial Sequence: Synthetic oligonucleotide
  Target: ATXN1; (-) strand; PAM type: YTN; PAM sequence: CTT
gtggtaatgctcttttctgc

SEQ ID NO: 208732 - DNA, 20 bp, Artificial Sequence
  Description of Artificial Sequence: Synthetic oligonucleotide
  Target: ATXN1; (-) strand; PAM type: YTN; PAM sequence: TTC
ttgtggtaatgctcttttct

SEQ ID NO: 208733 - DNA, 20 bp, Artificial Sequence
  Description of Artificial Sequence: Synthetic oligonucleotide
  Target: ATXN1; (-) strand; PAM type: YTN; PAM sequence: TTT
cttgtggtaatgctcttttc

SEQ ID NO: 208734 - DNA, 20 bp, Artificial Sequence
  Description of Artificial Sequence: Synthetic oligonucleotide
  Target: ATXN1; (-) strand; PAM type: YTN; PAM sequence: TTT
tcttgtggtaatgctctttt

SEQ ID NO: 208735 - DNA, 20 bp, Artificial Sequence
  Description of Artificial Sequence: Synthetic oligonucleotide
  Target: ATXN1; (-) strand; PAM type: YTN; PAM sequence: CTT
ttcttgtggtaatgctcttt

SEQ ID NO: 208736 - DNA, 20 bp, Artificial Sequence
  Description of Artificial Sequence: Synthetic oligonucleotide
  Target: ATXN1; (-) strand; PAM type: YTN; PAM sequence: CTC
ccgcgtcttttcttgtggta

SEQ ID NO: 208737 - DNA, 20 bp, Artificial Sequence
  Description of Artificial Sequence: Synthetic oligonucleotide
  Target: ATXN1; (-) strand; PAM type: YTN; PAM sequence: CTG
gtgaagcctcccgcgtcttt

SEQ ID NO: 208738 - DNA, 20 bp, Artificial Sequence
  Description of Artificial Sequence: Synthetic oligonucleotide
  Target: ATXN1; (-) strand; PAM type: YTN; PAM sequence: TTC
tggtgaagcctcccgcgtct

SEQ ID NO: 208739 - DNA, 20 bp, Artificial Sequence
  Description of Artificial Sequence: Synthetic oligonucleotide
  Target: ATXN1; (-) strand; PAM type: YTN; PAM sequence: CTG
ttctggtgaagcctcccgcg

SEQ ID NO: 208740 - DNA, 20 bp, Artificial Sequence
  Description of Artificial Sequence: Synthetic oligonucleotide
  Target: ATXN1; (-) strand; PAM type: YTN; PAM sequence: CTG
cctgttctggtgaagcctcc

SEQ ID NO: 208741 - DNA, 20 bp, Artificial Sequence
  Description of Artificial Sequence: Synthetic oligonucleotide
  Target: ATXN1; (-) strand; PAM type: YTN; PAM sequence: CTC
ctgcctgttctggtgaagcc

SEQ ID NO: 208742 - DNA, 20 bp, Artificial Sequence
  Description of Artificial Sequence: Synthetic oligonucleotide
  Target: ATXN1; (-) strand; PAM type: YTN; PAM sequence: TTC
ctcctgcctgttctggtgaa

SEQ ID NO: 208743 - DNA, 20 bp, Artificial Sequence
  Description of Artificial Sequence: Synthetic oligonucleotide
  Target: ATXN1; (-) strand; PAM type: YTN; PAM sequence: CTT
cctcctgcctgttctggtga

SEQ ID NO: 208744 - DNA, 20 bp, Artificial Sequence
  Description of Artificial Sequence: Synthetic oligonucleotide
  Target: ATXN1; (-) strand; PAM type: YTN; PAM sequence: CTA
cttcctcctgcctgttctgg

SEQ ID NO: 208745 - DNA, 20 bp, Artificial Sequence
  Description of Artificial Sequence: Synthetic oligonucleotide
  Target: ATXN1; (-) strand; PAM type: YTN; PAM sequence: CTC
acctacttcctcctgcctgt

SEQ ID NO: 208746 - DNA, 20 bp, Artificial Sequence
  Description of Artificial Sequence: Synthetic oligonucleotide
  Target: ATXN1; (-) strand; PAM type: YTN; PAM sequence: CTG
tgcctcacctacttcctcct

SEQ ID NO: 208747 - DNA, 20 bp, Artificial Sequence
  Description of Artificial Sequence: Synthetic oligonucleotide
  Target: ATXN1; (-) strand; PAM type: YTN; PAM sequence: CTG
ctgtgcctcacctacttcct

SEQ ID NO: 208748 - DNA, 20 bp, Artificial Sequence
  Description of Artificial Sequence: Synthetic oligonucleotide
  Target: ATXN1; (-) strand; PAM type: YTN; PAM sequence: TTC
acctgctgtgcctcacctac

SEQ ID NO: 208749 - DNA, 20 bp, Artificial Sequence
  Description of Artificial Sequence: Synthetic oligonucleotide
  Target: ATXN1; (-) strand; PAM type: YTN; PAM sequence: CTT
cacctgctgtgcctcaccta

SEQ ID NO: 208750 - DNA, 20 bp, Artificial Sequence
  Description of Artificial Sequence: Synthetic oligonucleotide
  Target: ATXN1; (-) strand; PAM type: YTN; PAM sequence: TTC
ccccacttcacctgctgtgc

SEQ ID NO: 208751 - DNA, 20 bp, Artificial Sequence
  Description of Artificial Sequence: Synthetic oligonucleotide
  Target: ATXN1; (-) strand; PAM type: YTN; PAM sequence: CTT
cccccacttcacctgctgtg

SEQ ID NO: 208752 - DNA, 20 bp, Artificial Sequence
  Description of Artificial Sequence: Synthetic oligonucleotide
  Target: ATXN1; (-) strand; PAM type: YTN; PAM sequence: CTG
gtggaacacttcccccactt

SEQ ID NO: 208753 - DNA, 20 bp, Artificial Sequence
  Description of Artificial Sequence: Synthetic oligonucleotide
  Target: ATXN1; (-) strand; PAM type: YTN; PAM sequence: TTC
acctggtggaacacttcccc

SEQ ID NO: 208754 - DNA, 20 bp, Artificial Sequence
  Description of Artificial Sequence: Synthetic oligonucleotide
  Target: ATXN1; (-) strand; PAM type: YTN; PAM sequence: TTT
cacctggtggaacacttccc

SEQ ID NO: 208755 - DNA, 20 bp, Artificial Sequence
  Description of Artificial Sequence: Synthetic oligonucleotide
  Target: ATXN1; (-) strand; PAM type: YTN; PAM sequence: CTG
taccccacagccaccaggcc

SEQ ID NO: 208756 - DNA, 20 bp, Artificial Sequence
  Description of Artificial Sequence: Synthetic oligonucleotide
  Target: ATXN1; (-) strand; PAM type: YTN; PAM sequence: TTC
ccctgtaccccacagccacc

SEQ ID NO: 208757 - DNA, 20 bp, Artificial Sequence
  Description of Artificial Sequence: Synthetic oligonucleotide
  Target: ATXN1; (-) strand; PAM type: YTN; PAM sequence: CTT
cccctgtaccccacagccac

SEQ ID NO: 208758 - DNA, 20 bp, Artificial Sequence
  Description of Artificial Sequence: Synthetic oligonucleotide
  Target: ATXN1; (-) strand; PAM type: YTN; PAM sequence: CTC
ttcccctgtaccccacagcc

SEQ ID NO: 208759 - DNA, 20 bp, Artificial Sequence
  Description of Artificial Sequence: Synthetic oligonucleotide
  Target: ATXN1; (-) strand; PAM type: YTN; PAM sequence: CTC
acctcttcccctgtacccca

SEQ ID NO: 208760 - DNA, 20 bp, Artificial Sequence
  Description of Artificial Sequence: Synthetic oligonucleotide
  Target: ATXN1; (-) strand; PAM type: YTN; PAM sequence: CTG
ctcacctcttcccctgtacc

SEQ ID NO: 208761 - DNA, 20 bp, Artificial Sequence
  Description of Artificial Sequence: Synthetic oligonucleotide
  Target: ATXN1; (-) strand; PAM type: YTN; PAM sequence: CTC
atccccaccccagcctgctc

SEQ ID NO: 208762 - DNA, 20 bp, Artificial Sequence
  Description of Artificial Sequence: Synthetic oligonucleotide
  Target: ATXN1; (-) strand; PAM type: YTN; PAM sequence: CTG
tcctcatccccaccccagcc

SEQ ID NO: 208763 - DNA, 20 bp, Artificial Sequence
  Description of Artificial Sequence: Synthetic oligonucleotide
  Target: ATXN1; (-) strand; PAM type: YTN; PAM sequence: CTG
ccactgtcctcatccccacc

SEQ ID NO: 208764 - DNA, 20 bp, Artificial Sequence
  Description of Artificial Sequence: Synthetic oligonucleotide
  Target: ATXN1; (-) strand; PAM type: YTN; PAM sequence: TTC
tgccactgtcctcatcccca

SEQ ID NO: 208765 - DNA, 20 bp, Artificial Sequence
  Description of Artificial Sequence: Synthetic oligonucleotide
  Target: ATXN1; (-) strand; PAM type: YTN; PAM sequence: CTT
ctgccactgtcctcatcccc

SEQ ID NO: 208766 - DNA, 20 bp, Artificial Sequence
  Description of Artificial Sequence: Synthetic oligonucleotide
  Target: ATXN1; (-) strand; PAM type: YTN; PAM sequence: TTC
gtcaatcttctgccactgtc

SEQ ID NO: 208767 - DNA, 20 bp, Artificial Sequence
  Description of Artificial Sequence: Synthetic oligonucleotide
  Target: ATXN1; (-) strand; PAM type: YTN; PAM sequence: CTT
cgtcaatcttctgccactgt

SEQ ID NO: 208768 - DNA, 20 bp, Artificial Sequence
  Description of Artificial Sequence: Synthetic oligonucleotide
  Target: ATXN1; (-) strand; PAM type: YTN; PAM sequence: CTG
cacaatgccttcgtcaatct

SEQ ID NO: 208769 - DNA, 20 bp, Artificial Sequence
  Description of Artificial Sequence: Synthetic oligonucleotide
  Target: ATXN1; (-) strand; PAM type: YTN; PAM sequence: TTG
catggggtgctgcacaatgc

SEQ ID NO: 208770 - DNA, 20 bp, Artificial Sequence
  Description of Artificial Sequence: Synthetic oligonucleotide
  Target: ATXN1; (-) strand; PAM type: YTN; PAM sequence: TTT
gcatggggtgctgcacaatg

SEQ ID NO: 208771 - DNA, 20 bp, Artificial Sequence
  Description of Artificial Sequence: Synthetic oligonucleotide
  Target: ATXN1; (-) strand; PAM type: YTN; PAM sequence: CTT
tgcatggggtgctgcacaat

SEQ ID NO: 208772 - DNA, 20 bp, Artificial Sequence
  Description of Artificial Sequence: Synthetic oligonucleotide
  Target: ATXN1; (-) strand; PAM type: YTN; PAM sequence: CTG
tgtgacggagaggcgcccct

SEQ ID NO: 208773 - DNA, 20 bp, Artificial Sequence
  Description of Artificial Sequence: Synthetic oligonucleotide
  Target: ATXN1; (-) strand; PAM type: YTN; PAM sequence: CTC
atgccagtacctgtgtgacg

SEQ ID NO: 208774 - DNA, 20 bp, Artificial Sequence
  Description of Artificial Sequence: Synthetic oligonucleotide
  Target: ATXN1; (-) strand; PAM type: YTN; PAM sequence: CTC
ggtccccacaccctcatgcc

SEQ ID NO: 208775 - DNA, 20 bp, Artificial Sequence
  Description of Artificial Sequence: Synthetic oligonucleotide
  Target: ATXN1; (-) strand; PAM type: YTN; PAM sequence: CTC
ataggactcggtccccacac

SEQ ID NO: 208776 - DNA, 20 bp, Artificial Sequence
  Description of Artificial Sequence: Synthetic oligonucleotide
  Target: ATXN1; (-) strand; PAM type: YTN; PAM sequence: CTG
gtagagacccaggaactcat

SEQ ID NO: 208777 - DNA, 20 bp, Artificial Sequence
  Description of Artificial Sequence: Synthetic oligonucleotide
  Target: ATXN1; (-) strand; PAM type: YTN; PAM sequence: CTG
gaaaatcctggtagagaccc

SEQ ID NO: 208778 - DNA, 20 bp, Artificial Sequence
  Description of Artificial Sequence: Synthetic oligonucleotide
  Target: ATXN1; (-) strand; PAM type: YTN; PAM sequence: CTG
acctggaaaatcctggtaga

SEQ ID NO: 208779 - DNA, 20 bp, Artificial Sequence
  Description of Artificial Sequence: Synthetic oligonucleotide
  Target: ATXN1; (-) strand; PAM type: YTN; PAM sequence: CTC
gatgctgacctggaaaatcc

SEQ ID NO: 208780 - DNA, 20 bp, Artificial Sequence
  Description of Artificial Sequence: Synthetic oligonucleotide
  Target: ATXN1; (-) strand; PAM type: YTN; PAM sequence: CTA
ggagagatagtatcactcga

SEQ ID NO: 208781 - DNA, 20 bp, Artificial Sequence
  Description of Artificial Sequence: Synthetic oligonucleotide
  Target: ATXN1; (-) strand; PAM type: YTN; PAM sequence: TTC
taggagagatagtatcactc

SEQ ID NO: 208782 - DNA, 20 bp, Artificial Sequence
  Description of Artificial Sequence: Synthetic oligonucleotide
  Target: ATXN1; (-) strand; PAM type: YTN; PAM sequence: CTT
ctaggagagatagtatcact

SEQ ID NO: 208783 - DNA, 20 bp, Artificial Sequence
  Description of Artificial Sequence: Synthetic oligonucleotide
  Target: ATXN1; (-) strand; PAM type: YTN; PAM sequence: TTC
ccaccacttctaggagagat

SEQ ID NO: 208784 - DNA, 20 bp, Artificial Sequence
  Description of Artificial Sequence: Synthetic oligonucleotide
  Target: ATXN1; (-) strand; PAM type: YTN; PAM sequence: TTC
ccatcagttcccaccacttc

SEQ ID NO: 208785 - DNA, 20 bp, Artificial Sequence
  Description of Artificial Sequence: Synthetic oligonucleotide
  Target: ATXN1; (-) strand; PAM type: YTN; PAM sequence: TTC
catggtcattcccatcagtt

SEQ ID NO: 208786 - DNA, 20 bp, Artificial Sequence
  Description of Artificial Sequence: Synthetic oligonucleotide
  Target: ATXN1; (-) strand; PAM type: YTN; PAM sequence: CTT
ccatggtcattcccatcagt

SEQ ID NO: 208787 - DNA, 20 bp, Artificial Sequence
  Description of Artificial Sequence: Synthetic oligonucleotide
  Target: ATXN1; (-) strand; PAM type: YTN; PAM sequence: TTC
agcttccatggtcattccca

SEQ ID NO: 208788 - DNA, 20 bp, Artificial Sequence
  Description of Artificial Sequence: Synthetic oligonucleotide
  Target: ATXN1; (-) strand; PAM type: YTN; PAM sequence: TTG
tggattcagcttccatggtc

SEQ ID NO: 208789 - DNA, 20 bp, Artificial Sequence
  Description of Artificial Sequence: Synthetic oligonucleotide
  Target: ATXN1; (-) strand; PAM type: YTN; PAM sequence: TTT
gtggattcagcttccatggt

SEQ ID NO: 208790 - DNA, 20 bp, Artificial Sequence
  Description of Artificial Sequence: Synthetic oligonucleotide
  Target: ATXN1; (-) strand; PAM type: YTN; PAM sequence: TTG
gtttgtggattcagcttcca

SEQ ID NO: 208791 - DNA, 20 bp, Artificial Sequence
  Description of Artificial Sequence: Synthetic oligonucleotide
  Target: ATXN1; (-) strand; PAM type: YTN; PAM sequence: CTT
ggtttgtggattcagcttcc

SEQ ID NO: 208792 - DNA, 20 bp, Artificial Sequence
  Description of Artificial Sequence: Synthetic oligonucleotide
  Target: ATXN1; (-) strand; PAM type: YTN; PAM sequence: TTA
tccatgagaggacaagataa

SEQ ID NO: 208793 - DNA, 20 bp, Artificial Sequence
  Description of Artificial Sequence: Synthetic oligonucleotide
  Target: ATXN1; (-) strand; PAM type: YTN; PAM sequence: CTT
atccatgagaggacaagata

SEQ ID NO: 208794 - DNA, 20 bp, Artificial Sequence
  Description of Artificial Sequence: Synthetic oligonucleotide
  Target: ATXN1; (-) strand; PAM type: YTN; PAM sequence: TTA
cgaagccttatccatgagag

SEQ ID NO: 208795 - DNA, 20 bp, Artificial Sequence
  Description of Artificial Sequence: Synthetic oligonucleotide
  Target: ATXN1; (-) strand; PAM type: YTN; PAM sequence: TTT
acgaagccttatccatgaga

SEQ ID NO: 208796 - DNA, 20 bp, Artificial Sequence
  Description of Artificial Sequence: Synthetic oligonucleotide
  Target: ATXN1; (-) strand; PAM type: YTN; PAM sequence: CTT
tacgaagccttatccatgag

SEQ ID NO: 208797 - DNA, 20 bp, Artificial Sequence
  Description of Artificial Sequence: Synthetic oligonucleotide
  Target: ATXN1; (-) strand; PAM type: YTN; PAM sequence: TTG
aggaatcccccctttacgaa

SEQ ID NO: 208798 - DNA, 20 bp, Artificial Sequence
  Description of Artificial Sequence: Synthetic oligonucleotide
  Target: ATXN1; (-) strand; PAM type: YTN; PAM sequence: CTT
gaggaatcccccctttacga

SEQ ID NO: 208799 - DNA, 20 bp, Artificial Sequence
  Description of Artificial Sequence: Synthetic oligonucleotide
  Target: ATXN1; (-) strand; PAM type: YTN; PAM sequence: TTA
aaagaccttgaggaatcccc

SEQ ID NO: 208800 - DNA, 20 bp, Artificial Sequence
  Description of Artificial Sequence: Synthetic oligonucleotide
  Target: ATXN1; (-) strand; PAM type: YTN; PAM sequence: TTG
gttaaaagaccttgaggaat

SEQ ID NO: 208801 - DNA, 20 bp, Artificial Sequence
  Description of Artificial Sequence: Synthetic oligonucleotide
  Target: ATXN1; (-) strand; PAM type: YTN; PAM sequence: CTT
ggttaaaagaccttgaggaa

SEQ ID NO: 208802 - DNA, 20 bp, Artificial Sequence
  Description of Artificial Sequence: Synthetic oligonucleotide
  Target: ATXN1; (-) strand; PAM type: YTN; PAM sequence: CTC
ccatgtgcagacttggttaa

SEQ ID NO: 208803 - DNA, 20 bp, Artificial Sequence
  Description of Artificial Sequence: Synthetic oligonucleotide
  Target: ATXN1; (-) strand; PAM type: YTN; PAM sequence: TTC
tcccatgtgcagacttggtt

SEQ ID NO: 208804 - DNA, 20 bp, Artificial Sequence
  Description of Artificial Sequence: Synthetic oligonucleotide
  Target: ATXN1; (-) strand; PAM type: YTN; PAM sequence: TTT
ctcccatgtgcagacttggt

SEQ ID NO: 208805 - DNA, 20 bp, Artificial Sequence
  Description of Artificial Sequence: Synthetic oligonucleotide
  Target: ATXN1; (-) strand; PAM type: YTN; PAM sequence: TTT
tctcccatgtgcagacttgg

SEQ ID NO: 208806 - DNA, 20 bp, Artificial Sequence
  Description of Artificial Sequence: Synthetic oligonucleotide
  Target: ATXN1; (-) strand; PAM type: YTN; PAM sequence: TTC
catcgttttctcccatgtgc

SEQ ID NO: 208807 - DNA, 20 bp, Artificial Sequence
  Description of Artificial Sequence: Synthetic oligonucleotide
  Target: ATXN1; (-) strand; PAM type: YTN; PAM sequence: TTT
ccatcgttttctcccatgtg

SEQ ID NO: 208808 - DNA, 20 bp, Artificial Sequence
  Description of Artificial Sequence: Synthetic oligonucleotide
  Target: ATXN1; (-) strand; PAM type: YTN; PAM sequence: CTT
tccatcgttttctcccatgt

SEQ ID NO: 208809 - DNA, 20 bp, Artificial Sequence
  Description of Artificial Sequence: Synthetic oligonucleotide
  Target: ATXN1; (-) strand; PAM type: YTN; PAM sequence: CTG
ctttccatcgttttctccca

SEQ ID NO: 208810 - DNA, 20 bp, Artificial Sequence
  Description of Artificial Sequence: Synthetic oligonucleotide
  Target: ATXN1; (-) strand; PAM type: YTN; PAM sequence: TTC
catctgctttccatcgtttt

SEQ ID NO: 208811 - DNA, 20 bp, Artificial Sequence
  Description of Artificial Sequence: Synthetic oligonucleotide
  Target: ATXN1; (-) strand; PAM type: YTN; PAM sequence: TTT
ccatctgctttccatcgttt

SEQ ID NO: 208812 - DNA, 20 bp, Artificial Sequence
  Description of Artificial Sequence: Synthetic oligonucleotide
  Target: ATXN1; (-) strand; PAM type: YTN; PAM sequence: TTG
agaagcatttccatctgctt

SEQ ID NO: 208813 - DNA, 20 bp, Artificial Sequence
  Description of Artificial Sequence: Synthetic oligonucleotide
  Target: ATXN1; (-) strand; PAM type: YTN; PAM sequence: CTT
gagaagcatttccatctgct

SEQ ID NO: 208814 - DNA, 20 bp, Artificial Sequence
  Description of Artificial Sequence: Synthetic oligonucleotide
  Target: ATXN1; (-) strand; PAM type: YTN; PAM sequence: TTC
ttgagaagcatttccatctg

SEQ ID NO: 208815 - DNA, 20 bp, Artificial Sequence
  Description of Artificial Sequence: Synthetic oligonucleotide
  Target: ATXN1; (-) strand; PAM type: YTN; PAM sequence: TTG
agaggttcttgagaagcatt

SEQ ID NO: 208816 - DNA, 20 bp, Artificial Sequence
  Description of Artificial Sequence: Synthetic oligonucleotide
  Target: ATXN1; (-) strand; PAM type: YTN; PAM sequence: TTG
tattgagaggttcttgagaa

SEQ ID NO: 208817 - DNA, 20 bp, Artificial Sequence
  Description of Artificial Sequence: Synthetic oligonucleotide
  Target: ATXN1; (-) strand; PAM type: YTN; PAM sequence: TTT
gtattgagaggttcttgaga

SEQ ID NO: 208818 - DNA, 20 bp, Artificial Sequence
  Description of Artificial Sequence: Synthetic oligonucleotide
  Target: ATXN1; (-) strand; PAM type: YTN; PAM sequence: CTT
tgtattgagaggttcttgag

SEQ ID NO: 208819 - DNA, 20 bp, Artificial Sequence
  Description of Artificial Sequence: Synthetic oligonucleotide
  Target: ATXN1; (-) strand; PAM type: YTN; PAM sequence: CTC
tttgtattgagaggttcttg

SEQ ID NO: 208820 - DNA, 20 bp, Artificial Sequence
  Description of Artificial Sequence: Synthetic oligonucleotide
  Target: ATXN1; (-) strand; PAM type: YTN; PAM sequence: TTA
tctctttgtattgagaggtt

SEQ ID NO: 208821 - DNA, 20 bp, Artificial Sequence
  Description of Artificial Sequence: Synthetic oligonucleotide
  Target: ATXN1; (-) strand; PAM type: YTN; PAM sequence: TTT
atctctttgtattgagaggt

SEQ ID NO: 208822 - DNA, 20 bp, Artificial Sequence
  Description of Artificial Sequence: Synthetic oligonucleotide
  Target: ATXN1; (-) strand; PAM type: YTN; PAM sequence: CTT
tatctctttgtattgagagg

SEQ ID NO: 208823 - DNA, 20 bp, Artificial Sequence
  Description of Artificial Sequence: Synthetic oligonucleotide
  Target: ATXN1; (-) strand; PAM type: YTN; PAM sequence: CTC
tttatctctttgtattgaga

SEQ ID NO: 208824 - DNA, 20 bp, Artificial Sequence
  Description of Artificial Sequence: Synthetic oligonucleotide
  Target: ATXN1; (-) strand; PAM type: YTN; PAM sequence: TTC
ctctttatctctttgtattg

SEQ ID NO: 208825 - DNA, 20 bp, Artificial Sequence
  Description of Artificial Sequence: Synthetic oligonucleotide
  Target: ATXN1; (-) strand; PAM type: YTN; PAM sequence: CTG
ttcctctttatctctttgta

SEQ ID NO: 208826 - DNA, 20 bp, Artificial Sequence
  Description of Artificial Sequence: Synthetic oligonucleotide
  Target: ATXN1; (-) strand; PAM type: YTN; PAM sequence: CTG
gcctgttcctctttatctct

SEQ ID NO: 208827 - DNA, 20 bp, Artificial Sequence
  Description of Artificial Sequence: Synthetic oligonucleotide
  Target: ATXN1; (-) strand; PAM type: YTN; PAM sequence: TTA
caggtgtgtgccatgtgcct

SEQ ID NO: 208828 - DNA, 20 bp, Artificial Sequence
  Description of Artificial Sequence: Synthetic oligonucleotide
  Target: ATXN1; (-) strand; PAM type: YTN; PAM sequence: CTG
aggttacaggtgtgtgccat

SEQ ID NO: 208829 - DNA, 20 bp, Artificial Sequence
  Description of Artificial Sequence: Synthetic oligonucleotide
  Target: ATXN1; (-) strand; PAM type: YTN; PAM sequence: TTC
caaagtgctgaggttacagg

SEQ ID NO: 208830 - DNA, 20 bp, Artificial Sequence
  Description of Artificial Sequence: Synthetic oligonucleotide
  Target: ATXN1; (-) strand; PAM type: YTN; PAM sequence: CTT
ccaaagtgctgaggttacag

SEQ ID NO: 208831 - DNA, 20 bp, Artificial Sequence
  Description of Artificial Sequence: Synthetic oligonucleotide
  Target: ATXN1; (-) strand; PAM type: YTN; PAM sequence: TTG
gccttccaaagtgctgaggt

SEQ ID NO: 208832 - DNA, 20 bp, Artificial Sequence
  Description of Artificial Sequence: Synthetic oligonucleotide
  Target: ATXN1; (-) strand; PAM type: YTN; PAM sequence: CTT
ggccttccaaagtgctgagg

SEQ ID NO: 208833 - DNA, 20 bp, Artificial Sequence
  Description of Artificial Sequence: Synthetic oligonucleotide
  Target: ATXN1; (-) strand; PAM type: YTN; PAM sequence: CTC
cttggccttccaaagtgctg

SEQ ID NO: 208834 - DNA, 20 bp, Artificial Sequence
  Description of Artificial Sequence: Synthetic oligonucleotide
  Target: ATXN1; (-) strand; PAM type: YTN; PAM sequence: TTC
cctccttggccttccaaagt

SEQ ID NO: 208835 - DNA, 20 bp, Artificial Sequence
  Description of Artificial Sequence: Synthetic oligonucleotide
  Target: ATXN1; (-) strand; PAM type: YTN; PAM sequence: CTT
ccctccttggccttccaaag

SEQ ID NO: 208836 - DNA, 20 bp, Artificial Sequence
  Description of Artificial Sequence: Synthetic oligonucleotide
  Target: ATXN1; (-) strand; PAM type: YTN; PAM sequence: CTC
aagtggtcttccctccttgg

SEQ ID NO: 208837 - DNA, 20 bp, Artificial Sequence
  Description of Artificial Sequence: Synthetic oligonucleotide
  Target: ATXN1; (-) strand; PAM type: YTN; PAM sequence: CTG
ggctcaagtggtcttccctc

SEQ ID NO: 208838 - DNA, 20 bp, Artificial Sequence
  Description of Artificial Sequence: Synthetic oligonucleotide
  Target: ATXN1; (-) strand; PAM type: YTN; PAM sequence: TTC
ctgggctcaagtggtcttcc

SEQ ID NO: 208839 - DNA, 20 bp, Artificial Sequence
  Description of Artificial Sequence: Synthetic oligonucleotide
  Target: ATXN1; (-) strand; PAM type: YTN; PAM sequence: TTG
aattcctgggctcaagtggt

SEQ ID NO: 208840 - DNA, 20 bp, Artificial Sequence
  Description of Artificial Sequence: Synthetic oligonucleotide
  Target: ATXN1; (-) strand; PAM type: YTN; PAM sequence: CTT
gaattcctgggctcaagtgg

SEQ ID NO: 208841 - DNA, 20 bp, Artificial Sequence
  Description of Artificial Sequence: Synthetic oligonucleotide
  Target: ATXN1; (-) strand; PAM type: YTN; PAM sequence: CTG
gtcttgaattcctgggctca

SEQ ID NO: 208842 - DNA, 20 bp, Artificial Sequence
  Description of Artificial Sequence: Synthetic oligonucleotide
  Target: ATXN1; (-) strand; PAM type: YTN; PAM sequence: TTG
cccaggctggtcttgaattc

SEQ ID NO: 208843 - DNA, 20 bp, Artificial Sequence
  Description of Artificial Sequence: Synthetic oligonucleotide
  Target: ATXN1; (-) strand; PAM type: YTN; PAM sequence: CTG
tgttgcccaggctggtcttg

SEQ ID NO: 208844 - DNA, 20 bp, Artificial Sequence
  Description of Artificial Sequence: Synthetic oligonucleotide
  Target: ATXN1; (-) strand; PAM type: YTN; PAM sequence: TTG
ctgtgttgcccaggctggtc

SEQ ID NO: 208845 - DNA, 20 bp, Artificial Sequence
  Description of Artificial Sequence: Synthetic oligonucleotide
  Target: ATXN1; (-) strand; PAM type: YTN; PAM sequence: TTT
gctgtgttgcccaggctggt

SEQ ID NO: 208846 - DNA, 20 bp, Artificial Sequence
  Description of Artificial Sequence: Synthetic oligonucleotide
  Target: ATXN1; (-) strand; PAM type: YTN; PAM sequence: TTT
tgctgtgttgcccaggctgg

SEQ ID NO: 208847 - DNA, 20 bp, Artificial Sequence
  Description of Artificial Sequence: Synthetic oligonucleotide
  Target: ATXN1; (-) strand; PAM type: YTN; PAM sequence: TTG
agacagagttttgctgtgtt

SEQ ID NO: 208848 - DNA, 20 bp, Artificial Sequence
  Description of Artificial Sequence: Synthetic oligonucleotide
  Target: ATXN1; (-) strand; PAM type: YTN; PAM sequence: TTT
gagacagagttttgctgtgt

SEQ ID NO: 208849 - DNA, 20 bp, Artificial Sequence
  Description of Artificial Sequence: Synthetic oligonucleotide
  Target: ATXN1; (-) strand; PAM type: YTN; PAM sequence: TTT
tgagacagagttttgctgtg

SEQ ID NO: 208850 - DNA, 20 bp, Artificial Sequence
  Description of Artificial Sequence: Synthetic oligonucleotide
  Target: ATXN1; (-) strand; PAM type: YTN; PAM sequence: TTT
ttgagacagagttttgctgt

SEQ ID NO: 208851 - DNA, 20 bp, Artificial Sequence
  Description of Artificial Sequence: Synthetic oligonucleotide
  Target: ATXN1; (-) strand; PAM type: YTN; PAM sequence: TTT
tttgagacagagttttgctg

SEQ ID NO: 208852 - DNA, 20 bp, Artificial Sequence
  Description of Artificial Sequence: Synthetic oligonucleotide
  Target: ATXN1; (-) strand; PAM type: YTN; PAM sequence: TTT
ttttgagacagagttttgct

SEQ ID NO: 208853 - DNA, 20 bp, Artificial Sequence
  Description of Artificial Sequence: Synthetic oligonucleotide
  Target: ATXN1; (-) strand; PAM type: YTN; PAM sequence: TTT
tttttgagacagagttttgc

SEQ ID NO: 208854 - DNA, 20 bp, Artificial Sequence
  Description of Artificial Sequence: Synthetic oligonucleotide
  Target: ATXN1; (-) strand; PAM type: YTN; PAM sequence: TTT
ttttttgagacagagttttg

SEQ ID NO: 208855 - DNA, 20 bp, Artificial Sequence
  Description of Artificial Sequence: Synthetic oligonucleotide
  Target: ATXN1; (-) strand; PAM type: YTN; PAM sequence: TTT
tttttttgagacagagtttt

SEQ ID NO: 208856 - DNA, 20 bp, Artificial Sequence
  Description of Artificial Sequence: Synthetic oligonucleotide
  Target: ATXN1; (-) strand; PAM type: YTN; PAM sequence: TTT
ttttttttgagacagagttt

SEQ ID NO: 208857 - DNA, 20 bp, Artificial Sequence
  Description of Artificial Sequence: Synthetic oligonucleotide
  Target: ATXN1; (-) strand; PAM type: YTN; PAM sequence: TTT
tttttttttgagacagagtt

SEQ ID NO: 208858 - DNA, 20 bp, Artificial Sequence
  Description of Artificial Sequence: Synthetic oligonucleotide
  Target: ATXN1; (-) strand; PAM type: YTN; PAM sequence: TTT
ttttttttttgagacagagt

SEQ ID NO: 208859 - DNA, 20 bp, Artificial Sequence
  Description of Artificial Sequence: Synthetic oligonucleotide
  Target: ATXN1; (-) strand; PAM type: YTN; PAM sequence: TTT
tttttttttttgagacagag

SEQ ID NO: 208860 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttgagacaga

SEQ ID NO: 208861 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttgagacag

SEQ ID NO: 208862 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttgagaca

SEQ ID NO: 208863 - DNA, 20 bp, Artificial Sequence
  Description of Artificial Sequence: Synthetic oligonucleotide
  Target: ATXN1; (-) strand; PAM type: YTN; PAM sequence: TTG
tttttttttttttttttgag

SEQ ID NO: 208864 - DNA, 20 bp, Artificial Sequence
  Description of Artificial Sequence: Synthetic oligonucleotide
  Target: ATXN1; (-) strand; PAM type: YTN; PAM sequence: TTT
gtttttttttttttttttga

SEQ ID NO: 208865 - DNA, 20 bp, Artificial Sequence
  Description of Artificial Sequence: Synthetic oligonucleotide
  Target: ATXN1; (-) strand; PAM type: YTN; PAM sequence: TTT
tgtttttttttttttttttg

SEQ ID NO: 208866 - DNA, 20 bp, Artificial Sequence
  Description of Artificial Sequence: Synthetic oligonucleotide
  Target: ATXN1; (-) strand; PAM type: YTN; PAM sequence: TTT
ttgttttttttttttttttt

SEQ ID NO: 208867 - DNA, 20 bp, Artificial Sequence
  Description of Artificial Sequence: Synthetic oligonucleotide
  Target: ATXN1; (-) strand; PAM type: YTN; PAM sequence: CTA
tagatgtgcaccacgtgcca

SEQ ID NO: 208868 - DNA, 20 bp, Artificial Sequence
  Description of Artificial Sequence: Synthetic oligonucleotide
  Target: ATXN1; (-) strand; PAM type: YTN; PAM sequence: CTG
gaactatagatgtgcaccac

SEQ ID NO: 208869 - DNA, 20 bp, Artificial Sequence
  Description of Artificial Sequence: Synthetic oligonucleotide
  Target: ATXN1; (-) strand; PAM type: YTN; PAM sequence: TTG
agtagctggaactatagatg

SEQ ID NO: 208870 - DNA, 20 bp, Artificial Sequence
  Description of Artificial Sequence: Synthetic oligonucleotide
  Target: ATXN1; (-) strand; PAM type: YTN; PAM sequence: CTC
agtcagttgagtagctggaa

SEQ ID NO: 208871 - DNA, 20 bp, Artificial Sequence
  Description of Artificial Sequence: Synthetic oligonucleotide
  Target: ATXN1; (-) strand; PAM type: YTN; PAM sequence: CTA
ccacctcagtcagttgagta

SEQ ID NO: 208872 - DNA, 20 bp, Artificial Sequence
  Description of Artificial Sequence: Synthetic oligonucleotide
  Target: ATXN1; (-) strand; PAM type: YTN; PAM sequence: CTC
aagcaatggtcctaccacct

SEQ ID NO: 208873 - DNA, 20 bp, Artificial Sequence
  Description of Artificial Sequence: Synthetic oligonucleotide
  Target: ATXN1; (-) strand; PAM type: YTN; PAM sequence: CTG
ggctcaagcaatggtcctac

SEQ ID NO: 208874 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagcaatggtcc

SEQ ID NO: 208875 - DNA, 20 bp, Artificial Sequence
  Description of Artificial Sequence: Synthetic oligonucleotide
  Target: ATXN1; (-) strand; PAM type: YTN; PAM sequence: CTC
gaactcctgggctcaagcaa

SEQ ID NO: 208876 - DNA, 20 bp, Artificial Sequence
  Description of Artificial Sequence: Synthetic oligonucleotide
  Target: ATXN1; (-) strand; PAM type: YTN; PAM sequence: TTG
cagcctcgaactcctgggct

SEQ ID NO: 208877 - DNA, 20 bp, Artificial Sequence
  Description of Artificial Sequence: Synthetic oligonucleotide
  Target: ATXN1; (-) strand; PAM type: YTN; PAM sequence: TTC
attgcagcctcgaactcctg

SEQ ID NO: 208878 - DNA, 20 bp, Artificial Sequence
  Description of Artificial Sequence: Synthetic oligonucleotide
  Target: ATXN1; (-) strand; PAM type: YTN; PAM sequence: TTG
tggttcattgcagcctcgaa

SEQ ID NO: 208879 - DNA, 20 bp, Artificial Sequence
  Description of Artificial Sequence: Synthetic oligonucleotide
  Target: ATXN1; (-) strand; PAM type: YTN; PAM sequence: CTG
gagagcagtgatacaattgt

SEQ ID NO: 208880 - DNA, 20 bp, Artificial Sequence
  Description of Artificial Sequence: Synthetic oligonucleotide
  Target: ATXN1; (-) strand; PAM type: YTN; PAM sequence: CTC
catcacccaggctggagagc

SEQ ID NO: 208881 - DNA, 20 bp, Artificial Sequence
  Description of Artificial Sequence: Synthetic oligonucleotide
  Target: ATXN1; (-) strand; PAM type: YTN; PAM sequence: CTC
tccatcacccaggctggaga

SEQ ID NO: 208882 - DNA, 20 bp, Artificial Sequence
  Description of Artificial Sequence: Synthetic oligonucleotide
  Target: ATXN1; (-) strand; PAM type: YTN; PAM sequence: CTC
tctccatcacccaggctgga

SEQ ID NO: 208883 - DNA, 20 bp, Artificial Sequence
  Description of Artificial Sequence: Synthetic oligonucleotide
  Target: ATXN1; (-) strand; PAM type: YTN; PAM sequence: TTA
gatacagggtctctctccat

SEQ ID NO: 208884 - DNA, 20 bp, Artificial Sequence
  Description of Artificial Sequence: Synthetic oligonucleotide
  Target: ATXN1; (-) strand; PAM type: YTN; PAM sequence: TTT
agatacagggtctctctcca

SEQ ID NO: 208885 - DNA, 20 bp, Artificial Sequence
  Description of Artificial Sequence: Synthetic oligonucleotide
  Target: ATXN1; (-) strand; PAM type: YTN; PAM sequence: TTT
tagatacagggtctctctcc

SEQ ID NO: 208886 - DNA, 20 bp, Artificial Sequence
  Description of Artificial Sequence: Synthetic oligonucleotide
  Target: ATXN1; (-) strand; PAM type: YTN; PAM sequence: TTT
ttagatacagggtctctctc

SEQ ID NO: 208887 - DNA, 20 bp, Artificial Sequence
  Description of Artificial Sequence: Synthetic oligonucleotide
  Target: ATXN1; (-) strand; PAM type: YTN; PAM sequence: TTT
tttagatacagggtctctct

SEQ ID NO: 208888 - DNA, 20 bp, Artificial Sequence
  Description of Artificial Sequence: Synthetic oligonucleotide
  Target: ATXN1; (-) strand; PAM type: YTN; PAM sequence: TTT
ttttagatacagggtctctc

SEQ ID NO: 208889 - DNA, 20 bp, Artificial Sequence
  Description of Artificial Sequence: Synthetic oligonucleotide
  Target: ATXN1; (-) strand; PAM type: YTN; PAM sequence: TTT
tttttagatacagggtctct

SEQ ID NO: 208890 - DNA, 20 bp, Artificial Sequence
  Description of Artificial Sequence: Synthetic oligonucleotide
  Target: ATXN1; (-) strand; PAM type: YTN; PAM sequence: CTT
ttttttagatacagggtctc

SEQ ID NO: 208891 - DNA, 20 bp, Artificial Sequence
  Description of Artificial Sequence: Synthetic oligonucleotide
  Target: ATXN1; (-) strand; PAM type: YTN; PAM sequence: TTC
ttttttttagatacagggtc

SEQ ID NO: 208892 - DNA, 20 bp, Artificial Sequence
  Description of Artificial Sequence: Synthetic oligonucleotide
  Target: ATXN1; (-) strand; PAM type: YTN; PAM sequence: TTT
cttttttttagatacagggt

SEQ ID NO: 208893 - DNA, 20 bp, Artificial Sequence
  Description of Artificial Sequence: Synthetic oligonucleotide
  Target: ATXN1; (-) strand; PAM type: YTN; PAM sequence: TTT
tcttttttttagatacaggg

SEQ ID NO: 208894 - DNA, 20 bp, Artificial Sequence
  Description of Artificial Sequence: Synthetic oligonucleotide
  Target: ATXN1; (-) strand; PAM type: YTN; PAM sequence: TTG
ttttcttttttttagataca

SEQ ID NO: 208895 - DNA, 20 bp, Artificial Sequence
  Description of Artificial Sequence: Synthetic oligonucleotide
  Target: ATXN1; (-) strand; PAM type: YTN; PAM sequence: TTT
gttttcttttttttagatac

SEQ ID NO: 208896 - DNA, 20 bp, Artificial Sequence
  Description of Artificial Sequence: Synthetic oligonucleotide
  Target: ATXN1; (-) strand; PAM type: YTN; PAM sequence: TTT
tgttttcttttttttagata

SEQ ID NO: 208897 - DNA, 20 bp, Artificial Sequence
  Description of Artificial Sequence: Synthetic oligonucleotide
  Target: ATXN1; (-) strand; PAM type: YTN; PAM sequence: TTA
attttgttttctttttttta

SEQ ID NO: 208898 - DNA, 20 bp, Artificial Sequence
  Description of Artificial Sequence: Synthetic oligonucleotide
  Target: ATXN1; (-) strand; PAM type: YTN; PAM sequence: TTT
aattttgttttctttttttt

SEQ ID NO: 208899 - DNA, 20 bp, Artificial Sequence
  Description of Artificial Sequence: Synthetic oligonucleotide
  Target: ATXN1; (-) strand; PAM type: YTN; PAM sequence: TTT
taattttgttttcttttttt

SEQ ID NO: 208900 - DNA, 20 bp, Artificial Sequence
  Description of Artificial Sequence: Synthetic oligonucleotide
  Target: ATXN1; (-) strand; PAM type: YTN; PAM sequence: CTT
ttaattttgttttctttttt

SEQ ID NO: 208901 - DNA, 20 bp, Artificial Sequence
  Description of Artificial Sequence: Synthetic oligonucleotide
  Target: ATXN1; (-) strand; PAM type: YTN; PAM sequence: TTC
ttttaattttgttttctttt

SEQ ID NO: 208902 - DNA, 20 bp, Artificial Sequence
  Description of Artificial Sequence: Synthetic oligonucleotide
  Target: ATXN1; (-) strand; PAM type: YTN; PAM sequence: TTT
cttttaattttgttttcttt

SEQ ID NO: 208903 - DNA, 20 bp, Artificial Sequence
  Description of Artificial Sequence: Synthetic oligonucleotide
  Target: ATXN1; (-) strand; PAM type: YTN; PAM sequence: TTA
tttcttttaattttgttttc

SEQ ID NO: 208904 - DNA, 20 bp, Artificial Sequence
  Description of Artificial Sequence: Synthetic oligonucleotide
  Target: ATXN1; (-) strand; PAM type: YTN; PAM sequence: TTT
atttcttttaattttgtttt

SEQ ID NO: 208905 - DNA, 20 bp, Artificial Sequence
  Description of Artificial Sequence: Synthetic oligonucleotide
  Target: ATXN1; (-) strand; PAM type: YTN; PAM sequence: CTT
tatttcttttaattttgttt

SEQ ID NO: 208906 - DNA, 20 bp, Artificial Sequence
  Description of Artificial Sequence: Synthetic oligonucleotide
  Target: ATXN1; (-) strand; PAM type: YTN; PAM sequence: TTC
tttatttcttttaattttgt

SEQ ID NO: 208907 - DNA, 20 bp, Artificial Sequence
  Description of Artificial Sequence: Synthetic oligonucleotide
  Target: ATXN1; (-) strand; PAM type: YTN; PAM sequence: TTT
ctttatttcttttaattttg

SEQ ID NO: 208908 - DNA, 20 bp, Artificial Sequence
  Description of Artificial Sequence: Synthetic oligonucleotide
  Target: ATXN1; (-) strand; PAM type: YTN; PAM sequence: TTT
tctttatttcttttaatttt

SEQ ID NO: 208909 - DNA, 20 bp, Artificial Sequence
  Description of Artificial Sequence: Synthetic oligonucleotide
  Target: ATXN1; (-) strand; PAM type: YTN; PAM sequence: CTG
agacattttctttatttctt

SEQ ID NO: 208910 - DNA, 20 bp, Artificial Sequence
  Description of Artificial Sequence: Synthetic oligonucleotide
  Target: ATXN1; (-) strand; PAM type: YTN; PAM sequence: TTC
ctgagacattttctttattt

SEQ ID NO: 208911 - DNA, 20 bp, Artificial Sequence
  Description of Artificial Sequence: Synthetic oligonucleotide
  Target: ATXN1; (-) strand; PAM type: YTN; PAM sequence: CTT
cctgagacattttctttatt

SEQ ID NO: 208912 - DNA, 20 bp, Artificial Sequence
  Description of Artificial Sequence: Synthetic oligonucleotide
  Target: ATXN1; (-) strand; PAM type: YTN; PAM sequence: TTC
ttcctgagacattttcttta

SEQ ID NO: 208913 - DNA, 20 bp, Artificial Sequence
  Description of Artificial Sequence: Synthetic oligonucleotide
  Target: ATXN1; (-) strand; PAM type: YTN; PAM sequence: CTT
cttcctgagacattttcttt

SEQ ID NO: 208914 - DNA, 20 bp, Artificial Sequence
  Description of Artificial Sequence: Synthetic oligonucleotide
  Target: ATXN1; (-) strand; PAM type: YTN; PAM sequence: CTG
aagaggaacaacttcttcct

SEQ ID NO: 208915 - DNA, 20 bp, Artificial Sequence
  Description of Artificial Sequence: Synthetic oligonucleotide
  Target: ATXN1; (-) strand; PAM type: YTN; PAM sequence: TTG
tctgaagaggaacaacttct

SEQ ID NO: 208916 - DNA, 20 bp, Artificial Sequence
  Description of Artificial Sequence: Synthetic oligonucleotide
  Target: ATXN1; (-) strand; PAM type: YTN; PAM sequence: CTA
aaaaaaaaaaaaaaaaagaa

SEQ ID NO: 208917 - DNA, 20 bp, Artificial Sequence
  Description of Artificial Sequence: Synthetic oligonucleotide
  Target: ATXN1; (-) strand; PAM type: YTN; PAM sequence: CTG
tctaaaaaaaaaaaaaaaaa

SEQ ID NO: 208918 - DNA, 20 bp, Artificial Sequence
  Description of Artificial Sequence: Synthetic oligonucleotide
  Target: ATXN1; (-) strand; PAM type: YTN; PAM sequence: CTG
ggcaacaaagcaagcctgtc

SEQ ID NO: 208919 - DNA, 20 bp, Artificial Sequence
  Description of Artificial Sequence: Synthetic oligonucleotide
  Target: ATXN1; (-) strand; PAM type: YTN; PAM sequence: CTA
gcctgggcaacaaagcaagc

SEQ ID NO: 208920 - DNA, 20 bp, Artificial Sequence
  Description of Artificial Sequence: Synthetic oligonucleotide
  Target: ATXN1; (-) strand; PAM type: YTN; PAM sequence: CTC
tagcctgggcaacaaagcaa

SEQ ID NO: 208921 - DNA, 20 bp, Artificial Sequence
  Description of Artificial Sequence: Synthetic oligonucleotide
  Target: ATXN1; (-) strand; PAM type: YTN; PAM sequence: CTG
cactctagcctgggcaacaa

SEQ ID NO: 208922 - DNA, 20 bp, Artificial Sequence
  Description of Artificial Sequence: Synthetic oligonucleotide
  Target: ATXN1; (-) strand; PAM type: YTN; PAM sequence: TTG
taccactgcactctagcctg

SEQ ID NO: 208923 - DNA, 20 bp, Artificial Sequence
  Description of Artificial Sequence: Synthetic oligonucleotide
  Target: ATXN1; (-) strand; PAM type: YTN; PAM sequence: CTG
attgtaccactgcactctag

SEQ ID NO: 208924 - DNA, 20 bp, Artificial Sequence
  Description of Artificial Sequence: Synthetic oligonucleotide
  Target: ATXN1; (-) strand; PAM type: YTN; PAM sequence: CTC
tgattgtaccactgcactct

SEQ ID NO: 208925 - DNA, 20 bp, Artificial Sequence
  Description of Artificial Sequence: Synthetic oligonucleotide
  Target: ATXN1; (-) strand; PAM type: YTN; PAM sequence: CTG
cagtgagctctgattgtacc

SEQ ID NO: 208926 - DNA, 20 bp, Artificial Sequence
  Description of Artificial Sequence: Synthetic oligonucleotide
  Target: ATXN1; (-) strand; PAM type: YTN; PAM sequence: CTG
aggctgcagtgagctctgat

SEQ ID NO: 208927 - DNA, 20 bp, Artificial Sequence
  Description of Artificial Sequence: Synthetic oligonucleotide
  Target: ATXN1; (-) strand; PAM type: YTN; PAM sequence: TTC
caggaggctgaggctgcagt

SEQ ID NO: 208928 - DNA, 20 bp, Artificial Sequence
  Description of Artificial Sequence: Synthetic oligonucleotide
  Target: ATXN1; (-) strand; PAM type: YTN; PAM sequence: CTG
gttccaggaggctgaggctg

SEQ ID NO: 208929 - DNA, 20 bp, Artificial Sequence
  Description of Artificial Sequence: Synthetic oligonucleotide
  Target: ATXN1; (-) strand; PAM type: YTN; PAM sequence: CTG
aagtgggaggatcacctggt

SEQ ID NO: 208930 - DNA, 20 bp, Artificial Sequence
  Description of Artificial Sequence: Synthetic oligonucleotide
  Target: ATXN1; (-) strand; PAM type: YTN; PAM sequence: CTC
agaaggctgaagtgggagga

SEQ ID NO: 208931 - DNA, 20 bp, Artificial Sequence
  Description of Artificial Sequence: Synthetic oligonucleotide
  Target: ATXN1; (-) strand; PAM type: YTN; PAM sequence: CTA
ctcagaaggctgaagtggga

SEQ ID NO: 208932 - DNA, 20 bp, Artificial Sequence
  Description of Artificial Sequence: Synthetic oligonucleotide
  Target: ATXN1; (-) strand; PAM type: YTN; PAM sequence: CTG
tggtcccggctactcagaag

SEQ ID NO: 208933 - DNA, 20 bp, Artificial Sequence
  Description of Artificial Sequence: Synthetic oligonucleotide
  Target: ATXN1; (-) strand; PAM type: YTN; PAM sequence: TTA
atcagccaggcatggtgatg

SEQ ID NO: 208934 - DNA, 20 bp, Artificial Sequence
  Description of Artificial Sequence: Synthetic oligonucleotide
  Target: ATXN1; (-) strand; PAM type: YTN; PAM sequence: TTT
aatcagccaggcatggtgat

SEQ ID NO: 208935 - DNA, 20 bp, Artificial Sequence
  Description of Artificial Sequence: Synthetic oligonucleotide
  Target: ATXN1; (-) strand; PAM type: YTN; PAM sequence: TTT
taatcagccaggcatggtga

SEQ ID NO: 208936 - DNA, 20 bp, Artificial Sequence
  Description of Artificial Sequence: Synthetic oligonucleotide
  Target: ATXN1; (-) strand; PAM type: YTN; PAM sequence: TTT
ttaatcagccaggcatggtg

SEQ ID NO: 208937 - DNA, 20 bp, Artificial Sequence
  Description of Artificial Sequence: Synthetic oligonucleotide
  Target: ATXN1; (-) strand; PAM type: YTN; PAM sequence: TTT
tttaatcagccaggcatggt

SEQ ID NO: 208938 - DNA, 20 bp, Artificial Sequence
  Description of Artificial Sequence: Synthetic oligonucleotide
  Target: ATXN1; (-) strand; PAM type: YTN; PAM sequence: TTT
ttttaatcagccaggcatgg

SEQ ID NO: 208939 - DNA, 20 bp, Artificial Sequence
  Description of Artificial Sequence: Synthetic oligonucleotide
  Target: ATXN1; (-) strand; PAM type: YTN; PAM sequence: TTT
tttttaatcagccaggcatg

SEQ ID NO: 208940 - DNA, 20 bp, Artificial Sequence
  Description of Artificial Sequence: Synthetic oligonucleotide
  Target: ATXN1; (-) strand; PAM type: YTN; PAM sequence: TTT
ttttttaatcagccaggcat

SEQ ID NO: 208941 - DNA, 20 bp, Artificial Sequence
  Description of Artificial Sequence: Synthetic oligonucleotide
  Target: ATXN1; (-) strand; PAM type: YTN; PAM sequence: TTT
tttttttaatcagccaggca

SEQ ID NO: 208942 - DNA, 20 bp, Artificial Sequence
  Description of Artificial Sequence: Synthetic oligonucleotide
  Target: ATXN1; (-) strand; PAM type: YTN; PAM sequence: TTT
ttttttttaatcagccaggc

SEQ ID NO: 208943 - DNA, 20 bp, Artificial Sequence
  Description of Artificial Sequence: Synthetic oligonucleotide
  Target: ATXN1; (-) strand; PAM type: YTN; PAM sequence: TTT
tttttttttaatcagccagg

SEQ ID NO: 208944 - DNA, 20 bp, Artificial Sequence
  Description of Artificial Sequence: Synthetic oligonucleotide
  Target: ATXN1; (-) strand; PAM type: YTN; PAM sequence: CTA
cattttttttttttaatcag

SEQ ID NO: 208945 - DNA, 20 bp, Artificial Sequence
  Description of Artificial Sequence: Synthetic oligonucleotide
  Target: ATXN1; (-) strand; PAM type: YTN; PAM sequence: CTC
tacattttttttttttaatc

SEQ ID NO: 208946 - DNA, 20 bp, Artificial Sequence
  Description of Artificial Sequence: Synthetic oligonucleotide
  Target: ATXN1; (-) strand; PAM type: YTN; PAM sequence: CTC
atctctacattttttttttt

SEQ ID NO: 208947 - DNA, 20 bp, Artificial Sequence
  Description of Artificial Sequence: Synthetic oligonucleotide
  Target: ATXN1; (-) strand; PAM type: YTN; PAM sequence: CTG
ggcaacatagtgaggcctca

SEQ ID NO: 208948 - DNA, 20 bp, Artificial Sequence
  Description of Artificial Sequence: Synthetic oligonucleotide
  Target: ATXN1; (-) strand; PAM type: YTN; PAM sequence: CTA
gcctgggcaacatagtgagg

SEQ ID NO: 208949 - DNA, 20 bp, Artificial Sequence
  Description of Artificial Sequence: Synthetic oligonucleotide
  Target: ATXN1; (-) strand; PAM type: YTN; PAM sequence: TTG
agactagcctgggcaacata

SEQ ID NO: 208950 - DNA, 20 bp, Artificial Sequence
  Description of Artificial Sequence: Synthetic oligonucleotide
  Target: ATXN1; (-) strand; PAM type: YTN; PAM sequence: TTT
gagactagcctgggcaacat

SEQ ID NO: 208951 - DNA, 20 bp, Artificial Sequence
  Description of Artificial Sequence: Synthetic oligonucleotide
  Target: ATXN1; (-) strand; PAM type: YTN; PAM sequence: TTA
gggcaggagtttgagactag

SEQ ID NO: 208952 - DNA, 20 bp, Artificial Sequence
  Description of Artificial Sequence: Synthetic oligonucleotide
  Target: ATXN1; (-) strand; PAM type: YTN; PAM sequence: CTT
agggcaggagtttgagacta

SEQ ID NO: 208953 - DNA, 20 bp, Artificial Sequence
  Description of Artificial Sequence: Synthetic oligonucleotide
  Target: ATXN1; (-) strand; PAM type: YTN; PAM sequence: TTG
cttagggcaggagtttgaga

SEQ ID NO: 208954 - DNA, 20 bp, Artificial Sequence
  Description of Artificial Sequence: Synthetic oligonucleotide
  Target: ATXN1; (-) strand; PAM type: YTN; PAM sequence: TTG
tgaagccaaagtgggaggat

SEQ ID NO: 208955 - DNA, 20 bp, Artificial Sequence
  Description of Artificial Sequence: Synthetic oligonucleotide
  Target: ATXN1; (-) strand; PAM type: YTN; PAM sequence: TTT
gtgaagccaaagtgggagga

SEQ ID NO: 208956 - DNA, 20 bp, Artificial Sequence
  Description of Artificial Sequence: Synthetic oligonucleotide
  Target: ATXN1; (-) strand; PAM type: YTN; PAM sequence: CTT
tgtgaagccaaagtgggagg

SEQ ID NO: 208957 - DNA, 20 bp, Artificial Sequence
  Description of Artificial Sequence: Synthetic oligonucleotide
  Target: ATXN1; (-) strand; PAM type: YTN; PAM sequence: TTC
cagcactttgtgaagccaaa

SEQ ID NO: 208958 - DNA, 20 bp, Artificial Sequence
  Description of Artificial Sequence: Synthetic oligonucleotide
  Target: ATXN1; (-) strand; PAM type: YTN; PAM sequence: TTT
ccagcactttgtgaagccaa

SEQ ID NO: 208959 - DNA, 20 bp, Artificial Sequence
  Description of Artificial Sequence: Synthetic oligonucleotide
  Target: ATXN1; (-) strand; PAM type: YTN; PAM sequence: TTG
agtgtgtatttccagcactt

SEQ ID NO: 208960 - DNA, 20 bp, Artificial Sequence
  Description of Artificial Sequence: Synthetic oligonucleotide
  Target: ATXN1; (-) strand; PAM type: YTN; PAM sequence: CTT
gagtgtgtatttccagcact

SEQ ID NO: 208961 - DNA, 20 bp, Artificial Sequence
  Description of Artificial Sequence: Synthetic oligonucleotide
  Target: ATXN1; (-) strand; PAM type: YTN; PAM sequence: CTG
ggtgcagtggcttgagtgtg

SEQ ID NO: 208962 - DNA, 20 bp, Artificial Sequence
  Description of Artificial Sequence: Synthetic oligonucleotide
  Target: ATXN1; (-) strand; PAM type: YTN; PAM sequence: TTC
caaaatccaggtggtcagct

SEQ ID NO: 208963 - DNA, 20 bp, Artificial Sequence
  Description of Artificial Sequence: Synthetic oligonucleotide
  Target: ATXN1; (-) strand; PAM type: YTN; PAM sequence: TTT
ccaaaatccaggtggtcagc

SEQ ID NO: 208964 - DNA, 20 bp, Artificial Sequence
  Description of Artificial Sequence: Synthetic oligonucleotide
  Target: ATXN1; (-) strand; PAM type: YTN; PAM sequence: TTT
tccaaaatccaggtggtcag

SEQ ID NO: 208965 - DNA, 20 bp, Artificial Sequence
  Description of Artificial Sequence: Synthetic oligonucleotide
  Target: ATXN1; (-) strand; PAM type: YTN; PAM sequence: CTT
ttccaaaatccaggtggtca

SEQ ID NO: 208966 - DNA, 20 bp, Artificial Sequence
  Description of Artificial Sequence: Synthetic oligonucleotide
  Target: ATXN1; (-) strand; PAM type: YTN; PAM sequence: CTC
ttttccaaaatccaggtggt

SEQ ID NO: 208967 - DNA, 20 bp, Artificial Sequence
  Description of Artificial Sequence: Synthetic oligonucleotide
  Target: ATXN1; (-) strand; PAM type: YTN; PAM sequence: TTC
ctcttttccaaaatccaggt

SEQ ID NO: 208968 - DNA, 20 bp, Artificial Sequence
  Description of Artificial Sequence: Synthetic oligonucleotide
  Target: ATXN1; (-) strand; PAM type: YTN; PAM sequence: TTT
cctcttttccaaaatccagg

SEQ ID NO: 208969 - DNA, 20 bp, Artificial Sequence
  Description of Artificial Sequence: Synthetic oligonucleotide
  Target: ATXN1; (-) strand; PAM type: YTN; PAM sequence: TTT
tcctcttttccaaaatccag

SEQ ID NO: 208970 - DNA, 20 bp, Artificial Sequence
  Description of Artificial Sequence: Synthetic oligonucleotide
  Target: ATXN1; (-) strand; PAM type: YTN; PAM sequence: TTC
cgttttcctcttttccaaaa

SEQ ID NO: 208971 - DNA, 20 bp, Artificial Sequence
  Description of Artificial Sequence: Synthetic oligonucleotide
  Target: ATXN1; (-) strand; PAM type: YTN; PAM sequence: CTT
ccgttttcctcttttccaaa

SEQ ID NO: 208972 - DNA, 20 bp, Artificial Sequence
  Description of Artificial Sequence: Synthetic oligonucleotide
  Target: ATXN1; (-) strand; PAM type: YTN; PAM sequence: CTA
acagtcagacttccgttttc

SEQ ID NO: 208973 - DNA, 20 bp, Artificial Sequence
  Description of Artificial Sequence: Synthetic oligonucleotide
  Target: ATXN1; (-) strand; PAM type: YTN; PAM sequence: TTC
ccacatctaacagtcagact

SEQ ID NO: 208974 - DNA, 20 bp, Artificial Sequence
  Description of Artificial Sequence: Synthetic oligonucleotide
  Target: ATXN1; (-) strand; PAM type: YTN; PAM sequence: CTG
attcccacatctaacagtca

SEQ ID NO: 208975 - DNA, 20 bp, Artificial Sequence
  Description of Artificial Sequence: Synthetic oligonucleotide
  Target: ATXN1; (-) strand; PAM type: YTN; PAM sequence: TTC
acatatataacatgaaaaca

SEQ ID NO: 208976 - DNA, 20 bp, Artificial Sequence
  Description of Artificial Sequence: Synthetic oligonucleotide
  Target: ATXN1; (-) strand; PAM type: YTN; PAM sequence: TTA
tgatatgcaccatacatgtg

SEQ ID NO: 208977 - DNA, 20 bp, Artificial Sequence
  Description of Artificial Sequence: Synthetic oligonucleotide
  Target: ATXN1; (-) strand; PAM type: YTN; PAM sequence: TTG
ttatgatatgcaccatacat

SEQ ID NO: 208978 - DNA, 20 bp, Artificial Sequence
  Description of Artificial Sequence: Synthetic oligonucleotide
  Target: ATXN1; (-) strand; PAM type: YTN; PAM sequence: CTT
gttatgatatgcaccataca

SEQ ID NO: 208979 - DNA, 20 bp, Artificial Sequence
  Description of Artificial Sequence: Synthetic oligonucleotide
  Target: ATXN1; (-) strand; PAM type: YTN; PAM sequence: CTC
ttgttatgatatgcaccata

SEQ ID NO: 208980 - DNA, 20 bp, Artificial Sequence
  Description of Artificial Sequence: Synthetic oligonucleotide
  Target: ATXN1; (-) strand; PAM type: YTN; PAM sequence: TTC
tcttgttatgatatgcacca

SEQ ID NO: 208981 - DNA, 20 bp, Artificial Sequence
  Description of Artificial Sequence: Synthetic oligonucleotide
  Target: ATXN1; (-) strand; PAM type: YTN; PAM sequence: TTT
ctcttgttatgatatgcacc

SEQ ID NO: 208982 - DNA, 20 bp, Artificial Sequence
  Description of Artificial Sequence: Synthetic oligonucleotide
  Target: ATXN1; (-) strand; PAM type: YTN; PAM sequence: CTT
tctcttgttatgatatgcac

SEQ ID NO: 208983 - DNA, 20 bp, Artificial Sequence
  Description of Artificial Sequence: Synthetic oligonucleotide
  Target: ATXN1; (-) strand; PAM type: YTN; PAM sequence: TTA
acactttctcttgttatgat

SEQ ID NO: 208984 - DNA, 20 bp, Artificial Sequence
  Description of Artificial Sequence: Synthetic oligonucleotide
  Target: ATXN1; (-) strand; PAM type: YTN; PAM sequence: TTT
aacactttctcttgttatga

SEQ ID NO: 208985 - DNA, 20 bp, Artificial Sequence
  Description of Artificial Sequence: Synthetic oligonucleotide
  Target: ATXN1; (-) strand; PAM type: YTN; PAM sequence: CTA
gtgtgtttaacactttctct

SEQ ID NO: 208986 - DNA, 20 bp, Artificial Sequence
  Description of Artificial Sequence: Synthetic oligonucleotide
  Target: ATXN1; (-) strand; PAM type: YTN; PAM sequence: CTC
tagtgtgtttaacactttct

SEQ ID NO: 208987 - DNA, 20 bp, Artificial Sequence
  Description of Artificial Sequence: Synthetic oligonucleotide
  Target: ATXN1; (-) strand; PAM type: YTN; PAM sequence: CTA
atgtctctagtgtgtttaac

SEQ ID NO: 208988 - DNA, 20 bp, Artificial Sequence
  Description of Artificial Sequence: Synthetic oligonucleotide
  Target: ATXN1; (-) strand; PAM type: YTN; PAM sequence: TTC
taatgtctctagtgtgttta

SEQ ID NO: 208989 - DNA, 20 bp, Artificial Sequence
  Description of Artificial Sequence: Synthetic oligonucleotide
  Target: ATXN1; (-) strand; PAM type: YTN; PAM sequence: TTT
ctaatgtctctagtgtgttt

SEQ ID NO: 208990 - DNA, 20 bp, Artificial Sequence
  Description of Artificial Sequence: Synthetic oligonucleotide
  Target: ATXN1; (-) strand; PAM type: YTN; PAM sequence: TTT
tctaatgtctctagtgtgtt

SEQ ID NO: 208991 - DNA, 20 bp, Artificial Sequence
  Description of Artificial Sequence: Synthetic oligonucleotide
  Target: ATXN1; (-) strand; PAM type: YTN; PAM sequence: TTG
ttttctaatgtctctagtgt

SEQ ID NO: 208992 - DNA, 20 bp, Artificial Sequence
  Description of Artificial Sequence: Synthetic oligonucleotide
  Target: ATXN1; (-) strand; PAM type: YTN; PAM sequence: TTT
gttttctaatgtctctagtg

SEQ ID NO: 208993 - DNA, 20 bp, Artificial Sequence
  Description of Artificial Sequence: Synthetic oligonucleotide
  Target: ATXN1; (-) strand; PAM type: YTN; PAM sequence: TTG
atttgttttctaatgtctct

SEQ ID NO: 208994 - DNA, 20 bp, Artificial Sequence
  Description of Artificial Sequence: Synthetic oligonucleotide
  Target: ATXN1; (-) strand; PAM type: YTN; PAM sequence: CTT
gatttgttttctaatgtctc

SEQ ID NO: 208995 - DNA, 20 bp, Artificial Sequence
  Description of Artificial Sequence: Synthetic oligonucleotide
  Target: ATXN1; (-) strand; PAM type: YTN; PAM sequence: CTC
agtccttgatttgttttcta

SEQ ID NO: 208996 - DNA, 20 bp, Artificial Sequence
  Description of Artificial Sequence: Synthetic oligonucleotide
  Target: ATXN1; (-) strand; PAM type: YTN; PAM sequence: TTC
ctcagtccttgatttgtttt

SEQ ID NO: 208997 - DNA, 20 bp, Artificial Sequence
  Description of Artificial Sequence: Synthetic oligonucleotide
  Target: ATXN1; (-) strand; PAM type: YTN; PAM sequence: TTG
ttcctcagtccttgatttgt

SEQ ID NO: 208998 - DNA, 20 bp, Artificial Sequence
  Description of Artificial Sequence: Synthetic oligonucleotide
  Target: ATXN1; (-) strand; PAM type: YTN; PAM sequence: TTA
ttgttcctcagtccttgatt

SEQ ID NO: 208999 - DNA, 20 bp, Artificial Sequence
  Description of Artificial Sequence: Synthetic oligonucleotide
  Target: ATXN1; (-) strand; PAM type: YTN; PAM sequence: TTT
attgttcctcagtccttgat

SEQ ID NO: 209000 - DNA, 20 bp, Artificial Sequence
  Description of Artificial Sequence: Synthetic oligonucleotide
  Target: ATXN1; (-) strand; PAM type: YTN; PAM sequence: TTT
tattgttcctcagtccttga

SEQ ID NO: 209001 - DNA, 20 bp, Artificial Sequence
  Description of Artificial Sequence: Synthetic oligonucleotide
  Target: ATXN1; (-) strand; PAM type: YTN; PAM sequence: TTT
ttattgttcctcagtccttg

SEQ ID NO: 209002 - DNA, 20 bp, Artificial Sequence
  Description of Artificial Sequence: Synthetic oligonucleotide
  Target: ATXN1; (-) strand; PAM type: YTN; PAM sequence: CTT
tttattgttcctcagtcctt

SEQ ID NO: 209003 - DNA, 20 bp, Artificial Sequence
  Description of Artificial Sequence: Synthetic oligonucleotide
  Target: ATXN1; (-) strand; PAM type: YTN; PAM sequence: TTG
caacactttttattgttcct

SEQ ID NO: 209004 - DNA, 20 bp, Artificial Sequence
  Description of Artificial Sequence: Synthetic oligonucleotide
  Target: ATXN1; (-) strand; PAM type: YTN; PAM sequence: TTA
caccattgcaacacttttta

SEQ ID NO: 209005 - DNA, 20 bp, Artificial Sequence
  Description of Artificial Sequence: Synthetic oligonucleotide
  Target: ATXN1; (-) strand; PAM type: YTN; PAM sequence: TTT
acaccattgcaacacttttt

SEQ ID NO: 209006 - DNA, 20 bp, Artificial Sequence
  Description of Artificial Sequence: Synthetic oligonucleotide
  Target: ATXN1; (-) strand; PAM type: YTN; PAM sequence: TTT
tacaccattgcaacactttt

SEQ ID NO: 209007 - DNA, 20 bp, Artificial Sequence
  Description of Artificial Sequence: Synthetic oligonucleotide
  Target: ATXN1; (-) strand; PAM type: YTN; PAM sequence: CTT
ttacaccattgcaacacttt

SEQ ID NO: 209008 - DNA, 20 bp, Artificial Sequence
  Description of Artificial Sequence: Synthetic oligonucleotide
  Target: ATXN1; (-) strand; PAM type: YTN; PAM sequence: TTA
cttttacaccattgcaacac

SEQ ID NO: 209009 - DNA, 20 bp, Artificial Sequence
  Description of Artificial Sequence: Synthetic oligonucleotide
  Target: ATXN1; (-) strand; PAM type: YTN; PAM sequence: TTG
tattacttttacaccattgc

SEQ ID NO: 209010 - DNA, 20 bp, Artificial Sequence
  Description of Artificial Sequence: Synthetic oligonucleotide
  Target: ATXN1; (-) strand; PAM type: YTN; PAM sequence: TTT
gtattacttttacaccattg

SEQ ID NO: 209011 - DNA, 20 bp, Artificial Sequence
  Description of Artificial Sequence: Synthetic oligonucleotide
  Target: ATXN1; (-) strand; PAM type: YTN; PAM sequence: CTA
taatttgtattacttttaca

SEQ ID NO: 209012 - DNA, 20 bp, Artificial Sequence
  Description of Artificial Sequence: Synthetic oligonucleotide
  Target: ATXN1; (-) strand; PAM type: YTN; PAM sequence: TTC
acgtaaaagactataatttg

SEQ ID NO: 209013 - DNA, 20 bp, Artificial Sequence
  Description of Artificial Sequence: Synthetic oligonucleotide
  Target: ATXN1; (-) strand; PAM type: YTN; PAM sequence: TTA
gtggaagcagttcacgtaaa

SEQ ID NO: 209014 - DNA, 20 bp, Artificial Sequence
  Description of Artificial Sequence: Synthetic oligonucleotide
  Target: ATXN1; (-) strand; PAM type: YTN; PAM sequence: TTG
ggcattagtggaagcagttc

SEQ ID NO: 209015 - DNA, 20 bp, Artificial Sequence
  Description of Artificial Sequence: Synthetic oligonucleotide
  Target: ATXN1; (-) strand; PAM type: YTN; PAM sequence: CTG
catagtaattgggcattagt

SEQ ID NO: 209016 - DNA, 20 bp, Artificial Sequence
  Description of Artificial Sequence: Synthetic oligonucleotide
  Target: ATXN1; (-) strand; PAM type: YTN; PAM sequence: CTG
tgctgcatagtaattgggca

SEQ ID NO: 209017 - DNA, 20 bp, Artificial Sequence
  Description of Artificial Sequence: Synthetic oligonucleotide
  Target: ATXN1; (-) strand; PAM type: YTN; PAM sequence: TTG
atactgtgctgcatagtaat

SEQ ID NO: 209018 - DNA, 20 bp, Artificial Sequence
  Description of Artificial Sequence: Synthetic oligonucleotide
  Target: ATXN1; (-) strand; PAM type: YTN; PAM sequence: CTA
aattgatactgtgctgcata

SEQ ID NO: 209019 - DNA, 20 bp, Artificial Sequence
  Description of Artificial Sequence: Synthetic oligonucleotide
  Target: ATXN1; (-) strand; PAM type: YTN; PAM sequence: TTC
atgatccactaaattgatac

SEQ ID NO: 209020 - DNA, 20 bp, Artificial Sequence
  Description of Artificial Sequence: Synthetic oligonucleotide
  Target: ATXN1; (-) strand; PAM type: YTN; PAM sequence: TTA
tacaagtgagtcaatcggat

SEQ ID NO: 209021 - DNA, 20 bp, Artificial Sequence
  Description of Artificial Sequence: Synthetic oligonucleotide
  Target: ATXN1; (-) strand; PAM type: YTN; PAM sequence: CTT
atacaagtgagtcaatcgga

SEQ ID NO: 209022 - DNA, 20 bp, Artificial Sequence
  Description of Artificial Sequence: Synthetic oligonucleotide
  Target: ATXN1; (-) strand; PAM type: YTN; PAM sequence: TTG
tcataaaatgtaacttatac

SEQ ID NO: 209023 - DNA, 20 bp, Artificial Sequence
  Description of Artificial Sequence: Synthetic oligonucleotide
  Target: ATXN1; (-) strand; PAM type: YTN; PAM sequence: TTA
gtgttgtcataaaatgtaac

SEQ ID NO: 209024 - DNA, 20 bp, Artificial Sequence
  Description of Artificial Sequence: Synthetic oligonucleotide
  Target: ATXN1; (-) strand; PAM type: YTN; PAM sequence: TTT
agtgttgtcataaaatgtaa

SEQ ID NO: 209025 - DNA, 20 bp, Artificial Sequence
  Description of Artificial Sequence: Synthetic oligonucleotide
  Target: ATXN1; (-) strand; PAM type: YTN; PAM sequence: CTG
aacatataaaggagaattta

SEQ ID NO: 209026 - DNA, 20 bp, Artificial Sequence
  Description of Artificial Sequence: Synthetic oligonucleotide
  Target: ATXN1; (-) strand; PAM type: YTN; PAM sequence: TTA
cacgcatcacaaaataggga

SEQ ID NO: 209027 - DNA, 20 bp, Artificial Sequence
  Description of Artificial Sequence: Synthetic oligonucleotide
  Target: ATXN1; (-) strand; PAM type: YTN; PAM sequence: CTG
caattacacgcatcacaaaa

SEQ ID NO: 209028 - DNA, 20 bp, Artificial Sequence
  Description of Artificial Sequence: Synthetic oligonucleotide
  Target: ATXN1; (-) strand; PAM type: YTN; PAM sequence: TTC
tgcaattacacgcatcacaa

SEQ ID NO: 209029 - DNA, 20 bp, Artificial Sequence
  Description of Artificial Sequence: Synthetic oligonucleotide
  Target: ATXN1; (-) strand; PAM type: YTN; PAM sequence: CTC
ccaagttctgcaattacacg

SEQ ID NO: 209030 - DNA, 20 bp, Artificial Sequence
  Description of Artificial Sequence: Synthetic oligonucleotide
  Target: ATXN1; (-) strand; PAM type: YTN; PAM sequence: CTA
gctcccaagttctgcaatta

SEQ ID NO: 209031 - DNA, 20 bp, Artificial Sequence
  Description of Artificial Sequence: Synthetic oligonucleotide
  Target: ATXN1; (-) strand; PAM type: YTN; PAM sequence: TTC
tagctcccaagttctgcaat

SEQ ID NO: 209032 - DNA, 20 bp, Artificial Sequence
  Description of Artificial Sequence: Synthetic oligonucleotide
  Target: ATXN1; (-) strand; PAM type: YTN; PAM sequence: CTC
aaggtccattctagctccca

SEQ ID NO: 209033 - DNA, 20 bp, Artificial Sequence
  Description of Artificial Sequence: Synthetic oligonucleotide
  Target: ATXN1; (-) strand; PAM type: YTN; PAM sequence: CTC
ctcaaggtccattctagctc

SEQ ID NO: 209034 - DNA, 20 bp, Artificial Sequence
  Description of Artificial Sequence: Synthetic oligonucleotide
  Target: ATXN1; (-) strand; PAM type: YTN; PAM sequence: TTG
gcgtaagggatctcctcaag

SEQ ID NO: 209035 - DNA, 20 bp, Artificial Sequence
  Description of Artificial Sequence: Synthetic oligonucleotide
  Target: ATXN1; (-) strand; PAM type: YTN; PAM sequence: CTG
tgaagtgaaagcgttggcgt

SEQ ID NO: 209036 - DNA, 20 bp, Artificial Sequence
  Description of Artificial Sequence: Synthetic oligonucleotide
  Target: ATXN1; (-) strand; PAM type: YTN; PAM sequence: CTA
catctgtgaagtgaaagcgt

SEQ ID NO: 209037 - DNA, 20 bp, Artificial Sequence
  Description of Artificial Sequence: Synthetic oligonucleotide
  Target: ATXN1; (-) strand; PAM type: YTN; PAM sequence: CTC
ggtgtctacatctgtgaagt

SEQ ID NO: 209038 - DNA, 20 bp, Artificial Sequence
  Description of Artificial Sequence: Synthetic oligonucleotide
  Target: ATXN1; (-) strand; PAM type: YTN; PAM sequence: TTA
agcctcggtgtctacatctg

SEQ ID NO: 209039 - DNA, 20 bp, Artificial Sequence
  Description of Artificial Sequence: Synthetic oligonucleotide
  Target: ATXN1; (-) strand; PAM type: YTN; PAM sequence: TTT
aagcctcggtgtctacatct

SEQ ID NO: 209040 - DNA, 20 bp, Artificial Sequence
  Description of Artificial Sequence: Synthetic oligonucleotide
  Target: ATXN1; (-) strand; PAM type: YTN; PAM sequence: CTT
taagcctcggtgtctacatc

SEQ ID NO: 209041 - DNA, 20 bp, Artificial Sequence
  Description of Artificial Sequence: Synthetic oligonucleotide
  Target: ATXN1; (-) strand; PAM type: YTN; PAM sequence: CTC
tttaagcctcggtgtctaca

SEQ ID NO: 209042 - DNA, 20 bp, Artificial Sequence
  Description of Artificial Sequence: Synthetic oligonucleotide
  Target: ATXN1; (-) strand; PAM type: YTN; PAM sequence: TTG
ggaaagtcataccctcttta

SEQ ID NO: 209043 - DNA, 20 bp, Artificial Sequence
  Description of Artificial Sequence: Synthetic oligonucleotide
  Target: ATXN1; (-) strand; PAM type: YTN; PAM sequence: CTT
gggaaagtcataccctcttt

SEQ ID NO: 209044 - DNA, 20 bp, Artificial Sequence
  Description of Artificial Sequence: Synthetic oligonucleotide
  Target: ATXN1; (-) strand; PAM type: YTN; PAM sequence: TTG
tggccttgggaaagtcatac

SEQ ID NO: 209045 - DNA, 20 bp, Artificial Sequence
  Description of Artificial Sequence: Synthetic oligonucleotide
  Target: ATXN1; (-) strand; PAM type: YTN; PAM sequence: CTT
gtggccttgggaaagtcata

SEQ ID NO: 209046 - DNA, 20 bp, Artificial Sequence
  Description of Artificial Sequence: Synthetic oligonucleotide
  Target: ATXN1; (-) strand; PAM type: YTN; PAM sequence: CTC
ttgtggccttgggaaagtca

SEQ ID NO: 209047 - DNA, 20 bp, Artificial Sequence
  Description of Artificial Sequence: Synthetic oligonucleotide
  Target: ATXN1; (-) strand; PAM type: YTN; PAM sequence: CTA
gtcctcttgtggccttggga

SEQ ID NO: 209048 - DNA, 20 bp, Artificial Sequence
  Description of Artificial Sequence: Synthetic oligonucleotide
  Target: ATXN1; (-) strand; PAM type: YTN; PAM sequence: CTG
taaactagtcctcttgtggc

SEQ ID NO: 209049 - DNA, 20 bp, Artificial Sequence
  Description of Artificial Sequence: Synthetic oligonucleotide
  Target: ATXN1; (-) strand; PAM type: YTN; PAM sequence: CTG
ctgtaaactagtcctcttgt

SEQ ID NO: 209050 - DNA, 20 bp, Artificial Sequence
  Description of Artificial Sequence: Synthetic oligonucleotide
  Target: ATXN1; (-) strand; PAM type: YTN; PAM sequence: CTC
tgctgtaaactagtcctctt

SEQ ID NO: 209051 - DNA, 20 bp, Artificial Sequence
  Description of Artificial Sequence: Synthetic oligonucleotide
  Target: ATXN1; (-) strand; PAM type: YTN; PAM sequence: TTA
tataagcccagctctgctgt

SEQ ID NO: 209052 - DNA, 20 bp, Artificial Sequence
  Description of Artificial Sequence: Synthetic oligonucleotide
  Target: ATXN1; (-) strand; PAM type: YTN; PAM sequence: CTG
ttatataagcccagctctgc

SEQ ID NO: 209053 - DNA, 20 bp, Artificial Sequence
  Description of Artificial Sequence: Synthetic oligonucleotide
  Target: ATXN1; (-) strand; PAM type: YTN; PAM sequence: CTC
atgggcagccctgttatata

SEQ ID NO: 209054 - DNA, 20 bp, Artificial Sequence
  Description of Artificial Sequence: Synthetic oligonucleotide
  Target: ATXN1; (-) strand; PAM type: YTN; PAM sequence: TTG
cagggctcatgggcagccct

SEQ ID NO: 209055 - DNA, 20 bp, Artificial Sequence
  Description of Artificial Sequence: Synthetic oligonucleotide
  Target: ATXN1; (-) strand; PAM type: YTN; PAM sequence: CTT
gcagggctcatgggcagccc

SEQ ID NO: 209056 - DNA, 20 bp, Artificial Sequence
  Description of Artificial Sequence: Synthetic oligonucleotide
  Target: ATXN1; (-) strand; PAM type: YTN; PAM sequence: CTG
gagccttgcagggctcatgg

SEQ ID NO: 209057 - DNA, 20 bp, Artificial Sequence
  Description of Artificial Sequence: Synthetic oligonucleotide
  Target: ATXN1; (-) strand; PAM type: YTN; PAM sequence: CTC
tggagccttgcagggctcat

SEQ ID NO: 209058 - DNA, 20 bp, Artificial Sequence
  Description of Artificial Sequence: Synthetic oligonucleotide
  Target: ATXN1; (-) strand; PAM type: YTN; PAM sequence: TTA
agaatagctctggagccttg

SEQ ID NO: 209059 - DNA, 20 bp, Artificial Sequence
  Description of Artificial Sequence: Synthetic oligonucleotide
  Target: ATXN1; (-) strand; PAM type: YTN; PAM sequence: CTT
aagaatagctctggagcctt

SEQ ID NO: 209060 - DNA, 20 bp, Artificial Sequence
  Description of Artificial Sequence: Synthetic oligonucleotide
  Target: ATXN1; (-) strand; PAM type: YTN; PAM sequence: CTA
agtgcagaggatcttaagaa

SEQ ID NO: 209061 - DNA, 20 bp, Artificial Sequence
  Description of Artificial Sequence: Synthetic oligonucleotide
  Target: ATXN1; (-) strand; PAM type: YTN; PAM sequence: TTG
tctaagtgcagaggatctta

SEQ ID NO: 209062 - DNA, 20 bp, Artificial Sequence
  Description of Artificial Sequence: Synthetic oligonucleotide
  Target: ATXN1; (-) strand; PAM type: YTN; PAM sequence: CTG
cagcattgtctaagtgcaga

SEQ ID NO: 209063 - DNA, 20 bp, Artificial Sequence
  Description of Artificial Sequence: Synthetic oligonucleotide
  Target: ATXN1; (-) strand; PAM type: YTN; PAM sequence: TTA
caaaataaagaagagagtgt

SEQ ID NO: 209064 - DNA, 20 bp, Artificial Sequence
  Description of Artificial Sequence: Synthetic oligonucleotide
  Target: ATXN1; (-) strand; PAM type: YTN; PAM sequence: CTT
acaaaataaagaagagagtg

SEQ ID NO: 209065 - DNA, 20 bp, Artificial Sequence
  Description of Artificial Sequence: Synthetic oligonucleotide
  Target: ATXN1; (-) strand; PAM type: YTN; PAM sequence: TTC
ttacaaaataaagaagagag

SEQ ID NO: 209066 - DNA, 20 bp, Artificial Sequence
  Description of Artificial Sequence: Synthetic oligonucleotide
  Target: ATXN1; (-) strand; PAM type: YTN; PAM sequence: TTG
tgagcaaatgttcttacaaa

SEQ ID NO: 209067 - DNA, 20 bp, Artificial Sequence
  Description of Artificial Sequence: Synthetic oligonucleotide
  Target: ATXN1; (-) strand; PAM type: YTN; PAM sequence: TTG
aattgtgagcaaatgttctt

SEQ ID NO: 209068 - DNA, 20 bp, Artificial Sequence
  Description of Artificial Sequence: Synthetic oligonucleotide
  Target: ATXN1; (-) strand; PAM type: YTN; PAM sequence: TTT
gaattgtgagcaaatgttct

SEQ ID NO: 209069 - DNA, 20 bp, Artificial Sequence
  Description of Artificial Sequence: Synthetic oligonucleotide
  Target: ATXN1; (-) strand; PAM type: YTN; PAM sequence: TTT
tgaattgtgagcaaatgttc

SEQ ID NO: 209070 - DNA, 20 bp, Artificial Sequence
  Description of Artificial Sequence: Synthetic oligonucleotide
  Target: ATXN1; (-) strand; PAM type: YTN; PAM sequence: TTG
aataattttgaattgtgagc

SEQ ID NO: 209071 - DNA, 20 bp, Artificial Sequence
  Description of Artificial Sequence: Synthetic oligonucleotide
  Target: ATXN1; (-) strand; PAM type: YTN; PAM sequence: TTT
gaataattttgaattgtgag

SEQ ID NO: 209072 - DNA, 20 bp, Artificial Sequence
  Description of Artificial Sequence: Synthetic oligonucleotide
  Target: ATXN1; (-) strand; PAM type: YTN; PAM sequence: CTT
tgaataattttgaattgtga

SEQ ID NO: 209073 - DNA, 20 bp, Artificial Sequence
  Description of Artificial Sequence: Synthetic oligonucleotide
  Target: ATXN1; (-) strand; PAM type: YTN; PAM sequence: CTC
tttgaataattttgaattgt

SEQ ID NO: 209074 - DNA, 20 bp, Artificial Sequence
  Description of Artificial Sequence: Synthetic oligonucleotide
  Target: ATXN1; (-) strand; PAM type: YTN; PAM sequence: TTC
tctttgaataattttgaatt

SEQ ID NO: 209075 - DNA, 20 bp, Artificial Sequence
  Description of Artificial Sequence: Synthetic oligonucleotide
  Target: ATXN1; (-) strand; PAM type: YTN; PAM sequence: TTC
ccattctctttgaataattt

SEQ ID NO: 209076 - DNA, 20 bp, Artificial Sequence
  Description of Artificial Sequence: Synthetic oligonucleotide
  Target: ATXN1; (-) strand; PAM type: YTN; PAM sequence: TTT
cccattctctttgaataatt

SEQ ID NO: 209077 - DNA, 20 bp, Artificial Sequence
  Description of Artificial Sequence: Synthetic oligonucleotide
  Target: ATXN1; (-) strand; PAM type: YTN; PAM sequence: CTG
tttcccattctctttgaata

SEQ ID NO: 209078 - DNA, 20 bp, Artificial Sequence
  Description of Artificial Sequence: Synthetic oligonucleotide
  Target: ATXN1; (-) strand; PAM type: YTN; PAM sequence: TTC
ccccatgcatcatacctgtt

SEQ ID NO: 209079 - DNA, 20 bp, Artificial Sequence
  Description of Artificial Sequence: Synthetic oligonucleotide
  Target: ATXN1; (-) strand; PAM type: YTN; PAM sequence: CTT
cccccatgcatcatacctgt

SEQ ID NO: 209080 - DNA, 20 bp, Artificial Sequence
  Description of Artificial Sequence: Synthetic oligonucleotide
  Target: ATXN1; (-) strand; PAM type: YTN; PAM sequence: CTC
ttcccccatgcatcatacct

SEQ ID NO: 209081 - DNA, 20 bp, Artificial Sequence
  Description of Artificial Sequence: Synthetic oligonucleotide
  Target: ATXN1; (-) strand; PAM type: YTN; PAM sequence: CTG
agcatacctcttcccccatg

SEQ ID NO: 209082 - DNA, 20 bp, Artificial Sequence
  Description of Artificial Sequence: Synthetic oligonucleotide
  Target: ATXN1; (-) strand; PAM type: YTN; PAM sequence: CTG
aatccctgagcatacctctt

SEQ ID NO: 209083 - DNA, 20 bp, Artificial Sequence
  Description of Artificial Sequence: Synthetic oligonucleotide
  Target: ATXN1; (-) strand; PAM type: YTN; PAM sequence: CTC
cagcatctgaatccctgagc

SEQ ID NO: 209084 - DNA, 20 bp, Artificial Sequence
  Description of Artificial Sequence: Synthetic oligonucleotide
  Target: ATXN1; (-) strand; PAM type: YTN; PAM sequence: TTA
accaagagctccagcatctg

SEQ ID NO: 209085 - DNA, 20 bp, Artificial Sequence
  Description of Artificial Sequence: Synthetic oligonucleotide
  Target: ATXN1; (-) strand; PAM type: YTN; PAM sequence: CTT
aaccaagagctccagcatct

SEQ ID NO: 209086 - DNA, 20 bp, Artificial Sequence
  Description of Artificial Sequence: Synthetic oligonucleotide
  Target: ATXN1; (-) strand; PAM type: YTN; PAM sequence: TTG
cttaaccaagagctccagca

SEQ ID NO: 209087 - DNA, 20 bp, Artificial Sequence
  Description of Artificial Sequence: Synthetic oligonucleotide
  Target: ATXN1; (-) strand; PAM type: YTN; PAM sequence: CTA
agtatcatatgatccaaaag

SEQ ID NO: 209088 - DNA, 20 bp, Artificial Sequence
  Description of Artificial Sequence: Synthetic oligonucleotide
  Target: ATXN1; (-) strand; PAM type: YTN; PAM sequence: TTC
taagtatcatatgatccaaa

SEQ ID NO: 209089 - DNA, 20 bp, Artificial Sequence
  Description of Artificial Sequence: Synthetic oligonucleotide
  Target: ATXN1; (-) strand; PAM type: YTN; PAM sequence: CTT
ctaagtatcatatgatccaa

SEQ ID NO: 209090 - DNA, 20 bp, Artificial Sequence
  Description of Artificial Sequence: Synthetic oligonucleotide
  Target: ATXN1; (-) strand; PAM type: YTN; PAM sequence: TTC
ttctaagtatcatatgatcc

SEQ ID NO: 209091 - DNA, 20 bp, Artificial Sequence
  Description of Artificial Sequence: Synthetic oligonucleotide
  Target: ATXN1; (-) strand; PAM type: YTN; PAM sequence: CTG
agagagatggtagttcttct

SEQ ID NO: 209092 - DNA, 20 bp, Artificial Sequence
  Description of Artificial Sequence: Synthetic oligonucleotide
  Target: ATXN1; (-) strand; PAM type: YTN; PAM sequence: TTA
ctgagagagatggtagttct

SEQ ID NO: 209093 - DNA, 20 bp, Artificial Sequence
  Description of Artificial Sequence: Synthetic oligonucleotide
  Target: ATXN1; (-) strand; PAM type: YTN; PAM sequence: CTT
actgagagagatggtagttc

SEQ ID NO: 209094 - DNA, 20 bp, Artificial Sequence
  Description of Artificial Sequence: Synthetic oligonucleotide
  Target: ATXN1; (-) strand; PAM type: YTN; PAM sequence: TTC
ttactgagagagatggtagt

SEQ ID NO: 209095 - DNA, 20 bp, Artificial Sequence
  Description of Artificial Sequence: Synthetic oligonucleotide
  Target: ATXN1; (-) strand; PAM type: YTN; PAM sequence: CTT
cttactgagagagatggtag

SEQ ID NO: 209096 - DNA, 20 bp, Artificial Sequence
  Description of Artificial Sequence: Synthetic oligonucleotide
  Target: ATXN1; (-) strand; PAM type: YTN; PAM sequence: CTA
atcttcttactgagagagat

SEQ ID NO: 209097 - DNA, 20 bp, Artificial Sequence
  Description of Artificial Sequence: Synthetic oligonucleotide
  Target: ATXN1; (-) strand; PAM type: YTN; PAM sequence: CTG
ctaatcttcttactgagaga

SEQ ID NO: 209098 - DNA, 20 bp, Artificial Sequence
  Description of Artificial Sequence: Synthetic oligonucleotide
  Target: ATXN1; (-) strand; PAM type: YTN; PAM sequence: CTC
ctgctaatcttcttactgag

SEQ ID NO: 209099 - DNA, 20 bp, Artificial Sequence
  Description of Artificial Sequence: Synthetic oligonucleotide
  Target: ATXN1; (-) strand; PAM type: YTN; PAM sequence: TTC
tcctgctaatcttcttactg

SEQ ID NO: 209100 - DNA, 20 bp, Artificial Sequence
  Description of Artificial Sequence: Synthetic oligonucleotide
  Target: ATXN1; (-) strand; PAM type: YTN; PAM sequence: CTG
taccatatgtattctcctgc

SEQ ID NO: 209101 - DNA, 20 bp, Artificial Sequence
  Description of Artificial Sequence: Synthetic oligonucleotide
  Target: ATXN1; (-) strand; PAM type: YTN; PAM sequence: CTA
ctgtaccatatgtattctcc

SEQ ID NO: 209102 - DNA, 20 bp, Artificial Sequence
  Description of Artificial Sequence: Synthetic oligonucleotide
  Target: ATXN1; (-) strand; PAM type: YTN; PAM sequence: TTC
tactgtaccatatgtattct

SEQ ID NO: 209103 - DNA, 20 bp, Artificial Sequence
  Description of Artificial Sequence: Synthetic oligonucleotide
  Target: ATXN1; (-) strand; PAM type: YTN; PAM sequence: TTT
ctactgtaccatatgtattc

SEQ ID NO: 209104 - DNA, 20 bp, Artificial Sequence
  Description of Artificial Sequence: Synthetic oligonucleotide
  Target: ATXN1; (-) strand; PAM type: YTN; PAM sequence: TTT
tctactgtaccatatgtatt

SEQ ID NO: 209105 - DNA, 20 bp, Artificial Sequence
  Description of Artificial Sequence: Synthetic oligonucleotide
  Target: ATXN1; (-) strand; PAM type: YTN; PAM sequence: TTT
ttctactgtaccatatgtat

SEQ ID NO: 209106 - DNA, 20 bp, Artificial Sequence
  Description of Artificial Sequence: Synthetic oligonucleotide
  Target: ATXN1; (-) strand; PAM type: YTN; PAM sequence: CTG
catttttctactgtaccata

SEQ ID NO: 209107 - DNA, 20 bp, Artificial Sequence
  Description of Artificial Sequence: Synthetic oligonucleotide
  Target: ATXN1; (-) strand; PAM type: YTN; PAM sequence: TTG
aataacctgcatttttctac

SEQ ID NO: 209108 - DNA, 20 bp, Artificial Sequence
  Description of Artificial Sequence: Synthetic oligonucleotide
  Target: ATXN1; (-) strand; PAM type: YTN; PAM sequence: CTT
gaataacctgcatttttcta

SEQ ID NO: 209109 - DNA, 20 bp, Artificial Sequence
  Description of Artificial Sequence: Synthetic oligonucleotide
  Target: ATXN1; (-) strand; PAM type: YTN; PAM sequence: CTG
cttgaataacctgcattttt

SEQ ID NO: 209110 - DNA, 20 bp, Artificial Sequence
  Description of Artificial Sequence: Synthetic oligonucleotide
  Target: ATXN1; (-) strand; PAM type: YTN; PAM sequence: CTA
gggtcactgcttgaataacc

SEQ ID NO: 209111 - DNA, 20 bp, Artificial Sequence
  Description of Artificial Sequence: Synthetic oligonucleotide
  Target: ATXN1; (-) strand; PAM type: YTN; PAM sequence: CTC
atcctagggtcactgcttga

SEQ ID NO: 209112 - DNA, 20 bp, Artificial Sequence
  Description of Artificial Sequence: Synthetic oligonucleotide
  Target: ATXN1; (-) strand; PAM type: YTN; PAM sequence: TTG
aggctcatcctagggtcact

SEQ ID NO: 209113 - DNA, 20 bp, Artificial Sequence
  Description of Artificial Sequence: Synthetic oligonucleotide
  Target: ATXN1; (-) strand; PAM type: YTN; PAM sequence: TTT
gaggctcatcctagggtcac

SEQ ID NO: 209114 - DNA, 20 bp, Artificial Sequence
  Description of Artificial Sequence: Synthetic oligonucleotide
  Target: ATXN1; (-) strand; PAM type: YTN; PAM sequence: CTT
tgaggctcatcctagggtca

SEQ ID NO: 209115 - DNA, 20 bp, Artificial Sequence
  Description of Artificial Sequence: Synthetic oligonucleotide
  Target: ATXN1; (-) strand; PAM type: YTN; PAM sequence: CTA
gtaagctttgaggctcatcc

SEQ ID NO: 209116 - DNA, 20 bp, Artificial Sequence
  Description of Artificial Sequence: Synthetic oligonucleotide
  Target: ATXN1; (-) strand; PAM type: YTN; PAM sequence: TTC
cagaccacatagctagtaag

SEQ ID NO: 209117 - DNA, 20 bp, Artificial Sequence
  Description of Artificial Sequence: Synthetic oligonucleotide
  Target: ATXN1; (-) strand; PAM type: YTN; PAM sequence: TTG
ttccagaccacatagctagt

SEQ ID NO: 209118 - DNA, 20 bp, Artificial Sequence
  Description of Artificial Sequence: Synthetic oligonucleotide
  Target: ATXN1; (-) strand; PAM type: YTN; PAM sequence: CTT
gttccagaccacatagctag

SEQ ID NO: 209119 - DNA, 20 bp, Artificial Sequence
  Description of Artificial Sequence: Synthetic oligonucleotide
  Target: ATXN1; (-) strand; PAM type: YTN; PAM sequence: CTA
tagcttgttccagaccacat

SEQ ID NO: 209120 - DNA, 20 bp, Artificial Sequence
  Description of Artificial Sequence: Synthetic oligonucleotide
  Target: ATXN1; (-) strand; PAM type: YTN; PAM sequence: TTC
tatagcttgttccagaccac

SEQ ID NO: 209121 - DNA, 20 bp, Artificial Sequence
  Description of Artificial Sequence: Synthetic oligonucleotide
  Target: ATXN1; (-) strand; PAM type: YTN; PAM sequence: TTT
ctatagcttgttccagacca

SEQ ID NO: 209122 - DNA, 20 bp, Artificial Sequence
  Description of Artificial Sequence: Synthetic oligonucleotide
  Target: ATXN1; (-) strand; PAM type: YTN; PAM sequence: TTA
agggaatatagacccggcaa

SEQ ID NO: 209123 - DNA, 20 bp, Artificial Sequence
  Description of Artificial Sequence: Synthetic oligonucleotide
  Target: ATXN1; (-) strand; PAM type: YTN; PAM sequence: TTA
cggttaagggaatatagacc

SEQ ID NO: 209124 - DNA, 20 bp, Artificial Sequence
  Description of Artificial Sequence: Synthetic oligonucleotide
  Target: ATXN1; (-) strand; PAM type: YTN; PAM sequence: TTT
acggttaagggaatatagac

SEQ ID NO: 209125 - DNA, 20 bp, Artificial Sequence
  Description of Artificial Sequence: Synthetic oligonucleotide
  Target: ATXN1; (-) strand; PAM type: YTN; PAM sequence: TTT
tacggttaagggaatataga

SEQ ID NO: 209126 - DNA, 20 bp, Artificial Sequence
  Description of Artificial Sequence: Synthetic oligonucleotide
  Target: ATXN1; (-) strand; PAM type: YTN; PAM sequence: TTG
gccattttacggttaaggga

SEQ ID NO: 209127 - DNA, 20 bp, Artificial Sequence
  Description of Artificial Sequence: Synthetic oligonucleotide
  Target: ATXN1; (-) strand; PAM type: YTN; PAM sequence: CTT
ggccattttacggttaaggg

SEQ ID NO: 209128 - DNA, 20 bp, Artificial Sequence
  Description of Artificial Sequence: Synthetic oligonucleotide
  Target: ATXN1; (-) strand; PAM type: YTN; PAM sequence: TTA
tcttggccattttacggtta

SEQ ID NO: 209129 - DNA, 20 bp, Artificial Sequence
  Description of Artificial Sequence: Synthetic oligonucleotide
  Target: ATXN1; (-) strand; PAM type: YTN; PAM sequence: CTG
gtcagtatcgttatcttggc

SEQ ID NO: 209130 - DNA, 20 bp, Artificial Sequence
  Description of Artificial Sequence: Synthetic oligonucleotide
  Target: ATXN1; (-) strand; PAM type: YTN; PAM sequence: CTA
cacctggtcagtatcgttat

SEQ ID NO: 209131 - DNA, 20 bp, Artificial Sequence
  Description of Artificial Sequence: Synthetic oligonucleotide
  Target: ATXN1; (-) strand; PAM type: YTN; PAM sequence: TTA
taggcatgagacactacacc

SEQ ID NO: 209132 - DNA, 20 bp, Artificial Sequence
  Description of Artificial Sequence: Synthetic oligonucleotide
  Target: ATXN1; (-) strand; PAM type: YTN; PAM sequence: CTG
ggattataggcatgagacac

SEQ ID NO: 209133 - DNA, 20 bp, Artificial Sequence
  Description of Artificial Sequence: Synthetic oligonucleotide
  Target: ATXN1; (-) strand; PAM type: YTN; PAM sequence: CTC
ccaaagtgctgggattatag

SEQ ID NO: 209134 - DNA, 20 bp, Artificial Sequence
  Description of Artificial Sequence: Synthetic oligonucleotide
  Target: ATXN1; (-) strand; PAM type: YTN; PAM sequence: CTC
agcctcccaaagtgctggga

SEQ ID NO: 209135 - DNA, 20 bp, Artificial Sequence
  Description of Artificial Sequence: Synthetic oligonucleotide
  Target: ATXN1; (-) strand; PAM type: YTN; PAM sequence: CTC
ccatctcagcctcccaaagt

SEQ ID NO: 209136 - DNA, 20 bp, Artificial Sequence
  Description of Artificial Sequence: Synthetic oligonucleotide
  Target: ATXN1; (-) strand; PAM type: YTN; PAM sequence: CTC
aagtgatcctcccatctcag

SEQ ID NO: 209137 - DNA, 20 bp, Artificial Sequence
  Description of Artificial Sequence: Synthetic oligonucleotide
  Target: ATXN1; (-) strand; PAM type: YTN; PAM sequence: CTG
ggctcaagtgatcctcccat

SEQ ID NO: 209138 - DNA, 20 bp, Artificial Sequence
  Description of Artificial Sequence: Synthetic oligonucleotide
  Target: ATXN1; (-) strand; PAM type: YTN; PAM sequence: CTC
ctgggctcaagtgatcctcc

SEQ ID NO: 209139 - DNA, 20 bp, Artificial Sequence
  Description of Artificial Sequence: Synthetic oligonucleotide
  Target: ATXN1; (-) strand; PAM type: YTN; PAM sequence: TTG
aactcctgggctcaagtgat

SEQ ID NO: 209140 - DNA, 20 bp, Artificial Sequence
  Description of Artificial Sequence: Synthetic oligonucleotide
  Target: ATXN1; (-) strand; PAM type: YTN; PAM sequence: CTT
gaactcctgggctcaagtga

SEQ ID NO: 209141 - DNA, 20 bp, Artificial Sequence
  Description of Artificial Sequence: Synthetic oligonucleotide
  Target: ATXN1; (-) strand; PAM type: YTN; PAM sequence: CTG
gtcttgaactcctgggctca

SEQ ID NO: 209142 - DNA, 20 bp, Artificial Sequence
  Description of Artificial Sequence: Synthetic oligonucleotide
  Target: ATXN1; (-) strand; PAM type: YTN; PAM sequence: TTC
ccaggctggtcttgaactcc

SEQ ID NO: 209143 - DNA, 20 bp, Artificial Sequence
  Description of Artificial Sequence: Synthetic oligonucleotide
  Target: ATXN1; (-) strand; PAM type: YTN; PAM sequence: TTT
cccaggctggtcttgaactc

SEQ ID NO: 209144 - DNA, 20 bp, Artificial Sequence
  Description of Artificial Sequence: Synthetic oligonucleotide
  Target: ATXN1; (-) strand; PAM type: YTN; PAM sequence: CTC
acatgtttcccaggctggtc

SEQ ID NO: 209145 - DNA, 20 bp, Artificial Sequence
  Description of Artificial Sequence: Synthetic oligonucleotide
  Target: ATXN1; (-) strand; PAM type: YTN; PAM sequence: TTA
gggtctcacatgtttcccag

SEQ ID NO: 209146 - DNA, 20 bp, Artificial Sequence
  Description of Artificial Sequence: Synthetic oligonucleotide
  Target: ATXN1; (-) strand; PAM type: YTN; PAM sequence: TTG
taaagttagggtctcacatg

SEQ ID NO: 209147 - DNA, 20 bp, Artificial Sequence
  Description of Artificial Sequence: Synthetic oligonucleotide
  Target: ATXN1; (-) strand; PAM type: YTN; PAM sequence: TTT
gtaaagttagggtctcacat

SEQ ID NO: 209148 - DNA, 20 bp, Artificial Sequence
  Description of Artificial Sequence: Synthetic oligonucleotide
  Target: ATXN1; (-) strand; PAM type: YTN; PAM sequence: TTA
tttgtaaagttagggtctca

SEQ ID NO: 209149 - DNA, 20 bp, Artificial Sequence
  Description of Artificial Sequence: Synthetic oligonucleotide
  Target: ATXN1; (-) strand; PAM type: YTN; PAM sequence: TTA
aacattatttgtaaagttag

SEQ ID NO: 209150 - DNA, 20 bp, Artificial Sequence
  Description of Artificial Sequence: Synthetic oligonucleotide
  Target: ATXN1; (-) strand; PAM type: YTN; PAM sequence: TTT
aaacattatttgtaaagtta

SEQ ID NO: 209151 - DNA, 20 bp, Artificial Sequence
  Description of Artificial Sequence: Synthetic oligonucleotide
  Target: ATXN1; (-) strand; PAM type: YTN; PAM sequence: TTT
taaacattatttgtaaagtt

SEQ ID NO: 209152 - DNA, 20 bp, Artificial Sequence
  Description of Artificial Sequence: Synthetic oligonucleotide
  Target: ATXN1; (-) strand; PAM type: YTN; PAM sequence: TTT
ttaaacattatttgtaaagt

SEQ ID NO: 209153 - DNA, 20 bp, Artificial Sequence
  Description of Artificial Sequence: Synthetic oligonucleotide
  Target: ATXN1; (-) strand; PAM type: YTN; PAM sequence: TTT
tttaaacattatttgtaaag

SEQ ID NO: 209154 - DNA, 20 bp, Artificial Sequence
  Description of Artificial Sequence: Synthetic oligonucleotide
  Target: ATXN1; (-) strand; PAM type: YTN; PAM sequence: CTA
attttttaaacattatttgt

SEQ ID NO: 209155 - DNA, 20 bp, Artificial Sequence
  Description of Artificial Sequence: Synthetic oligonucleotide
  Target: ATXN1; (-) strand; PAM type: YTN; PAM sequence: CTG
gctaattttttaaacattat

SEQ ID NO: 209156 - DNA, 20 bp, Artificial Sequence
  Description of Artificial Sequence: Synthetic oligonucleotide
  Target: ATXN1; (-) strand; PAM type: YTN; PAM sequence: CTA
tatgtacgtgccaccacacc

SEQ ID NO: 209157 - DNA, 20 bp, Artificial Sequence
  Description of Artificial Sequence: Synthetic oligonucleotide
  Target: ATXN1; (-) strand; PAM type: YTN; PAM sequence: CTG
gactatatgtacgtgccacc

SEQ ID NO: 209158 - DNA, 20 bp, Artificial Sequence
  Description of Artificial Sequence: Synthetic oligonucleotide
  Target: ATXN1; (-) strand; PAM type: YTN; PAM sequence: CTG
agtatctggactatatgtac

SEQ ID NO: 209159 - DNA, 20 bp, Artificial Sequence
  Description of Artificial Sequence: Synthetic oligonucleotide
  Target: ATXN1; (-) strand; PAM type: YTN; PAM sequence: CTC
ctgagtatctggactatatg

SEQ ID NO: 209160 - DNA, 20 bp, Artificial Sequence
  Description of Artificial Sequence: Synthetic oligonucleotide
  Target: ATXN1; (-) strand; PAM type: YTN; PAM sequence: CTC
atcctcctgagtatctggac

SEQ ID NO: 209161 - DNA, 20 bp, Artificial Sequence
  Description of Artificial Sequence: Synthetic oligonucleotide
  Target: ATXN1; (-) strand; PAM type: YTN; PAM sequence: TTC
aagcgatccccccacctcat

SEQ ID NO: 209162 - DNA, 20 bp, Artificial Sequence
  Description of Artificial Sequence: Synthetic oligonucleotide
  Target: ATXN1; (-) strand; PAM type: YTN; PAM sequence: CTG
ggttcaagcgatccccccac

SEQ ID NO: 209163 - DNA, 20 bp, Artificial Sequence
  Description of Artificial Sequence: Synthetic oligonucleotide
  Target: ATXN1; (-) strand; PAM type: YTN; PAM sequence: CTC
ctgggttcaagcgatccccc

SEQ ID NO: 209164 - DNA, 20 bp, Artificial Sequence
  Description of Artificial Sequence: Synthetic oligonucleotide
  Target: ATXN1; (-) strand; PAM type: YTN; PAM sequence: TTG
aactcctgggttcaagcgat

SEQ ID NO: 209165 - DNA, 20 bp, Artificial Sequence
  Description of Artificial Sequence: Synthetic oligonucleotide
  Target: ATXN1; (-) strand; PAM type: YTN; PAM sequence: CTT
gaactcctgggttcaagcga

SEQ ID NO: 209166 - DNA, 20 bp, Artificial Sequence
  Description of Artificial Sequence: Synthetic oligonucleotide
  Target: ATXN1; (-) strand; PAM type: YTN; PAM sequence: CTC
acagcagccttgaactcctg

SEQ ID NO: 209167 - DNA, 20 bp, Artificial Sequence
  Description of Artificial Sequence: Synthetic oligonucleotide
  Target: ATXN1; (-) strand; PAM type: YTN; PAM sequence: TTG
tacctcacagcagccttgaa

SEQ ID NO: 209168 - DNA, 20 bp, Artificial Sequence
  Description of Artificial Sequence: Synthetic oligonucleotide
  Target: ATXN1; (-) strand; PAM type: YTN; PAM sequence: CTG
gagtgcagtggcgtgattgt

SEQ ID NO: 209169 - DNA, 20 bp, Artificial Sequence
  Description of Artificial Sequence: Synthetic oligonucleotide
  Target: ATXN1; (-) strand; PAM type: YTN; PAM sequence: CTC
caggctggagtgcagtggcg

SEQ ID NO: 209170 - DNA, 20 bp, Artificial Sequence
  Description of Artificial Sequence: Synthetic oligonucleotide
  Target: ATXN1; (-) strand; PAM type: YTN; PAM sequence: CTG
tactccaggctggagtgcag

SEQ ID NO: 209171 - DNA, 20 bp, Artificial Sequence
  Description of Artificial Sequence: Synthetic oligonucleotide
  Target: ATXN1; (-) strand; PAM type: YTN; PAM sequence: CTC
cagagtgacacactgtactc

SEQ ID NO: 209172 - DNA, 20 bp, Artificial Sequence
  Description of Artificial Sequence: Synthetic oligonucleotide
  Target: ATXN1; (-) strand; PAM type: YTN; PAM sequence: CTG
tctccagagtgacacactgt

SEQ ID NO: 209173 - DNA, 20 bp, Artificial Sequence
  Description of Artificial Sequence: Synthetic oligonucleotide
  Target: ATXN1; (-) strand; PAM type: YTN; PAM sequence: CTC
tgtctccagagtgacacact

SEQ ID NO: 209174 - DNA, 20 bp, Artificial Sequence
  Description of Artificial Sequence: Synthetic oligonucleotide
  Target: ATXN1; (-) strand; PAM type: YTN; PAM sequence: CTC
gctctgtctccagagtgaca

SEQ ID NO: 209175 - DNA, 20 bp, Artificial Sequence
  Description of Artificial Sequence: Synthetic oligonucleotide
  Target: ATXN1; (-) strand; PAM type: YTN; PAM sequence: TTG
agacagggtctcgctctgtc

SEQ ID NO: 209176 - DNA, 20 bp, Artificial Sequence
  Description of Artificial Sequence: Synthetic oligonucleotide
  Target: ATXN1; (-) strand; PAM type: YTN; PAM sequence: TTT
gagacagggtctcgctctgt

SEQ ID NO: 209177 - DNA, 20 bp, Artificial Sequence
  Description of Artificial Sequence: Synthetic oligonucleotide
  Target: ATXN1; (-) strand; PAM type: YTN; PAM sequence: TTT
tgagacagggtctcgctctg

SEQ ID NO: 209178 - DNA, 20 bp, Artificial Sequence
  Description of Artificial Sequence: Synthetic oligonucleotide
  Target: ATXN1; (-) strand; PAM type: YTN; PAM sequence: TTT
ttgagacagggtctcgctct

SEQ ID NO: 209179 - DNA, 20 bp, Artificial Sequence
  Description of Artificial Sequence: Synthetic oligonucleotide
  Target: ATXN1; (-) strand; PAM type: YTN; PAM sequence: TTG
tttttgagacagggtctcgc

SEQ ID NO: 209180 - DNA, 20 bp, Artificial Sequence
  Description of Artificial Sequence: Synthetic oligonucleotide
  Target: ATXN1; (-) strand; PAM type: YTN; PAM sequence: TTT
gtttttgagacagggtctcg

SEQ ID NO: 209181 - DNA, 20 bp, Artificial Sequence
  Description of Artificial Sequence: Synthetic oligonucleotide
  Target: ATXN1; (-) strand; PAM type: YTN; PAM sequence: TTG
tttgtttttgagacagggtc

SEQ ID NO: 209182 - DNA, 20 bp, Artificial Sequence
  Description of Artificial Sequence: Synthetic oligonucleotide
  Target: ATXN1; (-) strand; PAM type: YTN; PAM sequence: TTT
gtttgtttttgagacagggt

SEQ ID NO: 209183 - DNA, 20 bp, Artificial Sequence
  Description of Artificial Sequence: Synthetic oligonucleotide
  Target: ATXN1; (-) strand; PAM type: YTN; PAM sequence: TTG
tttgtttgtttttgagacag

SEQ ID NO: 209184 - DNA, 20 bp, Artificial Sequence
  Description of Artificial Sequence: Synthetic oligonucleotide
  Target: ATXN1; (-) strand; PAM type: YTN; PAM sequence: TTT
gtttgtttgtttttgagaca

SEQ ID NO: 209185 - DNA, 20 bp, Artificial Sequence
  Description of Artificial Sequence: Synthetic oligonucleotide
  Target: ATXN1; (-) strand; PAM type: YTN; PAM sequence: TTT
tgtttgtttgtttttgagac

SEQ ID NO: 209186 - DNA, 20 bp, Artificial Sequence
  Description of Artificial Sequence: Synthetic oligonucleotide
  Target: ATXN1; (-) strand; PAM type: YTN; PAM sequence: TTT
ttgtttgtttgtttttgaga

SEQ ID NO: 209187 - DNA, 20 bp, Artificial Sequence
  Description of Artificial Sequence: Synthetic oligonucleotide
  Target: ATXN1; (-) strand; PAM type: YTN; PAM sequence: CTT
tttgtttgtttgtttttgag

SEQ ID NO: 209188 - DNA, 20 bp, Artificial Sequence
  Description of Artificial Sequence: Synthetic oligonucleotide
  Target: ATXN1; (-) strand; PAM type: YTN; PAM sequence: TTC
tttttgtttgtttgtttttg

SEQ ID NO: 209189 - DNA, 20 bp, Artificial Sequence
  Description of Artificial Sequence: Synthetic oligonucleotide
  Target: ATXN1; (-) strand; PAM type: YTN; PAM sequence: TTG
tcattctttttgtttgtttg

SEQ ID NO: 209190 - DNA, 20 bp, Artificial Sequence
  Description of Artificial Sequence: Synthetic oligonucleotide
  Target: ATXN1; (-) strand; PAM type: YTN; PAM sequence: TTA
attgtcattctttttgtttg

SEQ ID NO: 209191 - DNA, 20 bp, Artificial Sequence
  Description of Artificial Sequence: Synthetic oligonucleotide
  Target: ATXN1; (-) strand; PAM type: YTN; PAM sequence: TTG
agttaattgtcattcttttt

SEQ ID NO: 209192 - DNA, 20 bp, Artificial Sequence
  Description of Artificial Sequence: Synthetic oligonucleotide
  Target: ATXN1; (-) strand; PAM type: YTN; PAM sequence: TTT
gagttaattgtcattctttt

SEQ ID NO: 209193 - DNA, 20 bp, Artificial Sequence
  Description of Artificial Sequence: Synthetic oligonucleotide
  Target: ATXN1; (-) strand; PAM type: YTN; PAM sequence: CTT
tgagttaattgtcattcttt

SEQ ID NO: 209194 - DNA, 20 bp, Artificial Sequence
  Description of Artificial Sequence: Synthetic oligonucleotide
  Target: ATXN1; (-) strand; PAM type: YTN; PAM sequence: CTC
tttgagttaattgtcattct

SEQ ID NO: 209195 - DNA, 20 bp, Artificial Sequence
  Description of Artificial Sequence: Synthetic oligonucleotide
  Target: ATXN1; (-) strand; PAM type: YTN; PAM sequence: CTC
atcccataactctttgagtt

SEQ ID NO: 209196 - DNA, 20 bp, Artificial Sequence
  Description of Artificial Sequence: Synthetic oligonucleotide
  Target: ATXN1; (-) strand; PAM type: YTN; PAM sequence: TTA
tctcatcccataactctttg

SEQ ID NO: 209197 - DNA, 20 bp, Artificial Sequence
  Description of Artificial Sequence: Synthetic oligonucleotide
  Target: ATXN1; (-) strand; PAM type: YTN; PAM sequence: CTT
atctcatcccataactcttt

SEQ ID NO: 209198 - DNA, 20 bp, Artificial Sequence
  Description of Artificial Sequence: Synthetic oligonucleotide
  Target: ATXN1; (-) strand; PAM type: YTN; PAM sequence: CTA
aatatagaaccttatctcat

SEQ ID NO: 209199 - DNA, 20 bp, Artificial Sequence
  Description of Artificial Sequence: Synthetic oligonucleotide
  Target: ATXN1; (-) strand; PAM type: YTN; PAM sequence: TTC
taaatatagaaccttatctc

SEQ ID NO: 209200 - DNA, 20 bp, Artificial Sequence
  Description of Artificial Sequence: Synthetic oligonucleotide
  Target: ATXN1; (-) strand; PAM type: YTN; PAM sequence: CTA
ggtgttctaaatatagaacc

SEQ ID NO: 209201 - DNA, 20 bp, Artificial Sequence
  Description of Artificial Sequence: Synthetic oligonucleotide
  Target: ATXN1; (-) strand; PAM type: YTN; PAM sequence: CTG
tgctaggtgttctaaatata

SEQ ID NO: 209202 - DNA, 20 bp, Artificial Sequence
  Description of Artificial Sequence: Synthetic oligonucleotide
  Target: ATXN1; (-) strand; PAM type: YTN; PAM sequence: CTA
tgtcctgtgctaggtgttct

SEQ ID NO: 209203 - DNA, 20 bp, Artificial Sequence
  Description of Artificial Sequence: Synthetic oligonucleotide
  Target: ATXN1; (-) strand; PAM type: YTN; PAM sequence: TTG
agcctatgtcctgtgctagg

SEQ ID NO: 209204 - DNA, 20 bp, Artificial Sequence
  Description of Artificial Sequence: Synthetic oligonucleotide
  Target: ATXN1; (-) strand; PAM type: YTN; PAM sequence: TTG
attgagcctatgtcctgtgc

SEQ ID NO: 209205 - DNA, 20 bp, Artificial Sequence
  Description of Artificial Sequence: Synthetic oligonucleotide
  Target: ATXN1; (-) strand; PAM type: YTN; PAM sequence: CTG
aatattgattgagcctatgt

SEQ ID NO: 209206 - DNA, 20 bp, Artificial Sequence
  Description of Artificial Sequence: Synthetic oligonucleotide
  Target: ATXN1; (-) strand; PAM type: YTN; PAM sequence: TTG
aatactgaatattgattgag

SEQ ID NO: 209207 - DNA, 20 bp, Artificial Sequence
  Description of Artificial Sequence: Synthetic oligonucleotide
  Target: ATXN1; (-) strand; PAM type: YTN; PAM sequence: TTA
ttgaatactgaatattgatt

SEQ ID NO: 209208 - DNA, 20 bp, Artificial Sequence
  Description of Artificial Sequence: Synthetic oligonucleotide
  Target: ATXN1; (-) strand; PAM type: YTN; PAM sequence: TTT
attgaatactgaatattgat

SEQ ID NO: 209209 - DNA, 20 bp, Artificial Sequence
  Description of Artificial Sequence: Synthetic oligonucleotide
  Target: ATXN1; (-) strand; PAM type: YTN; PAM sequence: CTA
tgtaaggagacatagtaaag

SEQ ID NO: 209210 - DNA, 20 bp, Artificial Sequence
  Description of Artificial Sequence: Synthetic oligonucleotide
  Target: ATXN1; (-) strand; PAM type: YTN; PAM sequence: TTA
gcagcactatgtaaggagac

SEQ ID NO: 209211 - DNA, 20 bp, Artificial Sequence
  Description of Artificial Sequence: Synthetic oligonucleotide
  Target: ATXN1; (-) strand; PAM type: YTN; PAM sequence: CTT
agcagcactatgtaaggaga

SEQ ID NO: 209212 - DNA, 20 bp, Artificial Sequence
  Description of Artificial Sequence: Synthetic oligonucleotide
  Target: ATXN1; (-) strand; PAM type: YTN; PAM sequence: TTC
ttagcagcactatgtaagga

SEQ ID NO: 209213 - DNA, 20 bp, Artificial Sequence
  Description of Artificial Sequence: Synthetic oligonucleotide
  Target: ATXN1; (-) strand; PAM type: YTN; PAM sequence: TTT
cttagcagcactatgtaagg

SEQ ID NO: 209214 - DNA, 20 bp, Artificial Sequence
  Description of Artificial Sequence: Synthetic oligonucleotide
  Target: ATXN1; (-) strand; PAM type: YTN; PAM sequence: CTT
tcttagcagcactatgtaag

SEQ ID NO: 209215 - DNA, 20 bp, Artificial Sequence
  Description of Artificial Sequence: Synthetic oligonucleotide
  Target: ATXN1; (-) strand; PAM type: YTN; PAM sequence: TTC
gcaggtgaggctttcttagc

SEQ ID NO: 209216 - DNA, 20 bp, Artificial Sequence
  Description of Artificial Sequence: Synthetic oligonucleotide
  Target: ATXN1; (-) strand; PAM type: YTN; PAM sequence: TTC
accatccaggtacccatcac

SEQ ID NO: 209217 - DNA, 20 bp, Artificial Sequence
  Description of Artificial Sequence: Synthetic oligonucleotide
  Target: ATXN1; (-) strand; PAM type: YTN; PAM sequence: TTT
caccatccaggtacccatca

SEQ ID NO: 209218 - DNA, 20 bp, Artificial Sequence
  Description of Artificial Sequence: Synthetic oligonucleotide
  Target: ATXN1; (-) strand; PAM type: YTN; PAM sequence: TTG
gaaatacgtttcaccatcca

SEQ ID NO: 209219 - DNA, 20 bp, Artificial Sequence
  Description of Artificial Sequence: Synthetic oligonucleotide
  Target: ATXN1; (-) strand; PAM type: YTN; PAM sequence: CTT
ggaaatacgtttcaccatcc

SEQ ID NO: 209220 - DNA, 20 bp, Artificial Sequence
  Description of Artificial Sequence: Synthetic oligonucleotide
  Target: ATXN1; (-) strand; PAM type: YTN; PAM sequence: CTG
gtcttggaaatacgtttcac

SEQ ID NO: 209221 - DNA, 20 bp, Artificial Sequence
  Description of Artificial Sequence: Synthetic oligonucleotide
  Target: ATXN1; (-) strand; PAM type: YTN; PAM sequence: TTA
gacctggtcttggaaatacg

SEQ ID NO: 209222 - DNA, 20 bp, Artificial Sequence
  Description of Artificial Sequence: Synthetic oligonucleotide
  Target: ATXN1; (-) strand; PAM type: YTN; PAM sequence: CTT
agacctggtcttggaaatac

SEQ ID NO: 209223 - DNA, 20 bp, Artificial Sequence
  Description of Artificial Sequence: Synthetic oligonucleotide
  Target: ATXN1; (-) strand; PAM type: YTN; PAM sequence: TTC
atagtatccatgaaataact

SEQ ID NO: 209224 - DNA, 20 bp, Artificial Sequence
  Description of Artificial Sequence: Synthetic oligonucleotide
  Target: ATXN1; (-) strand; PAM type: YTN; PAM sequence: TTT
catagtatccatgaaataac

SEQ ID NO: 209225 - DNA, 20 bp, Artificial Sequence
  Description of Artificial Sequence: Synthetic oligonucleotide
  Target: ATXN1; (-) strand; PAM type: YTN; PAM sequence: TTA
gatttcatagtatccatgaa

SEQ ID NO: 209226 - DNA, 20 bp, Artificial Sequence
  Description of Artificial Sequence: Synthetic oligonucleotide
  Target: ATXN1; (-) strand; PAM type: YTN; PAM sequence: TTA
agataacattagatttcata

SEQ ID NO: 209227 - DNA, 20 bp, Artificial Sequence
  Description of Artificial Sequence: Synthetic oligonucleotide
  Target: ATXN1; (-) strand; PAM type: YTN; PAM sequence: CTT
aagataacattagatttcat

SEQ ID NO: 209228 - DNA, 20 bp, Artificial Sequence
  Description of Artificial Sequence: Synthetic oligonucleotide
  Target: ATXN1; (-) strand; PAM type: YTN; PAM sequence: TTG
gatcttaagataacattaga

SEQ ID NO: 209229 - DNA, 20 bp, Artificial Sequence
  Description of Artificial Sequence: Synthetic oligonucleotide
  Target: ATXN1; (-) strand; PAM type: YTN; PAM sequence: TTT
ggatcttaagataacattag

SEQ ID NO: 209230 - DNA, 20 bp, Artificial Sequence
  Description of Artificial Sequence: Synthetic oligonucleotide
  Target: ATXN1; (-) strand; PAM type: YTN; PAM sequence: CTT
tggatcttaagataacatta

SEQ ID NO: 209231 - DNA, 20 bp, Artificial Sequence
  Description of Artificial Sequence: Synthetic oligonucleotide
  Target: ATXN1; (-) strand; PAM type: YTN; PAM sequence: CTG
cactttggatcttaagataa

SEQ ID NO: 209232 - DNA, 20 bp, Artificial Sequence
  Description of Artificial Sequence: Synthetic oligonucleotide
  Target: ATXN1; (-) strand; PAM type: YTN; PAM sequence: CTC
tgcactttggatcttaagat

SEQ ID NO: 209233 - DNA, 20 bp, Artificial Sequence
  Description of Artificial Sequence: Synthetic oligonucleotide
  Target: ATXN1; (-) strand; PAM type: YTN; PAM sequence: TTA
agatcctctgcactttggat

SEQ ID NO: 209234 - DNA, 20 bp, Artificial Sequence
  Description of Artificial Sequence: Synthetic oligonucleotide
  Target: ATXN1; (-) strand; PAM type: YTN; PAM sequence: CTT
aagatcctctgcactttgga

SEQ ID NO: 209235 - DNA, 20 bp, Artificial Sequence
  Description of Artificial Sequence: Synthetic oligonucleotide
  Target: ATXN1; (-) strand; PAM type: YTN; PAM sequence: TTC
ttaagatcctctgcactttg

SEQ ID NO: 209236 - DNA, 20 bp, Artificial Sequence
  Description of Artificial Sequence: Synthetic oligonucleotide
  Target: ATXN1; (-) strand; PAM type: YTN; PAM sequence: CTA
ttcttaagatcctctgcact

SEQ ID NO: 209237 - DNA, 20 bp, Artificial Sequence
  Description of Artificial Sequence: Synthetic oligonucleotide
  Target: ATXN1; (-) strand; PAM type: YTN; PAM sequence: CTC
cagagctattcttaagatcc

SEQ ID NO: 209238 - DNA, 20 bp, Artificial Sequence
  Description of Artificial Sequence: Synthetic oligonucleotide
  Target: ATXN1; (-) strand; PAM type: YTN; PAM sequence: CTG
catggctccagagctattct

SEQ ID NO: 209239 - DNA, 20 bp, Artificial Sequence
  Description of Artificial Sequence: Synthetic oligonucleotide
  Target: ATXN1; (-) strand; PAM type: YTN; PAM sequence: TTA
tcccctgcatggctccagag

SEQ ID NO: 209240 - DNA, 20 bp, Artificial Sequence
  Description of Artificial Sequence: Synthetic oligonucleotide
  Target: ATXN1; (-) strand; PAM type: YTN; PAM sequence: CTG
cccattatcccctgcatggc

SEQ ID NO: 209241 - DNA, 20 bp, Artificial Sequence
  Description of Artificial Sequence: Synthetic oligonucleotide
  Target: ATXN1; (-) strand; PAM type: YTN; PAM sequence: CTC
aaaaaataaaaataaaaaaa

SEQ ID NO: 209242 - DNA, 20 bp, Artificial Sequence
  Description of Artificial Sequence: Synthetic oligonucleotide
  Target: ATXN1; (-) strand; PAM type: YTN; PAM sequence: CTG
tgtctcaaaaaataaaaata

SEQ ID NO: 209243 - DNA, 20 bp, Artificial Sequence
  Description of Artificial Sequence: Synthetic oligonucleotide
  Target: ATXN1; (-) strand; PAM type: YTN; PAM sequence: CTG
ggcgacagagcaagactgtg

SEQ ID NO: 209244 - DNA, 20 bp, Artificial Sequence
  Description of Artificial Sequence: Synthetic oligonucleotide
  Target: ATXN1; (-) strand; PAM type: YTN; PAM sequence: CTC
cagcctgggcgacagagcaa

SEQ ID NO: 209245 - DNA, 20 bp, Artificial Sequence
  Description of Artificial Sequence: Synthetic oligonucleotide
  Target: ATXN1; (-) strand; PAM type: YTN; PAM sequence: TTG
aacccaggagtcggaggtca

SEQ ID NO: 209246 - DNA, 20 bp, Artificial Sequence
  Description of Artificial Sequence: Synthetic oligonucleotide
  Target: ATXN1; (-) strand; PAM type: YTN; PAM sequence: CTT
gaacccaggagtcggaggtc

SEQ ID NO: 209247 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcacttgaa

SEQ ID NO: 209248 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 209249 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 209250 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 209251 - DNA, 20 bp, Artificial Sequence
  Description of Artificial Sequence: Synthetic oligonucleotide
  Target: ATXN1; (-) strand; PAM type: YTN; PAM sequence: CTG
tagtcccagctacttgggag

SEQ ID NO: 209252 - DNA, 20 bp, Artificial Sequence
  Description of Artificial Sequence: Synthetic oligonucleotide
  Target: ATXN1; (-) strand; PAM type: YTN; PAM sequence: TTG
gtggcaggcgcctgtagtcc

SEQ ID NO: 209253 - DNA, 20 bp, Artificial Sequence
  Description of Artificial Sequence: Synthetic oligonucleotide
  Target: ATXN1; (-) strand; PAM type: YTN; PAM sequence: TTT
ggtggcaggcgcctgtagtc

SEQ ID NO: 209254 - DNA, 20 bp, Artificial Sequence
  Description of Artificial Sequence: Synthetic oligonucleotide
  Target: ATXN1; (-) strand; PAM type: YTN; PAM sequence: TTA
gccaggtttggtggcaggcg

SEQ ID NO: 209255 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaaaattagcca

SEQ ID NO: 209256 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaaaattag

SEQ ID NO: 209257 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaaaatt

SEQ ID NO: 209258 - DNA, 20 bp, Artificial Sequence
  Description of Artificial Sequence: Synthetic oligonucleotide
  Target: ATXN1; (-) strand; PAM type: YTN; PAM sequence: CTA
acacggcgaaaccccatctc

SEQ ID NO: 209259 - DNA, 20 bp, Artificial Sequence
  Description of Artificial Sequence: Synthetic oligonucleotide
  Target: ATXN1; (-) strand; PAM type: YTN; PAM sequence: CTG
gctaacacggcgaaacccca

SEQ ID NO: 209260 - DNA, 20 bp, Artificial Sequence
  Description of Artificial Sequence: Synthetic oligonucleotide
  Target: ATXN1; (-) strand; PAM type: YTN; PAM sequence: CTG
aggcgggcggatcacgaggt

SEQ ID NO: 209261 - DNA, 20 bp, Artificial Sequence
  Description of Artificial Sequence: Synthetic oligonucleotide
  Target: ATXN1; (-) strand; PAM type: YTN; PAM sequence: TTC
gggaggctgaggcgggcgga

SEQ ID NO: 209262 - DNA, 20 bp, Artificial Sequence
  Description of Artificial Sequence: Synthetic oligonucleotide
  Target: ATXN1; (-) strand; PAM type: YTN; PAM sequence: CTT
cgggaggctgaggcgggcgg

SEQ ID NO: 209263 - DNA, 20 bp, Artificial Sequence
  Description of Artificial Sequence: Synthetic oligonucleotide
  Target: ATXN1; (-) strand; PAM type: YTN; PAM sequence: TTG
taatcccagcacttcgggag

SEQ ID NO: 209264 - DNA, 20 bp, Artificial Sequence
  Description of Artificial Sequence: Synthetic oligonucleotide
  Target: ATXN1; (-) strand; PAM type: YTN; PAM sequence: CTT
gtaatcccagcacttcggga

SEQ ID NO: 209265 - DNA, 20 bp, Artificial Sequence
  Description of Artificial Sequence: Synthetic oligonucleotide
  Target: ATXN1; (-) strand; PAM type: YTN; PAM sequence: CTC
atgcttgtaatcccagcact

SEQ ID NO: 209266 - DNA, 20 bp, Artificial Sequence
  Description of Artificial Sequence: Synthetic oligonucleotide
  Target: ATXN1; (-) strand; PAM type: YTN; PAM sequence: TTA
gggccgggcgtgatggctca

SEQ ID NO: 209267 - DNA, 20 bp, Artificial Sequence
  Description of Artificial Sequence: Synthetic oligonucleotide
  Target: ATXN1; (-) strand; PAM type: YTN; PAM sequence: TTT
agggccgggcgtgatggctc

SEQ ID NO: 209268 - DNA, 20 bp, Artificial Sequence
  Description of Artificial Sequence: Synthetic oligonucleotide
  Target: ATXN1; (-) strand; PAM type: YTN; PAM sequence: TTC
aatttagggccgggcgtgat

SEQ ID NO: 209269 - DNA, 20 bp, Artificial Sequence
  Description of Artificial Sequence: Synthetic oligonucleotide
  Target: ATXN1; (-) strand; PAM type: YTN; PAM sequence: TTC
ccccaaaattcaatttaggg

SEQ ID NO: 209270 - DNA, 20 bp, Artificial Sequence
  Description of Artificial Sequence: Synthetic oligonucleotide
  Target: ATXN1; (-) strand; PAM type: YTN; PAM sequence: TTT
cccccaaaattcaatttagg

SEQ ID NO: 209271 - DNA, 20 bp, Artificial Sequence
  Description of Artificial Sequence: Synthetic oligonucleotide
  Target: ATXN1; (-) strand; PAM type: YTN; PAM sequence: CTT
tcccccaaaattcaatttag

SEQ ID NO: 209272 - DNA, 20 bp, Artificial Sequence
  Description of Artificial Sequence: Synthetic oligonucleotide
  Target: ATXN1; (-) strand; PAM type: YTN; PAM sequence: CTG
tatactttcccccaaaattc

SEQ ID NO: 209273 - DNA, 20 bp, Artificial Sequence
  Description of Artificial Sequence: Synthetic oligonucleotide
  Target: ATXN1; (-) strand; PAM type: YTN; PAM sequence: CTC
atggaactgtatactttccc

SEQ ID NO: 209274 - DNA, 20 bp, Artificial Sequence
  Description of Artificial Sequence: Synthetic oligonucleotide
  Target: ATXN1; (-) strand; PAM type: YTN; PAM sequence: CTC
aaaaacaaacaaacaacaca

SEQ ID NO: 209275 - DNA, 20 bp, Artificial Sequence
  Description of Artificial Sequence: Synthetic oligonucleotide
  Target: ATXN1; (-) strand; PAM type: YTN; PAM sequence: CTG
cgcaataagagcaaaagtcc

SEQ ID NO: 209276 - DNA, 20 bp, Artificial Sequence
  Description of Artificial Sequence: Synthetic oligonucleotide
  Target: ATXN1; (-) strand; PAM type: YTN; PAM sequence: CTC
cagcctgcgcaataagagca

SEQ ID NO: 209277 - DNA, 20 bp, Artificial Sequence
  Description of Artificial Sequence: Synthetic oligonucleotide
  Target: ATXN1; (-) strand; PAM type: YTN; PAM sequence: TTG
tactccagcctgcgcaataa

SEQ ID NO: 209278 - DNA, 20 bp, Artificial Sequence
  Description of Artificial Sequence: Synthetic oligonucleotide
  Target: ATXN1; (-) strand; PAM type: YTN; PAM sequence: TTG
cagtgagccaagatcgcacc

SEQ ID NO: 209279 - DNA, 20 bp, Artificial Sequence
  Description of Artificial Sequence: Synthetic oligonucleotide
  Target: ATXN1; (-) strand; PAM type: YTN; PAM sequence: TTG
aacccgggaggcagaggttg

SEQ ID NO: 209280 - DNA, 20 bp, Artificial Sequence
  Description of Artificial Sequence: Synthetic oligonucleotide
  Target: ATXN1; (-) strand; PAM type: YTN; PAM sequence: CTT
gaacccgggaggcagaggtt

SEQ ID NO: 209281 - DNA, 20 bp, Artificial Sequence
  Description of Artificial Sequence: Synthetic oligonucleotide
  Target: ATXN1; (-) strand; PAM type: YTN; PAM sequence: CTG
aggcaggagaatcgcttgaa

SEQ ID NO: 209282 - DNA, 20 bp, Artificial Sequence
  Description of Artificial Sequence: Synthetic oligonucleotide
  Target: ATXN1; (-) strand; PAM type: YTN; PAM sequence: TTG
ggaggctgaggcaggagaat

SEQ ID NO: 209283 - DNA, 20 bp, Artificial Sequence
  Description of Artificial Sequence: Synthetic oligonucleotide
  Target: ATXN1; (-) strand; PAM type: YTN; PAM sequence: CTT
gggaggctgaggcaggagaa

SEQ ID NO: 209284 - DNA, 20 bp, Artificial Sequence
  Description of Artificial Sequence: Synthetic oligonucleotide
  Target: ATXN1; (-) strand; PAM type: YTN; PAM sequence: CTA
cttgggaggctgaggcagga

SEQ ID NO: 209285 - DNA, 20 bp, Artificial Sequence
  Description of Artificial Sequence: Synthetic oligonucleotide
  Target: ATXN1; (-) strand; PAM type: YTN; PAM sequence: CTG
taatcccagctacttgggag

SEQ ID NO: 209286 - DNA, 20 bp, Artificial Sequence
  Description of Artificial Sequence: Synthetic oligonucleotide
  Target: ATXN1; (-) strand; PAM type: YTN; PAM sequence: TTG
gcgcatgcctgtaatcccag

SEQ ID NO: 209287 - DNA, 20 bp, Artificial Sequence
  Description of Artificial Sequence: Synthetic oligonucleotide
  Target: ATXN1; (-) strand; PAM type: YTN; PAM sequence: CTG
ggcatgttggcgcatgcctg

SEQ ID NO: 209288 - DNA, 20 bp, Artificial Sequence
  Description of Artificial Sequence: Synthetic oligonucleotide
  Target: ATXN1; (-) strand; PAM type: YTN; PAM sequence: TTA
gctgggcatgttggcgcatg

SEQ ID NO: 209289 - DNA, 20 bp, Artificial Sequence
  Description of Artificial Sequence: Synthetic oligonucleotide
  Target: ATXN1; (-) strand; PAM type: YTN; PAM sequence: CTA
aaaatacaaaacattagctg

SEQ ID NO: 209290 - DNA, 20 bp, Artificial Sequence
  Description of Artificial Sequence: Synthetic oligonucleotide
  Target: ATXN1; (-) strand; PAM type: YTN; PAM sequence: CTA
ctaaaaatacaaaacattag

SEQ ID NO: 209291 - DNA, 20 bp, Artificial Sequence
  Description of Artificial Sequence: Synthetic oligonucleotide
  Target: ATXN1; (-) strand; PAM type: YTN; PAM sequence: CTC
tactaaaaatacaaaacatt

SEQ ID NO: 209292 - DNA, 20 bp, Artificial Sequence
  Description of Artificial Sequence: Synthetic oligonucleotide
  Target: ATXN1; (-) strand; PAM type: YTN; PAM sequence: CTG
gtgaaaccccatctctacta

SEQ ID NO: 209293 - DNA, 20 bp, Artificial Sequence
  Description of Artificial Sequence: Synthetic oligonucleotide
  Target: ATXN1; (-) strand; PAM type: YTN; PAM sequence: TTA
aactggtgaaaccccatctc

SEQ ID NO: 209294 - DNA, 20 bp, Artificial Sequence
  Description of Artificial Sequence: Synthetic oligonucleotide
  Target: ATXN1; (-) strand; PAM type: YTN; PAM sequence: TTT
aaactggtgaaaccccatct

SEQ ID NO: 209295 - DNA, 20 bp, Artificial Sequence
  Description of Artificial Sequence: Synthetic oligonucleotide
  Target: ATXN1; (-) strand; PAM type: YTN; PAM sequence: TTT
taaactggtgaaaccccatc

SEQ ID NO: 209296 - DNA, 20 bp, Artificial Sequence
  Description of Artificial Sequence: Synthetic oligonucleotide
  Target: ATXN1; (-) strand; PAM type: YTN; PAM sequence: CTG
aggtcaggagttttaaactg

SEQ ID NO: 209297 - DNA, 20 bp, Artificial Sequence
  Description of Artificial Sequence: Synthetic oligonucleotide
  Target: ATXN1; (-) strand; PAM type: YTN; PAM sequence: TTG
ggaggccaaggcgggtggat

SEQ ID NO: 209298 - DNA, 20 bp, Artificial Sequence
  Description of Artificial Sequence: Synthetic oligonucleotide
  Target: ATXN1; (-) strand; PAM type: YTN; PAM sequence: TTT
gggaggccaaggcgggtgga

SEQ ID NO: 209299 - DNA, 20 bp, Artificial Sequence
  Description of Artificial Sequence: Synthetic oligonucleotide
  Target: ATXN1; (-) strand; PAM type: YTN; PAM sequence: CTT
tgggaggccaaggcgggtgg

SEQ ID NO: 209300 - DNA, 20 bp, Artificial Sequence
  Description of Artificial Sequence: Synthetic oligonucleotide
  Target: ATXN1; (-) strand; PAM type: YTN; PAM sequence: CTG
taatcccaacactttgggag

SEQ ID NO: 209301 - DNA, 20 bp, Artificial Sequence
  Description of Artificial Sequence: Synthetic oligonucleotide
  Target: ATXN1; (-) strand; PAM type: YTN; PAM sequence: CTC
atgcctgtaatcccaacact

SEQ ID NO: 209302 - DNA, 20 bp, Artificial Sequence
  Description of Artificial Sequence: Synthetic oligonucleotide
  Target: ATXN1; (-) strand; PAM type: YTN; PAM sequence: CTG
gccggacgcggtggctcatg

SEQ ID NO: 209303 - DNA, 20 bp, Artificial Sequence
  Description of Artificial Sequence: Synthetic oligonucleotide
  Target: ATXN1; (-) strand; PAM type: YTN; PAM sequence: CTG
cctggccggacgcggtggct

SEQ ID NO: 209304 - DNA, 20 bp, Artificial Sequence
  Description of Artificial Sequence: Synthetic oligonucleotide
  Target: ATXN1; (-) strand; PAM type: YTN; PAM sequence: TTA
tataacagggctgcctggcc

SEQ ID NO: 209305 - DNA, 20 bp, Artificial Sequence
  Description of Artificial Sequence: Synthetic oligonucleotide
  Target: ATXN1; (-) strand; PAM type: YTN; PAM sequence: CTT
atataacagggctgcctggc

SEQ ID NO: 209306 - DNA, 20 bp, Artificial Sequence
  Description of Artificial Sequence: Synthetic oligonucleotide
  Target: ATXN1; (-) strand; PAM type: YTN; PAM sequence: CTG
ggcttatataacagggctgc

SEQ ID NO: 209307 - DNA, 20 bp, Artificial Sequence
  Description of Artificial Sequence: Synthetic oligonucleotide
  Target: ATXN1; (-) strand; PAM type: YTN; PAM sequence: TTA
cagcagagctgggcttatat

SEQ ID NO: 209308 - DNA, 20 bp, Artificial Sequence
  Description of Artificial Sequence: Synthetic oligonucleotide
  Target: ATXN1; (-) strand; PAM type: YTN; PAM sequence: TTT
acagcagagctgggcttata

SEQ ID NO: 209309 - DNA, 20 bp, Artificial Sequence
  Description of Artificial Sequence: Synthetic oligonucleotide
  Target: ATXN1; (-) strand; PAM type: YTN; PAM sequence: CTA
gtttacagcagagctgggct

SEQ ID NO: 209310 - DNA, 20 bp, Artificial Sequence
  Description of Artificial Sequence: Synthetic oligonucleotide
  Target: ATXN1; (-) strand; PAM type: YTN; PAM sequence: TTC
ccaaggccacaaaggactag

SEQ ID NO: 209311 - DNA, 20 bp, Artificial Sequence
  Description of Artificial Sequence: Synthetic oligonucleotide
  Target: ATXN1; (-) strand; PAM type: YTN; PAM sequence: TTT
cccaaggccacaaaggacta

SEQ ID NO: 209312 - DNA, 20 bp, Artificial Sequence
  Description of Artificial Sequence: Synthetic oligonucleotide
  Target: ATXN1; (-) strand; PAM type: YTN; PAM sequence: CTT
tcccaaggccacaaaggact

SEQ ID NO: 209313 - DNA, 20 bp, Artificial Sequence
  Description of Artificial Sequence: Synthetic oligonucleotide
  Target: ATXN1; (-) strand; PAM type: YTN; PAM sequence: TTA
gagagggtataactttccca

SEQ ID NO: 209314 - DNA, 20 bp, Artificial Sequence
  Description of Artificial Sequence: Synthetic oligonucleotide
  Target: ATXN1; (-) strand; PAM type: YTN; PAM sequence: CTT
agagagggtataactttccc

SEQ ID NO: 209315 - DNA, 20 bp, Artificial Sequence
  Description of Artificial Sequence: Synthetic oligonucleotide
  Target: ATXN1; (-) strand; PAM type: YTN; PAM sequence: CTG
aggcttagagagggtataac

SEQ ID NO: 209316 - DNA, 20 bp, Artificial Sequence
  Description of Artificial Sequence: Synthetic oligonucleotide
  Target: ATXN1; (-) strand; PAM type: YTN; PAM sequence: TTC
acagatgtagaaactgaggc

SEQ ID NO: 209317 - DNA, 20 bp, Artificial Sequence
  Description of Artificial Sequence: Synthetic oligonucleotide
  Target: ATXN1; (-) strand; PAM type: YTN; PAM sequence: CTT
cacagatgtagaaactgagg

SEQ ID NO: 209318 - DNA, 20 bp, Artificial Sequence
  Description of Artificial Sequence: Synthetic oligonucleotide
  Target: ATXN1; (-) strand; PAM type: YTN; PAM sequence: TTC
acttcacagatgtagaaact

SEQ ID NO: 209319 - DNA, 20 bp, Artificial Sequence
  Description of Artificial Sequence: Synthetic oligonucleotide
  Target: ATXN1; (-) strand; PAM type: YTN; PAM sequence: TTT
cacttcacagatgtagaaac

SEQ ID NO: 209320 - DNA, 20 bp, Artificial Sequence
  Description of Artificial Sequence: Synthetic oligonucleotide
  Target: ATXN1; (-) strand; PAM type: YTN; PAM sequence: CTT
tcacttcacagatgtagaaa

SEQ ID NO: 209321 - DNA, 20 bp, Artificial Sequence
  Description of Artificial Sequence: Synthetic oligonucleotide
  Target: ATXN1; (-) strand; PAM type: YTN; PAM sequence: TTA
cgccaaccctttcacttcac

SEQ ID NO: 209322 - DNA, 20 bp, Artificial Sequence
  Description of Artificial Sequence: Synthetic oligonucleotide
  Target: ATXN1; (-) strand; PAM type: YTN; PAM sequence: CTT
acgccaaccctttcacttca

SEQ ID NO: 209323 - DNA, 20 bp, Artificial Sequence
  Description of Artificial Sequence: Synthetic oligonucleotide
  Target: ATXN1; (-) strand; PAM type: YTN; PAM sequence: TTG
gagaggtcccttacgccaac

SEQ ID NO: 209324 - DNA, 20 bp, Artificial Sequence
  Description of Artificial Sequence: Synthetic oligonucleotide
  Target: ATXN1; (-) strand; PAM type: YTN; PAM sequence: CTT
ggagaggtcccttacgccaa

SEQ ID NO: 209325 - DNA, 20 bp, Artificial Sequence
  Description of Artificial Sequence: Synthetic oligonucleotide
  Target: ATXN1; (-) strand; PAM type: YTN; PAM sequence: CTA
gaatggaccttggagaggtc

SEQ ID NO: 209326 - DNA, 20 bp, Artificial Sequence
  Description of Artificial Sequence: Synthetic oligonucleotide
  Target: ATXN1; (-) strand; PAM type: YTN; PAM sequence: TTG
ggagctagaatggaccttgg

SEQ ID NO: 209327 - DNA, 20 bp, Artificial Sequence
  Description of Artificial Sequence: Synthetic oligonucleotide
  Target: ATXN1; (-) strand; PAM type: YTN; PAM sequence: CTT
gggagctagaatggaccttg

SEQ ID NO: 209328 - DNA, 20 bp, Artificial Sequence
  Description of Artificial Sequence: Synthetic oligonucleotide
  Target: ATXN1; (-) strand; PAM type: YTN; PAM sequence: TTG
cagaacttgggagctagaat

SEQ ID NO: 209329 - DNA, 20 bp, Artificial Sequence
  Description of Artificial Sequence: Synthetic oligonucleotide
  Target: ATXN1; (-) strand; PAM type: YTN; PAM sequence: TTG
tgatgcacataattgcagaa

SEQ ID NO: 209330 - DNA, 20 bp, Artificial Sequence
  Description of Artificial Sequence: Synthetic oligonucleotide
  Target: ATXN1; (-) strand; PAM type: YTN; PAM sequence: TTT
gtgatgcacataattgcaga

SEQ ID NO: 209331 - DNA, 20 bp, Artificial Sequence
  Description of Artificial Sequence: Synthetic oligonucleotide
  Target: ATXN1; (-) strand; PAM type: YTN; PAM sequence: TTT
tgtgatgcacataattgcag

SEQ ID NO: 209332 - DNA, 20 bp, Artificial Sequence
  Description of Artificial Sequence: Synthetic oligonucleotide
  Target: ATXN1; (-) strand; PAM type: YTN; PAM sequence: CTA
ttttgtgatgcacataattg

SEQ ID NO: 209333 - DNA, 20 bp, Artificial Sequence
  Description of Artificial Sequence: Synthetic oligonucleotide
  Target: ATXN1; (-) strand; PAM type: YTN; PAM sequence: TTC
ctattttgtgatgcacataa

SEQ ID NO: 209334 - DNA, 20 bp, Artificial Sequence
  Description of Artificial Sequence: Synthetic oligonucleotide
  Target: ATXN1; (-) strand; PAM type: YTN; PAM sequence: TTT
cctattttgtgatgcacata

SEQ ID NO: 209335 - DNA, 20 bp, Artificial Sequence
  Description of Artificial Sequence: Synthetic oligonucleotide
  Target: ATXN1; (-) strand; PAM type: YTN; PAM sequence: TTA
tatgtccaggtttcctattt

SEQ ID NO: 209336 - DNA, 20 bp, Artificial Sequence
  Description of Artificial Sequence: Synthetic oligonucleotide
  Target: ATXN1; (-) strand; PAM type: YTN; PAM sequence: CTT
atatgtccaggtttcctatt

SEQ ID NO: 209337 - DNA, 20 bp, Artificial Sequence
  Description of Artificial Sequence: Synthetic oligonucleotide
  Target: ATXN1; (-) strand; PAM type: YTN; PAM sequence: CTC
ccttatatgtccaggtttcc

SEQ ID NO: 209338 - DNA, 20 bp, Artificial Sequence
  Description of Artificial Sequence: Synthetic oligonucleotide
  Target: ATXN1; (-) strand; PAM type: YTN; PAM sequence: TTC
tcccttatatgtccaggttt

SEQ ID NO: 209339 - DNA, 20 bp, Artificial Sequence
  Description of Artificial Sequence: Synthetic oligonucleotide
  Target: ATXN1; (-) strand; PAM type: YTN; PAM sequence: TTA
attctcccttatatgtccag

SEQ ID NO: 209340 - DNA, 20 bp, Artificial Sequence
  Description of Artificial Sequence: Synthetic oligonucleotide
  Target: ATXN1; (-) strand; PAM type: YTN; PAM sequence: CTT
aattctcccttatatgtcca

SEQ ID NO: 209341 - DNA, 20 bp, Artificial Sequence
  Description of Artificial Sequence: Synthetic oligonucleotide
  Target: ATXN1; (-) strand; PAM type: YTN; PAM sequence: TTG
acaacacttaattctccctt

SEQ ID NO: 209342 - DNA, 20 bp, Artificial Sequence
  Description of Artificial Sequence: Synthetic oligonucleotide
  Target: ATXN1; (-) strand; PAM type: YTN; PAM sequence: TTT
gacaacacttaattctccct

SEQ ID NO: 209343 - DNA, 20 bp, Artificial Sequence
  Description of Artificial Sequence: Synthetic oligonucleotide
  Target: ATXN1; (-) strand; PAM type: YTN; PAM sequence: TTT
tgacaacacttaattctccc

SEQ ID NO: 209344 - DNA, 20 bp, Artificial Sequence
  Description of Artificial Sequence: Synthetic oligonucleotide
  Target: ATXN1; (-) strand; PAM type: YTN; PAM sequence: TTT
ttgacaacacttaattctcc

SEQ ID NO: 209345 - DNA, 20 bp, Artificial Sequence
  Description of Artificial Sequence: Synthetic oligonucleotide
  Target: ATXN1; (-) strand; PAM type: YTN; PAM sequence: TTT
tttgacaacacttaattctc

SEQ ID NO: 209346 - DNA, 20 bp, Artificial Sequence
  Description of Artificial Sequence: Synthetic oligonucleotide
  Target: ATXN1; (-) strand; PAM type: YTN; PAM sequence: TTA
cattttttgacaacacttaa

SEQ ID NO: 209347 - DNA, 20 bp, Artificial Sequence
  Description of Artificial Sequence: Synthetic oligonucleotide
  Target: ATXN1; (-) strand; PAM type: YTN; PAM sequence: TTT
acattttttgacaacactta

SEQ ID NO: 209348 - DNA, 20 bp, Artificial Sequence
  Description of Artificial Sequence: Synthetic oligonucleotide
  Target: ATXN1; (-) strand; PAM type: YTN; PAM sequence: TTG
cataatttacattttttgac

SEQ ID NO: 209349 - DNA, 20 bp, Artificial Sequence
  Description of Artificial Sequence: Synthetic oligonucleotide
  Target: ATXN1; (-) strand; PAM type: YTN; PAM sequence: CTT
gcataatttacattttttga

SEQ ID NO: 209350 - DNA, 20 bp, Artificial Sequence
  Description of Artificial Sequence: Synthetic oligonucleotide
  Target: ATXN1; (-) strand; PAM type: YTN; PAM sequence: CTC
acttgcataatttacatttt

SEQ ID NO: 209351 - DNA, 20 bp, Artificial Sequence
  Description of Artificial Sequence: Synthetic oligonucleotide
  Target: ATXN1; (-) strand; PAM type: YTN; PAM sequence: TTG
tctcacttgcataatttaca

SEQ ID NO: 209352 - DNA, 20 bp, Artificial Sequence
  Description of Artificial Sequence: Synthetic oligonucleotide
  Target: ATXN1; (-) strand; PAM type: YTN; PAM sequence: CTG
attgtctcacttgcataatt

SEQ ID NO: 209353 - DNA, 20 bp, Artificial Sequence
  Description of Artificial Sequence: Synthetic oligonucleotide
  Target: ATXN1; (-) strand; PAM type: YTN; PAM sequence: TTA
agtggatcatgaaacatgtg

SEQ ID NO: 209354 - DNA, 20 bp, Artificial Sequence
  Description of Artificial Sequence: Synthetic oligonucleotide
  Target: ATXN1; (-) strand; PAM type: YTN; PAM sequence: TTA
ccatgcagcgcaatatcaat

SEQ ID NO: 209355 - DNA, 20 bp, Artificial Sequence
  Description of Artificial Sequence: Synthetic oligonucleotide
  Target: ATXN1; (-) strand; PAM type: YTN; PAM sequence: CTC
aattaccatgcagcgcaata

SEQ ID NO: 209356 - DNA, 20 bp, Artificial Sequence
  Description of Artificial Sequence: Synthetic oligonucleotide
  Target: ATXN1; (-) strand; PAM type: YTN; PAM sequence: TTC
caagctcaattaccatgcag

SEQ ID NO: 209357 - DNA, 20 bp, Artificial Sequence
  Description of Artificial Sequence: Synthetic oligonucleotide
  Target: ATXN1; (-) strand; PAM type: YTN; PAM sequence: TTT
ccaagctcaattaccatgca

SEQ ID NO: 209358 - DNA, 20 bp, Artificial Sequence
  Description of Artificial Sequence: Synthetic oligonucleotide
  Target: ATXN1; (-) strand; PAM type: YTN; PAM sequence: CTT
tccaagctcaattaccatgc

SEQ ID NO: 209359 - DNA, 20 bp, Artificial Sequence
  Description of Artificial Sequence: Synthetic oligonucleotide
  Target: ATXN1; (-) strand; PAM type: YTN; PAM sequence: TTG
ggacatgctttccaagctca

SEQ ID NO: 209360 - DNA, 20 bp, Artificial Sequence
  Description of Artificial Sequence: Synthetic oligonucleotide
  Target: ATXN1; (-) strand; PAM type: YTN; PAM sequence: CTG
acacattgggacatgctttc

SEQ ID NO: 209361 - DNA, 20 bp, Artificial Sequence
  Description of Artificial Sequence: Synthetic oligonucleotide
  Target: ATXN1; (-) strand; PAM type: YTN; PAM sequence: TTA
cacatgaatataacactgac

SEQ ID NO: 209362 - DNA, 20 bp, Artificial Sequence
  Description of Artificial Sequence: Synthetic oligonucleotide
  Target: ATXN1; (-) strand; PAM type: YTN; PAM sequence: TTG
aagttacacatgaatataac

SEQ ID NO: 209363 - DNA, 20 bp, Artificial Sequence
  Description of Artificial Sequence: Synthetic oligonucleotide
  Target: ATXN1; (-) strand; PAM type: YTN; PAM sequence: TTT
gaagttacacatgaatataa

SEQ ID NO: 209364 - DNA, 20 bp, Artificial Sequence
  Description of Artificial Sequence: Synthetic oligonucleotide
  Target: ATXN1; (-) strand; PAM type: YTN; PAM sequence: TTT
tgaagttacacatgaatata

SEQ ID NO: 209365 - DNA, 20 bp, Artificial Sequence
  Description of Artificial Sequence: Synthetic oligonucleotide
  Target: ATXN1; (-) strand; PAM type: YTN; PAM sequence: TTC
cattttgaagttacacatga

SEQ ID NO: 209366 - DNA, 20 bp, Artificial Sequence
  Description of Artificial Sequence: Synthetic oligonucleotide
  Target: ATXN1; (-) strand; PAM type: YTN; PAM sequence: CTG
acattccattttgaagttac

SEQ ID NO: 209367 - DNA, 20 bp, Artificial Sequence
  Description of Artificial Sequence: Synthetic oligonucleotide
  Target: ATXN1; (-) strand; PAM type: YTN; PAM sequence: TTC
ccacccaccccagacactga

SEQ ID NO: 209368 - DNA, 20 bp, Artificial Sequence
  Description of Artificial Sequence: Synthetic oligonucleotide
  Target: ATXN1; (-) strand; PAM type: YTN; PAM sequence: TTT
cccacccaccccagacactg

SEQ ID NO: 209369 - DNA, 20 bp, Artificial Sequence
  Description of Artificial Sequence: Synthetic oligonucleotide
  Target: ATXN1; (-) strand; PAM type: YTN; PAM sequence: TTG
gatttcccacccaccccaga

SEQ ID NO: 209370 - DNA, 20 bp, Artificial Sequence
  Description of Artificial Sequence: Synthetic oligonucleotide
  Target: ATXN1; (-) strand; PAM type: YTN; PAM sequence: TTT
ggatttcccacccaccccag

SEQ ID NO: 209371 - DNA, 20 bp, Artificial Sequence
  Description of Artificial Sequence: Synthetic oligonucleotide
  Target: ATXN1; (-) strand; PAM type: YTN; PAM sequence: CTT
tggatttcccacccacccca

SEQ ID NO: 209372 - DNA, 20 bp, Artificial Sequence
  Description of Artificial Sequence: Synthetic oligonucleotide
  Target: ATXN1; (-) strand; PAM type: YTN; PAM sequence: TTC
cctttggatttcccacccac

SEQ ID NO: 209373 - DNA, 20 bp, Artificial Sequence
  Description of Artificial Sequence: Synthetic oligonucleotide
  Target: ATXN1; (-) strand; PAM type: YTN; PAM sequence: CTT
ccctttggatttcccaccca

SEQ ID NO: 209374 - DNA, 20 bp, Artificial Sequence
  Description of Artificial Sequence: Synthetic oligonucleotide
  Target: ATXN1; (-) strand; PAM type: YTN; PAM sequence: TTA
gaacttccctttggatttcc

SEQ ID NO: 209375 - DNA, 20 bp, Artificial Sequence
  Description of Artificial Sequence: Synthetic oligonucleotide
  Target: ATXN1; (-) strand; PAM type: YTN; PAM sequence: CTT
agaacttccctttggatttc

SEQ ID NO: 209376 - DNA, 20 bp, Artificial Sequence
  Description of Artificial Sequence: Synthetic oligonucleotide
  Target: ATXN1; (-) strand; PAM type: YTN; PAM sequence: CTC
ttagaacttccctttggatt

SEQ ID NO: 209377 - DNA, 20 bp, Artificial Sequence
  Description of Artificial Sequence: Synthetic oligonucleotide
  Target: ATXN1; (-) strand; PAM type: YTN; PAM sequence: TTC
actcttagaacttccctttg

SEQ ID NO: 209378 - DNA, 20 bp, Artificial Sequence
  Description of Artificial Sequence: Synthetic oligonucleotide
  Target: ATXN1; (-) strand; PAM type: YTN; PAM sequence: CTT
cactcttagaacttcccttt

SEQ ID NO: 209379 - DNA, 20 bp, Artificial Sequence
  Description of Artificial Sequence: Synthetic oligonucleotide
  Target: ATXN1; (-) strand; PAM type: YTN; PAM sequence: CTA
tcagatggaaacaggcttca

SEQ ID NO: 209380 - DNA, 20 bp, Artificial Sequence
  Description of Artificial Sequence: Synthetic oligonucleotide
  Target: ATXN1; (-) strand; PAM type: YTN; PAM sequence: TTG
acctatcagatggaaacagg

SEQ ID NO: 209381 - DNA, 20 bp, Artificial Sequence
  Description of Artificial Sequence: Synthetic oligonucleotide
  Target: ATXN1; (-) strand; PAM type: YTN; PAM sequence: TTT
gacctatcagatggaaacag

SEQ ID NO: 209382 - DNA, 20 bp, Artificial Sequence
  Description of Artificial Sequence: Synthetic oligonucleotide
  Target: ATXN1; (-) strand; PAM type: YTN; PAM sequence: TTT
tgacctatcagatggaaaca

SEQ ID NO: 209383 - DNA, 20 bp, Artificial Sequence
  Description of Artificial Sequence: Synthetic oligonucleotide
  Target: ATXN1; (-) strand; PAM type: YTN; PAM sequence: TTC
atgtattttgacctatcaga

SEQ ID NO: 209384 - DNA, 20 bp, Artificial Sequence
  Description of Artificial Sequence: Synthetic oligonucleotide
  Target: ATXN1; (-) strand; PAM type: YTN; PAM sequence: CTA
gagagatgggtacatattca

SEQ ID NO: 209385 - DNA, 20 bp, Artificial Sequence
  Description of Artificial Sequence: Synthetic oligonucleotide
  Target: ATXN1; (-) strand; PAM type: YTN; PAM sequence: TTG
cctagagagatgggtacata

SEQ ID NO: 209386 - DNA, 20 bp, Artificial Sequence
  Description of Artificial Sequence: Synthetic oligonucleotide
  Target: ATXN1; (-) strand; PAM type: YTN; PAM sequence: TTG
accatggttgcctagagaga

SEQ ID NO: 209387 - DNA, 20 bp, Artificial Sequence
  Description of Artificial Sequence: Synthetic oligonucleotide
  Target: ATXN1; (-) strand; PAM type: YTN; PAM sequence: TTC
aacagttgaccatggttgcc

SEQ ID NO: 209388 - DNA, 20 bp, Artificial Sequence
  Description of Artificial Sequence: Synthetic oligonucleotide
  Target: ATXN1; (-) strand; PAM type: YTN; PAM sequence: TTT
caacagttgaccatggttgc

SEQ ID NO: 209389 - DNA, 20 bp, Artificial Sequence
  Description of Artificial Sequence: Synthetic oligonucleotide
  Target: ATXN1; (-) strand; PAM type: YTN; PAM sequence: TTT
tcaacagttgaccatggttg

SEQ ID NO: 209390 - DNA, 20 bp, Artificial Sequence
  Description of Artificial Sequence: Synthetic oligonucleotide
  Target: ATXN1; (-) strand; PAM type: YTN; PAM sequence: TTG
atgtaaagcaagaagtggtt

SEQ ID NO: 209391 - DNA, 20 bp, Artificial Sequence
  Description of Artificial Sequence: Synthetic oligonucleotide
  Target: ATXN1; (-) strand; PAM type: YTN; PAM sequence: TTT
gatgtaaagcaagaagtggt

SEQ ID NO: 209392 - DNA, 20 bp, Artificial Sequence
  Description of Artificial Sequence: Synthetic oligonucleotide
  Target: ATXN1; (-) strand; PAM type: YTN; PAM sequence: TTT
tgatgtaaagcaagaagtgg

SEQ ID NO: 209393 - DNA, 20 bp, Artificial Sequence
  Description of Artificial Sequence: Synthetic oligonucleotide
  Target: ATXN1; (-) strand; PAM type: YTN; PAM sequence: CTA
acacattttgatgtaaagca

SEQ ID NO: 209394 - DNA, 20 bp, Artificial Sequence
  Description of Artificial Sequence: Synthetic oligonucleotide
  Target: ATXN1; (-) strand; PAM type: YTN; PAM sequence: CTA
ctaacacattttgatgtaaa

SEQ ID NO: 209395 - DNA, 20 bp, Artificial Sequence
  Description of Artificial Sequence: Synthetic oligonucleotide
  Target: ATXN1; (-) strand; PAM type: YTN; PAM sequence: TTC
tactaacacattttgatgta

SEQ ID NO: 209396 - DNA, 20 bp, Artificial Sequence
  Description of Artificial Sequence: Synthetic oligonucleotide
  Target: ATXN1; (-) strand; PAM type: YTN; PAM sequence: TTT
ctactaacacattttgatgt

SEQ ID NO: 209397 - DNA, 20 bp, Artificial Sequence
  Description of Artificial Sequence: Synthetic oligonucleotide
  Target: ATXN1; (-) strand; PAM type: YTN; PAM sequence: TTT
tctactaacacattttgatg

SEQ ID NO: 209398 - DNA, 20 bp, Artificial Sequence
  Description of Artificial Sequence: Synthetic oligonucleotide
  Target: ATXN1; (-) strand; PAM type: YTN; PAM sequence: TTG
ttttctactaacacattttg

SEQ ID NO: 209399 - DNA, 20 bp, Artificial Sequence
  Description of Artificial Sequence: Synthetic oligonucleotide
  Target: ATXN1; (-) strand; PAM type: YTN; PAM sequence: TTT
gttttctactaacacatttt

SEQ ID NO: 209400 - DNA, 20 bp, Artificial Sequence
  Description of Artificial Sequence: Synthetic oligonucleotide
  Target: ATXN1; (-) strand; PAM type: YTN; PAM sequence: TTT
tgttttctactaacacattt

SEQ ID NO: 209401 - DNA, 20 bp, Artificial Sequence
  Description of Artificial Sequence: Synthetic oligonucleotide
  Target: ATXN1; (-) strand; PAM type: YTN; PAM sequence: TTT
ttgttttctactaacacatt

SEQ ID NO: 209402 - DNA, 20 bp, Artificial Sequence
  Description of Artificial Sequence: Synthetic oligonucleotide
  Target: ATXN1; (-) strand; PAM type: YTN; PAM sequence: TTG
acccaaggtatttttgtttt

SEQ ID NO: 209403 - DNA, 20 bp, Artificial Sequence
  Description of Artificial Sequence: Synthetic oligonucleotide
  Target: ATXN1; (-) strand; PAM type: YTN; PAM sequence: CTT
gacccaaggtatttttgttt

SEQ ID NO: 209404 - DNA, 20 bp, Artificial Sequence
  Description of Artificial Sequence: Synthetic oligonucleotide
  Target: ATXN1; (-) strand; PAM type: YTN; PAM sequence: TTG
gggatatgcttgacccaagg

SEQ ID NO: 209405 - DNA, 20 bp, Artificial Sequence
  Description of Artificial Sequence: Synthetic oligonucleotide
  Target: ATXN1; (-) strand; PAM type: YTN; PAM sequence: TTT
ggggatatgcttgacccaag

SEQ ID NO: 209406 - DNA, 20 bp, Artificial Sequence
  Description of Artificial Sequence: Synthetic oligonucleotide
  Target: ATXN1; (-) strand; PAM type: YTN; PAM sequence: TTA
ggaatttggggatatgcttg

SEQ ID NO: 209407 - DNA, 20 bp, Artificial Sequence
  Description of Artificial Sequence: Synthetic oligonucleotide
  Target: ATXN1; (-) strand; PAM type: YTN; PAM sequence: TTT
aggaatttggggatatgctt

SEQ ID NO: 209408 - DNA, 20 bp, Artificial Sequence
  Description of Artificial Sequence: Synthetic oligonucleotide
  Target: ATXN1; (-) strand; PAM type: YTN; PAM sequence: CTT
taggaatttggggatatgct

SEQ ID NO: 209409 - DNA, 20 bp, Artificial Sequence
  Description of Artificial Sequence: Synthetic oligonucleotide
  Target: ATXN1; (-) strand; PAM type: YTN; PAM sequence: TTG
ggcataaaaaatgagcaaag

SEQ ID NO: 209410 - DNA, 20 bp, Artificial Sequence
  Description of Artificial Sequence: Synthetic oligonucleotide
  Target: ATXN1; (-) strand; PAM type: YTN; PAM sequence: TTT
gggcataaaaaatgagcaaa

SEQ ID NO: 209411 - DNA, 20 bp, Artificial Sequence
  Description of Artificial Sequence: Synthetic oligonucleotide
  Target: ATXN1; (-) strand; PAM type: YTN; PAM sequence: TTT
tgggcataaaaaatgagcaa

SEQ ID NO: 209412 - DNA, 20 bp, Artificial Sequence
  Description of Artificial Sequence: Synthetic oligonucleotide
  Target: ATXN1; (-) strand; PAM type: YTN; PAM sequence: TTA
gagattttgggcataaaaaa

SEQ ID NO: 209413 - DNA, 20 bp, Artificial Sequence
  Description of Artificial Sequence: Synthetic oligonucleotide
  Target: ATXN1; (-) strand; PAM type: YTN; PAM sequence: CTT
agagattttgggcataaaaa

SEQ ID NO: 209414 - DNA, 20 bp, Artificial Sequence
  Description of Artificial Sequence: Synthetic oligonucleotide
  Target: ATXN1; (-) strand; PAM type: YTN; PAM sequence: TTC
ttagagattttgggcataaa

SEQ ID NO: 209415 - DNA, 20 bp, Artificial Sequence
  Description of Artificial Sequence: Synthetic oligonucleotide
  Target: ATXN1; (-) strand; PAM type: YTN; PAM sequence: TTT
cttagagattttgggcataa

SEQ ID NO: 209416 - DNA, 20 bp, Artificial Sequence
  Description of Artificial Sequence: Synthetic oligonucleotide
  Target: ATXN1; (-) strand; PAM type: YTN; PAM sequence: CTG
tgatcaatttcttagagatt

SEQ ID NO: 209417 - DNA, 20 bp, Artificial Sequence
  Description of Artificial Sequence: Synthetic oligonucleotide
  Target: ATXN1; (-) strand; PAM type: YTN; PAM sequence: TTA
ggatctgtgatcaatttctt

SEQ ID NO: 209418 - DNA, 20 bp, Artificial Sequence
  Description of Artificial Sequence: Synthetic oligonucleotide
  Target: ATXN1; (-) strand; PAM type: YTN; PAM sequence: TTG
accatattaggatctgtgat

SEQ ID NO: 209419 - DNA, 20 bp, Artificial Sequence
  Description of Artificial Sequence: Synthetic oligonucleotide
  Target: ATXN1; (-) strand; PAM type: YTN; PAM sequence: CTG
tggttgaccatattaggatc

SEQ ID NO: 209420 - DNA, 20 bp, Artificial Sequence
  Description of Artificial Sequence: Synthetic oligonucleotide
  Target: ATXN1; (-) strand; PAM type: YTN; PAM sequence: CTG
cagacctgtggttgaccata

SEQ ID NO: 209421 - DNA, 20 bp, Artificial Sequence
  Description of Artificial Sequence: Synthetic oligonucleotide
  Target: ATXN1; (-) strand; PAM type: YTN; PAM sequence: TTG
tgacctgcagacctgtggtt

SEQ ID NO: 209422 - DNA, 20 bp, Artificial Sequence
  Description of Artificial Sequence: Synthetic oligonucleotide
  Target: ATXN1; (-) strand; PAM type: YTN; PAM sequence: TTC
agaccatgcccaaaaagata

SEQ ID NO: 209423 - DNA, 20 bp, Artificial Sequence
  Description of Artificial Sequence: Synthetic oligonucleotide
  Target: ATXN1; (-) strand; PAM type: YTN; PAM sequence: TTT
cagaccatgcccaaaaagat

SEQ ID NO: 209424 - DNA, 20 bp, Artificial Sequence
  Description of Artificial Sequence: Synthetic oligonucleotide
  Target: ATXN1; (-) strand; PAM type: YTN; PAM sequence: TTG
ggcatttcagaccatgccca

SEQ ID NO: 209425 - DNA, 20 bp, Artificial Sequence
  Description of Artificial Sequence: Synthetic oligonucleotide
  Target: ATXN1; (-) strand; PAM type: YTN; PAM sequence: CTT
gggcatttcagaccatgccc

SEQ ID NO: 209426 - DNA, 20 bp, Artificial Sequence
  Description of Artificial Sequence: Synthetic oligonucleotide
  Target: ATXN1; (-) strand; PAM type: YTN; PAM sequence: CTC
ggatgccttgggcatttcag

SEQ ID NO: 209427 - DNA, 20 bp, Artificial Sequence
  Description of Artificial Sequence: Synthetic oligonucleotide
  Target: ATXN1; (-) strand; PAM type: YTN; PAM sequence: TTC
ctcggatgccttgggcattt

SEQ ID NO: 209428 - DNA, 20 bp, Artificial Sequence
  Description of Artificial Sequence: Synthetic oligonucleotide
  Target: ATXN1; (-) strand; PAM type: YTN; PAM sequence: TTT
cctcggatgccttgggcatt

SEQ ID NO: 209429 - DNA, 20 bp, Artificial Sequence
  Description of Artificial Sequence: Synthetic oligonucleotide
  Target: ATXN1; (-) strand; PAM type: YTN; PAM sequence: TTT
tcctcggatgccttgggcat

SEQ ID NO: 209430 - DNA, 20 bp, Artificial Sequence
  Description of Artificial Sequence: Synthetic oligonucleotide
  Target: ATXN1; (-) strand; PAM type: YTN; PAM sequence: TTT
ttcctcggatgccttgggca

SEQ ID NO: 209431 - DNA, 20 bp, Artificial Sequence
  Description of Artificial Sequence: Synthetic oligonucleotide
  Target: ATXN1; (-) strand; PAM type: YTN; PAM sequence: CTT
tttcctcggatgccttgggc

SEQ ID NO: 209432 - DNA, 20 bp, Artificial Sequence
  Description of Artificial Sequence: Synthetic oligonucleotide
  Target: ATXN1; (-) strand; PAM type: YTN; PAM sequence: CTA
tagaccaagcacgtcttttt

SEQ ID NO: 209433 - DNA, 20 bp, Artificial Sequence
  Description of Artificial Sequence: Synthetic oligonucleotide
  Target: ATXN1; (-) strand; PAM type: YTN; PAM sequence: TTG
tctatagaccaagcacgtct

SEQ ID NO: 209434 - DNA, 20 bp, Artificial Sequence
  Description of Artificial Sequence: Synthetic oligonucleotide
  Target: ATXN1; (-) strand; PAM type: YTN; PAM sequence: TTT
gtctatagaccaagcacgtc

SEQ ID NO: 209435 - DNA, 20 bp, Artificial Sequence
  Description of Artificial Sequence: Synthetic oligonucleotide
  Target: ATXN1; (-) strand; PAM type: YTN; PAM sequence: CTT
tgtctatagaccaagcacgt

SEQ ID NO: 209436 - DNA, 20 bp, Artificial Sequence
  Description of Artificial Sequence: Synthetic oligonucleotide
  Target: ATXN1; (-) strand; PAM type: YTN; PAM sequence: TTG
aggggcctttgtctatagac

SEQ ID NO: 209437 - DNA, 20 bp, Artificial Sequence
  Description of Artificial Sequence: Synthetic oligonucleotide
  Target: ATXN1; (-) strand; PAM type: YTN; PAM sequence: CTC
accaccgattgaggggcctt

SEQ ID NO: 209438 - DNA, 20 bp, Artificial Sequence
  Description of Artificial Sequence: Synthetic oligonucleotide
  Target: ATXN1; (-) strand; PAM type: YTN; PAM sequence: TTG
tctcaccaccgattgagggg

SEQ ID NO: 209439 - DNA, 20 bp, Artificial Sequence
  Description of Artificial Sequence: Synthetic oligonucleotide
  Target: ATXN1; (-) strand; PAM type: YTN; PAM sequence: CTA
ttgtctcaccaccgattgag

SEQ ID NO: 209440 - DNA, 20 bp, Artificial Sequence
  Description of Artificial Sequence: Synthetic oligonucleotide
  Target: ATXN1; (-) strand; PAM type: YTN; PAM sequence: CTG
tagaatcctattgtctcacc

SEQ ID NO: 209441 - DNA, 20 bp, Artificial Sequence
  Description of Artificial Sequence: Synthetic oligonucleotide
  Target: ATXN1; (-) strand; PAM type: YTN; PAM sequence: TTA
tatatgggaagtggatgtca

SEQ ID NO: 209442 - DNA, 20 bp, Artificial Sequence
  Description of Artificial Sequence: Synthetic oligonucleotide
  Target: ATXN1; (-) strand; PAM type: YTN; PAM sequence: CTA
acaagattatatatgggaag

SEQ ID NO: 209443 - DNA, 20 bp, Artificial Sequence
  Description of Artificial Sequence: Synthetic oligonucleotide
  Target: ATXN1; (-) strand; PAM type: YTN; PAM sequence: TTA
ctaacaagattatatatggg

SEQ ID NO: 209444 - DNA, 20 bp, Artificial Sequence
  Description of Artificial Sequence: Synthetic oligonucleotide
  Target: ATXN1; (-) strand; PAM type: YTN; PAM sequence: TTT
actaacaagattatatatgg

SEQ ID NO: 209445 - DNA, 20 bp, Artificial Sequence
  Description of Artificial Sequence: Synthetic oligonucleotide
  Target: ATXN1; (-) strand; PAM type: YTN; PAM sequence: TTC
atttactaacaagattatat

SEQ ID NO: 209446 - DNA, 20 bp, Artificial Sequence
  Description of Artificial Sequence: Synthetic oligonucleotide
  Target: ATXN1; (-) strand; PAM type: YTN; PAM sequence: TTT
catttactaacaagattata

SEQ ID NO: 209447 - DNA, 20 bp, Artificial Sequence
  Description of Artificial Sequence: Synthetic oligonucleotide
  Target: ATXN1; (-) strand; PAM type: YTN; PAM sequence: TTA
atgtttcatttactaacaag

SEQ ID NO: 209448 - DNA, 20 bp, Artificial Sequence
  Description of Artificial Sequence: Synthetic oligonucleotide
  Target: ATXN1; (-) strand; PAM type: YTN; PAM sequence: TTT
aatgtttcatttactaacaa

SEQ ID NO: 209449 - DNA, 20 bp, Artificial Sequence
  Description of Artificial Sequence: Synthetic oligonucleotide
  Target: ATXN1; (-) strand; PAM type: YTN; PAM sequence: CTT
taatgtttcatttactaaca

SEQ ID NO: 209450 - DNA, 20 bp, Artificial Sequence
  Description of Artificial Sequence: Synthetic oligonucleotide
  Target: ATXN1; (-) strand; PAM type: YTN; PAM sequence: CTC
catgagactttaatgtttca

SEQ ID NO: 209451 - DNA, 20 bp, Artificial Sequence
  Description of Artificial Sequence: Synthetic oligonucleotide
  Target: ATXN1; (-) strand; PAM type: YTN; PAM sequence: TTC
tccatgagactttaatgttt

SEQ ID NO: 209452 - DNA, 20 bp, Artificial Sequence
  Description of Artificial Sequence: Synthetic oligonucleotide
  Target: ATXN1; (-) strand; PAM type: YTN; PAM sequence: TTT
ctccatgagactttaatgtt

SEQ ID NO: 209453 - DNA, 20 bp, Artificial Sequence
  Description of Artificial Sequence: Synthetic oligonucleotide
  Target: ATXN1; (-) strand; PAM type: YTN; PAM sequence: TTT
tctccatgagactttaatgt

SEQ ID NO: 209454 - DNA, 20 bp, Artificial Sequence
  Description of Artificial Sequence: Synthetic oligonucleotide
  Target: ATXN1; (-) strand; PAM type: YTN; PAM sequence: TTT
ttctccatgagactttaatg

SEQ ID NO: 209455 - DNA, 20 bp, Artificial Sequence
  Description of Artificial Sequence: Synthetic oligonucleotide
  Target: ATXN1; (-) strand; PAM type: YTN; PAM sequence: TTT
tttctccatgagactttaat

SEQ ID NO: 209456 - DNA, 20 bp, Artificial Sequence
  Description of Artificial Sequence: Synthetic oligonucleotide
  Target: ATXN1; (-) strand; PAM type: YTN; PAM sequence: CTT
ttttctccatgagactttaa

SEQ ID NO: 209457 - DNA, 20 bp, Artificial Sequence
  Description of Artificial Sequence: Synthetic oligonucleotide
  Target: ATXN1; (-) strand; PAM type: YTN; PAM sequence: CTG
cagacttttttctccatgag

SEQ ID NO: 209458 - DNA, 20 bp, Artificial Sequence
  Description of Artificial Sequence: Synthetic oligonucleotide
  Target: ATXN1; (-) strand; PAM type: YTN; PAM sequence: TTA
tagcataaaacagacactgc

SEQ ID NO: 209459 - DNA, 20 bp, Artificial Sequence
  Description of Artificial Sequence: Synthetic oligonucleotide
  Target: ATXN1; (-) strand; PAM type: YTN; PAM sequence: TTT
atagcataaaacagacactg

SEQ ID NO: 209460 - DNA, 20 bp, Artificial Sequence
  Description of Artificial Sequence: Synthetic oligonucleotide
  Target: ATXN1; (-) strand; PAM type: YTN; PAM sequence: CTG
tttatagcataaaacagaca

SEQ ID NO: 209461 - DNA, 20 bp, Artificial Sequence
  Description of Artificial Sequence: Synthetic oligonucleotide
  Target: ATXN1; (-) strand; PAM type: YTN; PAM sequence: CTG
gagatctgtttatagcataa

SEQ ID NO: 209462 - DNA, 20 bp, Artificial Sequence
  Description of Artificial Sequence: Synthetic oligonucleotide
  Target: ATXN1; (-) strand; PAM type: YTN; PAM sequence: TTC
agctggagatctgtttatag

SEQ ID NO: 209463 - DNA, 20 bp, Artificial Sequence
  Description of Artificial Sequence: Synthetic oligonucleotide
  Target: ATXN1; (-) strand; PAM type: YTN; PAM sequence: TTT
cagctggagatctgtttata

SEQ ID NO: 209464 - DNA, 20 bp, Artificial Sequence
  Description of Artificial Sequence: Synthetic oligonucleotide
  Target: ATXN1; (-) strand; PAM type: YTN; PAM sequence: TTC
agcacatagcaatttcagct

SEQ ID NO: 209465 - DNA, 20 bp, Artificial Sequence
  Description of Artificial Sequence: Synthetic oligonucleotide
  Target: ATXN1; (-) strand; PAM type: YTN; PAM sequence: CTC
caatgtcattcagcacatag

SEQ ID NO: 209466 - DNA, 20 bp, Artificial Sequence
  Description of Artificial Sequence: Synthetic oligonucleotide
  Target: ATXN1; (-) strand; PAM type: YTN; PAM sequence: CTC
ccactccaatgtcattcagc

SEQ ID NO: 209467 - DNA, 20 bp, Artificial Sequence
  Description of Artificial Sequence: Synthetic oligonucleotide
  Target: ATXN1; (-) strand; PAM type: YTN; PAM sequence: TTG
caggtaaagccagtggctcc

SEQ ID NO: 209468 - DNA, 20 bp, Artificial Sequence
  Description of Artificial Sequence: Synthetic oligonucleotide
  Target: ATXN1; (-) strand; PAM type: YTN; PAM sequence: CTT
gcaggtaaagccagtggctc

SEQ ID NO: 209469 - DNA, 20 bp, Artificial Sequence
  Description of Artificial Sequence: Synthetic oligonucleotide
  Target: ATXN1; (-) strand; PAM type: YTN; PAM sequence: CTG
aggcttgcaggtaaagccag

SEQ ID NO: 209470 - DNA, 20 bp, Artificial Sequence
  Description of Artificial Sequence: Synthetic oligonucleotide
  Target: ATXN1; (-) strand; PAM type: YTN; PAM sequence: CTA
aagctgaggcttgcaggtaa

SEQ ID NO: 209471 - DNA, 20 bp, Artificial Sequence
  Description of Artificial Sequence: Synthetic oligonucleotide
  Target: ATXN1; (-) strand; PAM type: YTN; PAM sequence: CTG
gactaaagctgaggcttgca

SEQ ID NO: 209472 - DNA, 20 bp, Artificial Sequence
  Description of Artificial Sequence: Synthetic oligonucleotide
  Target: ATXN1; (-) strand; PAM type: YTN; PAM sequence: TTG
cgtggaacagatctggacta

SEQ ID NO: 209473 - DNA, 20 bp, Artificial Sequence
  Description of Artificial Sequence: Synthetic oligonucleotide
  Target: ATXN1; (-) strand; PAM type: YTN; PAM sequence: TTG
ccagggttgcgtggaacaga

SEQ ID NO: 209474 - DNA, 20 bp, Artificial Sequence
  Description of Artificial Sequence: Synthetic oligonucleotide
  Target: ATXN1; (-) strand; PAM type: YTN; PAM sequence: CTA
gaacagaggtaatattgcca

SEQ ID NO: 209475 - DNA, 20 bp, Artificial Sequence
  Description of Artificial Sequence: Synthetic oligonucleotide
  Target: ATXN1; (-) strand; PAM type: YTN; PAM sequence: TTC
tagaacagaggtaatattgc

SEQ ID NO: 209476 - DNA, 20 bp, Artificial Sequence
  Description of Artificial Sequence: Synthetic oligonucleotide
  Target: ATXN1; (-) strand; PAM type: YTN; PAM sequence: TTG
gcagaacatccaagtcgcag

SEQ ID NO: 209477 - DNA, 20 bp, Artificial Sequence
  Description of Artificial Sequence: Synthetic oligonucleotide
  Target: ATXN1; (-) strand; PAM type: YTN; PAM sequence: CTT
ggcagaacatccaagtcgca

SEQ ID NO: 209478 - DNA, 20 bp, Artificial Sequence
  Description of Artificial Sequence: Synthetic oligonucleotide
  Target: ATXN1; (-) strand; PAM type: YTN; PAM sequence: TTG
cttggcagaacatccaagtc

SEQ ID NO: 209479 - DNA, 20 bp, Artificial Sequence
  Description of Artificial Sequence: Synthetic oligonucleotide
  Target: ATXN1; (-) strand; PAM type: YTN; PAM sequence: TTT
gcttggcagaacatccaagt

SEQ ID NO: 209480 - DNA, 20 bp, Artificial Sequence
  Description of Artificial Sequence: Synthetic oligonucleotide
  Target: ATXN1; (-) strand; PAM type: YTN; PAM sequence: TTG
tttgcttggcagaacatcca

SEQ ID NO: 209481 - DNA, 20 bp, Artificial Sequence
  Description of Artificial Sequence: Synthetic oligonucleotide
  Target: ATXN1; (-) strand; PAM type: YTN; PAM sequence: TTT
gtttgcttggcagaacatcc

SEQ ID NO: 209482 - DNA, 20 bp, Artificial Sequence
  Description of Artificial Sequence: Synthetic oligonucleotide
  Target: ATXN1; (-) strand; PAM type: YTN; PAM sequence: CTG
gataggcagacagatgtaga

SEQ ID NO: 209483 - DNA, 20 bp, Artificial Sequence
  Description of Artificial Sequence: Synthetic oligonucleotide
  Target: ATXN1; (-) strand; PAM type: YTN; PAM sequence: TTG
gagagagacagaaagagaga

SEQ ID NO: 209484 - DNA, 20 bp, Artificial Sequence
  Description of Artificial Sequence: Synthetic oligonucleotide
  Target: ATXN1; (-) strand; PAM type: YTN; PAM sequence: CTT
ggagagagacagaaagagag

SEQ ID NO: 209485 - DNA, 20 bp, Artificial Sequence
  Description of Artificial Sequence: Synthetic oligonucleotide
  Target: ATXN1; (-) strand; PAM type: YTN; PAM sequence: TTA
gaaaaagagagaccttggag

SEQ ID NO: 209486 - DNA, 20 bp, Artificial Sequence
  Description of Artificial Sequence: Synthetic oligonucleotide
  Target: ATXN1; (-) strand; PAM type: YTN; PAM sequence: CTT
agaaaaagagagaccttgga

SEQ ID NO: 209487 - DNA, 20 bp, Artificial Sequence
  Description of Artificial Sequence: Synthetic oligonucleotide
  Target: ATXN1; (-) strand; PAM type: YTN; PAM sequence: TTG
tcaacaaaggtgacttagaa

SEQ ID NO: 209488 - DNA, 20 bp, Artificial Sequence
  Description of Artificial Sequence: Synthetic oligonucleotide
  Target: ATXN1; (-) strand; PAM type: YTN; PAM sequence: CTG
caatgattgtcaacaaaggt

SEQ ID NO: 209489 - DNA, 20 bp, Artificial Sequence
  Description of Artificial Sequence: Synthetic oligonucleotide
  Target: ATXN1; (-) strand; PAM type: YTN; PAM sequence: CTG
gtccagctgcaatgattgtc

SEQ ID NO: 209490 - DNA, 20 bp, Artificial Sequence
  Description of Artificial Sequence: Synthetic oligonucleotide
  Target: ATXN1; (-) strand; PAM type: YTN; PAM sequence: CTC
actggtccagctgcaatgat

SEQ ID NO: 209491 - DNA, 20 bp, Artificial Sequence
  Description of Artificial Sequence: Synthetic oligonucleotide
  Target: ATXN1; (-) strand; PAM type: YTN; PAM sequence: TTC
tcactggtccagctgcaatg

SEQ ID NO: 209492 - DNA, 20 bp, Artificial Sequence
  Description of Artificial Sequence: Synthetic oligonucleotide
  Target: ATXN1; (-) strand; PAM type: YTN; PAM sequence: CTT
ctcactggtccagctgcaat

SEQ ID NO: 209493 - DNA, 20 bp, Artificial Sequence
  Description of Artificial Sequence: Synthetic oligonucleotide
  Target: ATXN1; (-) strand; PAM type: YTN; PAM sequence: TTA
tcccttctcactggtccagc

SEQ ID NO: 209494 - DNA, 20 bp, Artificial Sequence
  Description of Artificial Sequence: Synthetic oligonucleotide
  Target: ATXN1; (-) strand; PAM type: YTN; PAM sequence: TTT
atcccttctcactggtccag

SEQ ID NO: 209495 - DNA, 20 bp, Artificial Sequence
  Description of Artificial Sequence: Synthetic oligonucleotide
  Target: ATXN1; (-) strand; PAM type: YTN; PAM sequence: TTT
tatcccttctcactggtcca

SEQ ID NO: 209496 - DNA, 20 bp, Artificial Sequence
  Description of Artificial Sequence: Synthetic oligonucleotide
  Target: ATXN1; (-) strand; PAM type: YTN; PAM sequence: CTA
ttttatcccttctcactggt

SEQ ID NO: 209497 - DNA, 20 bp, Artificial Sequence
  Description of Artificial Sequence: Synthetic oligonucleotide
  Target: ATXN1; (-) strand; PAM type: YTN; PAM sequence: TTC
tattttatcccttctcactg

SEQ ID NO: 209498 - DNA, 20 bp, Artificial Sequence
  Description of Artificial Sequence: Synthetic oligonucleotide
  Target: ATXN1; (-) strand; PAM type: YTN; PAM sequence: CTT
ctattttatcccttctcact

SEQ ID NO: 209499 - DNA, 20 bp, Artificial Sequence
  Description of Artificial Sequence: Synthetic oligonucleotide
  Target: ATXN1; (-) strand; PAM type: YTN; PAM sequence: TTG
acttctattttatcccttct

SEQ ID NO: 209500 - DNA, 20 bp, Artificial Sequence
  Description of Artificial Sequence: Synthetic oligonucleotide
  Target: ATXN1; (-) strand; PAM type: YTN; PAM sequence: TTA
ttgacttctattttatccct

SEQ ID NO: 209501 - DNA, 20 bp, Artificial Sequence
  Description of Artificial Sequence: Synthetic oligonucleotide
  Target: ATXN1; (-) strand; PAM type: YTN; PAM sequence: TTT
attgacttctattttatccc

SEQ ID NO: 209502 - DNA, 20 bp, Artificial Sequence
  Description of Artificial Sequence: Synthetic oligonucleotide
  Target: ATXN1; (-) strand; PAM type: YTN; PAM sequence: TTA
tttattgacttctattttat

SEQ ID NO: 209503 - DNA, 20 bp, Artificial Sequence
  Description of Artificial Sequence: Synthetic oligonucleotide
  Target: ATXN1; (-) strand; PAM type: YTN; PAM sequence: TTT
atttattgacttctatttta

SEQ ID NO: 209504 - DNA, 20 bp, Artificial Sequence
  Description of Artificial Sequence: Synthetic oligonucleotide
  Target: ATXN1; (-) strand; PAM type: YTN; PAM sequence: CTT
tatttattgacttctatttt

SEQ ID NO: 209505 - DNA, 20 bp, Artificial Sequence
  Description of Artificial Sequence: Synthetic oligonucleotide
  Target: ATXN1; (-) strand; PAM type: YTN; PAM sequence: TTA
atgaacccagaagagcttta

SEQ ID NO: 209506 - DNA, 20 bp, Artificial Sequence
  Description of Artificial Sequence: Synthetic oligonucleotide
  Target: ATXN1; (-) strand; PAM type: YTN; PAM sequence: CTT
aatgaacccagaagagcttt

SEQ ID NO: 209507 - DNA, 20 bp, Artificial Sequence
  Description of Artificial Sequence: Synthetic oligonucleotide
  Target: ATXN1; (-) strand; PAM type: YTN; PAM sequence: TTA
agaagatagaaatcaagtgt

SEQ ID NO: 209508 - DNA, 20 bp, Artificial Sequence
  Description of Artificial Sequence: Synthetic oligonucleotide
  Target: ATXN1; (-) strand; PAM type: YTN; PAM sequence: CTC
cccacatccaaacacagtgt

SEQ ID NO: 209509 - DNA, 20 bp, Artificial Sequence
  Description of Artificial Sequence: Synthetic oligonucleotide
  Target: ATXN1; (-) strand; PAM type: YTN; PAM sequence: TTC
tccccacatccaaacacagt

SEQ ID NO: 209510 - DNA, 20 bp, Artificial Sequence
  Description of Artificial Sequence: Synthetic oligonucleotide
  Target: ATXN1; (-) strand; PAM type: YTN; PAM sequence: TTG
aataagagtgaaaaaatagt

SEQ ID NO: 209511 - DNA, 20 bp, Artificial Sequence
  Description of Artificial Sequence: Synthetic oligonucleotide
  Target: ATXN1; (-) strand; PAM type: YTN; PAM sequence: TTT
gaataagagtgaaaaaatag

SEQ ID NO: 209512 - DNA, 20 bp, Artificial Sequence
  Description of Artificial Sequence: Synthetic oligonucleotide
  Target: ATXN1; (-) strand; PAM type: YTN; PAM sequence: CTT
tgaataagagtgaaaaaata

SEQ ID NO: 209513 - DNA, 20 bp, Artificial Sequence
  Description of Artificial Sequence: Synthetic oligonucleotide
  Target: ATXN1; (-) strand; PAM type: YTN; PAM sequence: TTA
aggaaacaaagaataatagt

SEQ ID NO: 209514 - DNA, 20 bp, Artificial Sequence
  Description of Artificial Sequence: Synthetic oligonucleotide
  Target: ATXN1; (-) strand; PAM type: YTN; PAM sequence: TTT
aaggaaacaaagaataatag

SEQ ID NO: 209515 - DNA, 20 bp, Artificial Sequence
  Description of Artificial Sequence: Synthetic oligonucleotide
  Target: ATXN1; (-) strand; PAM type: YTN; PAM sequence: TTT
taaggaaacaaagaataata

SEQ ID NO: 209516 - DNA, 20 bp, Artificial Sequence
  Description of Artificial Sequence: Synthetic oligonucleotide
  Target: ATXN1; (-) strand; PAM type: YTN; PAM sequence: CTA
gggagagaagaatgccaaca

SEQ ID NO: 209517 - DNA, 20 bp, Artificial Sequence
  Description of Artificial Sequence: Synthetic oligonucleotide
  Target: ATXN1; (-) strand; PAM type: YTN; PAM sequence: CTA
ctagggagagaagaatgcca

SEQ ID NO: 209518 - DNA, 20 bp, Artificial Sequence
  Description of Artificial Sequence: Synthetic oligonucleotide
  Target: ATXN1; (-) strand; PAM type: YTN; PAM sequence: CTC
ctactagggagagaagaatg

SEQ ID NO: 209519 - DNA, 20 bp, Artificial Sequence
  Description of Artificial Sequence: Synthetic oligonucleotide
  Target: ATXN1; (-) strand; PAM type: YTN; PAM sequence: CTC
tcctactagggagagaagaa

SEQ ID NO: 209520 - DNA, 20 bp, Artificial Sequence
  Description of Artificial Sequence: Synthetic oligonucleotide
  Target: ATXN1; (-) strand; PAM type: YTN; PAM sequence: TTG
caggcgctctcctactaggg

SEQ ID NO: 209521 - DNA, 20 bp, Artificial Sequence
  Description of Artificial Sequence: Synthetic oligonucleotide
  Target: ATXN1; (-) strand; PAM type: YTN; PAM sequence: CTT
gcaggcgctctcctactagg

SEQ ID NO: 209522 - DNA, 20 bp, Artificial Sequence
  Description of Artificial Sequence: Synthetic oligonucleotide
  Target: ATXN1; (-) strand; PAM type: YTN; PAM sequence: TTG
tgatccttgcaggcgctctc

SEQ ID NO: 209523 - DNA, 20 bp, Artificial Sequence
  Description of Artificial Sequence: Synthetic oligonucleotide
  Target: ATXN1; (-) strand; PAM type: YTN; PAM sequence: TTT
gtgatccttgcaggcgctct

SEQ ID NO: 209524 - DNA, 20 bp, Artificial Sequence
  Description of Artificial Sequence: Synthetic oligonucleotide
  Target: ATXN1; (-) strand; PAM type: YTN; PAM sequence: TTT
tgtgatccttgcaggcgctc

SEQ ID NO: 209525 - DNA, 20 bp, Artificial Sequence
  Description of Artificial Sequence: Synthetic oligonucleotide
  Target: ATXN1; (-) strand; PAM type: YTN; PAM sequence: CTT
ttgtgatccttgcaggcgct

SEQ ID NO: 209526 - DNA, 20 bp, Artificial Sequence
  Description of Artificial Sequence: Synthetic oligonucleotide
  Target: ATXN1; (-) strand; PAM type: YTN; PAM sequence: CTC
cccagaagcttttgtgatcc

SEQ ID NO: 209527 - DNA, 20 bp, Artificial Sequence
  Description of Artificial Sequence: Synthetic oligonucleotide
  Target: ATXN1; (-) strand; PAM type: YTN; PAM sequence: TTC
tccccagaagcttttgtgat

SEQ ID NO: 209528 - DNA, 20 bp, Artificial Sequence
  Description of Artificial Sequence: Synthetic oligonucleotide
  Target: ATXN1; (-) strand; PAM type: YTN; PAM sequence: CTT
ctccccagaagcttttgtga

SEQ ID NO: 209529 - DNA, 20 bp, Artificial Sequence
  Description of Artificial Sequence: Synthetic oligonucleotide
  Target: ATXN1; (-) strand; PAM type: YTN; PAM sequence: TTG
cttctccccagaagcttttg

SEQ ID NO: 209530 - DNA, 20 bp, Artificial Sequence
  Description of Artificial Sequence: Synthetic oligonucleotide
  Target: ATXN1; (-) strand; PAM type: YTN; PAM sequence: TTA
ttgcttctccccagaagctt

SEQ ID NO: 209531 - DNA, 20 bp, Artificial Sequence
  Description of Artificial Sequence: Synthetic oligonucleotide
  Target: ATXN1; (-) strand; PAM type: YTN; PAM sequence: TTC
agcagattattgcttctccc

SEQ ID NO: 209532 - DNA, 20 bp, Artificial Sequence
  Description of Artificial Sequence: Synthetic oligonucleotide
  Target: ATXN1; (-) strand; PAM type: YTN; PAM sequence: TTA
ttcagcagattattgcttct

SEQ ID NO: 209533 - DNA, 20 bp, Artificial Sequence
  Description of Artificial Sequence: Synthetic oligonucleotide
  Target: ATXN1; (-) strand; PAM type: YTN; PAM sequence: CTG
gttattcagcagattattgc

SEQ ID NO: 209534 - DNA, 20 bp, Artificial Sequence
  Description of Artificial Sequence: Synthetic oligonucleotide
  Target: ATXN1; (-) strand; PAM type: YTN; PAM sequence: CTG
gggcctggttattcagcaga

SEQ ID NO: 209535 - DNA, 20 bp, Artificial Sequence
  Description of Artificial Sequence: Synthetic oligonucleotide
  Target: ATXN1; (-) strand; PAM type: YTN; PAM sequence: TTG
gcagctggggcctggttatt

SEQ ID NO: 209536 - DNA, 20 bp, Artificial Sequence
  Description of Artificial Sequence: Synthetic oligonucleotide
  Target: ATXN1; (-) strand; PAM type: YTN; PAM sequence: TTT
ggcagctggggcctggttat

SEQ ID NO: 209537 - DNA, 20 bp, Artificial Sequence
  Description of Artificial Sequence: Synthetic oligonucleotide
  Target: ATXN1; (-) strand; PAM type: YTN; PAM sequence: TTC
ccagtggcatttggcagctg

SEQ ID NO: 209538 - DNA, 20 bp, Artificial Sequence
  Description of Artificial Sequence: Synthetic oligonucleotide
  Target: ATXN1; (-) strand; PAM type: YTN; PAM sequence: TTT
cccagtggcatttggcagct

SEQ ID NO: 209539 - DNA, 20 bp, Artificial Sequence
  Description of Artificial Sequence: Synthetic oligonucleotide
  Target: ATXN1; (-) strand; PAM type: YTN; PAM sequence: TTT
tcccagtggcatttggcagc

SEQ ID NO: 209540 - DNA, 20 bp, Artificial Sequence
  Description of Artificial Sequence: Synthetic oligonucleotide
  Target: ATXN1; (-) strand; PAM type: YTN; PAM sequence: CTT
ttcccagtggcatttggcag

SEQ ID NO: 209541 - DNA, 20 bp, Artificial Sequence
  Description of Artificial Sequence: Synthetic oligonucleotide
  Target: ATXN1; (-) strand; PAM type: YTN; PAM sequence: TTG
cacttttcccagtggcattt

SEQ ID NO: 209542 - DNA, 20 bp, Artificial Sequence
  Description of Artificial Sequence: Synthetic oligonucleotide
  Target: ATXN1; (-) strand; PAM type: YTN; PAM sequence: TTT
gcacttttcccagtggcatt

SEQ ID NO: 209543 - DNA, 20 bp, Artificial Sequence
  Description of Artificial Sequence: Synthetic oligonucleotide
  Target: ATXN1; (-) strand; PAM type: YTN; PAM sequence: CTT
tgcacttttcccagtggcat

SEQ ID NO: 209544 - DNA, 20 bp, Artificial Sequence
  Description of Artificial Sequence: Synthetic oligonucleotide
  Target: ATXN1; (-) strand; PAM type: YTN; PAM sequence: TTC
accctttgcacttttcccag

SEQ ID NO: 209545 - DNA, 20 bp, Artificial Sequence
  Description of Artificial Sequence: Synthetic oligonucleotide
  Target: ATXN1; (-) strand; PAM type: YTN; PAM sequence: TTC
agagtggtgcccaattcacc

SEQ ID NO: 209546 - DNA, 20 bp, Artificial Sequence
  Description of Artificial Sequence: Synthetic oligonucleotide
  Target: ATXN1; (-) strand; PAM type: YTN; PAM sequence: TTA
tgattcagagtggtgcccaa

SEQ ID NO: 209547 - DNA, 20 bp, Artificial Sequence
  Description of Artificial Sequence: Synthetic oligonucleotide
  Target: ATXN1; (-) strand; PAM type: YTN; PAM sequence: TTT
atgattcagagtggtgccca

SEQ ID NO: 209548 - DNA, 20 bp, Artificial Sequence
  Description of Artificial Sequence: Synthetic oligonucleotide
  Target: ATXN1; (-) strand; PAM type: YTN; PAM sequence: CTG
taataatgtttatgattcag

SEQ ID NO: 209549 - DNA, 20 bp, Artificial Sequence
  Description of Artificial Sequence: Synthetic oligonucleotide
  Target: ATXN1; (-) strand; PAM type: YTN; PAM sequence: TTG
cctgtaataatgtttatgat

SEQ ID NO: 209550 - DNA, 20 bp, Artificial Sequence
  Description of Artificial Sequence: Synthetic oligonucleotide
  Target: ATXN1; (-) strand; PAM type: YTN; PAM sequence: TTT
gcctgtaataatgtttatga

SEQ ID NO: 209551 - DNA, 20 bp, Artificial Sequence
  Description of Artificial Sequence: Synthetic oligonucleotide
  Target: ATXN1; (-) strand; PAM type: YTN; PAM sequence: CTT
tgcctgtaataatgtttatg

SEQ ID NO: 209552 - DNA, 20 bp, Artificial Sequence
  Description of Artificial Sequence: Synthetic oligonucleotide
  Target: ATXN1; (-) strand; PAM type: YTN; PAM sequence: CTC
aagtagcagccagtcacttt

SEQ ID NO: 209553 - DNA, 20 bp, Artificial Sequence
  Description of Artificial Sequence: Synthetic oligonucleotide
  Target: ATXN1; (-) strand; PAM type: YTN; PAM sequence: CTC
tcaagtagcagccagtcact

SEQ ID NO: 209554 - DNA, 20 bp, Artificial Sequence
  Description of Artificial Sequence: Synthetic oligonucleotide
  Target: ATXN1; (-) strand; PAM type: YTN; PAM sequence: TTA
ggtacagaagaactctcaag

SEQ ID NO: 209555 - DNA, 20 bp, Artificial Sequence
  Description of Artificial Sequence: Synthetic oligonucleotide
  Target: ATXN1; (-) strand; PAM type: YTN; PAM sequence: CTG
catggtccaattaggtacag

SEQ ID NO: 209556 - DNA, 20 bp, Artificial Sequence
  Description of Artificial Sequence: Synthetic oligonucleotide
  Target: ATXN1; (-) strand; PAM type: YTN; PAM sequence: CTG
taatggtccccaggagtatc

SEQ ID NO: 209557 - DNA, 20 bp, Artificial Sequence
  Description of Artificial Sequence: Synthetic oligonucleotide
  Target: ATXN1; (-) strand; PAM type: YTN; PAM sequence: CTG
tatccctgtaatggtcccca

SEQ ID NO: 209558 - DNA, 20 bp, Artificial Sequence
  Description of Artificial Sequence: Synthetic oligonucleotide
  Target: ATXN1; (-) strand; PAM type: YTN; PAM sequence: CTA
cacctgtatccctgtaatgg

SEQ ID NO: 209559 - DNA, 20 bp, Artificial Sequence
  Description of Artificial Sequence: Synthetic oligonucleotide
  Target: ATXN1; (-) strand; PAM type: YTN; PAM sequence: TTG
taagctacacctgtatccct

SEQ ID NO: 209560 - DNA, 20 bp, Artificial Sequence
  Description of Artificial Sequence: Synthetic oligonucleotide
  Target: ATXN1; (-) strand; PAM type: YTN; PAM sequence: TTG
tatattgtaagctacacctg

SEQ ID NO: 209561 - DNA, 20 bp, Artificial Sequence
  Description of Artificial Sequence: Synthetic oligonucleotide
  Target: ATXN1; (-) strand; PAM type: YTN; PAM sequence: TTT
gtatattgtaagctacacct

SEQ ID NO: 209562 - DNA, 20 bp, Artificial Sequence
  Description of Artificial Sequence: Synthetic oligonucleotide
  Target: ATXN1; (-) strand; PAM type: YTN; PAM sequence: TTT
tgtatattgtaagctacacc

SEQ ID NO: 209563 - DNA, 20 bp, Artificial Sequence
  Description of Artificial Sequence: Synthetic oligonucleotide
  Target: ATXN1; (-) strand; PAM type: YTN; PAM sequence: CTT
ttgtatattgtaagctacac

SEQ ID NO: 209564 - DNA, 20 bp, Artificial Sequence
  Description of Artificial Sequence: Synthetic oligonucleotide
  Target: ATXN1; (-) strand; PAM type: YTN; PAM sequence: TTG
tcagacacacagcttttgta

SEQ ID NO: 209565 - DNA, 20 bp, Artificial Sequence
  Description of Artificial Sequence: Synthetic oligonucleotide
  Target: ATXN1; (-) strand; PAM type: YTN; PAM sequence: TTA
cacgtagattgtcagacaca

SEQ ID NO: 209566 - DNA, 20 bp, Artificial Sequence
  Description of Artificial Sequence: Synthetic oligonucleotide
  Target: ATXN1; (-) strand; PAM type: YTN; PAM sequence: CTT
acacgtagattgtcagacac

SEQ ID NO: 209567 - DNA, 20 bp, Artificial Sequence
  Description of Artificial Sequence: Synthetic oligonucleotide
  Target: ATXN1; (-) strand; PAM type: YTN; PAM sequence: TTA
ggcttacacgtagattgtca

SEQ ID NO: 209568 - DNA, 20 bp, Artificial Sequence
  Description of Artificial Sequence: Synthetic oligonucleotide
  Target: ATXN1; (-) strand; PAM type: YTN; PAM sequence: TTA
gcacaccaagtaatgtaaaa

SEQ ID NO: 209569 - DNA, 20 bp, Artificial Sequence
  Description of Artificial Sequence: Synthetic oligonucleotide
  Target: ATXN1; (-) strand; PAM type: YTN; PAM sequence: CTT
agcacaccaagtaatgtaaa

SEQ ID NO: 209570 - DNA, 20 bp, Artificial Sequence
  Description of Artificial Sequence: Synthetic oligonucleotide
  Target: ATXN1; (-) strand; PAM type: YTN; PAM sequence: CTC
aggacacttagcacaccaag

SEQ ID NO: 209571 - DNA, 20 bp, Artificial Sequence
  Description of Artificial Sequence: Synthetic oligonucleotide
  Target: ATXN1; (-) strand; PAM type: YTN; PAM sequence: CTC
cctcaggacacttagcacac

SEQ ID NO: 209572 - DNA, 20 bp, Artificial Sequence
  Description of Artificial Sequence: Synthetic oligonucleotide
  Target: ATXN1; (-) strand; PAM type: YTN; PAM sequence: CTA
aataatgaactccctcagga

SEQ ID NO: 209573 - DNA, 20 bp, Artificial Sequence
  Description of Artificial Sequence: Synthetic oligonucleotide
  Target: ATXN1; (-) strand; PAM type: YTN; PAM sequence: CTC
taaataatgaactccctcag

SEQ ID NO: 209574 - DNA, 20 bp, Artificial Sequence
  Description of Artificial Sequence: Synthetic oligonucleotide
  Target: ATXN1; (-) strand; PAM type: YTN; PAM sequence: TTC
tctaaataatgaactccctc

SEQ ID NO: 209575 - DNA, 20 bp, Artificial Sequence
  Description of Artificial Sequence: Synthetic oligonucleotide
  Target: ATXN1; (-) strand; PAM type: YTN; PAM sequence: TTA
tggagttctctaaataatga

SEQ ID NO: 209576 - DNA, 20 bp, Artificial Sequence
  Description of Artificial Sequence: Synthetic oligonucleotide
  Target: ATXN1; (-) strand; PAM type: YTN; PAM sequence: TTT
atggagttctctaaataatg

SEQ ID NO: 209577 - DNA, 20 bp, Artificial Sequence
  Description of Artificial Sequence: Synthetic oligonucleotide
  Target: ATXN1; (-) strand; PAM type: YTN; PAM sequence: TTA
caaaagtatttatggagttc

SEQ ID NO: 209578 - DNA, 20 bp, Artificial Sequence
  Description of Artificial Sequence: Synthetic oligonucleotide
  Target: ATXN1; (-) strand; PAM type: YTN; PAM sequence: TTT
acaaaagtatttatggagtt

SEQ ID NO: 209579 - DNA, 20 bp, Artificial Sequence
  Description of Artificial Sequence: Synthetic oligonucleotide
  Target: ATXN1; (-) strand; PAM type: YTN; PAM sequence: TTT
tacaaaagtatttatggagt

SEQ ID NO: 209580 - DNA, 20 bp, Artificial Sequence
  Description of Artificial Sequence: Synthetic oligonucleotide
  Target: ATXN1; (-) strand; PAM type: YTN; PAM sequence: TTA
caaaacacaaatggagagga

SEQ ID NO: 209581 - DNA, 20 bp, Artificial Sequence
  Description of Artificial Sequence: Synthetic oligonucleotide
  Target: ATXN1; (-) strand; PAM type: YTN; PAM sequence: TTT
acaaaacacaaatggagagg

SEQ ID NO: 209582 - DNA, 20 bp, Artificial Sequence
  Description of Artificial Sequence: Synthetic oligonucleotide
  Target: ATXN1; (-) strand; PAM type: YTN; PAM sequence: CTA
aagacagagaggggaaattt

SEQ ID NO: 209583 - DNA, 20 bp, Artificial Sequence
  Description of Artificial Sequence: Synthetic oligonucleotide
  Target: ATXN1; (-) strand; PAM type: YTN; PAM sequence: CTC
taaagacagagaggggaaat

SEQ ID NO: 209584 - DNA, 20 bp, Artificial Sequence
  Description of Artificial Sequence: Synthetic oligonucleotide
  Target: ATXN1; (-) strand; PAM type: YTN; PAM sequence: TTG
atgacgtgctctaaagacag

SEQ ID NO: 209585 - DNA, 20 bp, Artificial Sequence
  Description of Artificial Sequence: Synthetic oligonucleotide
  Target: ATXN1; (-) strand; PAM type: YTN; PAM sequence: TTC
agattgatgacgtgctctaa

SEQ ID NO: 209586 - DNA, 20 bp, Artificial Sequence
  Description of Artificial Sequence: Synthetic oligonucleotide
  Target: ATXN1; (-) strand; PAM type: YTN; PAM sequence: TTG
tgggaaatggatgttcagat

SEQ ID NO: 209587 - DNA, 20 bp, Artificial Sequence
  Description of Artificial Sequence: Synthetic oligonucleotide
  Target: ATXN1; (-) strand; PAM type: YTN; PAM sequence: TTT
gtgggaaatggatgttcaga

SEQ ID NO: 209588 - DNA, 20 bp, Artificial Sequence
  Description of Artificial Sequence: Synthetic oligonucleotide
  Target: ATXN1; (-) strand; PAM type: YTN; PAM sequence: TTA
tatttgtgggaaatggatgt

SEQ ID NO: 209589 - DNA, 20 bp, Artificial Sequence
  Description of Artificial Sequence: Synthetic oligonucleotide
  Target: ATXN1; (-) strand; PAM type: YTN; PAM sequence: TTT
atatttgtgggaaatggatg

SEQ ID NO: 209590 - DNA, 20 bp, Artificial Sequence
  Description of Artificial Sequence: Synthetic oligonucleotide
  Target: ATXN1; (-) strand; PAM type: YTN; PAM sequence: CTT
tatatttgtgggaaatggat

SEQ ID NO: 209591 - DNA, 20 bp, Artificial Sequence
  Description of Artificial Sequence: Synthetic oligonucleotide
  Target: ATXN1; (-) strand; PAM type: YTN; PAM sequence: TTC
cccccatctttatatttgtg

SEQ ID NO: 209592 - DNA, 20 bp, Artificial Sequence
  Description of Artificial Sequence: Synthetic oligonucleotide
  Target: ATXN1; (-) strand; PAM type: YTN; PAM sequence: CTT
ccccccatctttatatttgt

SEQ ID NO: 209593 - DNA, 20 bp, Artificial Sequence
  Description of Artificial Sequence: Synthetic oligonucleotide
  Target: ATXN1; (-) strand; PAM type: YTN; PAM sequence: CTG
gtgtagacttccccccatct

SEQ ID NO: 209594 - DNA, 20 bp, Artificial Sequence
  Description of Artificial Sequence: Synthetic oligonucleotide
  Target: ATXN1; (-) strand; PAM type: YTN; PAM sequence: TTC
agcactggtgtagacttccc

SEQ ID NO: 209595 - DNA, 20 bp, Artificial Sequence
  Description of Artificial Sequence: Synthetic oligonucleotide
  Target: ATXN1; (-) strand; PAM type: YTN; PAM sequence: TTT
cagcactggtgtagacttcc

SEQ ID NO: 209596 - DNA, 20 bp, Artificial Sequence
  Description of Artificial Sequence: Synthetic oligonucleotide
  Target: ATXN1; (-) strand; PAM type: YTN; PAM sequence: TTT
tcagcactggtgtagacttc

SEQ ID NO: 209597 - DNA, 20 bp, Artificial Sequence
  Description of Artificial Sequence: Synthetic oligonucleotide
  Target: ATXN1; (-) strand; PAM type: YTN; PAM sequence: TTT
ttcagcactggtgtagactt

SEQ ID NO: 209598 - DNA, 20 bp, Artificial Sequence
  Description of Artificial Sequence: Synthetic oligonucleotide
  Target: ATXN1; (-) strand; PAM type: YTN; PAM sequence: TTT
tttcagcactggtgtagact

SEQ ID NO: 209599 - DNA, 20 bp, Artificial Sequence
  Description of Artificial Sequence: Synthetic oligonucleotide
  Target: ATXN1; (-) strand; PAM type: YTN; PAM sequence: TTT
ttttcagcactggtgtagac

SEQ ID NO: 209600 - DNA, 20 bp, Artificial Sequence
  Description of Artificial Sequence: Synthetic oligonucleotide
  Target: ATXN1; (-) strand; PAM type: YTN; PAM sequence: TTT
tttttcagcactggtgtaga

SEQ ID NO: 209601 - DNA, 20 bp, Artificial Sequence
  Description of Artificial Sequence: Synthetic oligonucleotide
  Target: ATXN1; (-) strand; PAM type: YTN; PAM sequence: CTT
ttttttcagcactggtgtag

SEQ ID NO: 209602 - DNA, 20 bp, Artificial Sequence
  Description of Artificial Sequence: Synthetic oligonucleotide
  Target: ATXN1; (-) strand; PAM type: YTN; PAM sequence: CTC
cttttttttcagcactggtg

SEQ ID NO: 209603 - DNA, 20 bp, Artificial Sequence
  Description of Artificial Sequence: Synthetic oligonucleotide
  Target: ATXN1; (-) strand; PAM type: YTN; PAM sequence: CTG
ggtgccctccttttttttca

SEQ ID NO: 209604 - DNA, 20 bp, Artificial Sequence
  Description of Artificial Sequence: Synthetic oligonucleotide
  Target: ATXN1; (-) strand; PAM type: YTN; PAM sequence: TTA
aaaatgctgggtgccctcct

SEQ ID NO: 209605 - DNA, 20 bp, Artificial Sequence
  Description of Artificial Sequence: Synthetic oligonucleotide
  Target: ATXN1; (-) strand; PAM type: YTN; PAM sequence: TTA
atgttaaaaatgctgggtgc

SEQ ID NO: 209606 - DNA, 20 bp, Artificial Sequence
  Description of Artificial Sequence: Synthetic oligonucleotide
  Target: ATXN1; (-) strand; PAM type: YTN; PAM sequence: CTT
aatgttaaaaatgctgggtg

SEQ ID NO: 209607 - DNA, 20 bp, Artificial Sequence
  Description of Artificial Sequence: Synthetic oligonucleotide
  Target: ATXN1; (-) strand; PAM type: YTN; PAM sequence: CTA
acaaaatgtcttaatgttaa

SEQ ID NO: 209608 - DNA, 20 bp, Artificial Sequence
  Description of Artificial Sequence: Synthetic oligonucleotide
  Target: ATXN1; (-) strand; PAM type: YTN; PAM sequence: CTA
tctaacaaaatgtcttaatg

SEQ ID NO: 209609 - DNA, 20 bp, Artificial Sequence
  Description of Artificial Sequence: Synthetic oligonucleotide
  Target: ATXN1; (-) strand; PAM type: YTN; PAM sequence: CTG
gtctatctaacaaaatgtct

SEQ ID NO: 209610 - DNA, 20 bp, Artificial Sequence
  Description of Artificial Sequence: Synthetic oligonucleotide
  Target: ATXN1; (-) strand; PAM type: YTN; PAM sequence: CTC
tggtctatctaacaaaatgt

SEQ ID NO: 209611 - DNA, 20 bp, Artificial Sequence
  Description of Artificial Sequence: Synthetic oligonucleotide
  Target: ATXN1; (-) strand; PAM type: YTN; PAM sequence: TTC
tctggtctatctaacaaaat

SEQ ID NO: 209612 - DNA, 20 bp, Artificial Sequence
  Description of Artificial Sequence: Synthetic oligonucleotide
  Target: ATXN1; (-) strand; PAM type: YTN; PAM sequence: TTT
ctctggtctatctaacaaaa

SEQ ID NO: 209613 - DNA, 20 bp, Artificial Sequence
  Description of Artificial Sequence: Synthetic oligonucleotide
  Target: ATXN1; (-) strand; PAM type: YTN; PAM sequence: CTT
tctctggtctatctaacaaa

SEQ ID NO: 209614 - DNA, 20 bp, Artificial Sequence
  Description of Artificial Sequence: Synthetic oligonucleotide
  Target: ATXN1; (-) strand; PAM type: YTN; PAM sequence: TTA
tgtgatgctttctctggtct

SEQ ID NO: 209615 - DNA, 20 bp, Artificial Sequence
  Description of Artificial Sequence: Synthetic oligonucleotide
  Target: ATXN1; (-) strand; PAM type: YTN; PAM sequence: TTT
atgtgatgctttctctggtc

SEQ ID NO: 209616 - DNA, 20 bp, Artificial Sequence
  Description of Artificial Sequence: Synthetic oligonucleotide
  Target: ATXN1; (-) strand; PAM type: YTN; PAM sequence: TTT
tatgtgatgctttctctggt

SEQ ID NO: 209617 - DNA, 20 bp, Artificial Sequence
  Description of Artificial Sequence: Synthetic oligonucleotide
  Target: ATXN1; (-) strand; PAM type: YTN; PAM sequence: CTT
ttatgtgatgctttctctgg

SEQ ID NO: 209618 - DNA, 20 bp, Artificial Sequence
  Description of Artificial Sequence: Synthetic oligonucleotide
  Target: ATXN1; (-) strand; PAM type: YTN; PAM sequence: TTC
agccttttatgtgatgcttt

SEQ ID NO: 209619 - DNA, 20 bp, Artificial Sequence
  Description of Artificial Sequence: Synthetic oligonucleotide
  Target: ATXN1; (-) strand; PAM type: YTN; PAM sequence: CTG
attcagccttttatgtgatg

SEQ ID NO: 209620 - DNA, 20 bp, Artificial Sequence
  Description of Artificial Sequence: Synthetic oligonucleotide
  Target: ATXN1; (-) strand; PAM type: YTN; PAM sequence: TTC
tgattcagccttttatgtga

SEQ ID NO: 209621 - DNA, 20 bp, Artificial Sequence
  Description of Artificial Sequence: Synthetic oligonucleotide
  Target: ATXN1; (-) strand; PAM type: YTN; PAM sequence: TTT
ctgattcagccttttatgtg

SEQ ID NO: 209622 - DNA, 20 bp, Artificial Sequence
  Description of Artificial Sequence: Synthetic oligonucleotide
  Target: ATXN1; (-) strand; PAM type: YTN; PAM sequence: TTC
aagaaagagaatcccaacac

SEQ ID NO: 209623 - DNA, 20 bp, Artificial Sequence
  Description of Artificial Sequence: Synthetic oligonucleotide
  Target: ATXN1; (-) strand; PAM type: YTN; PAM sequence: TTT
caagaaagagaatcccaaca

SEQ ID NO: 209624 - DNA, 20 bp, Artificial Sequence
  Description of Artificial Sequence: Synthetic oligonucleotide
  Target: ATXN1; (-) strand; PAM type: YTN; PAM sequence: TTT
tcaagaaagagaatcccaac

SEQ ID NO: 209625 - DNA, 20 bp, Artificial Sequence
  Description of Artificial Sequence: Synthetic oligonucleotide
  Target: ATXN1; (-) strand; PAM type: YTN; PAM sequence: CTT
ttcaagaaagagaatcccaa

SEQ ID NO: 209626 - DNA, 20 bp, Artificial Sequence
  Description of Artificial Sequence: Synthetic oligonucleotide
  Target: ATXN1; (-) strand; PAM type: YTN; PAM sequence: CTG
tgccaccttttcaagaaaga

SEQ ID NO: 209627 - DNA, 20 bp, Artificial Sequence
  Description of Artificial Sequence: Synthetic oligonucleotide
  Target: ATXN1; (-) strand; PAM type: YTN; PAM sequence: CTC
acagtgctgtgccacctttt

SEQ ID NO: 209628 - DNA, 20 bp, Artificial Sequence
  Description of Artificial Sequence: Synthetic oligonucleotide
  Target: ATXN1; (-) strand; PAM type: YTN; PAM sequence: TTC
tcacagtgctgtgccacctt

SEQ ID NO: 209629 - DNA, 20 bp, Artificial Sequence
  Description of Artificial Sequence: Synthetic oligonucleotide
  Target: ATXN1; (-) strand; PAM type: YTN; PAM sequence: CTT
ctcacagtgctgtgccacct

SEQ ID NO: 209630 - DNA, 20 bp, Artificial Sequence
  Description of Artificial Sequence: Synthetic oligonucleotide
  Target: ATXN1; (-) strand; PAM type: YTN; PAM sequence: TTC
ttctcacagtgctgtgccac

SEQ ID NO: 209631 - DNA, 20 bp, Artificial Sequence
  Description of Artificial Sequence: Synthetic oligonucleotide
  Target: ATXN1; (-) strand; PAM type: YTN; PAM sequence: TTT
cttctcacagtgctgtgcca

SEQ ID NO: 209632 - DNA, 20 bp, Artificial Sequence
  Description of Artificial Sequence: Synthetic oligonucleotide
  Target: ATXN1; (-) strand; PAM type: YTN; PAM sequence: TTG
tttcttctcacagtgctgtg

SEQ ID NO: 209633 - DNA, 20 bp, Artificial Sequence
  Description of Artificial Sequence: Synthetic oligonucleotide
  Target: ATXN1; (-) strand; PAM type: YTN; PAM sequence: CTT
gtttcttctcacagtgctgt

SEQ ID NO: 209634 - DNA, 20 bp, Artificial Sequence
  Description of Artificial Sequence: Synthetic oligonucleotide
  Target: ATXN1; (-) strand; PAM type: YTN; PAM sequence: TTC
ttgtttcttctcacagtgct

SEQ ID NO: 209635 - DNA, 20 bp, Artificial Sequence
  Description of Artificial Sequence: Synthetic oligonucleotide
  Target: ATXN1; (-) strand; PAM type: YTN; PAM sequence: CTT
cttgtttcttctcacagtgc

SEQ ID NO: 209636 - DNA, 20 bp, Artificial Sequence
  Description of Artificial Sequence: Synthetic oligonucleotide
  Target: ATXN1; (-) strand; PAM type: YTN; PAM sequence: CTC
ttcttgtttcttctcacagt

SEQ ID NO: 209637 - DNA, 20 bp, Artificial Sequence
  Description of Artificial Sequence: Synthetic oligonucleotide
  Target: ATXN1; (-) strand; PAM type: YTN; PAM sequence: CTG
tcagaatctcttcttgtttc

SEQ ID NO: 209638 - DNA, 20 bp, Artificial Sequence
  Description of Artificial Sequence: Synthetic oligonucleotide
  Target: ATXN1; (-) strand; PAM type: YTN; PAM sequence: CTC
tgtcagaatctcttcttgtt

SEQ ID NO: 209639 - DNA, 20 bp, Artificial Sequence
  Description of Artificial Sequence: Synthetic oligonucleotide
  Target: ATXN1; (-) strand; PAM type: YTN; PAM sequence: CTA
accagtgctctgtcagaatc

SEQ ID NO: 209640 - DNA, 20 bp, Artificial Sequence
  Description of Artificial Sequence: Synthetic oligonucleotide
  Target: ATXN1; (-) strand; PAM type: YTN; PAM sequence: TTC
taaccagtgctctgtcagaa

SEQ ID NO: 209641 - DNA, 20 bp, Artificial Sequence
  Description of Artificial Sequence: Synthetic oligonucleotide
  Target: ATXN1; (-) strand; PAM type: YTN; PAM sequence: TTT
ctaaccagtgctctgtcaga

SEQ ID NO: 209642 - DNA, 20 bp, Artificial Sequence
  Description of Artificial Sequence: Synthetic oligonucleotide
  Target: ATXN1; (-) strand; PAM type: YTN; PAM sequence: TTA
ggaagatttctaaccagtgc

SEQ ID NO: 209643 - DNA, 20 bp, Artificial Sequence
  Description of Artificial Sequence: Synthetic oligonucleotide
  Target: ATXN1; (-) strand; PAM type: YTN; PAM sequence: TTT
aggaagatttctaaccagtg

SEQ ID NO: 209644 - DNA, 20 bp, Artificial Sequence
  Description of Artificial Sequence: Synthetic oligonucleotide
  Target: ATXN1; (-) strand; PAM type: YTN; PAM sequence: TTT
taggaagatttctaaccagt

SEQ ID NO: 209645 - DNA, 20 bp, Artificial Sequence
  Description of Artificial Sequence: Synthetic oligonucleotide
  Target: ATXN1; (-) strand; PAM type: YTN; PAM sequence: TTC
agtccattttaggaagattt

SEQ ID NO: 209646 - DNA, 20 bp, Artificial Sequence
  Description of Artificial Sequence: Synthetic oligonucleotide
  Target: ATXN1; (-) strand; PAM type: YTN; PAM sequence: CTC
cagcgttcagtccattttag

SEQ ID NO: 209647 - DNA, 20 bp, Artificial Sequence
  Description of Artificial Sequence: Synthetic oligonucleotide
  Target: ATXN1; (-) strand; PAM type: YTN; PAM sequence: CTC
acctccagcgttcagtccat

SEQ ID NO: 209648 - DNA, 20 bp, Artificial Sequence
  Description of Artificial Sequence: Synthetic oligonucleotide
  Target: ATXN1; (-) strand; PAM type: YTN; PAM sequence: CTC
tcacctccagcgttcagtcc

SEQ ID NO: 209649 - DNA, 20 bp, Artificial Sequence
  Description of Artificial Sequence: Synthetic oligonucleotide
  Target: ATXN1; (-) strand; PAM type: YTN; PAM sequence: CTG
ctctcacctccagcgttcag

SEQ ID NO: 209650 - DNA, 20 bp, Artificial Sequence
  Description of Artificial Sequence: Synthetic oligonucleotide
  Target: ATXN1; (-) strand; PAM type: YTN; PAM sequence: CTA
gcctgctctcacctccagcg

SEQ ID NO: 209651 - DNA, 20 bp, Artificial Sequence
  Description of Artificial Sequence: Synthetic oligonucleotide
  Target: ATXN1; (-) strand; PAM type: YTN; PAM sequence: TTG
ctagcctgctctcacctcca

SEQ ID NO: 209652 - DNA, 20 bp, Artificial Sequence
  Description of Artificial Sequence: Synthetic oligonucleotide
  Target: ATXN1; (-) strand; PAM type: YTN; PAM sequence: TTT
gctagcctgctctcacctcc

SEQ ID NO: 209653 - DNA, 20 bp, Artificial Sequence
  Description of Artificial Sequence: Synthetic oligonucleotide
  Target: ATXN1; (-) strand; PAM type: YTN; PAM sequence: CTG
gtttgctagcctgctctcac

SEQ ID NO: 209654 - DNA, 20 bp, Artificial Sequence
  Description of Artificial Sequence: Synthetic oligonucleotide
  Target: ATXN1; (-) strand; PAM type: YTN; PAM sequence: CTA
tctggtttgctagcctgctc

SEQ ID NO: 209655 - DNA, 20 bp, Artificial Sequence
  Description of Artificial Sequence: Synthetic oligonucleotide
  Target: ATXN1; (-) strand; PAM type: YTN; PAM sequence: CTG
gacaccagacactatctggt

SEQ ID NO: 209656 - DNA, 20 bp, Artificial Sequence
  Description of Artificial Sequence: Synthetic oligonucleotide
  Target: ATXN1; (-) strand; PAM type: YTN; PAM sequence: TTC
cgaatgtgaatgccctggac

SEQ ID NO: 209657 - DNA, 20 bp, Artificial Sequence
  Description of Artificial Sequence: Synthetic oligonucleotide
  Target: ATXN1; (-) strand; PAM type: YTN; PAM sequence: CTT
ccgaatgtgaatgccctgga

SEQ ID NO: 209658 - DNA, 20 bp, Artificial Sequence
  Description of Artificial Sequence: Synthetic oligonucleotide
  Target: ATXN1; (-) strand; PAM type: YTN; PAM sequence: TTA
gtgccttccgaatgtgaatg

SEQ ID NO: 209659 - DNA, 20 bp, Artificial Sequence
  Description of Artificial Sequence: Synthetic oligonucleotide
  Target: ATXN1; (-) strand; PAM type: YTN; PAM sequence: CTT
agtgccttccgaatgtgaat

SEQ ID NO: 209660 - DNA, 20 bp, Artificial Sequence
  Description of Artificial Sequence: Synthetic oligonucleotide
  Target: ATXN1; (-) strand; PAM type: YTN; PAM sequence: TTC
ttagtgccttccgaatgtga

SEQ ID NO: 209661 - DNA, 20 bp, Artificial Sequence
  Description of Artificial Sequence: Synthetic oligonucleotide
  Target: ATXN1; (-) strand; PAM type: YTN; PAM sequence: CTT
cttagtgccttccgaatgtg

SEQ ID NO: 209662 - DNA, 20 bp, Artificial Sequence
  Description of Artificial Sequence: Synthetic oligonucleotide
  Target: ATXN1; (-) strand; PAM type: YTN; PAM sequence: CTC
ttcttagtgccttccgaatg

SEQ ID NO: 209663 - DNA, 20 bp, Artificial Sequence
  Description of Artificial Sequence: Synthetic oligonucleotide
  Target: ATXN1; (-) strand; PAM type: YTN; PAM sequence: TTC
tcttcttagtgccttccgaa

SEQ ID NO: 209664 - DNA, 20 bp, Artificial Sequence
  Description of Artificial Sequence: Synthetic oligonucleotide
  Target: ATXN1; (-) strand; PAM type: YTN; PAM sequence: TTG
gttctcttcttagtgccttc

SEQ ID NO: 209665 - DNA, 20 bp, Artificial Sequence
  Description of Artificial Sequence: Synthetic oligonucleotide
  Target: ATXN1; (-) strand; PAM type: YTN; PAM sequence: CTT
ggttctcttcttagtgcctt

SEQ ID NO: 209666 - DNA, 20 bp, Artificial Sequence
  Description of Artificial Sequence: Synthetic oligonucleotide
  Target: ATXN1; (-) strand; PAM type: YTN; PAM sequence: TTA
tgcttggttctcttcttagt

SEQ ID NO: 209667 - DNA, 20 bp, Artificial Sequence
  Description of Artificial Sequence: Synthetic oligonucleotide
  Target: ATXN1; (-) strand; PAM type: YTN; PAM sequence: CTT
atgcttggttctcttcttag

SEQ ID NO: 209668 - DNA, 20 bp, Artificial Sequence
  Description of Artificial Sequence: Synthetic oligonucleotide
  Target: ATXN1; (-) strand; PAM type: YTN; PAM sequence: CTC
acatcccaccagatggccat

SEQ ID NO: 209669 - DNA, 20 bp, Artificial Sequence
  Description of Artificial Sequence: Synthetic oligonucleotide
  Target: ATXN1; (-) strand; PAM type: YTN; PAM sequence: CTA
tgtagagagacatctcacat

SEQ ID NO: 209670 - DNA, 20 bp, Artificial Sequence
  Description of Artificial Sequence: Synthetic oligonucleotide
  Target: ATXN1; (-) strand; PAM type: YTN; PAM sequence: CTG
ctatgtagagagacatctca

SEQ ID NO: 209671 - DNA, 20 bp, Artificial Sequence
  Description of Artificial Sequence: Synthetic oligonucleotide
  Target: ATXN1; (-) strand; PAM type: YTN; PAM sequence: CTG
gcatcagagtcctgctatgt

SEQ ID NO: 209672 - DNA, 20 bp, Artificial Sequence
  Description of Artificial Sequence: Synthetic oligonucleotide
  Target: ATXN1; (-) strand; PAM type: YTN; PAM sequence: TTC
tggcatcagagtcctgctat

SEQ ID NO: 209673 - DNA, 20 bp, Artificial Sequence
  Description of Artificial Sequence: Synthetic oligonucleotide
  Target: ATXN1; (-) strand; PAM type: YTN; PAM sequence: TTT
ctggcatcagagtcctgcta

SEQ ID NO: 209674 - DNA, 20 bp, Artificial Sequence
  Description of Artificial Sequence: Synthetic oligonucleotide
  Target: ATXN1; (-) strand; PAM type: YTN; PAM sequence: TTT
tctggcatcagagtcctgct

SEQ ID NO: 209675 - DNA, 20 bp, Artificial Sequence
  Description of Artificial Sequence: Synthetic oligonucleotide
  Target: ATXN1; (-) strand; PAM type: YTN; PAM sequence: TTT
ttctggcatcagagtcctgc

SEQ ID NO: 209676 - DNA, 20 bp, Artificial Sequence
  Description of Artificial Sequence: Synthetic oligonucleotide
  Target: ATXN1; (-) strand; PAM type: YTN; PAM sequence: TTG
tagcagaggatgcatttttc

SEQ ID NO: 209677 - DNA, 20 bp, Artificial Sequence
  Description of Artificial Sequence: Synthetic oligonucleotide
  Target: ATXN1; (-) strand; PAM type: YTN; PAM sequence: TTT
gtagcagaggatgcattttt

SEQ ID NO: 209678 - DNA, 20 bp, Artificial Sequence
  Description of Artificial Sequence: Synthetic oligonucleotide
  Target: ATXN1; (-) strand; PAM type: YTN; PAM sequence: CTT
tgtagcagaggatgcatttt

SEQ ID NO: 209679 - DNA, 20 bp, Artificial Sequence
  Description of Artificial Sequence: Synthetic oligonucleotide
  Target: ATXN1; (-) strand; PAM type: YTN; PAM sequence: CTC
caagccccctttgtagcaga

SEQ ID NO: 209680 - DNA, 20 bp, Artificial Sequence
  Description of Artificial Sequence: Synthetic oligonucleotide
  Target: ATXN1; (-) strand; PAM type: YTN; PAM sequence: TTC
actccaagccccctttgtag

SEQ ID NO: 209681 - DNA, 20 bp, Artificial Sequence
  Description of Artificial Sequence: Synthetic oligonucleotide
  Target: ATXN1; (-) strand; PAM type: YTN; PAM sequence: CTT
cactccaagccccctttgta

SEQ ID NO: 209682 - DNA, 20 bp, Artificial Sequence
  Description of Artificial Sequence: Synthetic oligonucleotide
  Target: ATXN1; (-) strand; PAM type: YTN; PAM sequence: CTA
gcttcactccaagccccctt

SEQ ID NO: 209683 - DNA, 20 bp, Artificial Sequence
  Description of Artificial Sequence: Synthetic oligonucleotide
  Target: ATXN1; (-) strand; PAM type: YTN; PAM sequence: CTG
accctagcttcactccaagc

SEQ ID NO: 209684 - DNA, 20 bp, Artificial Sequence
  Description of Artificial Sequence: Synthetic oligonucleotide
  Target: ATXN1; (-) strand; PAM type: YTN; PAM sequence: CTC
cctgaccctagcttcactcc

SEQ ID NO: 209685 - DNA, 20 bp, Artificial Sequence
  Description of Artificial Sequence: Synthetic oligonucleotide
  Target: ATXN1; (-) strand; PAM type: YTN; PAM sequence: TTC
tccctgaccctagcttcact

SEQ ID NO: 209686 - DNA, 20 bp, Artificial Sequence
  Description of Artificial Sequence: Synthetic oligonucleotide
  Target: ATXN1; (-) strand; PAM type: YTN; PAM sequence: CTT
ctccctgaccctagcttcac

SEQ ID NO: 209687 - DNA, 20 bp, Artificial Sequence
  Description of Artificial Sequence: Synthetic oligonucleotide
  Target: ATXN1; (-) strand; PAM type: YTN; PAM sequence: CTG
aacttctccctgaccctagc

SEQ ID NO: 209688 - DNA, 20 bp, Artificial Sequence
  Description of Artificial Sequence: Synthetic oligonucleotide
  Target: ATXN1; (-) strand; PAM type: YTN; PAM sequence: TTC
tgaacttctccctgacccta

SEQ ID NO: 209689 - DNA, 20 bp, Artificial Sequence
  Description of Artificial Sequence: Synthetic oligonucleotide
  Target: ATXN1; (-) strand; PAM type: YTN; PAM sequence: CTC
attctgaacttctccctgac

SEQ ID NO: 209690 - DNA, 20 bp, Artificial Sequence
  Description of Artificial Sequence: Synthetic oligonucleotide
  Target: ATXN1; (-) strand; PAM type: YTN; PAM sequence: TTC
tcattctgaacttctccctg

SEQ ID NO: 209691 - DNA, 20 bp, Artificial Sequence
  Description of Artificial Sequence: Synthetic oligonucleotide
  Target: ATXN1; (-) strand; PAM type: YTN; PAM sequence: TTG
gcaatgggtgaagccatcgt

SEQ ID NO: 209692 - DNA, 20 bp, Artificial Sequence
  Description of Artificial Sequence: Synthetic oligonucleotide
  Target: ATXN1; (-) strand; PAM type: YTN; PAM sequence: CTT
ggcaatgggtgaagccatcg

SEQ ID NO: 209693 - DNA, 20 bp, Artificial Sequence
  Description of Artificial Sequence: Synthetic oligonucleotide
  Target: ATXN1; (-) strand; PAM type: YTN; PAM sequence: CTG
cttggcaatgggtgaagcca

SEQ ID NO: 209694 - DNA, 20 bp, Artificial Sequence
  Description of Artificial Sequence: Synthetic oligonucleotide
  Target: ATXN1; (-) strand; PAM type: YTN; PAM sequence: TTG
ctgcttggcaatgggtgaag

SEQ ID NO: 209695 - DNA, 20 bp, Artificial Sequence
  Description of Artificial Sequence: Synthetic oligonucleotide
  Target: ATXN1; (-) strand; PAM type: YTN; PAM sequence: TTG
catggttgctgcttggcaat

SEQ ID NO: 209696 - DNA, 20 bp, Artificial Sequence
  Description of Artificial Sequence: Synthetic oligonucleotide
  Target: ATXN1; (-) strand; PAM type: YTN; PAM sequence: CTT
gcatggttgctgcttggcaa

SEQ ID NO: 209697 - DNA, 20 bp, Artificial Sequence
  Description of Artificial Sequence: Synthetic oligonucleotide
  Target: ATXN1; (-) strand; PAM type: YTN; PAM sequence: TTC
cttgcatggttgctgcttgg

SEQ ID NO: 209698 - DNA, 20 bp, Artificial Sequence
  Description of Artificial Sequence: Synthetic oligonucleotide
  Target: ATXN1; (-) strand; PAM type: YTN; PAM sequence: CTT
ccttgcatggttgctgcttg

SEQ ID NO: 209699 - DNA, 20 bp, Artificial Sequence
  Description of Artificial Sequence: Synthetic oligonucleotide
  Target: ATXN1; (-) strand; PAM type: YTN; PAM sequence: TTC
ttccttgcatggttgctgct

SEQ ID NO: 209700 - DNA, 20 bp, Artificial Sequence
  Description of Artificial Sequence: Synthetic oligonucleotide
  Target: ATXN1; (-) strand; PAM type: YTN; PAM sequence: TTG
gggttcttccttgcatggtt

SEQ ID NO: 209701 - DNA, 20 bp, Artificial Sequence
  Description of Artificial Sequence: Synthetic oligonucleotide
  Target: ATXN1; (-) strand; PAM type: YTN; PAM sequence: CTA
ttggggttcttccttgcatg

SEQ ID NO: 209702 - DNA, 20 bp, Artificial Sequence
  Description of Artificial Sequence: Synthetic oligonucleotide
  Target: ATXN1; (-) strand; PAM type: YTN; PAM sequence: CTC
tattggggttcttccttgca

SEQ ID NO: 209703 - DNA, 20 bp, Artificial Sequence
  Description of Artificial Sequence: Synthetic oligonucleotide
  Target: ATXN1; (-) strand; PAM type: YTN; PAM sequence: CTG
gagccacagggcaatctcta

SEQ ID NO: 209704 - DNA, 20 bp, Artificial Sequence
  Description of Artificial Sequence: Synthetic oligonucleotide
  Target: ATXN1; (-) strand; PAM type: YTN; PAM sequence: TTG
tagggagctggagccacagg

SEQ ID NO: 209705 - DNA, 20 bp, Artificial Sequence
  Description of Artificial Sequence: Synthetic oligonucleotide
  Target: ATXN1; (-) strand; PAM type: YTN; PAM sequence: TTT
gtagggagctggagccacag

SEQ ID NO: 209706 - DNA, 20 bp, Artificial Sequence
  Description of Artificial Sequence: Synthetic oligonucleotide
  Target: ATXN1; (-) strand; PAM type: YTN; PAM sequence: CTG
cacaaatttgtagggagctg

SEQ ID NO: 209707 - DNA, 20 bp, Artificial Sequence
  Description of Artificial Sequence: Synthetic oligonucleotide
  Target: ATXN1; (-) strand; PAM type: YTN; PAM sequence: TTC
agcagctgcacaaatttgta

SEQ ID NO: 209708 - DNA, 20 bp, Artificial Sequence
  Description of Artificial Sequence: Synthetic oligonucleotide
  Target: ATXN1; (-) strand; PAM type: YTN; PAM sequence: TTT
cagcagctgcacaaatttgt

SEQ ID NO: 209709 - DNA, 20 bp, Artificial Sequence
  Description of Artificial Sequence: Synthetic oligonucleotide
  Target: ATXN1; (-) strand; PAM type: YTN; PAM sequence: TTT
tcagcagctgcacaaatttg

SEQ ID NO: 209710 - DNA, 20 bp, Artificial Sequence
  Description of Artificial Sequence: Synthetic oligonucleotide
  Target: ATXN1; (-) strand; PAM type: YTN; PAM sequence: TTT
ttcagcagctgcacaaattt

SEQ ID NO: 209711 - DNA, 20 bp, Artificial Sequence
  Description of Artificial Sequence: Synthetic oligonucleotide
  Target: ATXN1; (-) strand; PAM type: YTN; PAM sequence: CTA
gaccaggtgtgtttttcagc

SEQ ID NO: 209712 - DNA, 20 bp, Artificial Sequence
  Description of Artificial Sequence: Synthetic oligonucleotide
  Target: ATXN1; (-) strand; PAM type: YTN; PAM sequence: TTA
aaaatgtactagaccaggtg

SEQ ID NO: 209713 - DNA, 20 bp, Artificial Sequence
  Description of Artificial Sequence: Synthetic oligonucleotide
  Target: ATXN1; (-) strand; PAM type: YTN; PAM sequence: CTT
aaaaatgtactagaccaggt

SEQ ID NO: 209714 - DNA, 20 bp, Artificial Sequence
  Description of Artificial Sequence: Synthetic oligonucleotide
  Target: ATXN1; (-) strand; PAM type: YTN; PAM sequence: TTC
ttaaaaatgtactagaccag

SEQ ID NO: 209715 - DNA, 20 bp, Artificial Sequence
  Description of Artificial Sequence: Synthetic oligonucleotide
  Target: ATXN1; (-) strand; PAM type: YTN; PAM sequence: TTG
ttcttaaaaatgtactagac

SEQ ID NO: 209716 - DNA, 20 bp, Artificial Sequence
  Description of Artificial Sequence: Synthetic oligonucleotide
  Target: ATXN1; (-) strand; PAM type: YTN; PAM sequence: TTT
gttcttaaaaatgtactaga

SEQ ID NO: 209717 - DNA, 20 bp, Artificial Sequence
  Description of Artificial Sequence: Synthetic oligonucleotide
  Target: ATXN1; (-) strand; PAM type: YTN; PAM sequence: CTT
tgttcttaaaaatgtactag

SEQ ID NO: 209718 - DNA, 20 bp, Artificial Sequence
  Description of Artificial Sequence: Synthetic oligonucleotide
  Target: ATXN1; (-) strand; PAM type: YTN; PAM sequence: CTG
aaggctttgttcttaaaaat

SEQ ID NO: 209719 - DNA, 20 bp, Artificial Sequence
  Description of Artificial Sequence: Synthetic oligonucleotide
  Target: ATXN1; (-) strand; PAM type: YTN; PAM sequence: TTA
agctgaaggctttgttctta

SEQ ID NO: 209720 - DNA, 20 bp, Artificial Sequence
  Description of Artificial Sequence: Synthetic oligonucleotide
  Target: ATXN1; (-) strand; PAM type: YTN; PAM sequence: CTT
aagctgaaggctttgttctt

SEQ ID NO: 209721 - DNA, 20 bp, Artificial Sequence
  Description of Artificial Sequence: Synthetic oligonucleotide
  Target: ATXN1; (-) strand; PAM type: YTN; PAM sequence: CTC
ggtcttaagctgaaggcttt

SEQ ID NO: 209722 - DNA, 20 bp, Artificial Sequence
  Description of Artificial Sequence: Synthetic oligonucleotide
  Target: ATXN1; (-) strand; PAM type: YTN; PAM sequence: TTC
ctcggtcttaagctgaaggc

SEQ ID NO: 209723 - DNA, 20 bp, Artificial Sequence
  Description of Artificial Sequence: Synthetic oligonucleotide
  Target: ATXN1; (-) strand; PAM type: YTN; PAM sequence: TTT
cctcggtcttaagctgaagg

SEQ ID NO: 209724 - DNA, 20 bp, Artificial Sequence
  Description of Artificial Sequence: Synthetic oligonucleotide
  Target: ATXN1; (-) strand; PAM type: YTN; PAM sequence: CTT
tcctcggtcttaagctgaag

SEQ ID NO: 209725 - DNA, 20 bp, Artificial Sequence
  Description of Artificial Sequence: Synthetic oligonucleotide
  Target: ATXN1; (-) strand; PAM type: YTN; PAM sequence: CTC
ctttcctcggtcttaagctg

SEQ ID NO: 209726 - DNA, 20 bp, Artificial Sequence
  Description of Artificial Sequence: Synthetic oligonucleotide
  Target: ATXN1; (-) strand; PAM type: YTN; PAM sequence: TTG
gactcctttcctcggtctta

SEQ ID NO: 209727 - DNA, 20 bp, Artificial Sequence
  Description of Artificial Sequence: Synthetic oligonucleotide
  Target: ATXN1; (-) strand; PAM type: YTN; PAM sequence: TTA
gggaaaggttggactccttt

SEQ ID NO: 209728 - DNA, 20 bp, Artificial Sequence
  Description of Artificial Sequence: Synthetic oligonucleotide
  Target: ATXN1; (-) strand; PAM type: YTN; PAM sequence: CTG
taccattagggaaaggttgg

SEQ ID NO: 209729 - DNA, 20 bp, Artificial Sequence
  Description of Artificial Sequence: Synthetic oligonucleotide
  Target: ATXN1; (-) strand; PAM type: YTN; PAM sequence: CTC
tgtaccattagggaaaggtt

SEQ ID NO: 209730 - DNA, 20 bp, Artificial Sequence
  Description of Artificial Sequence: Synthetic oligonucleotide
  Target: ATXN1; (-) strand; PAM type: YTN; PAM sequence: CTC
aaataatctctgtaccatta

SEQ ID NO: 209731 - DNA, 20 bp, Artificial Sequence
  Description of Artificial Sequence: Synthetic oligonucleotide
  Target: ATXN1; (-) strand; PAM type: YTN; PAM sequence: TTC
tcaaataatctctgtaccat

SEQ ID NO: 209732 - DNA, 20 bp, Artificial Sequence
  Description of Artificial Sequence: Synthetic oligonucleotide
  Target: ATXN1; (-) strand; PAM type: YTN; PAM sequence: TTG
ttctcaaataatctctgtac

SEQ ID NO: 209733 - DNA, 20 bp, Artificial Sequence
  Description of Artificial Sequence: Synthetic oligonucleotide
  Target: ATXN1; (-) strand; PAM type: YTN; PAM sequence: CTG
gaaattgttctcaaataatc

SEQ ID NO: 209734 - DNA, 20 bp, Artificial Sequence
  Description of Artificial Sequence: Synthetic oligonucleotide
  Target: ATXN1; (-) strand; PAM type: YTN; PAM sequence: CTA
gcccgccctggaaattgttc

SEQ ID NO: 209735 - DNA, 20 bp, Artificial Sequence
  Description of Artificial Sequence: Synthetic oligonucleotide
  Target: ATXN1; (-) strand; PAM type: YTN; PAM sequence: TTG
aatgatgggagggctagccc

SEQ ID NO: 209736 - DNA, 20 bp, Artificial Sequence
  Description of Artificial Sequence: Synthetic oligonucleotide
  Target: ATXN1; (-) strand; PAM type: YTN; PAM sequence: CTC
atcattgaatgatgggaggg

SEQ ID NO: 209737 - DNA, 20 bp, Artificial Sequence
  Description of Artificial Sequence: Synthetic oligonucleotide
  Target: ATXN1; (-) strand; PAM type: YTN; PAM sequence: CTG
ctcatcattgaatgatggga

SEQ ID NO: 209738 - DNA, 20 bp, Artificial Sequence
  Description of Artificial Sequence: Synthetic oligonucleotide
  Target: ATXN1; (-) strand; PAM type: YTN; PAM sequence: TTG
ggtctgctcatcattgaatg

SEQ ID NO: 209739 - DNA, 20 bp, Artificial Sequence
  Description of Artificial Sequence: Synthetic oligonucleotide
  Target: ATXN1; (-) strand; PAM type: YTN; PAM sequence: TTT
gggtctgctcatcattgaat

SEQ ID NO: 209740 - DNA, 20 bp, Artificial Sequence
  Description of Artificial Sequence: Synthetic oligonucleotide
  Target: ATXN1; (-) strand; PAM type: YTN; PAM sequence: TTT
tgggtctgctcatcattgaa

SEQ ID NO: 209741 - DNA, 20 bp, Artificial Sequence
  Description of Artificial Sequence: Synthetic oligonucleotide
  Target: ATXN1; (-) strand; PAM type: YTN; PAM sequence: TTG
ccagttttgggtctgctcat

SEQ ID NO: 209742 - DNA, 20 bp, Artificial Sequence
  Description of Artificial Sequence: Synthetic oligonucleotide
  Target: ATXN1; (-) strand; PAM type: YTN; PAM sequence: TTA
taagcccaatgttgccagtt

SEQ ID NO: 209743 - DNA, 20 bp, Artificial Sequence
  Description of Artificial Sequence: Synthetic oligonucleotide
  Target: ATXN1; (-) strand; PAM type: YTN; PAM sequence: CTT
ataagcccaatgttgccagt

SEQ ID NO: 209744 - DNA, 20 bp, Artificial Sequence
  Description of Artificial Sequence: Synthetic oligonucleotide
  Target: ATXN1; (-) strand; PAM type: YTN; PAM sequence: TTA
accaagtccttataagccca

SEQ ID NO: 209745 - DNA, 20 bp, Artificial Sequence
  Description of Artificial Sequence: Synthetic oligonucleotide
  Target: ATXN1; (-) strand; PAM type: YTN; PAM sequence: TTG
ttaaccaagtccttataagc

SEQ ID NO: 209746 - DNA, 20 bp, Artificial Sequence
  Description of Artificial Sequence: Synthetic oligonucleotide
  Target: ATXN1; (-) strand; PAM type: YTN; PAM sequence: TTT
gttaaccaagtccttataag

SEQ ID NO: 209747 - DNA, 20 bp, Artificial Sequence
  Description of Artificial Sequence: Synthetic oligonucleotide
  Target: ATXN1; (-) strand; PAM type: YTN; PAM sequence: TTT
tgttaaccaagtccttataa

SEQ ID NO: 209748 - DNA, 20 bp, Artificial Sequence
  Description of Artificial Sequence: Synthetic oligonucleotide
  Target: ATXN1; (-) strand; PAM type: YTN; PAM sequence: TTG
ttttgttaaccaagtcctta

SEQ ID NO: 209749 - DNA, 20 bp, Artificial Sequence
  Description of Artificial Sequence: Synthetic oligonucleotide
  Target: ATXN1; (-) strand; PAM type: YTN; PAM sequence: CTT
gttttgttaaccaagtcctt

SEQ ID NO: 209750 - DNA, 20 bp, Artificial Sequence
  Description of Artificial Sequence: Synthetic oligonucleotide
  Target: ATXN1; (-) strand; PAM type: YTN; PAM sequence: TTC
ttgttttgttaaccaagtcc

SEQ ID NO: 209751 - DNA, 20 bp, Artificial Sequence
  Description of Artificial Sequence: Synthetic oligonucleotide
  Target: ATXN1; (-) strand; PAM type: YTN; PAM sequence: TTT
cttgttttgttaaccaagtc

SEQ ID NO: 209752 - DNA, 20 bp, Artificial Sequence
  Description of Artificial Sequence: Synthetic oligonucleotide
  Target: ATXN1; (-) strand; PAM type: YTN; PAM sequence: TTG
gatgtttcttgttttgttaa

SEQ ID NO: 209753 - DNA, 20 bp, Artificial Sequence
  Description of Artificial Sequence: Synthetic oligonucleotide
  Target: ATXN1; (-) strand; PAM type: YTN; PAM sequence: CTT
ggatgtttcttgttttgtta

SEQ ID NO: 209754 - DNA, 20 bp, Artificial Sequence
  Description of Artificial Sequence: Synthetic oligonucleotide
  Target: ATXN1; (-) strand; PAM type: YTN; PAM sequence: TTC
ttggatgtttcttgttttgt

SEQ ID NO: 209755 - DNA, 20 bp, Artificial Sequence
  Description of Artificial Sequence: Synthetic oligonucleotide
  Target: ATXN1; (-) strand; PAM type: YTN; PAM sequence: TTT
cttggatgtttcttgttttg

SEQ ID NO: 209756 - DNA, 20 bp, Artificial Sequence
  Description of Artificial Sequence: Synthetic oligonucleotide
  Target: ATXN1; (-) strand; PAM type: YTN; PAM sequence: TTA
tttcttggatgtttcttgtt

SEQ ID NO: 209757 - DNA, 20 bp, Artificial Sequence
  Description of Artificial Sequence: Synthetic oligonucleotide
  Target: ATXN1; (-) strand; PAM type: YTN; PAM sequence: TTT
atttcttggatgtttcttgt

SEQ ID NO: 209758 - DNA, 20 bp, Artificial Sequence
  Description of Artificial Sequence: Synthetic oligonucleotide
  Target: ATXN1; (-) strand; PAM type: YTN; PAM sequence: CTT
tatttcttggatgtttcttg

SEQ ID NO: 209759 - DNA, 20 bp, Artificial Sequence
  Description of Artificial Sequence: Synthetic oligonucleotide
  Target: ATXN1; (-) strand; PAM type: YTN; PAM sequence: TTC
ctttatttcttggatgtttc

SEQ ID NO: 209760 - DNA, 20 bp, Artificial Sequence
  Description of Artificial Sequence: Synthetic oligonucleotide
  Target: ATXN1; (-) strand; PAM type: YTN; PAM sequence: CTT
cctttatttcttggatgttt

SEQ ID NO: 209761 - DNA, 20 bp, Artificial Sequence
  Description of Artificial Sequence: Synthetic oligonucleotide
  Target: ATXN1; (-) strand; PAM type: YTN; PAM sequence: TTC
ttcctttatttcttggatgt

SEQ ID NO: 209762 - DNA, 20 bp, Artificial Sequence
  Description of Artificial Sequence: Synthetic oligonucleotide
  Target: ATXN1; (-) strand; PAM type: YTN; PAM sequence: CTT
cttcctttatttcttggatg

SEQ ID NO: 209763 - DNA, 20 bp, Artificial Sequence
  Description of Artificial Sequence: Synthetic oligonucleotide
  Target: ATXN1; (-) strand; PAM type: YTN; PAM sequence: TTG
aaatcgtcttcttcctttat

SEQ ID NO: 209764 - DNA, 20 bp, Artificial Sequence
  Description of Artificial Sequence: Synthetic oligonucleotide
  Target: ATXN1; (-) strand; PAM type: YTN; PAM sequence: TTT
gaaatcgtcttcttccttta

SEQ ID NO: 209765 - DNA, 20 bp, Artificial Sequence
  Description of Artificial Sequence: Synthetic oligonucleotide
  Target: ATXN1; (-) strand; PAM type: YTN; PAM sequence: TTT
tgaaatcgtcttcttccttt

SEQ ID NO: 209766 - DNA, 20 bp, Artificial Sequence
  Description of Artificial Sequence: Synthetic oligonucleotide
  Target: ATXN1; (-) strand; PAM type: YTN; PAM sequence: TTT
ttgaaatcgtcttcttcctt

SEQ ID NO: 209767 - DNA, 20 bp, Artificial Sequence
  Description of Artificial Sequence: Synthetic oligonucleotide
  Target: ATXN1; (-) strand; PAM type: YTN; PAM sequence: TTT
tttgaaatcgtcttcttcct

SEQ ID NO: 209768 - DNA, 20 bp, Artificial Sequence
  Description of Artificial Sequence: Synthetic oligonucleotide
  Target: ATXN1; (-) strand; PAM type: YTN; PAM sequence: TTC
cagtagtaaatattttttga

SEQ ID NO: 209769 - DNA, 20 bp, Artificial Sequence
  Description of Artificial Sequence: Synthetic oligonucleotide
  Target: ATXN1; (-) strand; PAM type: YTN; PAM sequence: TTT
ccagtagtaaatattttttg

SEQ ID NO: 209770 - DNA, 20 bp, Artificial Sequence
  Description of Artificial Sequence: Synthetic oligonucleotide
  Target: ATXN1; (-) strand; PAM type: YTN; PAM sequence: CTA
tttccagtagtaaatatttt

SEQ ID NO: 209771 - DNA, 20 bp, Artificial Sequence
  Description of Artificial Sequence: Synthetic oligonucleotide
  Target: ATXN1; (-) strand; PAM type: YTN; PAM sequence: TTC
tatttccagtagtaaatatt

SEQ ID NO: 209772 - DNA, 20 bp, Artificial Sequence
  Description of Artificial Sequence: Synthetic oligonucleotide
  Target: ATXN1; (-) strand; PAM type: YTN; PAM sequence: TTT
ctatttccagtagtaaatat

SEQ ID NO: 209773 - DNA, 20 bp, Artificial Sequence
  Description of Artificial Sequence: Synthetic oligonucleotide
  Target: ATXN1; (-) strand; PAM type: YTN; PAM sequence: TTG
tttctatttccagtagtaaa

SEQ ID NO: 209774 - DNA, 20 bp, Artificial Sequence
  Description of Artificial Sequence: Synthetic oligonucleotide
  Target: ATXN1; (-) strand; PAM type: YTN; PAM sequence: CTT
gtttctatttccagtagtaa

SEQ ID NO: 209775 - DNA, 20 bp, Artificial Sequence
  Description of Artificial Sequence: Synthetic oligonucleotide
  Target: ATXN1; (-) strand; PAM type: YTN; PAM sequence: CTG
aaacttgtttctatttccag

SEQ ID NO: 209776 - DNA, 20 bp, Artificial Sequence
  Description of Artificial Sequence: Synthetic oligonucleotide
  Target: ATXN1; (-) strand; PAM type: YTN; PAM sequence: TTG
tctgaaacttgtttctattt

SEQ ID NO: 209777 - DNA, 20 bp, Artificial Sequence
  Description of Artificial Sequence: Synthetic oligonucleotide
  Target: ATXN1; (-) strand; PAM type: YTN; PAM sequence: CTT
gtctgaaacttgtttctatt

SEQ ID NO: 209778 - DNA, 20 bp, Artificial Sequence
  Description of Artificial Sequence: Synthetic oligonucleotide
  Target: ATXN1; (-) strand; PAM type: YTN; PAM sequence: TTC
aaaggtgcaaatcacatctt

SEQ ID NO: 209779 - DNA, 20 bp, Artificial Sequence
  Description of Artificial Sequence: Synthetic oligonucleotide
  Target: ATXN1; (-) strand; PAM type: YTN; PAM sequence: CTT
caaaggtgcaaatcacatct

SEQ ID NO: 209780 - DNA, 20 bp, Artificial Sequence
  Description of Artificial Sequence: Synthetic oligonucleotide
  Target: ATXN1; (-) strand; PAM type: YTN; PAM sequence: TTC
ttcaaaggtgcaaatcacat

SEQ ID NO: 209781 - DNA, 20 bp, Artificial Sequence
  Description of Artificial Sequence: Synthetic oligonucleotide
  Target: ATXN1; (-) strand; PAM type: YTN; PAM sequence: CTT
cttcaaaggtgcaaatcaca

SEQ ID NO: 209782 - DNA, 20 bp, Artificial Sequence
  Description of Artificial Sequence: Synthetic oligonucleotide
  Target: ATXN1; (-) strand; PAM type: YTN; PAM sequence: CTC
cttcttcaaaggtgcaaatc

SEQ ID NO: 209783 - DNA, 20 bp, Artificial Sequence
  Description of Artificial Sequence: Synthetic oligonucleotide
  Target: ATXN1; (-) strand; PAM type: YTN; PAM sequence: CTC
ctccttcttcaaaggtgcaa

SEQ ID NO: 209784 - DNA, 20 bp, Artificial Sequence
  Description of Artificial Sequence: Synthetic oligonucleotide
  Target: ATXN1; (-) strand; PAM type: YTN; PAM sequence: TTC
ctcctccttcttcaaaggtg

SEQ ID NO: 209785 - DNA, 20 bp, Artificial Sequence
  Description of Artificial Sequence: Synthetic oligonucleotide
  Target: ATXN1; (-) strand; PAM type: YTN; PAM sequence: TTT
cctcctccttcttcaaaggt

SEQ ID NO: 209786 - DNA, 20 bp, Artificial Sequence
  Description of Artificial Sequence: Synthetic oligonucleotide
  Target: ATXN1; (-) strand; PAM type: YTN; PAM sequence: TTT
tcctcctccttcttcaaagg

SEQ ID NO: 209787 - DNA, 20 bp, Artificial Sequence
  Description of Artificial Sequence: Synthetic oligonucleotide
  Target: ATXN1; (-) strand; PAM type: YTN; PAM sequence: TTT
ttcctcctccttcttcaaag

SEQ ID NO: 209788 - DNA, 20 bp, Artificial Sequence
  Description of Artificial Sequence: Synthetic oligonucleotide
  Target: ATXN1; (-) strand; PAM type: YTN; PAM sequence: CTT
tttcctcctccttcttcaaa

SEQ ID NO: 209789 - DNA, 20 bp, Artificial Sequence
  Description of Artificial Sequence: Synthetic oligonucleotide
  Target: ATXN1; (-) strand; PAM type: YTN; PAM sequence: TTC
tttttcctcctccttcttca

SEQ ID NO: 209790 - DNA, 20 bp, Artificial Sequence
  Description of Artificial Sequence: Synthetic oligonucleotide
  Target: ATXN1; (-) strand; PAM type: YTN; PAM sequence: CTT
ctttttcctcctccttcttc

SEQ ID NO: 209791 - DNA, 20 bp, Artificial Sequence
  Description of Artificial Sequence: Synthetic oligonucleotide
  Target: ATXN1; (-) strand; PAM type: YTN; PAM sequence: CTC
cccttctttttcctcctcct

SEQ ID NO: 209792 - DNA, 20 bp, Artificial Sequence
  Description of Artificial Sequence: Synthetic oligonucleotide
  Target: ATXN1; (-) strand; PAM type: YTN; PAM sequence: CTC
ctccccttctttttcctcct

SEQ ID NO: 209793 - DNA, 20 bp, Artificial Sequence
  Description of Artificial Sequence: Synthetic oligonucleotide
  Target: ATXN1; (-) strand; PAM type: YTN; PAM sequence: CTG
ggtctcctccccttcttttt

SEQ ID NO: 209794 - DNA, 20 bp, Artificial Sequence
  Description of Artificial Sequence: Synthetic oligonucleotide
  Target: ATXN1; (-) strand; PAM type: YTN; PAM sequence: CTA
agtctgggtctcctcccctt

SEQ ID NO: 209795 - DNA, 20 bp, Artificial Sequence
  Description of Artificial Sequence: Synthetic oligonucleotide
  Target: ATXN1; (-) strand; PAM type: YTN; PAM sequence: TTC
acgcctaagtctgggtctcc

SEQ ID NO: 209796 - DNA, 20 bp, Artificial Sequence
  Description of Artificial Sequence: Synthetic oligonucleotide
  Target: ATXN1; (-) strand; PAM type: YTN; PAM sequence: TTG
tcattcacgcctaagtctgg

SEQ ID NO: 209797 - DNA, 20 bp, Artificial Sequence
  Description of Artificial Sequence: Synthetic oligonucleotide
  Target: ATXN1; (-) strand; PAM type: YTN; PAM sequence: CTT
gtcattcacgcctaagtctg

SEQ ID NO: 209798 - DNA, 20 bp, Artificial Sequence
  Description of Artificial Sequence: Synthetic oligonucleotide
  Target: ATXN1; (-) strand; PAM type: YTN; PAM sequence: TTA
cttgtcattcacgcctaagt

SEQ ID NO: 209799 - DNA, 20 bp, Artificial Sequence
  Description of Artificial Sequence: Synthetic oligonucleotide
  Target: ATXN1; (-) strand; PAM type: YTN; PAM sequence: TTT
acttgtcattcacgcctaag

SEQ ID NO: 209800 - DNA, 20 bp, Artificial Sequence
  Description of Artificial Sequence: Synthetic oligonucleotide
  Target: ATXN1; (-) strand; PAM type: YTN; PAM sequence: TTC
atttacttgtcattcacgcc

SEQ ID NO: 209801 - DNA, 20 bp, Artificial Sequence
  Description of Artificial Sequence: Synthetic oligonucleotide
  Target: ATXN1; (-) strand; PAM type: YTN; PAM sequence: TTT
catttacttgtcattcacgc

SEQ ID NO: 209802 - DNA, 20 bp, Artificial Sequence
  Description of Artificial Sequence: Synthetic oligonucleotide
  Target: ATXN1; (-) strand; PAM type: YTN; PAM sequence: TTT
tcatttacttgtcattcacg

SEQ ID NO: 209803 - DNA, 20 bp, Artificial Sequence
  Description of Artificial Sequence: Synthetic oligonucleotide
  Target: ATXN1; (-) strand; PAM type: YTN; PAM sequence: TTG
ttttcatttacttgtcattc

SEQ ID NO: 209804 - DNA, 20 bp, Artificial Sequence
  Description of Artificial Sequence: Synthetic oligonucleotide
  Target: ATXN1; (-) strand; PAM type: YTN; PAM sequence: TTT
gttttcatttacttgtcatt

SEQ ID NO: 209805 - DNA, 20 bp, Artificial Sequence
  Description of Artificial Sequence: Synthetic oligonucleotide
  Target: ATXN1; (-) strand; PAM type: YTN; PAM sequence: TTT
tgttttcatttacttgtcat

SEQ ID NO: 209806 - DNA, 20 bp, Artificial Sequence
  Description of Artificial Sequence: Synthetic oligonucleotide
  Target: ATXN1; (-) strand; PAM type: YTN; PAM sequence: TTT
ttgttttcatttacttgtca

SEQ ID NO: 209807 - DNA, 20 bp, Artificial Sequence
  Description of Artificial Sequence: Synthetic oligonucleotide
  Target: ATXN1; (-) strand; PAM type: YTN; PAM sequence: CTT
tttgttttcatttacttgtc

SEQ ID NO: 209808 - DNA, 20 bp, Artificial Sequence
  Description of Artificial Sequence: Synthetic oligonucleotide
  Target: ATXN1; (-) strand; PAM type: YTN; PAM sequence: TTC
tttttgttttcatttacttg

SEQ ID NO: 209809 - DNA, 20 bp, Artificial Sequence
  Description of Artificial Sequence: Synthetic oligonucleotide
  Target: ATXN1; (-) strand; PAM type: YTN; PAM sequence: TTT
ctttttgttttcatttactt

SEQ ID NO: 209810 - DNA, 20 bp, Artificial Sequence
  Description of Artificial Sequence: Synthetic oligonucleotide
  Target: ATXN1; (-) strand; PAM type: YTN; PAM sequence: TTG
gtgtttctttttgttttcat

SEQ ID NO: 209811 - DNA, 20 bp, Artificial Sequence
  Description of Artificial Sequence: Synthetic oligonucleotide
  Target: ATXN1; (-) strand; PAM type: YTN; PAM sequence: TTG
taagttggtgtttctttttg

SEQ ID NO: 209812 - DNA, 20 bp, Artificial Sequence
  Description of Artificial Sequence: Synthetic oligonucleotide
  Target: ATXN1; (-) strand; PAM type: YTN; PAM sequence: TTT
gtaagttggtgtttcttttt

SEQ ID NO: 209813 - DNA, 20 bp, Artificial Sequence
  Description of Artificial Sequence: Synthetic oligonucleotide
  Target: ATXN1; (-) strand; PAM type: YTN; PAM sequence: TTT
tgtaagttggtgtttctttt

SEQ ID NO: 209814 - DNA, 20 bp, Artificial Sequence
  Description of Artificial Sequence: Synthetic oligonucleotide
  Target: ATXN1; (-) strand; PAM type: YTN; PAM sequence: TTT
ttgtaagttggtgtttcttt

SEQ ID NO: 209815 - DNA, 20 bp, Artificial Sequence
  Description of Artificial Sequence: Synthetic oligonucleotide
  Target: ATXN1; (-) strand; PAM type: YTN; PAM sequence: TTT
tttgtaagttggtgtttctt

SEQ ID NO: 209816 - DNA, 20 bp, Artificial Sequence
  Description of Artificial Sequence: Synthetic oligonucleotide
  Target: ATXN1; (-) strand; PAM type: YTN; PAM sequence: TTT
ttttgtaagttggtgtttct

SEQ ID NO: 209817 - DNA, 20 bp, Artificial Sequence
  Description of Artificial Sequence: Synthetic oligonucleotide
  Target: ATXN1; (-) strand; PAM type: YTN; PAM sequence: TTT
tttttgtaagttggtgtttc

SEQ ID NO: 209818 - DNA, 20 bp, Artificial Sequence
  Description of Artificial Sequence: Synthetic oligonucleotide
  Target: ATXN1; (-) strand; PAM type: YTN; PAM sequence: TTT
ttttttgtaagttggtgttt

SEQ ID NO: 209819 - DNA, 20 bp, Artificial Sequence
  Description of Artificial Sequence: Synthetic oligonucleotide
  Target: ATXN1; (-) strand; PAM type: YTN; PAM sequence: CTA
atttttttttgtaagttggt

SEQ ID NO: 209820 - DNA, 20 bp, Artificial Sequence
  Description of Artificial Sequence: Synthetic oligonucleotide
  Target: ATXN1; (-) strand; PAM type: YTN; PAM sequence: TTG
aaaaaaaatcctaatttttt

SEQ ID NO: 209821 - DNA, 20 bp, Artificial Sequence
  Description of Artificial Sequence: Synthetic oligonucleotide
  Target: ATXN1; (-) strand; PAM type: YTN; PAM sequence: TTG
gaaaatcagtcattgaaaaa

SEQ ID NO: 209822 - DNA, 20 bp, Artificial Sequence
  Description of Artificial Sequence: Synthetic oligonucleotide
  Target: ATXN1; (-) strand; PAM type: YTN; PAM sequence: TTT
ggaaaatcagtcattgaaaa

SEQ ID NO: 209823 - DNA, 20 bp, Artificial Sequence
  Description of Artificial Sequence: Synthetic oligonucleotide
  Target: ATXN1; (-) strand; PAM type: YTN; PAM sequence: CTT
tggaaaatcagtcattgaaa

SEQ ID NO: 209824 - DNA, 20 bp, Artificial Sequence
  Description of Artificial Sequence: Synthetic oligonucleotide
  Target: ATXN1; (-) strand; PAM type: YTN; PAM sequence: TTA
aataatactttggaaaatca

SEQ ID NO: 209825 - DNA, 20 bp, Artificial Sequence
  Description of Artificial Sequence: Synthetic oligonucleotide
  Target: ATXN1; (-) strand; PAM type: YTN; PAM sequence: TTT
aaataatactttggaaaatc

SEQ ID NO: 209826 - DNA, 20 bp, Artificial Sequence
  Description of Artificial Sequence: Synthetic oligonucleotide
  Target: ATXN1; (-) strand; PAM type: YTN; PAM sequence: TTT
taaataatactttggaaaat

SEQ ID NO: 209827 - DNA, 20 bp, Artificial Sequence
  Description of Artificial Sequence: Synthetic oligonucleotide
  Target: ATXN1; (-) strand; PAM type: YTN; PAM sequence: TTG
catcgaatgtagttttaaat

SEQ ID NO: 209828 - DNA, 20 bp, Artificial Sequence
  Description of Artificial Sequence: Synthetic oligonucleotide
  Target: ATXN1; (-) strand; PAM type: YTN; PAM sequence: TTC
attgcatcgaatgtagtttt

SEQ ID NO: 209829 - DNA, 20 bp, Artificial Sequence
  Description of Artificial Sequence: Synthetic oligonucleotide
  Target: ATXN1; (-) strand; PAM type: YTN; PAM sequence: TTT
cattgcatcgaatgtagttt

SEQ ID NO: 209830 - DNA, 20 bp, Artificial Sequence
  Description of Artificial Sequence: Synthetic oligonucleotide
  Target: ATXN1; (-) strand; PAM type: YTN; PAM sequence: TTT
tcattgcatcgaatgtagtt

SEQ ID NO: 209831 - DNA, 20 bp, Artificial Sequence
  Description of Artificial Sequence: Synthetic oligonucleotide
  Target: ATXN1; (-) strand; PAM type: YTN; PAM sequence: CTT
ttcattgcatcgaatgtagt

SEQ ID NO: 209832 - DNA, 20 bp, Artificial Sequence
  Description of Artificial Sequence: Synthetic oligonucleotide
  Target: ATXN1; (-) strand; PAM type: YTN; PAM sequence: TTC
cttttcattgcatcgaatgt

SEQ ID NO: 209833 - DNA, 20 bp, Artificial Sequence
  Description of Artificial Sequence: Synthetic oligonucleotide
  Target: ATXN1; (-) strand; PAM type: YTN; PAM sequence: TTT
ccttttcattgcatcgaatg

SEQ ID NO: 209834 - DNA, 20 bp, Artificial Sequence
  Description of Artificial Sequence: Synthetic oligonucleotide
  Target: ATXN1; (-) strand; PAM type: YTN; PAM sequence: TTT
tccttttcattgcatcgaat

SEQ ID NO: 209835 - DNA, 20 bp, Artificial Sequence
  Description of Artificial Sequence: Synthetic oligonucleotide
  Target: ATXN1; (-) strand; PAM type: YTN; PAM sequence: TTT
ttccttttcattgcatcgaa

SEQ ID NO: 209836 - DNA, 20 bp, Artificial Sequence
  Description of Artificial Sequence: Synthetic oligonucleotide
  Target: ATXN1; (-) strand; PAM type: YTN; PAM sequence: CTG
tttttccttttcattgcatc

SEQ ID NO: 209837 - DNA, 20 bp, Artificial Sequence
  Description of Artificial Sequence: Synthetic oligonucleotide
  Target: ATXN1; (-) strand; PAM type: YTN; PAM sequence: CTC
caaaggctgtttttcctttt

SEQ ID NO: 209838 - DNA, 20 bp, Artificial Sequence
  Description of Artificial Sequence: Synthetic oligonucleotide
  Target: ATXN1; (-) strand; PAM type: YTN; PAM sequence: TTG
atgctccaaaggctgttttt

SEQ ID NO: 209839 - DNA, 20 bp, Artificial Sequence
  Description of Artificial Sequence: Synthetic oligonucleotide
  Target: ATXN1; (-) strand; PAM type: YTN; PAM sequence: TTT
gatgctccaaaggctgtttt

SEQ ID NO: 209840 - DNA, 20 bp, Artificial Sequence
  Description of Artificial Sequence: Synthetic oligonucleotide
  Target: ATXN1; (-) strand; PAM type: YTN; PAM sequence: CTG
gtttgatgctccaaaggctg

SEQ ID NO: 209841 - DNA, 20 bp, Artificial Sequence
  Description of Artificial Sequence: Synthetic oligonucleotide
  Target: ATXN1; (-) strand; PAM type: YTN; PAM sequence: TTG
ctggtttgatgctccaaagg

SEQ ID NO: 209842 - DNA, 20 bp, Artificial Sequence
  Description of Artificial Sequence: Synthetic oligonucleotide
  Target: ATXN1; (-) strand; PAM type: YTN; PAM sequence: CTT
gctggtttgatgctccaaag

SEQ ID NO: 209843 - DNA, 20 bp, Artificial Sequence
  Description of Artificial Sequence: Synthetic oligonucleotide
  Target: ATXN1; (-) strand; PAM type: YTN; PAM sequence: TTC
acttgctggtttgatgctcc

SEQ ID NO: 209844 - DNA, 20 bp, Artificial Sequence
  Description of Artificial Sequence: Synthetic oligonucleotide
  Target: ATXN1; (-) strand; PAM type: YTN; PAM sequence: CTT
cacttgctggtttgatgctc

SEQ ID NO: 209845 - DNA, 20 bp, Artificial Sequence
  Description of Artificial Sequence: Synthetic oligonucleotide
  Target: ATXN1; (-) strand; PAM type: YTN; PAM sequence: TTC
ttcacttgctggtttgatgc

SEQ ID NO: 209846 - DNA, 20 bp, Artificial Sequence
  Description of Artificial Sequence: Synthetic oligonucleotide
  Target: ATXN1; (-) strand; PAM type: YTN; PAM sequence: TTG
ttcttcacttgctggtttga

SEQ ID NO: 209847 - DNA, 20 bp, Artificial Sequence
  Description of Artificial Sequence: Synthetic oligonucleotide
  Target: ATXN1; (-) strand; PAM type: YTN; PAM sequence: TTT
gttcttcacttgctggtttg

SEQ ID NO: 209848 - DNA, 20 bp, Artificial Sequence
  Description of Artificial Sequence: Synthetic oligonucleotide
  Target: ATXN1; (-) strand; PAM type: YTN; PAM sequence: TTC
aggtttgttcttcacttgct

SEQ ID NO: 209849 - DNA, 20 bp, Artificial Sequence
  Description of Artificial Sequence: Synthetic oligonucleotide
  Target: ATXN1; (-) strand; PAM type: YTN; PAM sequence: TTT
caggtttgttcttcacttgc

SEQ ID NO: 209850 - DNA, 20 bp, Artificial Sequence
  Description of Artificial Sequence: Synthetic oligonucleotide
  Target: ATXN1; (-) strand; PAM type: YTN; PAM sequence: TTT
tcaggtttgttcttcacttg

SEQ ID NO: 209851 - DNA, 20 bp, Artificial Sequence
  Description of Artificial Sequence: Synthetic oligonucleotide
  Target: ATXN1; (-) strand; PAM type: YTN; PAM sequence: TTT
ttcaggtttgttcttcactt

SEQ ID NO: 209852 - DNA, 20 bp, Artificial Sequence
  Description of Artificial Sequence: Synthetic oligonucleotide
  Target: ATXN1; (-) strand; PAM type: YTN; PAM sequence: CTT
tttcaggtttgttcttcact

SEQ ID NO: 209853 - DNA, 20 bp, Artificial Sequence
  Description of Artificial Sequence: Synthetic oligonucleotide
  Target: ATXN1; (-) strand; PAM type: YTN; PAM sequence: TTG
ggagactttttcaggtttgt

SEQ ID NO: 209854 - DNA, 20 bp, Artificial Sequence
  Description of Artificial Sequence: Synthetic oligonucleotide
  Target: ATXN1; (-) strand; PAM type: YTN; PAM sequence: TTT
gggagactttttcaggtttg

SEQ ID NO: 209855 - DNA, 20 bp, Artificial Sequence
  Description of Artificial Sequence: Synthetic oligonucleotide
  Target: ATXN1; (-) strand; PAM type: YTN; PAM sequence: TTT
tgggagactttttcaggttt

SEQ ID NO: 209856 - DNA, 20 bp, Artificial Sequence
  Description of Artificial Sequence: Synthetic oligonucleotide
  Target: ATXN1; (-) strand; PAM type: YTN; PAM sequence: CTT
ttgggagactttttcaggtt

SEQ ID NO: 209857 - DNA, 20 bp, Artificial Sequence
  Description of Artificial Sequence: Synthetic oligonucleotide
  Target: ATXN1; (-) strand; PAM type: YTN; PAM sequence: TTC
cagtgccttttgggagactt

SEQ ID NO: 209858 - DNA, 20 bp, Artificial Sequence
  Description of Artificial Sequence: Synthetic oligonucleotide
  Target: ATXN1; (-) strand; PAM type: YTN; PAM sequence: TTT
ccagtgccttttgggagact

SEQ ID NO: 209859 - DNA, 20 bp, Artificial Sequence
  Description of Artificial Sequence: Synthetic oligonucleotide
  Target: ATXN1; (-) strand; PAM type: YTN; PAM sequence: TTT
tccagtgccttttgggagac

SEQ ID NO: 209860 - DNA, 20 bp, Artificial Sequence
  Description of Artificial Sequence: Synthetic oligonucleotide
  Target: ATXN1; (-) strand; PAM type: YTN; PAM sequence: TTT
ttccagtgccttttgggaga

SEQ ID NO: 209861 - DNA, 20 bp, Artificial Sequence
  Description of Artificial Sequence: Synthetic oligonucleotide
  Target: ATXN1; (-) strand; PAM type: YTN; PAM sequence: TTT
tttccagtgccttttgggag

SEQ ID NO: 209862 - DNA, 20 bp, Artificial Sequence
  Description of Artificial Sequence: Synthetic oligonucleotide
  Target: ATXN1; (-) strand; PAM type: YTN; PAM sequence: CTT
ttttccagtgccttttggga

SEQ ID NO: 209863 - DNA, 20 bp, Artificial Sequence
  Description of Artificial Sequence: Synthetic oligonucleotide
  Target: ATXN1; (-) strand; PAM type: YTN; PAM sequence: TTC
atcttttttccagtgccttt

SEQ ID NO: 209864 - DNA, 20 bp, Artificial Sequence
  Description of Artificial Sequence: Synthetic oligonucleotide
  Target: ATXN1; (-) strand; PAM type: YTN; PAM sequence: TTT
catcttttttccagtgcctt

SEQ ID NO: 209865 - DNA, 20 bp, Artificial Sequence
  Description of Artificial Sequence: Synthetic oligonucleotide
  Target: ATXN1; (-) strand; PAM type: YTN; PAM sequence: TTT
tcatcttttttccagtgcct

SEQ ID NO: 209866 - DNA, 20 bp, Artificial Sequence
  Description of Artificial Sequence: Synthetic oligonucleotide
  Target: ATXN1; (-) strand; PAM type: YTN; PAM sequence: CTT
ttcatcttttttccagtgcc

SEQ ID NO: 209867 - DNA, 20 bp, Artificial Sequence
  Description of Artificial Sequence: Synthetic oligonucleotide
  Target: ATXN1; (-) strand; PAM type: YTN; PAM sequence: TTA
tacttttcatcttttttcca

SEQ ID NO: 209868 - DNA, 20 bp, Artificial Sequence
  Description of Artificial Sequence: Synthetic oligonucleotide
  Target: ATXN1; (-) strand; PAM type: YTN; PAM sequence: TTT
atacttttcatcttttttcc

SEQ ID NO: 209869 - DNA, 20 bp, Artificial Sequence
  Description of Artificial Sequence: Synthetic oligonucleotide
  Target: ATXN1; (-) strand; PAM type: YTN; PAM sequence: TTG
tttatacttttcatcttttt

SEQ ID NO: 209870 - DNA, 20 bp, Artificial Sequence
  Description of Artificial Sequence: Synthetic oligonucleotide
  Target: ATXN1; (-) strand; PAM type: YTN; PAM sequence: TTT
gtttatacttttcatctttt

SEQ ID NO: 209871 - DNA, 20 bp, Artificial Sequence
  Description of Artificial Sequence: Synthetic oligonucleotide
  Target: ATXN1; (-) strand; PAM type: YTN; PAM sequence: CTG
atttgtttatacttttcatc

SEQ ID NO: 209872 - DNA, 20 bp, Artificial Sequence
  Description of Artificial Sequence: Synthetic oligonucleotide
  Target: ATXN1; (-) strand; PAM type: YTN; PAM sequence: CTA
tctgatttgtttatactttt

SEQ ID NO: 209873 - DNA, 20 bp, Artificial Sequence
  Description of Artificial Sequence: Synthetic oligonucleotide
  Target: ATXN1; (-) strand; PAM type: YTN; PAM sequence: TTA
gcatctatctgatttgttta

SEQ ID NO: 209874 - DNA, 20 bp, Artificial Sequence
  Description of Artificial Sequence: Synthetic oligonucleotide
  Target: ATXN1; (-) strand; PAM type: YTN; PAM sequence: CTG
tatccattagcatctatctg

SEQ ID NO: 209875 - DNA, 20 bp, Artificial Sequence
  Description of Artificial Sequence: Synthetic oligonucleotide
  Target: ATXN1; (-) strand; PAM type: YTN; PAM sequence: CTC
ctgtatccattagcatctat

SEQ ID NO: 209876 - DNA, 20 bp, Artificial Sequence
  Description of Artificial Sequence: Synthetic oligonucleotide
  Target: ATXN1; (-) strand; PAM type: YTN; PAM sequence: TTG
tctcctgtatccattagcat

SEQ ID NO: 209877 - DNA, 20 bp, Artificial Sequence
  Description of Artificial Sequence: Synthetic oligonucleotide
  Target: ATXN1; (-) strand; PAM type: YTN; PAM sequence: TTT
gtctcctgtatccattagca

SEQ ID NO: 209878 - DNA, 20 bp, Artificial Sequence
  Description of Artificial Sequence: Synthetic oligonucleotide
  Target: ATXN1; (-) strand; PAM type: YTN; PAM sequence: CTT
tgtctcctgtatccattagc

SEQ ID NO: 209879 - DNA, 20 bp, Artificial Sequence
  Description of Artificial Sequence: Synthetic oligonucleotide
  Target: ATXN1; (-) strand; PAM type: YTN; PAM sequence: CTA
ctttgtctcctgtatccatt

SEQ ID NO: 209880 - DNA, 20 bp, Artificial Sequence
  Description of Artificial Sequence: Synthetic oligonucleotide
  Target: ATXN1; (-) strand; PAM type: YTN; PAM sequence: TTC
ctactttgtctcctgtatcc

SEQ ID NO: 209881 - DNA, 20 bp, Artificial Sequence
  Description of Artificial Sequence: Synthetic oligonucleotide
  Target: ATXN1; (-) strand; PAM type: YTN; PAM sequence: CTT
cctactttgtctcctgtatc

SEQ ID NO: 209882 - DNA, 20 bp, Artificial Sequence
  Description of Artificial Sequence: Synthetic oligonucleotide
  Target: ATXN1; (-) strand; PAM type: YTN; PAM sequence: TTG
gcttcctactttgtctcctg

SEQ ID NO: 209883 - DNA, 20 bp, Artificial Sequence
  Description of Artificial Sequence: Synthetic oligonucleotide
  Target: ATXN1; (-) strand; PAM type: YTN; PAM sequence: CTA
tgttggcttcctactttgtc

SEQ ID NO: 209884 - DNA, 20 bp, Artificial Sequence
  Description of Artificial Sequence: Synthetic oligonucleotide
  Target: ATXN1; (-) strand; PAM type: YTN; PAM sequence: CTC
tatgttggcttcctactttg

SEQ ID NO: 209885 - DNA, 20 bp, Artificial Sequence
  Description of Artificial Sequence: Synthetic oligonucleotide
  Target: ATXN1; (-) strand; PAM type: YTN; PAM sequence: CTA
tctctatgttggcttcctac

SEQ ID NO: 209886 - DNA, 20 bp, Artificial Sequence
  Description of Artificial Sequence: Synthetic oligonucleotide
  Target: ATXN1; (-) strand; PAM type: YTN; PAM sequence: CTA
tgcatcaatcatgctatctc

SEQ ID NO: 209887 - DNA, 20 bp, Artificial Sequence
  Description of Artificial Sequence: Synthetic oligonucleotide
  Target: ATXN1; (-) strand; PAM type: YTN; PAM sequence: TTG
actatgcatcaatcatgcta

SEQ ID NO: 209888 - DNA, 20 bp, Artificial Sequence
  Description of Artificial Sequence: Synthetic oligonucleotide
  Target: ATXN1; (-) strand; PAM type: YTN; PAM sequence: TTT
gactatgcatcaatcatgct

SEQ ID NO: 209889 - DNA, 20 bp, Artificial Sequence
  Description of Artificial Sequence: Synthetic oligonucleotide
  Target: ATXN1; (-) strand; PAM type: YTN; PAM sequence: CTT
tgactatgcatcaatcatgc

SEQ ID NO: 209890 - DNA, 20 bp, Artificial Sequence
  Description of Artificial Sequence: Synthetic oligonucleotide
  Target: ATXN1; (-) strand; PAM type: YTN; PAM sequence: TTA
ctttgactatgcatcaatca

SEQ ID NO: 209891 - DNA, 20 bp, Artificial Sequence
  Description of Artificial Sequence: Synthetic oligonucleotide
  Target: ATXN1; (-) strand; PAM type: YTN; PAM sequence: TTT
actttgactatgcatcaatc

SEQ ID NO: 209892 - DNA, 20 bp, Artificial Sequence
  Description of Artificial Sequence: Synthetic oligonucleotide
  Target: ATXN1; (-) strand; PAM type: YTN; PAM sequence: CTG
tggtatttactttgactatg

SEQ ID NO: 209893 - DNA, 20 bp, Artificial Sequence
  Description of Artificial Sequence: Synthetic oligonucleotide
  Target: ATXN1; (-) strand; PAM type: YTN; PAM sequence: TTC
tgtggtatttactttgacta

SEQ ID NO: 209894 - DNA, 20 bp, Artificial Sequence
  Description of Artificial Sequence: Synthetic oligonucleotide
  Target: ATXN1; (-) strand; PAM type: YTN; PAM sequence: CTT
ctgtggtatttactttgact

SEQ ID NO: 209895 - DNA, 20 bp, Artificial Sequence
  Description of Artificial Sequence: Synthetic oligonucleotide
  Target: ATXN1; (-) strand; PAM type: YTN; PAM sequence: TTG
cttctgtggtatttactttg

SEQ ID NO: 209896 - DNA, 20 bp, Artificial Sequence
  Description of Artificial Sequence: Synthetic oligonucleotide
  Target: ATXN1; (-) strand; PAM type: YTN; PAM sequence: TTA
ataattgcttctgtggtatt

SEQ ID NO: 209897 - DNA, 20 bp, Artificial Sequence
  Description of Artificial Sequence: Synthetic oligonucleotide
  Target: ATXN1; (-) strand; PAM type: YTN; PAM sequence: TTT
aataattgcttctgtggtat

SEQ ID NO: 209898 - DNA, 20 bp, Artificial Sequence
  Description of Artificial Sequence: Synthetic oligonucleotide
  Target: ATXN1; (-) strand; PAM type: YTN; PAM sequence: CTT
taataattgcttctgtggta

SEQ ID NO: 209899 - DNA, 20 bp, Artificial Sequence
  Description of Artificial Sequence: Synthetic oligonucleotide
  Target: ATXN1; (-) strand; PAM type: YTN; PAM sequence: TTC
tttaataattgcttctgtgg

SEQ ID NO: 209900 - DNA, 20 bp, Artificial Sequence
  Description of Artificial Sequence: Synthetic oligonucleotide
  Target: ATXN1; (-) strand; PAM type: YTN; PAM sequence: TTT
ctttaataattgcttctgtg

SEQ ID NO: 209901 - DNA, 20 bp, Artificial Sequence
  Description of Artificial Sequence: Synthetic oligonucleotide
  Target: ATXN1; (-) strand; PAM type: YTN; PAM sequence: TTA
tttctttaataattgcttct

SEQ ID NO: 209902 - DNA, 20 bp, Artificial Sequence
  Description of Artificial Sequence: Synthetic oligonucleotide
  Target: ATXN1; (-) strand; PAM type: YTN; PAM sequence: TTC
attatttctttaataattgc

SEQ ID NO: 209903 - DNA, 20 bp, Artificial Sequence
  Description of Artificial Sequence: Synthetic oligonucleotide
  Target: ATXN1; (-) strand; PAM type: YTN; PAM sequence: TTT
cattatttctttaataattg

SEQ ID NO: 209904 - DNA, 20 bp, Artificial Sequence
  Description of Artificial Sequence: Synthetic oligonucleotide
  Target: ATXN1; (-) strand; PAM type: YTN; PAM sequence: CTT
tcattatttctttaataatt

SEQ ID NO: 209905 - DNA, 20 bp, Artificial Sequence
  Description of Artificial Sequence: Synthetic oligonucleotide
  Target: ATXN1; (-) strand; PAM type: YTN; PAM sequence: TTC
tttcattatttctttaataa

SEQ ID NO: 209906 - DNA, 20 bp, Artificial Sequence
  Description of Artificial Sequence: Synthetic oligonucleotide
  Target: ATXN1; (-) strand; PAM type: YTN; PAM sequence: TTT
ctttcattatttctttaata

SEQ ID NO: 209907 - DNA, 20 bp, Artificial Sequence
  Description of Artificial Sequence: Synthetic oligonucleotide
  Target: ATXN1; (-) strand; PAM type: YTN; PAM sequence: TTT
tctttcattatttctttaat

SEQ ID NO: 209908 - DNA, 20 bp, Artificial Sequence
  Description of Artificial Sequence: Synthetic oligonucleotide
  Target: ATXN1; (-) strand; PAM type: YTN; PAM sequence: TTA
gaaaaattttctttcattat

SEQ ID NO: 209909 - DNA, 20 bp, Artificial Sequence
  Description of Artificial Sequence: Synthetic oligonucleotide
  Target: ATXN1; (-) strand; PAM type: YTN; PAM sequence: TTT
agaaaaattttctttcatta

SEQ ID NO: 209910 - DNA, 20 bp, Artificial Sequence
  Description of Artificial Sequence: Synthetic oligonucleotide
  Target: ATXN1; (-) strand; PAM type: YTN; PAM sequence: TTC
agtttagaaaaattttcttt

SEQ ID NO: 209911 - DNA, 20 bp, Artificial Sequence
  Description of Artificial Sequence: Synthetic oligonucleotide
  Target: ATXN1; (-) strand; PAM type: YTN; PAM sequence: CTT
cagtttagaaaaattttctt

SEQ ID NO: 209912 - DNA, 20 bp, Artificial Sequence
  Description of Artificial Sequence: Synthetic oligonucleotide
  Target: ATXN1; (-) strand; PAM type: YTN; PAM sequence: TTC
ttcagtttagaaaaattttc

SEQ ID NO: 209913 - DNA, 20 bp, Artificial Sequence
  Description of Artificial Sequence: Synthetic oligonucleotide
  Target: ATXN1; (-) strand; PAM type: YTN; PAM sequence: TTT
cttcagtttagaaaaatttt

SEQ ID NO: 209914 - DNA, 20 bp, Artificial Sequence
  Description of Artificial Sequence: Synthetic oligonucleotide
  Target: ATXN1; (-) strand; PAM type: YTN; PAM sequence: CTG
tatttcttcagtttagaaaa

SEQ ID NO: 209915 - DNA, 20 bp, Artificial Sequence
  Description of Artificial Sequence: Synthetic oligonucleotide
  Target: ATXN1; (-) strand; PAM type: YTN; PAM sequence: CTC
tgtatttcttcagtttagaa

SEQ ID NO: 209916 - DNA, 20 bp, Artificial Sequence
  Description of Artificial Sequence: Synthetic oligonucleotide
  Target: ATXN1; (-) strand; PAM type: YTN; PAM sequence: TTA
ctctgtatttcttcagttta

SEQ ID NO: 209917 - DNA, 20 bp, Artificial Sequence
  Description of Artificial Sequence: Synthetic oligonucleotide
  Target: ATXN1; (-) strand; PAM type: YTN; PAM sequence: TTT
actctgtatttcttcagttt

SEQ ID NO: 209918 - DNA, 20 bp, Artificial Sequence
  Description of Artificial Sequence: Synthetic oligonucleotide
  Target: ATXN1; (-) strand; PAM type: YTN; PAM sequence: TTG
gtttactctgtatttcttca

SEQ ID NO: 209919 - DNA, 20 bp, Artificial Sequence
  Description of Artificial Sequence: Synthetic oligonucleotide
  Target: ATXN1; (-) strand; PAM type: YTN; PAM sequence: TTG
gttggtttactctgtatttc

SEQ ID NO: 209920 - DNA, 20 bp, Artificial Sequence
  Description of Artificial Sequence: Synthetic oligonucleotide
  Target: ATXN1; (-) strand; PAM type: YTN; PAM sequence: TTG
gttggttggtttactctgta

SEQ ID NO: 209921 - DNA, 20 bp, Artificial Sequence
  Description of Artificial Sequence: Synthetic oligonucleotide
  Target: ATXN1; (-) strand; PAM type: YTN; PAM sequence: TTG
gttggttggttggtttactc

SEQ ID NO: 209922 - DNA, 20 bp, Artificial Sequence
  Description of Artificial Sequence: Synthetic oligonucleotide
  Target: ATXN1; (-) strand; PAM type: YTN; PAM sequence: TTG
gttggttggttggttggttt

SEQ ID NO: 209923 - DNA, 20 bp, Artificial Sequence
  Description of Artificial Sequence: Synthetic oligonucleotide
  Target: ATXN1; (-) strand; PAM type: YTN; PAM sequence: TTG
gttggttggttggttggttg

SEQ ID NO: 209924 - DNA, 20 bp, Artificial Sequence
  Description of Artificial Sequence: Synthetic oligonucleotide
  Target: ATXN1; (-) strand; PAM type: YTN; PAM sequence: TTG
gttggttggttggttggttg

SEQ ID NO: 209925 - DNA, 20 bp, Artificial Sequence
  Description of Artificial Sequence: Synthetic oligonucleotide
  Target: ATXN1; (-) strand; PAM type: YTN; PAM sequence: TTT
ggttggttggttggttggtt

SEQ ID NO: 209926 - DNA, 20 bp, Artificial Sequence
  Description of Artificial Sequence: Synthetic oligonucleotide
  Target: ATXN1; (-) strand; PAM type: YTN; PAM sequence: TTT
tggttggttggttggttggt

SEQ ID NO: 209927 - DNA, 20 bp, Artificial Sequence
  Description of Artificial Sequence: Synthetic oligonucleotide
  Target: ATXN1; (-) strand; PAM type: YTN; PAM sequence: TTT
ttggttggttggttggttgg

SEQ ID NO: 209928 - DNA, 20 bp, Artificial Sequence
  Description of Artificial Sequence: Synthetic oligonucleotide
  Target: ATXN1; (-) strand; PAM type: YTN; PAM sequence: TTG
tatagagtgagtttttggtt

SEQ ID NO: 209929 - DNA, 20 bp, Artificial Sequence
  Description of Artificial Sequence: Synthetic oligonucleotide
  Target: ATXN1; (-) strand; PAM type: YTN; PAM sequence: CTT
gtatagagtgagtttttggt

SEQ ID NO: 209930 - DNA, 20 bp, Artificial Sequence
  Description of Artificial Sequence: Synthetic oligonucleotide
  Target: ATXN1; (-) strand; PAM type: YTN; PAM sequence: TTC
ttgtatagagtgagtttttg

SEQ ID NO: 209931 - DNA, 20 bp, Artificial Sequence
  Description of Artificial Sequence: Synthetic oligonucleotide
  Target: ATXN1; (-) strand; PAM type: YTN; PAM sequence: CTT
cttgtatagagtgagttttt

SEQ ID NO: 209932 - DNA, 20 bp, Artificial Sequence
  Description of Artificial Sequence: Synthetic oligonucleotide
  Target: ATXN1; (-) strand; PAM type: YTN; PAM sequence: TTC
ttcttgtatagagtgagttt

SEQ ID NO: 209933 - DNA, 20 bp, Artificial Sequence
  Description of Artificial Sequence: Synthetic oligonucleotide
  Target: ATXN1; (-) strand; PAM type: YTN; PAM sequence: TTT
cttcttgtatagagtgagtt

SEQ ID NO: 209934 - DNA, 20 bp, Artificial Sequence
  Description of Artificial Sequence: Synthetic oligonucleotide
  Target: ATXN1; (-) strand; PAM type: YTN; PAM sequence: TTT
tcttcttgtatagagtgagt

SEQ ID NO: 209935 - DNA, 20 bp, Artificial Sequence
  Description of Artificial Sequence: Synthetic oligonucleotide
  Target: ATXN1; (-) strand; PAM type: YTN; PAM sequence: TTT
ttcttcttgtatagagtgag

SEQ ID NO: 209936 - DNA, 20 bp, Artificial Sequence
  Description of Artificial Sequence: Synthetic oligonucleotide
  Target: ATXN1; (-) strand; PAM type: YTN; PAM sequence: TTT
tttcttcttgtatagagtga

SEQ ID NO: 209937 - DNA, 20 bp, Artificial Sequence
  Description of Artificial Sequence: Synthetic oligonucleotide
  Target: ATXN1; (-) strand; PAM type: YTN; PAM sequence: TTT
ttttcttcttgtatagagtg

SEQ ID NO: 209938 - DNA, 20 bp, Artificial Sequence
  Description of Artificial Sequence: Synthetic oligonucleotide
  Target: ATXN1; (-) strand; PAM type: YTN; PAM sequence: TTC
atttttttcttcttgtatag

SEQ ID NO: 209939 - DNA, 20 bp, Artificial Sequence
  Description of Artificial Sequence: Synthetic oligonucleotide
  Target: ATXN1; (-) strand; PAM type: YTN; PAM sequence: TTT
catttttttcttcttgtata

SEQ ID NO: 209940 - DNA, 20 bp, Artificial Sequence
  Description of Artificial Sequence: Synthetic oligonucleotide
  Target: ATXN1; (-) strand; PAM type: YTN; PAM sequence: TTT
tcatttttttcttcttgtat

SEQ ID NO: 209941 - DNA, 20 bp, Artificial Sequence
  Description of Artificial Sequence: Synthetic oligonucleotide
  Target: ATXN1; (-) strand; PAM type: YTN; PAM sequence: TTA
tatcagttttcatttttttc

SEQ ID NO: 209942 - DNA, 20 bp, Artificial Sequence
  Description of Artificial Sequence: Synthetic oligonucleotide
  Target: ATXN1; (-) strand; PAM type: YTN; PAM sequence: TTT
atatcagttttcattttttt

SEQ ID NO: 209943 - DNA, 20 bp, Artificial Sequence
  Description of Artificial Sequence: Synthetic oligonucleotide
  Target: ATXN1; (-) strand; PAM type: YTN; PAM sequence: TTA
atatttatatcagttttcat

SEQ ID NO: 209944 - DNA, 20 bp, Artificial Sequence
  Description of Artificial Sequence: Synthetic oligonucleotide
  Target: ATXN1; (-) strand; PAM type: YTN; PAM sequence: TTA
tattaatatttatatcagtt

SEQ ID NO: 209945 - DNA, 20 bp, Artificial Sequence
  Description of Artificial Sequence: Synthetic oligonucleotide
  Target: ATXN1; (-) strand; PAM type: YTN; PAM sequence: TTT
atattaatatttatatcagt

SEQ ID NO: 209946 - DNA, 20 bp, Artificial Sequence
  Description of Artificial Sequence: Synthetic oligonucleotide
  Target: ATXN1; (-) strand; PAM type: YTN; PAM sequence: TTA
atttatattaatatttatat

SEQ ID NO: 209947 - DNA, 20 bp, Artificial Sequence
  Description of Artificial Sequence: Synthetic oligonucleotide
  Target: ATXN1; (-) strand; PAM type: YTN; PAM sequence: TTA
ttaatttatattaatattta

SEQ ID NO: 209948 - DNA, 20 bp, Artificial Sequence
  Description of Artificial Sequence: Synthetic oligonucleotide
  Target: ATXN1; (-) strand; PAM type: YTN; PAM sequence: TTT
attaatttatattaatattt

SEQ ID NO: 209949 - DNA, 20 bp, Artificial Sequence
  Description of Artificial Sequence: Synthetic oligonucleotide
  Target: ATXN1; (-) strand; PAM type: YTN; PAM sequence: TTA
atttattaatttatattaat

SEQ ID NO: 209950 - DNA, 20 bp, Artificial Sequence
  Description of Artificial Sequence: Synthetic oligonucleotide
  Target: ATXN1; (-) strand; PAM type: YTN; PAM sequence: TTT
aatttattaatttatattaa

SEQ ID NO: 209951 - DNA, 20 bp, Artificial Sequence
  Description of Artificial Sequence: Synthetic oligonucleotide
  Target: ATXN1; (-) strand; PAM type: YTN; PAM sequence: CTT
taatttattaatttatatta

SEQ ID NO: 209952 - DNA, 20 bp, Artificial Sequence
  Description of Artificial Sequence: Synthetic oligonucleotide
  Target: ATXN1; (-) strand; PAM type: YTN; PAM sequence: TTC
tttaatttattaatttatat

SEQ ID NO: 209953 - DNA, 20 bp, Artificial Sequence
  Description of Artificial Sequence: Synthetic oligonucleotide
  Target: ATXN1; (-) strand; PAM type: YTN; PAM sequence: TTT
ctttaatttattaatttata

SEQ ID NO: 209954 - DNA, 20 bp, Artificial Sequence
  Description of Artificial Sequence: Synthetic oligonucleotide
  Target: ATXN1; (-) strand; PAM type: YTN; PAM sequence: TTT
tctttaatttattaatttat

SEQ ID NO: 209955 - DNA, 20 bp, Artificial Sequence
  Description of Artificial Sequence: Synthetic oligonucleotide
  Target: ATXN1; (-) strand; PAM type: YTN; PAM sequence: TTG
caccagaaggtaaataaata

SEQ ID NO: 209956 - DNA, 20 bp, Artificial Sequence
  Description of Artificial Sequence: Synthetic oligonucleotide
  Target: ATXN1; (-) strand; PAM type: YTN; PAM sequence: CTC
aaaagttgcaccagaaggta

SEQ ID NO: 209957 - DNA, 20 bp, Artificial Sequence
  Description of Artificial Sequence: Synthetic oligonucleotide
  Target: ATXN1; (-) strand; PAM type: YTN; PAM sequence: TTG
acctcaaaagttgcaccaga

SEQ ID NO: 209958 - DNA, 20 bp, Artificial Sequence
  Description of Artificial Sequence: Synthetic oligonucleotide
  Target: ATXN1; (-) strand; PAM type: YTN; PAM sequence: TTT
gacctcaaaagttgcaccag

SEQ ID NO: 209959 - DNA, 20 bp, Artificial Sequence
  Description of Artificial Sequence: Synthetic oligonucleotide
  Target: ATXN1; (-) strand; PAM type: YTN; PAM sequence: TTT
tgacctcaaaagttgcacca

SEQ ID NO: 209960 - DNA, 20 bp, Artificial Sequence
  Description of Artificial Sequence: Synthetic oligonucleotide
  Target: ATXN1; (-) strand; PAM type: YTN; PAM sequence: TTG
ttttgacctcaaaagttgca

SEQ ID NO: 209961 - DNA, 20 bp, Artificial Sequence
  Description of Artificial Sequence: Synthetic oligonucleotide
  Target: ATXN1; (-) strand; PAM type: YTN; PAM sequence: TTA
tgagttgttttgacctcaaa

SEQ ID NO: 209962 - DNA, 20 bp, Artificial Sequence
  Description of Artificial Sequence: Synthetic oligonucleotide
  Target: ATXN1; (-) strand; PAM type: YTN; PAM sequence: CTT
atgagttgttttgacctcaa

SEQ ID NO: 209963 - DNA, 20 bp, Artificial Sequence
  Description of Artificial Sequence: Synthetic oligonucleotide
  Target: ATXN1; (-) strand; PAM type: YTN; PAM sequence: CTG
aatgcttatgagttgttttg

SEQ ID NO: 209964 - DNA, 20 bp, Artificial Sequence
  Description of Artificial Sequence: Synthetic oligonucleotide
  Target: ATXN1; (-) strand; PAM type: YTN; PAM sequence: CTC
actgaatgcttatgagttgt

SEQ ID NO: 209965 - DNA, 20 bp, Artificial Sequence
  Description of Artificial Sequence: Synthetic oligonucleotide
  Target: ATXN1; (-) strand; PAM type: YTN; PAM sequence: CTC
ctcactgaatgcttatgagt

SEQ ID NO: 209966 - DNA, 20 bp, Artificial Sequence
  Description of Artificial Sequence: Synthetic oligonucleotide
  Target: ATXN1; (-) strand; PAM type: YTN; PAM sequence: TTC
ctcctcactgaatgcttatg

SEQ ID NO: 209967 - DNA, 20 bp, Artificial Sequence
  Description of Artificial Sequence: Synthetic oligonucleotide
  Target: ATXN1; (-) strand; PAM type: YTN; PAM sequence: TTT
cctcctcactgaatgcttat

SEQ ID NO: 209968 - DNA, 20 bp, Artificial Sequence
  Description of Artificial Sequence: Synthetic oligonucleotide
  Target: ATXN1; (-) strand; PAM type: YTN; PAM sequence: TTT
tcctcctcactgaatgctta

SEQ ID NO: 209969 - DNA, 20 bp, Artificial Sequence
  Description of Artificial Sequence: Synthetic oligonucleotide
  Target: ATXN1; (-) strand; PAM type: YTN; PAM sequence: CTT
ttcctcctcactgaatgctt

SEQ ID NO: 209970 - DNA, 20 bp, Artificial Sequence
  Description of Artificial Sequence: Synthetic oligonucleotide
  Target: ATXN1; (-) strand; PAM type: YTN; PAM sequence: TTC
ttttcctcctcactgaatgc

SEQ ID NO: 209971 - DNA, 20 bp, Artificial Sequence
  Description of Artificial Sequence: Synthetic oligonucleotide
  Target: ATXN1; (-) strand; PAM type: YTN; PAM sequence: TTT
cttttcctcctcactgaatg

SEQ ID NO: 209972 - DNA, 20 bp, Artificial Sequence
  Description of Artificial Sequence: Synthetic oligonucleotide
  Target: ATXN1; (-) strand; PAM type: YTN; PAM sequence: CTG
tatttcttttcctcctcact

SEQ ID NO: 209973 - DNA, 20 bp, Artificial Sequence
  Description of Artificial Sequence: Synthetic oligonucleotide
  Target: ATXN1; (-) strand; PAM type: YTN; PAM sequence: TTA
cctgtatttcttttcctcct

SEQ ID NO: 209974 - DNA, 20 bp, Artificial Sequence
  Description of Artificial Sequence: Synthetic oligonucleotide
  Target: ATXN1; (-) strand; PAM type: YTN; PAM sequence: CTG
gttacctgtatttcttttcc

SEQ ID NO: 209975 - DNA, 20 bp, Artificial Sequence
  Description of Artificial Sequence: Synthetic oligonucleotide
  Target: ATXN1; (-) strand; PAM type: YTN; PAM sequence: TTG
gtgacctggttacctgtatt

SEQ ID NO: 209976 - DNA, 20 bp, Artificial Sequence
  Description of Artificial Sequence: Synthetic oligonucleotide
  Target: ATXN1; (-) strand; PAM type: YTN; PAM sequence: CTT
ggtgacctggttacctgtat

SEQ ID NO: 209977 - DNA, 20 bp, Artificial Sequence
  Description of Artificial Sequence: Synthetic oligonucleotide
  Target: ATXN1; (-) strand; PAM type: YTN; PAM sequence: TTC
caccttggtgacctggttac

SEQ ID NO: 209978 - DNA, 20 bp, Artificial Sequence
  Description of Artificial Sequence: Synthetic oligonucleotide
  Target: ATXN1; (-) strand; PAM type: YTN; PAM sequence: TTT
ccaccttggtgacctggtta

SEQ ID NO: 209979 - DNA, 20 bp, Artificial Sequence
  Description of Artificial Sequence: Synthetic oligonucleotide
  Target: ATXN1; (-) strand; PAM type: YTN; PAM sequence: TTT
tccaccttggtgacctggtt

SEQ ID NO: 209980 - DNA, 20 bp, Artificial Sequence
  Description of Artificial Sequence: Synthetic oligonucleotide
  Target: ATXN1; (-) strand; PAM type: YTN; PAM sequence: TTT
ttccaccttggtgacctggt

SEQ ID NO: 209981 - DNA, 20 bp, Artificial Sequence
  Description of Artificial Sequence: Synthetic oligonucleotide
  Target: ATXN1; (-) strand; PAM type: YTN; PAM sequence: TTT
tttccaccttggtgacctgg

SEQ ID NO: 209982 - DNA, 20 bp, Artificial Sequence
  Description of Artificial Sequence: Synthetic oligonucleotide
  Target: ATXN1; (-) strand; PAM type: YTN; PAM sequence: TTT
ttttccaccttggtgacctg

SEQ ID NO: 209983 - DNA, 20 bp, Artificial Sequence
  Description of Artificial Sequence: Synthetic oligonucleotide
  Target: ATXN1; (-) strand; PAM type: YTN; PAM sequence: TTT
tttttccaccttggtgacct

SEQ ID NO: 209984 - DNA, 20 bp, Artificial Sequence
  Description of Artificial Sequence: Synthetic oligonucleotide
  Target: ATXN1; (-) strand; PAM type: YTN; PAM sequence: CTG
attttttttccaccttggtg

SEQ ID NO: 209985 - DNA, 20 bp, Artificial Sequence
  Description of Artificial Sequence: Synthetic oligonucleotide
  Target: ATXN1; (-) strand; PAM type: YTN; PAM sequence: TTG
tcagaaatctgatttttttt

SEQ ID NO: 209986 - DNA, 20 bp, Artificial Sequence
  Description of Artificial Sequence: Synthetic oligonucleotide
  Target: ATXN1; (-) strand; PAM type: YTN; PAM sequence: CTA
ttgtcagaaatctgattttt

SEQ ID NO: 209987 - DNA, 20 bp, Artificial Sequence
  Description of Artificial Sequence: Synthetic oligonucleotide
  Target: ATXN1; (-) strand; PAM type: YTN; PAM sequence: TTC
tattgtcagaaatctgattt

SEQ ID NO: 209988 - DNA, 20 bp, Artificial Sequence
  Description of Artificial Sequence: Synthetic oligonucleotide
  Target: ATXN1; (-) strand; PAM type: YTN; PAM sequence: CTT
ctattgtcagaaatctgatt

SEQ ID NO: 209989 - DNA, 20 bp, Artificial Sequence
  Description of Artificial Sequence: Synthetic oligonucleotide
  Target: ATXN1; (-) strand; PAM type: YTN; PAM sequence: TTC
ttctattgtcagaaatctga

SEQ ID NO: 209990 - DNA, 20 bp, Artificial Sequence
  Description of Artificial Sequence: Synthetic oligonucleotide
  Target: ATXN1; (-) strand; PAM type: YTN; PAM sequence: TTT
cttctattgtcagaaatctg

SEQ ID NO: 209991 - DNA, 20 bp, Artificial Sequence
  Description of Artificial Sequence: Synthetic oligonucleotide
  Target: ATXN1; (-) strand; PAM type: YTN; PAM sequence: TTA
tttcttctattgtcagaaat

SEQ ID NO: 209992 - DNA, 20 bp, Artificial Sequence
  Description of Artificial Sequence: Synthetic oligonucleotide
  Target: ATXN1; (-) strand; PAM type: YTN; PAM sequence: TTT
atttcttctattgtcagaaa

SEQ ID NO: 209993 - DNA, 20 bp, Artificial Sequence
  Description of Artificial Sequence: Synthetic oligonucleotide
  Target: ATXN1; (-) strand; PAM type: YTN; PAM sequence: TTT
tatttcttctattgtcagaa

SEQ ID NO: 209994 - DNA, 20 bp, Artificial Sequence
  Description of Artificial Sequence: Synthetic oligonucleotide
  Target: ATXN1; (-) strand; PAM type: YTN; PAM sequence: TTG
ttttatttcttctattgtca

SEQ ID NO: 209995 - DNA, 20 bp, Artificial Sequence
  Description of Artificial Sequence: Synthetic oligonucleotide
  Target: ATXN1; (-) strand; PAM type: YTN; PAM sequence: CTG
tgtagttgttttatttcttc

SEQ ID NO: 209996 - DNA, 20 bp, Artificial Sequence
  Description of Artificial Sequence: Synthetic oligonucleotide
  Target: ATXN1; (-) strand; PAM type: YTN; PAM sequence: TTA
gagctgtgtagttgttttat

SEQ ID NO: 209997 - DNA, 20 bp, Artificial Sequence
  Description of Artificial Sequence: Synthetic oligonucleotide
  Target: ATXN1; (-) strand; PAM type: YTN; PAM sequence: TTG
ccattagagctgtgtagttg

SEQ ID NO: 209998 - DNA, 20 bp, Artificial Sequence
  Description of Artificial Sequence: Synthetic oligonucleotide
  Target: ATXN1; (-) strand; PAM type: YTN; PAM sequence: TTT
gccattagagctgtgtagtt

SEQ ID NO: 209999 - DNA, 20 bp, Artificial Sequence
  Description of Artificial Sequence: Synthetic oligonucleotide
  Target: ATXN1; (-) strand; PAM type: YTN; PAM sequence: CTT
tgccattagagctgtgtagt

SEQ ID NO: 210000 - DNA, 20 bp, Artificial Sequence
  Description of Artificial Sequence: Synthetic oligonucleotide
  Target: ATXN1; (-) strand; PAM type: YTN; PAM sequence: TTG
tatcagaaccctttgccatt

SEQ ID NO: 210001 - DNA, 20 bp, Artificial Sequence
  Description of Artificial Sequence: Synthetic oligonucleotide
  Target: ATXN1; (-) strand; PAM type: YTN; PAM sequence: TTT
gtatcagaaccctttgccat

SEQ ID NO: 210002 - DNA, 20 bp, Artificial Sequence
  Description of Artificial Sequence: Synthetic oligonucleotide
  Target: ATXN1; (-) strand; PAM type: YTN; PAM sequence: TTT
tgtatcagaaccctttgcca

SEQ ID NO: 210003 - DNA, 20 bp, Artificial Sequence
  Description of Artificial Sequence: Synthetic oligonucleotide
  Target: ATXN1; (-) strand; PAM type: YTN; PAM sequence: TTT
ttgtatcagaaccctttgcc

SEQ ID NO: 210004 - DNA, 20 bp, Artificial Sequence
  Description of Artificial Sequence: Synthetic oligonucleotide
  Target: ATXN1; (-) strand; PAM type: YTN; PAM sequence: TTG
gaatttttgtatcagaaccc

SEQ ID NO: 210005 - DNA, 20 bp, Artificial Sequence
  Description of Artificial Sequence: Synthetic oligonucleotide
  Target: ATXN1; (-) strand; PAM type: YTN; PAM sequence: TTT
ggaatttttgtatcagaacc

SEQ ID NO: 210006 - DNA, 20 bp, Artificial Sequence
  Description of Artificial Sequence: Synthetic oligonucleotide
  Target: ATXN1; (-) strand; PAM type: YTN; PAM sequence: TTA
gtttggaatttttgtatcag

SEQ ID NO: 210007 - DNA, 20 bp, Artificial Sequence
  Description of Artificial Sequence: Synthetic oligonucleotide
  Target: ATXN1; (-) strand; PAM type: YTN; PAM sequence: TTG
gttagtttggaatttttgta

SEQ ID NO: 210008 - DNA, 20 bp, Artificial Sequence
  Description of Artificial Sequence: Synthetic oligonucleotide
  Target: ATXN1; (-) strand; PAM type: YTN; PAM sequence: TTA
gtaggaaagttggttagttt

SEQ ID NO: 210009 - DNA, 20 bp, Artificial Sequence
  Description of Artificial Sequence: Synthetic oligonucleotide
  Target: ATXN1; (-) strand; PAM type: YTN; PAM sequence: CTT
agtaggaaagttggttagtt

SEQ ID NO: 210010 - DNA, 20 bp, Artificial Sequence
  Description of Artificial Sequence: Synthetic oligonucleotide
  Target: ATXN1; (-) strand; PAM type: YTN; PAM sequence: CTC
ataccttagtaggaaagttg

SEQ ID NO: 210011 - DNA, 20 bp, Artificial Sequence
  Description of Artificial Sequence: Synthetic oligonucleotide
  Target: ATXN1; (-) strand; PAM type: YTN; PAM sequence: CTC
tcataccttagtaggaaagt

SEQ ID NO: 210012 - DNA, 20 bp, Artificial Sequence
  Description of Artificial Sequence: Synthetic oligonucleotide
  Target: ATXN1; (-) strand; PAM type: YTN; PAM sequence: TTA
actctcataccttagtagga

SEQ ID NO: 210013 - DNA, 20 bp, Artificial Sequence
  Description of Artificial Sequence: Synthetic oligonucleotide
  Target: ATXN1; (-) strand; PAM type: YTN; PAM sequence: TTT
aactctcataccttagtagg

SEQ ID NO: 210014 - DNA, 20 bp, Artificial Sequence
  Description of Artificial Sequence: Synthetic oligonucleotide
  Target: ATXN1; (-) strand; PAM type: YTN; PAM sequence: TTT
taactctcataccttagtag

SEQ ID NO: 210015 - DNA, 20 bp, Artificial Sequence
  Description of Artificial Sequence: Synthetic oligonucleotide
  Target: ATXN1; (-) strand; PAM type: YTN; PAM sequence: TTT
ttaactctcataccttagta

SEQ ID NO: 210016 - DNA, 20 bp, Artificial Sequence
  Description of Artificial Sequence: Synthetic oligonucleotide
  Target: ATXN1; (-) strand; PAM type: YTN; PAM sequence: TTT
tttaactctcataccttagt

SEQ ID NO: 210017 - DNA, 20 bp, Artificial Sequence
  Description of Artificial Sequence: Synthetic oligonucleotide
  Target: ATXN1; (-) strand; PAM type: YTN; PAM sequence: TTA
ttttttaactctcatacctt

SEQ ID NO: 210018 - DNA, 20 bp, Artificial Sequence
  Description of Artificial Sequence: Synthetic oligonucleotide
  Target: ATXN1; (-) strand; PAM type: YTN; PAM sequence: TTT
attttttaactctcatacct

SEQ ID NO: 210019 - DNA, 20 bp, Artificial Sequence
  Description of Artificial Sequence: Synthetic oligonucleotide
  Target: ATXN1; (-) strand; PAM type: YTN; PAM sequence: TTT
tattttttaactctcatacc

SEQ ID NO: 210020 - DNA, 20 bp, Artificial Sequence
  Description of Artificial Sequence: Synthetic oligonucleotide
  Target: ATXN1; (-) strand; PAM type: YTN; PAM sequence: TTT
ttattttttaactctcatac

SEQ ID NO: 210021 - DNA, 20 bp, Artificial Sequence
  Description of Artificial Sequence: Synthetic oligonucleotide
  Target: ATXN1; (-) strand; PAM type: YTN; PAM sequence: TTT
tttattttttaactctcata

SEQ ID NO: 210022 - DNA, 20 bp, Artificial Sequence
  Description of Artificial Sequence: Synthetic oligonucleotide
  Target: ATXN1; (-) strand; PAM type: YTN; PAM sequence: CTT
ttttattttttaactctcat

SEQ ID NO: 210023 - DNA, 20 bp, Artificial Sequence
  Description of Artificial Sequence: Synthetic oligonucleotide
  Target: ATXN1; (-) strand; PAM type: YTN; PAM sequence: TTG
ggatccaagaatgccttttt

SEQ ID NO: 210024 - DNA, 20 bp, Artificial Sequence
  Description of Artificial Sequence: Synthetic oligonucleotide
  Target: ATXN1; (-) strand; PAM type: YTN; PAM sequence: CTT
gggatccaagaatgcctttt

SEQ ID NO: 210025 - DNA, 20 bp, Artificial Sequence
  Description of Artificial Sequence: Synthetic oligonucleotide
  Target: ATXN1; (-) strand; PAM type: YTN; PAM sequence: CTC
cttgggatccaagaatgcct

SEQ ID NO: 210026 - DNA, 20 bp, Artificial Sequence
  Description of Artificial Sequence: Synthetic oligonucleotide
  Target: ATXN1; (-) strand; PAM type: YTN; PAM sequence: TTG
ctccttgggatccaagaatg

SEQ ID NO: 210027 - DNA, 20 bp, Artificial Sequence
  Description of Artificial Sequence: Synthetic oligonucleotide
  Target: ATXN1; (-) strand; PAM type: YTN; PAM sequence: TTG
ttgctccttgggatccaaga

SEQ ID NO: 210028 - DNA, 20 bp, Artificial Sequence
  Description of Artificial Sequence: Synthetic oligonucleotide
  Target: ATXN1; (-) strand; PAM type: YTN; PAM sequence: TTT
gttgctccttgggatccaag

SEQ ID NO: 210029 - DNA, 20 bp, Artificial Sequence
  Description of Artificial Sequence: Synthetic oligonucleotide
  Target: ATXN1; (-) strand; PAM type: YTN; PAM sequence: TTT
tgttgctccttgggatccaa

SEQ ID NO: 210030 - DNA, 20 bp, Artificial Sequence
  Description of Artificial Sequence: Synthetic oligonucleotide
  Target: ATXN1; (-) strand; PAM type: YTN; PAM sequence: TTT
ttgttgctccttgggatcca

SEQ ID NO: 210031 - DNA, 20 bp, Artificial Sequence
  Description of Artificial Sequence: Synthetic oligonucleotide
  Target: ATXN1; (-) strand; PAM type: YTN; PAM sequence: TTG
tgtttttgttgctccttggg

SEQ ID NO: 210032 - DNA, 20 bp, Artificial Sequence
  Description of Artificial Sequence: Synthetic oligonucleotide
  Target: ATXN1; (-) strand; PAM type: YTN; PAM sequence: CTA
tgaaatacattgtgtttttg

SEQ ID NO: 210033 - DNA, 20 bp, Artificial Sequence
  Description of Artificial Sequence: Synthetic oligonucleotide
  Target: ATXN1; (-) strand; PAM type: YTN; PAM sequence: TTC
tatgaaatacattgtgtttt

SEQ ID NO: 210034 - DNA, 20 bp, Artificial Sequence
  Description of Artificial Sequence: Synthetic oligonucleotide
  Target: ATXN1; (-) strand; PAM type: YTN; PAM sequence: TTC
aaatatattctatgaaatac

SEQ ID NO: 210035 - DNA, 20 bp, Artificial Sequence
  Description of Artificial Sequence: Synthetic oligonucleotide
  Target: ATXN1; (-) strand; PAM type: YTN; PAM sequence: CTT
caaatatattctatgaaata

SEQ ID NO: 210036 - DNA, 20 bp, Artificial Sequence
  Description of Artificial Sequence: Synthetic oligonucleotide
  Target: ATXN1; (-) strand; PAM type: YTN; PAM sequence: TTC
ttcaaatatattctatgaaa

SEQ ID NO: 210037 - DNA, 20 bp, Artificial Sequence
  Description of Artificial Sequence: Synthetic oligonucleotide
  Target: ATXN1; (-) strand; PAM type: YTN; PAM sequence: CTT
cttcaaatatattctatgaa

SEQ ID NO: 210038 - DNA, 20 bp, Artificial Sequence
  Description of Artificial Sequence: Synthetic oligonucleotide
  Target: ATXN1; (-) strand; PAM type: YTN; PAM sequence: TTA
gggagcttcttcaaatatat

SEQ ID NO: 210039 - DNA, 20 bp, Artificial Sequence
  Description of Artificial Sequence: Synthetic oligonucleotide
  Target: ATXN1; (-) strand; PAM type: YTN; PAM sequence: TTG
attagggagcttcttcaaat

SEQ ID NO: 210040 - DNA, 20 bp, Artificial Sequence
  Description of Artificial Sequence: Synthetic oligonucleotide
  Target: ATXN1; (-) strand; PAM type: YTN; PAM sequence: TTG
attgattagggagcttcttc

SEQ ID NO: 210041 - DNA, 20 bp, Artificial Sequence
  Description of Artificial Sequence: Synthetic oligonucleotide
  Target: ATXN1; (-) strand; PAM type: YTN; PAM sequence: TTT
gattgattagggagcttctt

SEQ ID NO: 210042 - DNA, 20 bp, Artificial Sequence
  Description of Artificial Sequence: Synthetic oligonucleotide
  Target: ATXN1; (-) strand; PAM type: YTN; PAM sequence: TTT
tgattgattagggagcttct

SEQ ID NO: 210043 - DNA, 20 bp, Artificial Sequence
  Description of Artificial Sequence: Synthetic oligonucleotide
  Target: ATXN1; (-) strand; PAM type: YTN; PAM sequence: TTT
ttgattgattagggagcttc

SEQ ID NO: 210044 - DNA, 20 bp, Artificial Sequence
  Description of Artificial Sequence: Synthetic oligonucleotide
  Target: ATXN1; (-) strand; PAM type: YTN; PAM sequence: TTA
aatttttgattgattaggga

SEQ ID NO: 210045 - DNA, 20 bp, Artificial Sequence
  Description of Artificial Sequence: Synthetic oligonucleotide
  Target: ATXN1; (-) strand; PAM type: YTN; PAM sequence: TTA
aaattaaatttttgattgat

SEQ ID NO: 210046 - DNA, 20 bp, Artificial Sequence
  Description of Artificial Sequence: Synthetic oligonucleotide
  Target: ATXN1; (-) strand; PAM type: YTN; PAM sequence: TTT
aaaattaaatttttgattga

SEQ ID NO: 210047 - DNA, 20 bp, Artificial Sequence
  Description of Artificial Sequence: Synthetic oligonucleotide
  Target: ATXN1; (-) strand; PAM type: YTN; PAM sequence: TTG
tttaaaattaaatttttgat

SEQ ID NO: 210048 - DNA, 20 bp, Artificial Sequence
  Description of Artificial Sequence: Synthetic oligonucleotide
  Target: ATXN1; (-) strand; PAM type: YTN; PAM sequence: TTA
ttgtttaaaattaaattttt

SEQ ID NO: 210049 - DNA, 20 bp, Artificial Sequence
  Description of Artificial Sequence: Synthetic oligonucleotide
  Target: ATXN1; (-) strand; PAM type: YTN; PAM sequence: TTT
attgtttaaaattaaatttt

SEQ ID NO: 210050 - DNA, 20 bp, Artificial Sequence
  Description of Artificial Sequence: Synthetic oligonucleotide
  Target: ATXN1; (-) strand; PAM type: YTN; PAM sequence: CTT
tattgtttaaaattaaattt

SEQ ID NO: 210051 - DNA, 20 bp, Artificial Sequence
  Description of Artificial Sequence: Synthetic oligonucleotide
  Target: ATXN1; (-) strand; PAM type: YTN; PAM sequence: TTC
tttattgtttaaaattaaat

SEQ ID NO: 210052 - DNA, 20 bp, Artificial Sequence
  Description of Artificial Sequence: Synthetic oligonucleotide
  Target: ATXN1; (-) strand; PAM type: YTN; PAM sequence: TTT
ctttattgtttaaaattaaa

SEQ ID NO: 210053 - DNA, 20 bp, Artificial Sequence
  Description of Artificial Sequence: Synthetic oligonucleotide
  Target: ATXN1; (-) strand; PAM type: YTN; PAM sequence: TTT
tctttattgtttaaaattaa

SEQ ID NO: 210054 - DNA, 20 bp, Artificial Sequence
  Description of Artificial Sequence: Synthetic oligonucleotide
  Target: ATXN1; (-) strand; PAM type: YTN; PAM sequence: CTT
ttctttattgtttaaaatta

SEQ ID NO: 210055 - DNA, 20 bp, Artificial Sequence
  Description of Artificial Sequence: Synthetic oligonucleotide
  Target: ATXN1; (-) strand; PAM type: YTN; PAM sequence: CTA
ccccttttctttattgttta

SEQ ID NO: 210056 - DNA, 20 bp, Artificial Sequence
  Description of Artificial Sequence: Synthetic oligonucleotide
  Target: ATXN1; (-) strand; PAM type: YTN; PAM sequence: TTA
aagcacaactaccccttttc

SEQ ID NO: 210057 - DNA, 20 bp, Artificial Sequence
  Description of Artificial Sequence: Synthetic oligonucleotide
  Target: ATXN1; (-) strand; PAM type: YTN; PAM sequence: TTT
aaagcacaactacccctttt

SEQ ID NO: 210058 - DNA, 20 bp, Artificial Sequence
  Description of Artificial Sequence: Synthetic oligonucleotide
  Target: ATXN1; (-) strand; PAM type: YTN; PAM sequence: TTT
taaagcacaactaccccttt

SEQ ID NO: 210059 - DNA, 20 bp, Artificial Sequence
  Description of Artificial Sequence: Synthetic oligonucleotide
  Target: ATXN1; (-) strand; PAM type: YTN; PAM sequence: CTG
ttttaaagcacaactacccc

SEQ ID NO: 210060 - DNA, 20 bp, Artificial Sequence
  Description of Artificial Sequence: Synthetic oligonucleotide
  Target: ATXN1; (-) strand; PAM type: YTN; PAM sequence: TTG
tgaactgttttaaagcacaa

SEQ ID NO: 210061 - DNA, 20 bp, Artificial Sequence
  Description of Artificial Sequence: Synthetic oligonucleotide
  Target: ATXN1; (-) strand; PAM type: YTN; PAM sequence: CTG
aatccatattgtgaactgtt

SEQ ID NO: 210062 - DNA, 20 bp, Artificial Sequence
  Description of Artificial Sequence: Synthetic oligonucleotide
  Target: ATXN1; (-) strand; PAM type: YTN; PAM sequence: CTG
ggcctgaatccatattgtga

SEQ ID NO: 210063 - DNA, 20 bp, Artificial Sequence
  Description of Artificial Sequence: Synthetic oligonucleotide
  Target: ATXN1; (-) strand; PAM type: YTN; PAM sequence: CTG
tgctgggcctgaatccatat

SEQ ID NO: 210064 - DNA, 20 bp, Artificial Sequence
  Description of Artificial Sequence: Synthetic oligonucleotide
  Target: ATXN1; (-) strand; PAM type: YTN; PAM sequence: TTA
cagggatgagcccctgtgct

SEQ ID NO: 210065 - DNA, 20 bp, Artificial Sequence
  Description of Artificial Sequence: Synthetic oligonucleotide
  Target: ATXN1; (-) strand; PAM type: YTN; PAM sequence: CTG
ggattacagggatgagcccc

SEQ ID NO: 210066 - DNA, 20 bp, Artificial Sequence
  Description of Artificial Sequence: Synthetic oligonucleotide
  Target: ATXN1; (-) strand; PAM type: YTN; PAM sequence: TTC
tgggattacagggatgagcc

SEQ ID NO: 210067 - DNA, 20 bp, Artificial Sequence
  Description of Artificial Sequence: Synthetic oligonucleotide
  Target: ATXN1; (-) strand; PAM type: YTN; PAM sequence: CTC
ccaaagttctgggattacag

SEQ ID NO: 210068 - DNA, 20 bp, Artificial Sequence
  Description of Artificial Sequence: Synthetic oligonucleotide
  Target: ATXN1; (-) strand; PAM type: YTN; PAM sequence: CTC
ggcctcccaaagttctggga

SEQ ID NO: 210069 - DNA, 20 bp, Artificial Sequence
  Description of Artificial Sequence: Synthetic oligonucleotide
  Target: ATXN1; (-) strand; PAM type: YTN; PAM sequence: CTC
ccacctcggcctcccaaagt

SEQ ID NO: 210070 - DNA, 20 bp, Artificial Sequence
  Description of Artificial Sequence: Synthetic oligonucleotide
  Target: ATXN1; (-) strand; PAM type: YTN; PAM sequence: CTC
aagcaatcctcccacctcgg

SEQ ID NO: 210071 - DNA, 20 bp, Artificial Sequence
  Description of Artificial Sequence: Synthetic oligonucleotide
  Target: ATXN1; (-) strand; PAM type: YTN; PAM sequence: TTG
gcctcaagcaatcctcccac

SEQ ID NO: 210072 - DNA, 20 bp, Artificial Sequence
  Description of Artificial Sequence: Synthetic oligonucleotide
  Target: ATXN1; (-) strand; PAM type: YTN; PAM sequence: CTT
ggcctcaagcaatcctccca

SEQ ID NO: 210073 - DNA, 20 bp, Artificial Sequence
  Description of Artificial Sequence: Synthetic oligonucleotide
  Target: ATXN1; (-) strand; PAM type: YTN; PAM sequence: CTC
ttggcctcaagcaatcctcc

SEQ ID NO: 210074 - DNA, 20 bp, Artificial Sequence
  Description of Artificial Sequence: Synthetic oligonucleotide
  Target: ATXN1; (-) strand; PAM type: YTN; PAM sequence: TTA
aactcttggcctcaagcaat

SEQ ID NO: 210075 - DNA, 20 bp, Artificial Sequence
  Description of Artificial Sequence: Synthetic oligonucleotide
  Target: ATXN1; (-) strand; PAM type: YTN; PAM sequence: TTT
aaactcttggcctcaagcaa

SEQ ID NO: 210076 - DNA, 20 bp, Artificial Sequence
  Description of Artificial Sequence: Synthetic oligonucleotide
  Target: ATXN1; (-) strand; PAM type: YTN; PAM sequence: TTT
taaactcttggcctcaagca

SEQ ID NO: 210077 - DNA, 20 bp, Artificial Sequence
  Description of Artificial Sequence: Synthetic oligonucleotide
  Target: ATXN1; (-) strand; PAM type: YTN; PAM sequence: TTG
tcccgggtggttttaaactc

SEQ ID NO: 210078 - DNA, 20 bp, Artificial Sequence
  Description of Artificial Sequence: Synthetic oligonucleotide
  Target: ATXN1; (-) strand; PAM type: YTN; PAM sequence: CTC
gatgtgttgtcccgggtggt

SEQ ID NO: 210079 - DNA, 20 bp, Artificial Sequence
  Description of Artificial Sequence: Synthetic oligonucleotide
  Target: ATXN1; (-) strand; PAM type: YTN; PAM sequence: TTA
tagatgacgtctcgatgtgt

SEQ ID NO: 210080 - DNA, 20 bp, Artificial Sequence
  Description of Artificial Sequence: Synthetic oligonucleotide
  Target: ATXN1; (-) strand; PAM type: YTN; PAM sequence: TTT
atagatgacgtctcgatgtg

SEQ ID NO: 210081 - DNA, 20 bp, Artificial Sequence
  Description of Artificial Sequence: Synthetic oligonucleotide
  Target: ATXN1; (-) strand; PAM type: YTN; PAM sequence: TTT
tatagatgacgtctcgatgt

SEQ ID NO: 210082 - DNA, 20 bp, Artificial Sequence
  Description of Artificial Sequence: Synthetic oligonucleotide
  Target: ATXN1; (-) strand; PAM type: YTN; PAM sequence: TTT
ttatagatgacgtctcgatg

SEQ ID NO: 210083 - DNA, 20 bp, Artificial Sequence
  Description of Artificial Sequence: Synthetic oligonucleotide
  Target: ATXN1; (-) strand; PAM type: YTN; PAM sequence: TTT
tttatagatgacgtctcgat

SEQ ID NO: 210084 - DNA, 20 bp, Artificial Sequence
  Description of Artificial Sequence: Synthetic oligonucleotide
  Target: ATXN1; (-) strand; PAM type: YTN; PAM sequence: TTT
ttttatagatgacgtctcga

SEQ ID NO: 210085 - DNA, 20 bp, Artificial Sequence
  Description of Artificial Sequence: Synthetic oligonucleotide
  Target: ATXN1; (-) strand; PAM type: YTN; PAM sequence: TTT
tttttatagatgacgtctcg

SEQ ID NO: 210086 - DNA, 20 bp, Artificial Sequence
  Description of Artificial Sequence: Synthetic oligonucleotide
  Target: ATXN1; (-) strand; PAM type: YTN; PAM sequence: TTT
ttttttatagatgacgtctc

SEQ ID NO: 210087 - DNA, 20 bp, Artificial Sequence
  Description of Artificial Sequence: Synthetic oligonucleotide
  Target: ATXN1; (-) strand; PAM type: YTN; PAM sequence: TTT
tttttttatagatgacgtct

SEQ ID NO: 210088 - DNA, 20 bp, Artificial Sequence
  Description of Artificial Sequence: Synthetic oligonucleotide
  Target: ATXN1; (-) strand; PAM type: YTN; PAM sequence: TTT
ttttttttatagatgacgtc

SEQ ID NO: 210089 - DNA, 20 bp, Artificial Sequence
  Description of Artificial Sequence: Synthetic oligonucleotide
  Target: ATXN1; (-) strand; PAM type: YTN; PAM sequence: TTT
tttttttttatagatgacgt

SEQ ID NO: 210090 - DNA, 20 bp, Artificial Sequence
  Description of Artificial Sequence: Synthetic oligonucleotide
  Target: ATXN1; (-) strand; PAM type: YTN; PAM sequence: TTT
ttttttttttatagatgacg

SEQ ID NO: 210091 - DNA, 20 bp, Artificial Sequence
  Description of Artificial Sequence: Synthetic oligonucleotide
  Target: ATXN1; (-) strand; PAM type: YTN; PAM sequence: TTT
tttttttttttatagatgac

SEQ ID NO: 210092 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttatagatga

SEQ ID NO: 210093 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttatagatg

SEQ ID NO: 210094 - DNA, 20 bp, Artificial Sequence
  Description of Artificial Sequence: Synthetic oligonucleotide
  Target: ATXN1; (-) strand; PAM type: YTN; PAM sequence: TTT
ttttttttttttttatagat

SEQ ID NO: 210095 - DNA, 20 bp, Artificial Sequence
  Description of Artificial Sequence: Synthetic oligonucleotide
  Target: ATXN1; (-) strand; PAM type: YTN; PAM sequence: TTT
tttttttttttttttataga

SEQ ID NO: 210096 - DNA, 20 bp, Artificial Sequence
  Description of Artificial Sequence: Synthetic oligonucleotide
  Target: ATXN1; (-) strand; PAM type: YTN; PAM sequence: TTA
ttttttttttttttttttat

SEQ ID NO: 210097 - DNA, 20 bp, Artificial Sequence
  Description of Artificial Sequence: Synthetic oligonucleotide
  Target: ATXN1; (-) strand; PAM type: YTN; PAM sequence: TTT
atttttttttttttttttta

SEQ ID NO: 210098 - DNA, 20 bp, Artificial Sequence
  Description of Artificial Sequence: Synthetic oligonucleotide
  Target: ATXN1; (-) strand; PAM type: YTN; PAM sequence: CTT
tatttttttttttttttttt

SEQ ID NO: 210099 - DNA, 20 bp, Artificial Sequence
  Description of Artificial Sequence: Synthetic oligonucleotide
  Target: ATXN1; (-) strand; PAM type: YTN; PAM sequence: CTA
actttatttttttttttttt

SEQ ID NO: 210100 - DNA, 20 bp, Artificial Sequence
  Description of Artificial Sequence: Synthetic oligonucleotide
  Target: ATXN1; (-) strand; PAM type: YTN; PAM sequence: CTG
gctaactttatttttttttt

SEQ ID NO: 210101 - DNA, 20 bp, Artificial Sequence
  Description of Artificial Sequence: Synthetic oligonucleotide
  Target: ATXN1; (-) strand; PAM type: YTN; PAM sequence: CTA
caggcacacagccccacgcc

SEQ ID NO: 210102 - DNA, 20 bp, Artificial Sequence
  Description of Artificial Sequence: Synthetic oligonucleotide
  Target: ATXN1; (-) strand; PAM type: YTN; PAM sequence: CTG
ggactacaggcacacagccc

SEQ ID NO: 210103 - DNA, 20 bp, Artificial Sequence
  Description of Artificial Sequence: Synthetic oligonucleotide
  Target: ATXN1; (-) strand; PAM type: YTN; PAM sequence: CTA
agtagctgggactacaggca

SEQ ID NO: 210104 - DNA, 20 bp, Artificial Sequence
  Description of Artificial Sequence: Synthetic oligonucleotide
  Target: ATXN1; (-) strand; PAM type: YTN; PAM sequence: CTC
ctaagtagctgggactacag

SEQ ID NO: 210105 - DNA, 20 bp, Artificial Sequence
  Description of Artificial Sequence: Synthetic oligonucleotide
  Target: ATXN1; (-) strand; PAM type: YTN; PAM sequence: CTC
agcctcctaagtagctggga

SEQ ID NO: 210106 - DNA, 20 bp, Artificial Sequence
  Description of Artificial Sequence: Synthetic oligonucleotide
  Target: ATXN1; (-) strand; PAM type: YTN; PAM sequence: CTA
aaggatcccccacctcagcc

SEQ ID NO: 210107 - DNA, 20 bp, Artificial Sequence
  Description of Artificial Sequence: Synthetic oligonucleotide
  Target: ATXN1; (-) strand; PAM type: YTN; PAM sequence: CTC
taaaggatcccccacctcag

SEQ ID NO: 210108 - DNA, 20 bp, Artificial Sequence
  Description of Artificial Sequence: Synthetic oligonucleotide
  Target: ATXN1; (-) strand; PAM type: YTN; PAM sequence: CTG
gctctaaaggatcccccacc

SEQ ID NO: 210109 - DNA, 20 bp, Artificial Sequence
  Description of Artificial Sequence: Synthetic oligonucleotide
  Target: ATXN1; (-) strand; PAM type: YTN; PAM sequence: CTC
ctggctctaaaggatccccc

SEQ ID NO: 210110 - DNA, 20 bp, Artificial Sequence
  Description of Artificial Sequence: Synthetic oligonucleotide
  Target: ATXN1; (-) strand; PAM type: YTN; PAM sequence: TTG
acctcctggctctaaaggat

SEQ ID NO: 210111 - DNA, 20 bp, Artificial Sequence
  Description of Artificial Sequence: Synthetic oligonucleotide
  Target: ATXN1; (-) strand; PAM type: YTN; PAM sequence: CTT
gacctcctggctctaaagga

SEQ ID NO: 210112 - DNA, 20 bp, Artificial Sequence
  Description of Artificial Sequence: Synthetic oligonucleotide
  Target: ATXN1; (-) strand; PAM type: YTN; PAM sequence: CTG
cagccttgacctcctggctc

SEQ ID NO: 210113 - DNA, 20 bp, Artificial Sequence
  Description of Artificial Sequence: Synthetic oligonucleotide
  Target: ATXN1; (-) strand; PAM type: YTN; PAM sequence: CTC
gctgcagccttgacctcctg

SEQ ID NO: 210114 - DNA, 20 bp, Artificial Sequence
  Description of Artificial Sequence: Synthetic oligonucleotide
  Target: ATXN1; (-) strand; PAM type: YTN; PAM sequence: CTG
gtgggatcataactcgctgc

SEQ ID NO: 210115 - DNA, 20 bp, Artificial Sequence
  Description of Artificial Sequence: Synthetic oligonucleotide
  Target: ATXN1; (-) strand; PAM type: YTN; PAM sequence: CTG
gagtgcactggtgggatcat

SEQ ID NO: 210116 - DNA, 20 bp, Artificial Sequence
  Description of Artificial Sequence: Synthetic oligonucleotide
  Target: ATXN1; (-) strand; PAM type: YTN; PAM sequence: CTG
tggtgcagcctggagtgcac

SEQ ID NO: 210117 - DNA, 20 bp, Artificial Sequence
  Description of Artificial Sequence: Synthetic oligonucleotide
  Target: ATXN1; (-) strand; PAM type: YTN; PAM sequence: CTC
tgtggtgcagcctggagtgc

SEQ ID NO: 210118 - DNA, 20 bp, Artificial Sequence
  Description of Artificial Sequence: Synthetic oligonucleotide
  Target: ATXN1; (-) strand; PAM type: YTN; PAM sequence: TTG
ctctgtggtgcagcctggag

SEQ ID NO: 210119 - DNA, 20 bp, Artificial Sequence
  Description of Artificial Sequence: Synthetic oligonucleotide
  Target: ATXN1; (-) strand; PAM type: YTN; PAM sequence: CTT
gctctgtggtgcagcctgga

SEQ ID NO: 210120 - DNA, 20 bp, Artificial Sequence
  Description of Artificial Sequence: Synthetic oligonucleotide
  Target: ATXN1; (-) strand; PAM type: YTN; PAM sequence: CTA
gagacagggtcttgctctgt

SEQ ID NO: 210121 - DNA, 20 bp, Artificial Sequence
  Description of Artificial Sequence: Synthetic oligonucleotide
  Target: ATXN1; (-) strand; PAM type: YTN; PAM sequence: CTC
tagagacagggtcttgctct

SEQ ID NO: 210122 - DNA, 20 bp, Artificial Sequence
  Description of Artificial Sequence: Synthetic oligonucleotide
  Target: ATXN1; (-) strand; PAM type: YTN; PAM sequence: TTC
tctagagacagggtcttgct

SEQ ID NO: 210123 - DNA, 20 bp, Artificial Sequence
  Description of Artificial Sequence: Synthetic oligonucleotide
  Target: ATXN1; (-) strand; PAM type: YTN; PAM sequence: TTT
ctctagagacagggtcttgc

SEQ ID NO: 210124 - DNA, 20 bp, Artificial Sequence
  Description of Artificial Sequence: Synthetic oligonucleotide
  Target: ATXN1; (-) strand; PAM type: YTN; PAM sequence: TTT
tctctagagacagggtcttg

SEQ ID NO: 210125 - DNA, 20 bp, Artificial Sequence
  Description of Artificial Sequence: Synthetic oligonucleotide
  Target: ATXN1; (-) strand; PAM type: YTN; PAM sequence: TTT
ttctctagagacagggtctt

SEQ ID NO: 210126 - DNA, 20 bp, Artificial Sequence
  Description of Artificial Sequence: Synthetic oligonucleotide
  Target: ATXN1; (-) strand; PAM type: YTN; PAM sequence: TTA
tatgtgtatatatttttctc

SEQ ID NO: 210127 - DNA, 20 bp, Artificial Sequence
  Description of Artificial Sequence: Synthetic oligonucleotide
  Target: ATXN1; (-) strand; PAM type: YTN; PAM sequence: CTT
atatgtgtatatatttttct

SEQ ID NO: 210128 - DNA, 20 bp, Artificial Sequence
  Description of Artificial Sequence: Synthetic oligonucleotide
  Target: ATXN1; (-) strand; PAM type: YTN; PAM sequence: CTC
cttatatgtgtatatatttt

SEQ ID NO: 210129 - DNA, 20 bp, Artificial Sequence
  Description of Artificial Sequence: Synthetic oligonucleotide
  Target: ATXN1; (-) strand; PAM type: YTN; PAM sequence: CTC
tccttatatgtgtatatatt

SEQ ID NO: 210130 - DNA, 20 bp, Artificial Sequence
  Description of Artificial Sequence: Synthetic oligonucleotide
  Target: ATXN1; (-) strand; PAM type: YTN; PAM sequence: TTA
tatgctctccttatatgtgt

SEQ ID NO: 210131 - DNA, 20 bp, Artificial Sequence
  Description of Artificial Sequence: Synthetic oligonucleotide
  Target: ATXN1; (-) strand; PAM type: YTN; PAM sequence: TTG
ttatatgctctccttatatg

SEQ ID NO: 210132 - DNA, 20 bp, Artificial Sequence
  Description of Artificial Sequence: Synthetic oligonucleotide
  Target: ATXN1; (-) strand; PAM type: YTN; PAM sequence: TTT
gttatatgctctccttatat

SEQ ID NO: 210133 - DNA, 20 bp, Artificial Sequence
  Description of Artificial Sequence: Synthetic oligonucleotide
  Target: ATXN1; (-) strand; PAM type: YTN; PAM sequence: TTG
tttgttatatgctctcctta

SEQ ID NO: 210134 - DNA, 20 bp, Artificial Sequence
  Description of Artificial Sequence: Synthetic oligonucleotide
  Target: ATXN1; (-) strand; PAM type: YTN; PAM sequence: TTC
agttgtttgttatatgctct

SEQ ID NO: 210135 - DNA, 20 bp, Artificial Sequence
  Description of Artificial Sequence: Synthetic oligonucleotide
  Target: ATXN1; (-) strand; PAM type: YTN; PAM sequence: TTA
taacgatattcagttgtttg

SEQ ID NO: 210136 - DNA, 20 bp, Artificial Sequence
  Description of Artificial Sequence: Synthetic oligonucleotide
  Target: ATXN1; (-) strand; PAM type: YTN; PAM sequence: TTT
ataacgatattcagttgttt

SEQ ID NO: 210137 - DNA, 20 bp, Artificial Sequence
  Description of Artificial Sequence: Synthetic oligonucleotide
  Target: ATXN1; (-) strand; PAM type: YTN; PAM sequence: TTT
tataacgatattcagttgtt

SEQ ID NO: 210138 - DNA, 20 bp, Artificial Sequence
  Description of Artificial Sequence: Synthetic oligonucleotide
  Target: ATXN1; (-) strand; PAM type: YTN; PAM sequence: TTT
ttataacgatattcagttgt

SEQ ID NO: 210139 - DNA, 20 bp, Artificial Sequence
  Description of Artificial Sequence: Synthetic oligonucleotide
  Target: ATXN1; (-) strand; PAM type: YTN; PAM sequence: CTT
tttataacgatattcagttg

SEQ ID NO: 210140 - DNA, 20 bp, Artificial Sequence
  Description of Artificial Sequence: Synthetic oligonucleotide
  Target: ATXN1; (-) strand; PAM type: YTN; PAM sequence: TTC
ctttttataacgatattcag

SEQ ID NO: 210141 - DNA, 20 bp, Artificial Sequence
  Description of Artificial Sequence: Synthetic oligonucleotide
  Target: ATXN1; (-) strand; PAM type: YTN; PAM sequence: CTG
tgttcctttttataacgata

SEQ ID NO: 210142 - DNA, 20 bp, Artificial Sequence
  Description of Artificial Sequence: Synthetic oligonucleotide
  Target: ATXN1; (-) strand; PAM type: YTN; PAM sequence: CTA
tatctgtgttcctttttata

SEQ ID NO: 210143 - DNA, 20 bp, Artificial Sequence
  Description of Artificial Sequence: Synthetic oligonucleotide
  Target: ATXN1; (-) strand; PAM type: YTN; PAM sequence: TTA
tctatatctgtgttcctttt

SEQ ID NO: 210144 - DNA, 20 bp, Artificial Sequence
  Description of Artificial Sequence: Synthetic oligonucleotide
  Target: ATXN1; (-) strand; PAM type: YTN; PAM sequence: TTA
ataaggattatctatatctg

SEQ ID NO: 210145 - DNA, 20 bp, Artificial Sequence
  Description of Artificial Sequence: Synthetic oligonucleotide
  Target: ATXN1; (-) strand; PAM type: YTN; PAM sequence: CTT
aataaggattatctatatct

SEQ ID NO: 210146 - DNA, 20 bp, Artificial Sequence
  Description of Artificial Sequence: Synthetic oligonucleotide
  Target: ATXN1; (-) strand; PAM type: YTN; PAM sequence: TTC
ttaataaggattatctatat

SEQ ID NO: 210147 - DNA, 20 bp, Artificial Sequence
  Description of Artificial Sequence: Synthetic oligonucleotide
  Target: ATXN1; (-) strand; PAM type: YTN; PAM sequence: TTT
cttaataaggattatctata

SEQ ID NO: 210148 - DNA, 20 bp, Artificial Sequence
  Description of Artificial Sequence: Synthetic oligonucleotide
  Target: ATXN1; (-) strand; PAM type: YTN; PAM sequence: TTT
tcttaataaggattatctat

SEQ ID NO: 210149 - DNA, 20 bp, Artificial Sequence
  Description of Artificial Sequence: Synthetic oligonucleotide
  Target: ATXN1; (-) strand; PAM type: YTN; PAM sequence: CTT
ttcttaataaggattatcta

SEQ ID NO: 210150 - DNA, 20 bp, Artificial Sequence
  Description of Artificial Sequence: Synthetic oligonucleotide
  Target: ATXN1; (-) strand; PAM type: YTN; PAM sequence: TTA
tgtaacttttcttaataagg

SEQ ID NO: 210151 - DNA, 20 bp, Artificial Sequence
  Description of Artificial Sequence: Synthetic oligonucleotide
  Target: ATXN1; (-) strand; PAM type: YTN; PAM sequence: TTA
aatattatgtaacttttctt

SEQ ID NO: 210152 - DNA, 20 bp, Artificial Sequence
  Description of Artificial Sequence: Synthetic oligonucleotide
  Target: ATXN1; (-) strand; PAM type: YTN; PAM sequence: TTT
aaatattatgtaacttttct

SEQ ID NO: 210153 - DNA, 20 bp, Artificial Sequence
  Description of Artificial Sequence: Synthetic oligonucleotide
  Target: ATXN1; (-) strand; PAM type: YTN; PAM sequence: TTT
taaatattatgtaacttttc

SEQ ID NO: 210154 - DNA, 20 bp, Artificial Sequence
  Description of Artificial Sequence: Synthetic oligonucleotide
  Target: ATXN1; (-) strand; PAM type: YTN; PAM sequence: CTT
ttaaatattatgtaactttt

SEQ ID NO: 210155 - DNA, 20 bp, Artificial Sequence
  Description of Artificial Sequence: Synthetic oligonucleotide
  Target: ATXN1; (-) strand; PAM type: YTN; PAM sequence: TTA
cttttaaatattatgtaact

SEQ ID NO: 210156 - DNA, 20 bp, Artificial Sequence
  Description of Artificial Sequence: Synthetic oligonucleotide
  Target: ATXN1; (-) strand; PAM type: YTN; PAM sequence: TTA
tgattacttttaaatattat

SEQ ID NO: 210157 - DNA, 20 bp, Artificial Sequence
  Description of Artificial Sequence: Synthetic oligonucleotide
  Target: ATXN1; (-) strand; PAM type: YTN; PAM sequence: TTT
atgattacttttaaatatta

SEQ ID NO: 210158 - DNA, 20 bp, Artificial Sequence
  Description of Artificial Sequence: Synthetic oligonucleotide
  Target: ATXN1; (-) strand; PAM type: YTN; PAM sequence: TTG
atccagtttatgattacttt

SEQ ID NO: 210159 - DNA, 20 bp, Artificial Sequence
  Description of Artificial Sequence: Synthetic oligonucleotide
  Target: ATXN1; (-) strand; PAM type: YTN; PAM sequence: TTT
gatccagtttatgattactt

SEQ ID NO: 210160 - DNA, 20 bp, Artificial Sequence
  Description of Artificial Sequence: Synthetic oligonucleotide
  Target: ATXN1; (-) strand; PAM type: YTN; PAM sequence: TTT
tgatccagtttatgattact

SEQ ID NO: 210161 - DNA, 20 bp, Artificial Sequence
  Description of Artificial Sequence: Synthetic oligonucleotide
  Target: ATXN1; (-) strand; PAM type: YTN; PAM sequence: TTA
gatatagacatatagatgtt

SEQ ID NO: 210162 - DNA, 20 bp, Artificial Sequence
  Description of Artificial Sequence: Synthetic oligonucleotide
  Target: ATXN1; (-) strand; PAM type: YTN; PAM sequence: TTA
aagttagatatagacatata

SEQ ID NO: 210163 - DNA, 20 bp, Artificial Sequence
  Description of Artificial Sequence: Synthetic oligonucleotide
  Target: ATXN1; (-) strand; PAM type: YTN; PAM sequence: TTT
aaagttagatatagacatat

SEQ ID NO: 210164 - DNA, 20 bp, Artificial Sequence
  Description of Artificial Sequence: Synthetic oligonucleotide
  Target: ATXN1; (-) strand; PAM type: YTN; PAM sequence: TTT
taaagttagatatagacata

SEQ ID NO: 210165 - DNA, 20 bp, Artificial Sequence
  Description of Artificial Sequence: Synthetic oligonucleotide
  Target: ATXN1; (-) strand; PAM type: YTN; PAM sequence: TTT
ttaaagttagatatagacat

SEQ ID NO: 210166 - DNA, 20 bp, Artificial Sequence
  Description of Artificial Sequence: Synthetic oligonucleotide
  Target: ATXN1; (-) strand; PAM type: YTN; PAM sequence: TTT
tttaaagttagatatagaca

SEQ ID NO: 210167 - DNA, 20 bp, Artificial Sequence
  Description of Artificial Sequence: Synthetic oligonucleotide
  Target: ATXN1; (-) strand; PAM type: YTN; PAM sequence: CTT
ttttaaagttagatatagac

SEQ ID NO: 210168 - DNA, 20 bp, Artificial Sequence
  Description of Artificial Sequence: Synthetic oligonucleotide
  Target: ATXN1; (-) strand; PAM type: YTN; PAM sequence: TTC
ttttttaaagttagatatag

SEQ ID NO: 210169 - DNA, 20 bp, Artificial Sequence
  Description of Artificial Sequence: Synthetic oligonucleotide
  Target: ATXN1; (-) strand; PAM type: YTN; PAM sequence: TTT
cttttttaaagttagatata

SEQ ID NO: 210170 - DNA, 20 bp, Artificial Sequence
  Description of Artificial Sequence: Synthetic oligonucleotide
  Target: ATXN1; (-) strand; PAM type: YTN; PAM sequence: TTT
tcttttttaaagttagatat

SEQ ID NO: 210171 - DNA, 20 bp, Artificial Sequence
  Description of Artificial Sequence: Synthetic oligonucleotide
  Target: ATXN1; (-) strand; PAM type: YTN; PAM sequence: CTT
ttcttttttaaagttagata

SEQ ID NO: 210172 - DNA, 20 bp, Artificial Sequence
  Description of Artificial Sequence: Synthetic oligonucleotide
  Target: ATXN1; (-) strand; PAM type: YTN; PAM sequence: CTC
cttttcttttttaaagttag

SEQ ID NO: 210173 - DNA, 20 bp, Artificial Sequence
  Description of Artificial Sequence: Synthetic oligonucleotide
  Target: ATXN1; (-) strand; PAM type: YTN; PAM sequence: TTC
tccttttcttttttaaagtt

SEQ ID NO: 210174 - DNA, 20 bp, Artificial Sequence
  Description of Artificial Sequence: Synthetic oligonucleotide
  Target: ATXN1; (-) strand; PAM type: YTN; PAM sequence: TTG
gaattctccttttctttttt

SEQ ID NO: 210175 - DNA, 20 bp, Artificial Sequence
  Description of Artificial Sequence: Synthetic oligonucleotide
  Target: ATXN1; (-) strand; PAM type: YTN; PAM sequence: TTT
ggaattctccttttcttttt

SEQ ID NO: 210176 - DNA, 20 bp, Artificial Sequence
  Description of Artificial Sequence: Synthetic oligonucleotide
  Target: ATXN1; (-) strand; PAM type: YTN; PAM sequence: CTT
tggaattctccttttctttt

SEQ ID NO: 210177 - DNA, 20 bp, Artificial Sequence
  Description of Artificial Sequence: Synthetic oligonucleotide
  Target: ATXN1; (-) strand; PAM type: YTN; PAM sequence: CTC
ctttggaattctccttttct

SEQ ID NO: 210178 - DNA, 20 bp, Artificial Sequence
  Description of Artificial Sequence: Synthetic oligonucleotide
  Target: ATXN1; (-) strand; PAM type: YTN; PAM sequence: TTC
tcctttggaattctcctttt

SEQ ID NO: 210179 - DNA, 20 bp, Artificial Sequence
  Description of Artificial Sequence: Synthetic oligonucleotide
  Target: ATXN1; (-) strand; PAM type: YTN; PAM sequence: TTA
ttctcctttggaattctcct

SEQ ID NO: 210180 - DNA, 20 bp, Artificial Sequence
  Description of Artificial Sequence: Synthetic oligonucleotide
  Target: ATXN1; (-) strand; PAM type: YTN; PAM sequence: TTT
attctcctttggaattctcc

SEQ ID NO: 210181 - DNA, 20 bp, Artificial Sequence
  Description of Artificial Sequence: Synthetic oligonucleotide
  Target: ATXN1; (-) strand; PAM type: YTN; PAM sequence: TTT
tattctcctttggaattctc

SEQ ID NO: 210182 - DNA, 20 bp, Artificial Sequence
  Description of Artificial Sequence: Synthetic oligonucleotide
  Target: ATXN1; (-) strand; PAM type: YTN; PAM sequence: TTA
acacattttattctcctttg

SEQ ID NO: 210183 - DNA, 20 bp, Artificial Sequence
  Description of Artificial Sequence: Synthetic oligonucleotide
  Target: ATXN1; (-) strand; PAM type: YTN; PAM sequence: CTG
tataagataagattaacaca

SEQ ID NO: 210184 - DNA, 20 bp, Artificial Sequence
  Description of Artificial Sequence: Synthetic oligonucleotide
  Target: ATXN1; (-) strand; PAM type: YTN; PAM sequence: CTC
cctgtataagataagattaa

SEQ ID NO: 210185 - DNA, 20 bp, Artificial Sequence
  Description of Artificial Sequence: Synthetic oligonucleotide
  Target: ATXN1; (-) strand; PAM type: YTN; PAM sequence: CTC
ctccctgtataagataagat

SEQ ID NO: 210186 - DNA, 20 bp, Artificial Sequence
  Description of Artificial Sequence: Synthetic oligonucleotide
  Target: ATXN1; (-) strand; PAM type: YTN; PAM sequence: CTG
accatacctcctccctgtat

SEQ ID NO: 210187 - DNA, 20 bp, Artificial Sequence
  Description of Artificial Sequence: Synthetic oligonucleotide
  Target: ATXN1; (-) strand; PAM type: YTN; PAM sequence: CTG
gctgaccatacctcctccct

SEQ ID NO: 210188 - DNA, 20 bp, Artificial Sequence
  Description of Artificial Sequence: Synthetic oligonucleotide
  Target: ATXN1; (-) strand; PAM type: YTN; PAM sequence: CTG
tatgagcaaagtgaggaagc

SEQ ID NO: 210189 - DNA, 20 bp, Artificial Sequence
  Description of Artificial Sequence: Synthetic oligonucleotide
  Target: ATXN1; (-) strand; PAM type: YTN; PAM sequence: TTC
tgtatgagcaaagtgaggaa

SEQ ID NO: 210190 - DNA, 20 bp, Artificial Sequence
  Description of Artificial Sequence: Synthetic oligonucleotide
  Target: ATXN1; (-) strand; PAM type: YTN; PAM sequence: TTT
ctgtatgagcaaagtgagga

SEQ ID NO: 210191 - DNA, 20 bp, Artificial Sequence
  Description of Artificial Sequence: Synthetic oligonucleotide
  Target: ATXN1; (-) strand; PAM type: YTN; PAM sequence: CTA
tatttctgtatgagcaaagt

SEQ ID NO: 210192 - DNA, 20 bp, Artificial Sequence
  Description of Artificial Sequence: Synthetic oligonucleotide
  Target: ATXN1; (-) strand; PAM type: YTN; PAM sequence: CTA
aatatgacctatatttctgt

SEQ ID NO: 210193 - DNA, 20 bp, Artificial Sequence
  Description of Artificial Sequence: Synthetic oligonucleotide
  Target: ATXN1; (-) strand; PAM type: YTN; PAM sequence: TTG
actaaatatgacctatattt

SEQ ID NO: 210194 - DNA, 20 bp, Artificial Sequence
  Description of Artificial Sequence: Synthetic oligonucleotide
  Target: ATXN1; (-) strand; PAM type: YTN; PAM sequence: TTT
gactaaatatgacctatatt

SEQ ID NO: 210195 - DNA, 20 bp, Artificial Sequence
  Description of Artificial Sequence: Synthetic oligonucleotide
  Target: ATXN1; (-) strand; PAM type: YTN; PAM sequence: TTA
aatttgactaaatatgacct

SEQ ID NO: 210196 - DNA, 20 bp, Artificial Sequence
  Description of Artificial Sequence: Synthetic oligonucleotide
  Target: ATXN1; (-) strand; PAM type: YTN; PAM sequence: CTT
aaatttgactaaatatgacc

SEQ ID NO: 210197 - DNA, 20 bp, Artificial Sequence
  Description of Artificial Sequence: Synthetic oligonucleotide
  Target: ATXN1; (-) strand; PAM type: YTN; PAM sequence: TTC
ttaaatttgactaaatatga

SEQ ID NO: 210198 - DNA, 20 bp, Artificial Sequence
  Description of Artificial Sequence: Synthetic oligonucleotide
  Target: ATXN1; (-) strand; PAM type: YTN; PAM sequence: CTT
cttaaatttgactaaatatg

SEQ ID NO: 210199 - DNA, 20 bp, Artificial Sequence
  Description of Artificial Sequence: Synthetic oligonucleotide
  Target: ATXN1; (-) strand; PAM type: YTN; PAM sequence: TTG
tcttcttaaatttgactaaa

SEQ ID NO: 210200 - DNA, 20 bp, Artificial Sequence
  Description of Artificial Sequence: Synthetic oligonucleotide
  Target: ATXN1; (-) strand; PAM type: YTN; PAM sequence: CTA
gttgtcttcttaaatttgac

SEQ ID NO: 210201 - DNA, 20 bp, Artificial Sequence
  Description of Artificial Sequence: Synthetic oligonucleotide
  Target: ATXN1; (-) strand; PAM type: YTN; PAM sequence: TTC
tagttgtcttcttaaatttg

SEQ ID NO: 210202 - DNA, 20 bp, Artificial Sequence
  Description of Artificial Sequence: Synthetic oligonucleotide
  Target: ATXN1; (-) strand; PAM type: YTN; PAM sequence: CTT
ctagttgtcttcttaaattt

SEQ ID NO: 210203 - DNA, 20 bp, Artificial Sequence
  Description of Artificial Sequence: Synthetic oligonucleotide
  Target: ATXN1; (-) strand; PAM type: YTN; PAM sequence: TTA
atcttctagttgtcttctta

SEQ ID NO: 210204 - DNA, 20 bp, Artificial Sequence
  Description of Artificial Sequence: Synthetic oligonucleotide
  Target: ATXN1; (-) strand; PAM type: YTN; PAM sequence: TTT
aatcttctagttgtcttctt

SEQ ID NO: 210205 - DNA, 20 bp, Artificial Sequence
  Description of Artificial Sequence: Synthetic oligonucleotide
  Target: ATXN1; (-) strand; PAM type: YTN; PAM sequence: TTA
tatttaatcttctagttgtc

SEQ ID NO: 210206 - DNA, 20 bp, Artificial Sequence
  Description of Artificial Sequence: Synthetic oligonucleotide
  Target: ATXN1; (-) strand; PAM type: YTN; PAM sequence: CTT
atatttaatcttctagttgt

SEQ ID NO: 210207 - DNA, 20 bp, Artificial Sequence
  Description of Artificial Sequence: Synthetic oligonucleotide
  Target: ATXN1; (-) strand; PAM type: YTN; PAM sequence: CTC
ataccttatatttaatcttc

SEQ ID NO: 210208 - DNA, 20 bp, Artificial Sequence
  Description of Artificial Sequence: Synthetic oligonucleotide
  Target: ATXN1; (-) strand; PAM type: YTN; PAM sequence: CTG
taatactcataccttatatt

SEQ ID NO: 210209 - DNA, 20 bp, Artificial Sequence
  Description of Artificial Sequence: Synthetic oligonucleotide
  Target: ATXN1; (-) strand; PAM type: YTN; PAM sequence: CTG
tctgtaatactcatacctta

SEQ ID NO: 210210 - DNA, 20 bp, Artificial Sequence
  Description of Artificial Sequence: Synthetic oligonucleotide
  Target: ATXN1; (-) strand; PAM type: YTN; PAM sequence: TTA
ctgtctgtaatactcatacc
